United States Patent 8,299,318 (NUCLEOTIDE SEQUENCES AND CORRESPONDING POLYPEPTIDES CONFERRING MODULATED PLANT CHARACTERISTICS) - sequence listing, part 4

SEQ ID NO: 7383 - DNA, 1722 bp, Panicum virgatum
  misc_feature: Ceres CLONE 1908991
  misc_feature: Encodes the peptide sequence at SEQ ID NO. 7384
atcaagcgctcgctgcctacctccaccctctcacccacatggattcctccgccggcggcggcgggggcggccgcggcgagccggcccgatggctggagattgccgggaagctcctcgccgcgcgggacctggtcggctgcaagcgcctggcggagcgcgcggtggaggcggacccgaacctcccgggtgccgacgagctcctcgccgtcgccgacgtcctcctcgcctcccagcgccagctcccctccggccgccccgatccggtcgccgtgctccagcttcagcccggccccgaccccgccgcggtcaagcgcgccttcggccgcctctcccagctcgtgtccgccccgcgtaacccccgtcccgccgcggacaccgccctccacttcgtccaacaagccttcgctgatctctccaagaacgcctccagcgatacggctcctgctgctgcttctactcctgcttcagggggtgcctcggcagccgctgccgatgccgatgcgttctggacgtcgtgcccctactgctgccacgtctaccagtaccagcgcgcgctggtggggcgcgcgctcaggtgccagagcgccggatgccggcgcgcgttcgtggccaccgagatcccgaccgtgccgcctattgtgccgggcaccgacatgtactactgcgcgtgggggtttttccccatgggctttcctaaggcagctgatttgagcaccaactggaagccattttgccccatgtatcctgggaatcttcaagctccaccgcagtcagcatctgcagggactgccaatgtcgatcccatgaatgttcaatctccacagcagccagcatctgcaggaactgccaatattgatcccaggaattttcaatctccgctgcagacaggaactgctgggactgccaatgttgattccaggaattttcaatctacgccacagccagcatctgcaggggttgccaatattgatgtaccaaatattgagaataatggcataccttttaatgccaattcaacacctgcaaatgtgcagccagcaaataagagtggtgtccgtggcagtccagcagggccatctagaggtaggacgaagaagacaacagcacgcaagaaggttggtaccgtgtttaagaagcacgcttccagtgggttggaaagtggcattgagccatctatgcttgggtcggattcatggaatgggaatgcaggtagtggcagtgcgcagacagcgggtactagagagatcaacataaatgaggtggcaaagccaactgatggcgccacaatgctaaattttggtggggatgaggacattgggtttgatttggatgttgatgcaacggatgccatattgggaaatttacagcacctgccattcttgagggaggatgacaataccagaaggatgttttagttgtcgatgtgctcagtgtaggtattcgtagatttggtgtatatcgtgctgttgaaggaaatcctgcataggccgatccttcaatgctgcccttctgtcattccaactatttcttatatttattctgtgttccgtagttatctaccttggttcagctagctggtgatcacttgtagcatctggatcagtactctttacaaatctatagactagattatcccaaattagttgggggatgtgtaatatttgctacctgcagattgacttaaggatgtaactggtcgagcaaaaaaaaaaaaaaaaaaaa

SEQ ID NO: 7384 - protein, 458 aa, Panicum virgatum
  misc_feature: Ceres CLONE 1908991
  misc_feature (1)..(56): Pfam Name: DnaJ Pfam Description: DnaJ domain
MDSSAGGGGGGRGEPARWLEIAGKLLAARDLVGCKRLAERAVEADPNLPGADELLAVADVLLASQRQLPSGRPDPVAVLQLQPGPDPAAVKRAFGRLSQLVSAPRNPRPAADTALHFVQQAFADLSKNASSDTAPAAASTPASGGASAAAADADAFWTSCPYCCHVYQYQRALVGRALRCQSAGCRRAFVATEIPTVPPIVPGTDMYYCAWGFFPMGFPKAADLSTNWKPFCPMYPGNLQAPPQSASAGTANVDPMNVQSPQQPASAGTANIDPRNFQSPLQTGTAGTANVDSRNFQSTPQPASAGVANIDVPNIENNGIPFNANSTPANVQPANKSGVRGSPAGPSRGRTKKTTARKKVGTVFKKHASSGLESGIEPSMLGSDSWNGNAGSGSAQTAGTREININEVAKPTDGATMLNFGGDEDIGFDLDVDATDAILGNLQHLPFLREDDNTRRMF

SEQ ID NO: 7385 - DNA, 1321 bp, Panicum virgatum
  misc_feature: Ceres CLONE 1909004
  misc_feature: Encodes the peptide sequence at SEQ ID NO. 7386
aatttcctccgcttccgctccctttctccaccaaatgaacccccgaaaagcaggataggcgagccccggaggaggtaggctagggttaggttcaccgctcccccgtcgcctgggcgagtggcgagatggccgcccctggccccgctggcgccgccgcctcaccgtcgccgctgccgccacagctgccgtcgccgttcgcggagctcgtcaagagcccctccggcctcgagaaggtctatctttatggaggtcaagtaacatcatggaagaatgacaacggggaagagttgctttttctcagcagcaaggctattttcaaacctccaaaagccattcgtggtggtatacccatctgctttccccaatttggaactcatggaaatcttgagcagcatgggttcgcaaggaaccggttttggaccattgacaatgacccacctcctttaccagcaaaccctgctattaaagcttatgttgatctgattctaaggccttctgaagaagatttaaagatctggcctcatagttttgagttccgcttgagagttgctcttggaccttctggagatttgagtctcacctctcgaatcaggaataccaacactgatggaagacctttctcttacacatttgcatatcacacatacttctctgtctctgacataagtgaggtgcgtgttgaagggctggaaacaatggactaccttgacaacttgaaggcaaaggagcgtttcacagagcaaggagatgctattgtttttgaatcggaggttgataaagtttatcttgctgcaccctcaaaaattgcaataattgatcatgagaagaaaaaaacatttgttgtgacaaaagaagggcttccagatgctgttgtttggaacccctgggacaagaaggctaaagctatgcaagattttggggatggagaatacaagaacatgttgtgtgtggaacctgcagctgttgagaagcctattactctgaagcctggtgaagagtggaaaggaagacttgccctctcagctgtcccttccagttactgtagcggacaattggatccattgaaggtgcttcagtgctgagaaacctcattttctgcgtcttgtacaggagaacttcattgcccttcttatttgatgctgggctggcgtcaacgccgcttcgtccttttgccattttcatcccccatatttctgtcctttttttgtatctagaatttgagttgtaggttacttctgaataacagactctaccagctgctttgagcttataatgggatctctcctcgacggtgaatgatatcggtggacacaatactggc

SEQ ID NO: 7386 - protein, 318 aa, Panicum virgatum
  misc_feature: Ceres CLONE 1909004
  misc_feature (14)..(277): Pfam Name: Aldose_epim Pfam Description: Aldose 1-epimerase
  misc_feature (4)..(277): Pfam Name: Aldose_epim Pfam Description: Aldose 1-epimerase
MAAPGPAGAAASPSPLPPQLPSPFAELVKSPSGLEKVYLYGGQVTSWKNDNGEELLFLSSKAIFKPPKAIRGGIPICFPQFGTHGNLEQHGFARNRFWTIDNDPPPLPANPAIKAYVDLILRPSEEDLKIWPHSFEFRLRVALGPSGDLSLTSRIRNTNTDGRPFSYTFAYHTYFSVSDISEVRVEGLETMDYLDNLKAKERFTEQGDAIVFESEVDKVYLAAPSKIAIIDHEKKKTFVVTKEGLPDAVVWNPWDKKAKAMQDFGDGEYKNMLCVEPAAVEKPITLKPGEEWKGRLALSAVPSSYCSGQLDPLKVLQC

SEQ ID NO: 7387 - DNA, 1266 bp, Panicum virgatum
  misc_feature: Ceres CLONE 1909038
  misc_feature: Encodes the peptide sequence at SEQ ID NO. 7388
cgctggcctgctgctgcggagctgcccgcccgccccgaagcttctcgcctctcccccttcccgtccgtctggaattccaccccaccaccaccctctactcgctcgcaagcagcttgagcacaagaccccattcccttccttcgaggatcggatcggatccgatttctcagatcagatccaccgctgccgtctccggccgattctactccatccagtccggtccagctaatatcaggatatggcggcaaatgtcggggaatcgacaagcggcagcagcagtggcgctgatactgggggtagctttgagtgcaacatatgctttgagctgccacaggagccgattgtaacgctctgtggccacctcttctgctggccatgcctttacaaatggctgcgcatccactcgcactcgccagagtgcccagtgtgcaaggctgttgtcgaggaggataagctcgtccccctgtatggccgtggcaaggaccgcgtcgacccaaggtcaaagaacgtcccaggggctgacattcccaaccggccagctgggcagaggcctgcaactgctccacaggccgatcctaacaaccacttccccaatgccgatcctaacaaccacttcccgctggccaatgcacggtgggggaactatacgttctcggctgcgttcgggggtttgttcccgctgctcagcttccaggtgcatgggttccctgatgcaacagcttatggtcagccggctgggttcccttacgggtatgggcatggccatgggcatgcatttcacggtgggcatgcagggcatgctcacgccgcagctccccggcatggaccgcatgggcagcagcagcagcaggcggatgtgtacctgaaggcgctgctcatcctagttggatttcttgtgatcgcgagcctcatcactttctaggcctgcttgttggtgtcatactgtttgtcagatttgctggtaataagtgagagaaagacatacaagacaattgccgtggtgatacgattccgatgttgctgtgtgcgtttacctagctttgcctccatgcaggaccaaatctgaatggagtggtgcgtctgcatggaagtgttgacagagaaattggtgtacatactgtttggatgtggtatactgcggttttgattatacaagaataatttggacatgtgtttgcttgaatgaaacgtagcaagggcattttgccctacatgtaaattgtactttttgatgaatctgtaatgaactagcaaggcatgcagttg

SEQ ID NO: 7388 - protein, 227 aa, Panicum virgatum
  misc_feature: Ceres CLONE 1909038
  misc_feature (1)..(41): Pfam Name: zf-C3HC4 Pfam Description: Zinc finger, C3HC4 type (RING finger)
MAANVGESTSGSSSGADTGGSFECNICFELPQEPIVTLCGHLFCWPCLYKWLRIHSHSPECPVCKAVVEEDKLVPLYGRGKDRVDPRSKNVPGADIPNRPAGQRPATAPQADPNNHFPNADPNNHFPLANARWGNYTFSAAFGGLFPLLSFQVHGFPDATAYGQPAGFPYGYGHGHGHAFHGGHAGHAHAAAPRHGPHGQQQQQADVYLKALLILVGFLVIASLITF

SEQ ID NO: 7389 - DNA, 1933 bp, Panicum virgatum
  misc_feature: Ceres CLONE 1909197
  misc_feature: Encodes the peptide sequence at SEQ ID NO. 7390
aaaacagaacaccacctcccgcatccgaaaaaaaaaaccatcccgcccccagaaaccccaaaaatccccccgcggcggcgatggacctctcgccggcgggctccggcggcaactcgctgccgtcggtcgggcccgacgggcagaagcggcgcgtgtgctacttctacgacccggaggtgggcaactactactacgggcaggggcacccgatgaagccgcaccgcatccggatgacgcactcgctgctcgcccgctacggcctcctcaaccagatgcaggtctaccgccccaaccccgcccgcgaccgcgacctctgccgcttccacgccgacgactacatcaacttcctccgcaccgtcacgcccgagacacagcaggaccagatccgcctcctcaagcgcttcaacgtcggcgaggactgccccgtcttcgacggcctctacagcttctgccagacctacgccggcgcctccgtcgggggcgccgtcaagctcaaccacggccacgacatcgccatcaactggtcggggggcctgcaccacgccaagaagtgcgaggcgtccggcttctgctacgtcaacgacatcgtgctcgccatactcgagctcctcaagcaccacgagagagttctgtatgttgatatcgatatccaccatggagacggagtcgaggaggctttctacacaacagacagggttatgaccgtctcgttccacaagtttggggattatttcccaggaacaggggacatccgtgacattgggcactcaaaggggaagtactactctctgaatgtcccgctggatgatgggattgatgatgaaagctatcagtccctgttcaagccaatcgtgggcaaggttatggaggttttccgccctggtgcagttgtgcttcagtgcggcgctgattccttgtctggggataggctgggctgcttcaacctctctatcagaggtcatgcagaatgtgtcaaatacatgaggtctttcaacgttccattgttgcttctcggtggtggtggatataccataagaaatgttgcccggtgctggtgttatgagaccggagttgctcttggtcaagagctggaagacaagatgcctgtcaacgagtactatgaatacttcggtccagattacactcttcatgttgcaccaagtaacatggagaacaaaaatacacgacaccaactggatgatattagaagcaaacttctggataatctttcaaaacttaggcatgctcctagcgtccagtttcaagagcgggctcctgacacggagttacctgagccagatgaagatcaagcggatccagatgaaaggcatgatcctgattctgacatggaaatggatgatcacaaggctgtggaagagtcaacaaggaggagcaacattctaggtgttcgagttaagagagaatttagtgaaaatgagaccaaagttcaggatgctagccgagttacatctgaacgtagaggactggaacccatggtagaagacattggtccctccaagcaagctcctgcggatgctaatgcgatggccattgacgagccaggcaacgtcaagaatgaactagagaactcaactaaattaccagaccaaccaggcatgtaccataagccatgactgcgacatctgaacttgccagtccaaaaaccaaagtgattcggcgatgcagcctgccatttcaaattcgatttgagttatagtcatctgtaatcagttaatcccatgggagtatttcatggcagtagtgaagttctgcgagtccaccaccgggcaatgcttgaggttgagatagacgatagtctgacccatgtatacatgatgtgagttaagttgtacagtcgttagtcaatgcaaatatgtaatgaacttgacgttaaatttcattgagttttcttcaaaaaaaaaaaaaaaaaaaa

SEQ ID NO: 7390 - protein, 517 aa, Panicum virgatum
  misc_feature: Ceres CLONE 1909197
  misc_feature (1)..(312): Pfam Name: Hist_deacetyl Pfam Description: Histone deacetylase domain
  misc_feature (1)..(311): Pfam Name: Hist_deacetyl Pfam Description: Histone deacetylase domain
  misc_feature (1)..(312): Pfam Name: Hist_deacetyl Pfam Description: Histone deacetylase domain
  misc_feature (1)..(314): Pfam Name: Hist_deacetyl Pfam Description: Histone deacetylase domain
  misc_feature (1)..(312): Pfam Name: Hist_deacetyl Pfam Description: Histone deacetylase domain
  misc_feature (1)..(311): Pfam Name: Hist_deacetyl Pfam Description: Histone deacetylase domain
  misc_feature (1)..(311): Pfam Name: Hist_deacetyl Pfam Description: Histone deacetylase domain
  misc_feature (1)..(314): Pfam Name: Hist_deacetyl Pfam Description: Histone deacetylase domain
  misc_feature (1)..(311): Pfam Name: Hist_deacetyl Pfam Description: Histone deacetylase domain
  misc_feature (1)..(311): Pfam Name: Hist_deacetyl Pfam Description: Histone deacetylase domain
MDLSPAGSGGNSLPSVGPDGQKRRVCYFYDPEVGNYYYGQGHPMKPHRIRMTHSLLARYGLLNQMQVYRPNPARDRDLCRFHADDYINFLRTVTPETQQDQIRLLKRFNVGEDCPVFDGLYSFCQTYAGASVGGAVKLNHGHDIAINWSGGLHHAKKCEASGFCYVNDIVLAILELLKHHERVLYVDIDIHHGDGVEEAFYTTDRVMTVSFHKFGDYFPGTGDIRDIGHSKGKYYSLNVPLDDGIDDESYQSLFKPIVGKVMEVFRPGAVVLQCGADSLSGDRLGCFNLSIRGHAECVKYMRSFNVPLLLLGGGGYTIRNVARCWCYETGVALGQELEDKMPVNEYYEYFGPDYTLHVAPSNMENKNTRHQLDDIRSKLLDNLSKLRHAPSVQFQERAPDTELPEPDEDQADPDERHDPDSDMEMDDHKAVEESTRRSNILGVRVKREFSENETKVQDASRVTSERRGLEPMVEDIGPSKQAPADANAMAIDEPGNVKNELENSTKLPDQPGMYHKP

SEQ ID NO: 7391 - DNA, 1299 bp, Panicum virgatum
  misc_feature: Ceres CLONE 1909198
  misc_feature: Encodes the peptide sequence at SEQ ID NO. 7392
gagggtttccgccgccgcctctcccgccgcgttcgccgtcgcgccgtttctctcctccccaattcgaaaagcctccctcgcgggccactcgcgcatcccgtcctatcccttcccggagcatggccaccgcgacggagccggaggacgcgccgtccgcgcccgggggcgctaaaggagaggccaacaggaagcggggcaacgaacagggagagggaggcggcggcggcggcggcggcgggcagaagcggaagaagaaggaggtcttcatctacggcaactacaggaactactacggctaccggatcgatcgtaatgttggtgaagatcctcgcctagaggcattcaacaagcagtggtttgaaaacaaggattgtcttgatattggatgcaaccagggcctggtaactattggcttagccatgaaatttaaatgtcgaagaatccttggagttgatattgattcaggtttgatcgagactgctaagtggaatctgcgaaggataacgcggcaggataaggtggctacaaaaaatgttaaagctcaagaatcttcaaatcccccatctcagagctctgcagaagtggcacctgaattttcaaatgggaacaaacacaatgatcttttcaaaattgtatcttttcgacgtgaaaattttgtagaaagtttgggtggatgttcagaacaatatgacactatactttgtttaagtgtgacaaaatggatccacctgaactggggtgatgatggcctagttactttatttgtaaagatctggaggcttctaagaccgggcggggtttttatcatggagcctcaaccttggacttcatacaagagaaacagattagtttcagaggttgcaaaagagaacttcaacactatctgtatatacccagagaaatttcgggagatacttctagacaaggttggatttaggtcagtagagttgattatggagagattggtgggtgccgtcactggtttcgaccgtccaatagaagtttaccacaaatgatgagaccggatcaaggattgtcgcatccctttccaaatacgcatgctctaaccaaatgattaggtggagcgttaaaatgctctctgactgattgggtacaacaagtacgacagtgcaagctttgcatggtgctggattgcaggtgttataatttagtggtcaaagtattgagatggaagggtggtggtatggtgtcgtgttcactaccttttgagaatttatgagtagatctgttcttgtataaatgtataatagacacccttgtgctgaaagtttttttttc

SEQ ID NO: 7392 - protein, 298 aa, Panicum virgatum
  misc_feature: Ceres CLONE 1909198
  misc_feature (1)..(42): Pfam Name: Methyltransf_12 Pfam Description: Methyltransferase domain
MATATEPEDAPSAPGGAKGEANRKRGNEQGEGGGGGGGGGQKRKKKEVFIYGNYRNYYGYRIDRNVGEDPRLEAFNKQWFENKDCLDIGCNQGLVTIGLAMKFKCRRILGVDIDSGLIETAKWNLRRITRQDKVATKNVKAQESSNPPSQSSAEVAPEFSNGNKHNDLFKIVSFRRENFVESLGGCSEQYDTILCLSVTKWIHLNWGDDGLVTLFVKIWRLLRPGGVFIMEPQPWTSYKRNRLVSEVAKENFNTICIYPEKFREILLDKVGFRSVELIMERLVGAVTGFDRPIEVYHK

SEQ ID NO: 7393 - DNA, 1922 bp, Panicum virgatum
  misc_feature: Ceres CLONE 1909246
  misc_feature: Encodes the peptide sequence at SEQ ID NO. 7394
catttcgcaaaaacgcgccacctccttccgatccggtcgtcgctgcctcgctggccgttcgctcgtcgcctcctcctccctcctccccttcccacgcctcctctgacctcgcctccggcgcctcgcccgctccccgatccgagccctagccctagcttcctctcgccggcgatgcacccctccggcgcgggggattacgccccctactaccccccttacccctcctccgcagcgccgcccccggccacctacccgttggtgccggccccggcttccgctcccccgtactcgccgtatcccaccgacttcgcccccgcgccgtcgtaccccgcctacccgccggcccagcccgtcgacctcccccactacgcgcctccggccgccgcgccgccgcccccgcagccgtactacccctacgagccgccgccaccgctccctccgtccccgcacaacccggtgccgtcgccgtacccgtcgctggatcgggcggggagctacggctacggatcgggctccggctccgggtacggccaggagctgtacccgccccagccggctggcgggggcgggtggtccgatgatggggtctacgcgtacgacggcggcgacgcgccggagccatacggggccagggggaccgcgccgaggtcggggtcgggatcgggatccgcgctgtttgatgactacgggaggtcgattggtgccgcgacggataggggtgggcgtgggggtagtgcggtgagccccaaggtggtgagggccgtgcccaaggcggagacgacggaggacgtcaggggtggggtgcagaagttcagggttaagctgctgccggagggggctgggagcccgatggatgtactctgccaggttggtttggatggaatccggatgcttgatcccaacactagtaggactttaagaatatatccccttgaaactgtaactagatgggatgtattagattcttctatctttgctttttggtccaagagttcagtggatgttgaagcaaaaaggataaggctgaagtcaaacagctacacatccaacaccattctagacactgtaacagctgccactgtgcagttcaaggagatgggtgggagcagtatttcaagaagtagagcaattgctgatgcagccaagcccgctgagctgcaaaatgaaaggaggagaattttccctgatttgaggaatttaatgaagcctatgaatgaggagaaagatcattgggtcccagatgaagctgtcaccaagtgcacagcatgtgcagcagatttcagtgctttcaaccgcaggcatcactgtcgaaactgtggtgatattttctgtgacaagtgcacccagggaaggactcctctaactacggatgctgatgctcaaccagtccgagtttgtgacagatgcatggctgaagtaacacaaagacttgccaatgcaagggaagcggcaaatcgaccaattgttcacagccatgaggatcttgccaaaaaacttcaggaagccatggatataaataaaaggtcatcttcagggacaaggtcatcagatgtttctggcaagcgaatgcgggaagttgcgtgccctatctgcacggtccatcttcaggtccaagttccaacttctggttcagagacaattgaatgtggcgtatgtcagcatcctttcctcgtcagtgcccgttgaggcaactgacacgcaggggtgtcttctcgggttcacgaacggaagtccgccctgttcgatcgagcttgctgcttaagtcagacgatccaccatgtctgcatggagtcctttgcggcattctgtatatgaatttatgaaatcctgtgcaaatttagtacagttatgttgtggagtaagcaagggtgaataagagttccactttgctgcagttacttgaaaaaaaaaaaaaaaaaaaa

SEQ ID NO: 7394 - protein, 504 aa, Panicum virgatum
  misc_feature: Ceres CLONE 1909246
  misc_feature (1)..(67): Pfam Name: FYVE Pfam Description: FYVE zinc finger
MHPSGAGDYAPYYPPYPSSAAPPPATYPLVPAPASAPPYSPYPTDFAPAPSYPAYPPAQPVDLPHYAPPAAAPPPPQPYYPYEPPPPLPPSPHNPVPSPYPSLDRAGSYGYGSGSGSGYGQELYPPQPAGGGGWSDDGVYAYDGGDAPEPYGARGTAPRSGSGSGSALFDDYGRSIGAATDRGGRGGSAVSPKVVRAVPKAETTEDVRGGVQKFRVKLLPEGAGSPMDVLCQVGLDGIRMLDPNTSRTLRIYPLETVTRWDVLDSSIFAFWSKSSVDVEAKRIRLKSNSYTSNTILDTVTAATVQFKEMGGSSISRSRAIADAAKPAELQNERRRIFPDLRNLMKPMNEEKDHWVPDEAVTKCTACAADFSAFNRRHHCRNCGDIFCDKCTQGRTPLTTDADAQPVRVCDRCMAEVTQRLANAREAANRPIVHSHEDLAKKLQEAMDINKRSSSGTRSSDVSGKRMREVACPICTVHLQVQVPTSGSETIECGVCQHPFLVSAR

SEQ ID NO: 7395 - DNA, 1818 bp, Panicum virgatum
  misc_feature: Ceres CLONE 1909284
  misc_feature: Encodes the peptide sequence at SEQ ID NO. 7396
gggcctggccaattacgcgcttcgctggcccatccacggcgaatcgccgccgccgccgccgccggtctctcgacttcccgtcgacggcgctgggatccctatgccgcggcggtggcttgaccgaaattccggtgattgaatccagatccagtaatcacaccgccaagaggcgcactgatcgttggtccggaaaagtagcagccttgcaagctcgtcgcgcggccatcgctttccgtcgcccctgccggtggccgccaaacagtttacgctgcctgcctgcctccacaacttccgacagccgcacagatcgcctccgctcgtgtctgatttcggcgaaccctattcccattccccttttgtgtgcgtcgttgatgcagataaggtgcttgcccagaagcaaatgcgtgccttgtgcggggagcgcacaattgcagcaagcaacagatcaaccactgaccgacagaactgtgccaatttgccaactgaaggtggactttaagccccttgtgagctagtgaagtctagcagcaataaactcaaggaaaacattccaccagggtaataatggcggatgaatcatggaggatacctatgttagtgcaagaactggcagccaaggtgcagcagccaccaagcagatatgtgcagccggagcagtatcatcccgtcagcctactggttggtgctgagaagccggagcccatccctgtaattgaccttagccggcttttggctgctgatggtgcggatgatgagggaagcaagctccggttcgccttgcagagctgggggctcttcctggtcgataaccatgaaattgaaacttctttgatggatgatttgatcaacgcatcaagagagtttttccatctgccactcgaagagaaacagaagtgcagtaacttgatagacggcaaacatttccaggtggaaggatatggaaatgacccagtggcatcaaaggatcaaaccctggattggttggaccgacttcatctcagggtagagccagaagatgagaggaatcttgtccattggccggaacatcccaattcttttagggctcttttacatgagtacacgttgagctgcaagagaatcaaagattgtatccttcgggcaatggccaagtctctaggacttaatgaagattacattgtttcccagtttagcaacaaggctcccagtttcgccagattcaactactacccaccctgtccaagaccagatattgtctttggcgtcaagcctcactctgacagcggtgttcttaccattcttctcatggacaaagatgttggtggacttcaagttcttagagatggcgtgtggcacaatgttccaacaaatcctcacaggttgttgattaacataggagactacgtagagataatgagtaatgggatcttcaagagcccagtgcacagggctgtcacaaacgcggggaaggagaggatctctttggctatgttccatggcctggatcccgagaaagagattgagccggcgacagctctgttacatgagaagcaaccagcacggtacaggaaaatcaaagcaaaggagtaccttgctgggttctacgaacatttttgtagaggagcaagatttatagactccgtgaagatctaagggaggtagcttagtttctaacggagtatcaatggtgagtcaagaatgtcttctttgtcgtgtgatgtacgtatataatatggatcaccagatgaatgtgctgaagatgatttaaagaacccaccgctgggattttatataaatattttttcttcgacacgaggctaaaaaaaaaaaaaaaaaaaa

SEQ ID NO: 7396 - protein, 355 aa, Panicum virgatum
  misc_feature: Ceres CLONE 1909284
  misc_feature (1)..(101): Pfam Name: 2OG-FeII_Oxy Pfam Description: 2OG-Fe(II) oxygenase superfamily
MADESWRIPMLVQELAAKVQQPPSRYVQPEQYHPVSLLVGAEKPEPIPVIDLSRLLAADGADDEGSKLRFALQSWGLFLVDNHEIETSLMDDLINASREFFHLPLEEKQKCSNLIDGKHFQVEGYGNDPVASKDQTLDWLDRLHLRVEPEDERNLVHWPEHPNSFRALLHEYTLSCKRIKDCILRAMAKSLGLNEDYIVSQFSNKAPSFARFNYYPPCPRPDIVFGVKPHSDSGVLTILLMDKDVGGLQVLRDGVWHNVPTNPHRLLINIGDYVEIMSNGIFKSPVHRAVTNAGKERISLAMFHGLDPEKEIEPATALLHEKQPARYRKIKAKEYLAGFYEHFCRGARFIDSVKI

SEQ ID NO: 7397 - DNA, 717 bp, Panicum virgatum
  misc_feature: Ceres CLONE 1909288
  misc_feature: Encodes the peptide sequence at SEQ ID NO. 7398
ctatctgctattcttcctcttccacgccgtcctctcggcccgccgccgcagccactgcctagccttgcaaagatgaatgtggataagctgaagaagatggcgggcgctgtacgcactggaggaaagggcagcatgcgcaggaagaagaaggcagttcacaagatcacaaccaccgatgacaagaggcttcaaagtactttaaaaagaattggagtgaacactattcctgatattgaggaggtcaacattttcaaggatgatgttgtgatccaatttcagaaccctaaagtgcaagcatctattcctgcaaatacatgggtggtcagtgaagtaccacagacgaaaagtctgcaggacctgctgccaacgattatcaaccaactgggccctgataacctggacaaccttcggaggctcgctgagcagttccagaagcaggccactgcagctgcacaggacgatgatgatgtccctgagcttgtcccgggagagacatttgaagaggcagctgaggagaaggaaccggagctttaagagaagaaagaatcataattttgttccacatttcattcattgttgatccagtgctgtcatccaccatgcgagagacgtgctcttccttgaactgagtctgacgtgcgccattcttctccatatgctccagtttccagttttacaaggattttggtcgaatcccaaaaaaaaaaaaaaaaaaaa

SEQ ID NO: 7398 - protein, 153 aa, Panicum virgatum
  misc_feature: Ceres CLONE 1909288
  misc_feature: Great-hit functional homolog of the protein sequence given in SEQ ID NO 9453
  misc_feature: The sequence is a functional homolog of  SEQ ID NO 1614 in the  11/479,226 US patent application
  misc_feature: The sequence is a functional homolog of  SEQ ID NO 1617 in the  11/479,226 US patent application
  misc_feature: The sequence is a functional homolog of  SEQ ID NO 784 in the  10/412,699 US patent application
  misc_feature: The sequence is a functional homolog of  SEQ ID NO 786 in the  10/412,699 US patent application
  misc_feature: Useful for making plants with modulated biomass
  misc_feature: The plant is abnormally large.
  misc_feature: Useful for making plants with modulated growth and phenotype characteristics
MNVDKLKKMAGAVRTGGKGSMRRKKKAVHKITTTDDKRLQSTLKRIGVNTIPDIEEVNIFKDDVVIQFQNPKVQASIPANTWVVSEVPQTKSLQDLLPTIINQLGPDNLDNLRRLAEQFQKQATAAAQDDDDVPELVPGETFEEAAEEKEPEL

SEQ ID NO: 7399 - DNA, 1960 bp, Panicum virgatum
  misc_feature: Ceres CLONE 1909352
  misc_feature: Encodes the peptide sequence at SEQ ID NO. 7400
atttggcccagcctgcgcgcctgagcccgacgcggcgacgcccccccggatccaaaccctagcgtccgccgcccccctcaagtcgaccgagcccgtcctaaaaccctcggaccacgagccagtcatgtcactctacacgctcaaccacctggccgccgccggcgccgggatcgggaaacccttgtctccggctgccccggcggcggcgcgctcggtgcgcctgctgcctaaggcgcgcctcccgggccccgtctccgccgcggccgccgcgaccgcgtccgctcgcgcggaccccgcggaggatagggtttccgcgctgagccaggtctccggcgtgctggggtcgcagtggggggacgaggggaagggcaagctcgtcgacgtgctcgccccgcgcttcgacgtcgtcgcgcgctgccaggggggagcaaatgctggacacaccatctataactccgaaggaaagaaatttgcccttcatcttgttccatctggtatcctccatgaagggacactctgtgttgttggcaatggagcggtgatccatgttccagggttctttgaagaaattgatggtcttgagtccaatggagtctcctgcgatggaagaatactggtctctgatcgggcacatctgctgtttgatctgcaccaggttgtagatggactcagggaagctgaactggaaaattcctttatagggacaactaagagaggcatcggaccttgttactcaagcaaggtaactcgaaatggactgcgagtttgtgatctaaggaacatggacacttttggggataagcttgatgtcttatttaaagatgccgcttcgagatttcaaggcttcgagtacagcaaaaacatgctcaaacaagaggttgagaggtacaagaggtttgcagagcacttggagcccttcattgctgacactgtccatgtattaaatgaatctatccaacagaagaagaaaattctagttgaaggtggccaagcaacaatgctggatattgattttggtacctatccatttgtgacttcttctagcccttcagctggtgggatatgcactggccttgggattgccccaagggtaatcggtgacctgattggagtggtcaaagcttacacatcaagagtcggctctggtcctttcccaactgaactctttggagaggaaggtgatcgccttaggaaagctggaatggaatttggcacgacaaccggccgtccaaggcgatgtggctggcttgacattgttgcactgaagtactgctgtcaaatcaatggattctcatcactgaatctgaccaaacttgatgttctgtccgacctgccagaaattaaggtgggggtttcgtataacaaaactgatggacagaagctacaatccttccctggggatcttgacaccctggagcaagtacaggtcaactatgaggtgctgcctgggtggcaaagtgacatttcttcagttcgaagttaccatgaacttccccaagctgctcgccgctatgtggagaggatagaagagcttgtcggtgttccagtgcactacattggtgttgggcccgggagagatgctctcatatacaagtaaaagccacttcattttgtcagcgggcaactggacgaaaaaatcaagccttaactagctttgagcatttgctcttattattaatctcccttgtcatggtagctctgatacagcgaagttactggctggtggagtgatctaatgtgcacaataataaaacatcttccgaaacatttgctaaggcgaataaggatgagcgttttgcactaagtttgactcaccaaatcatatattttgtactaattgagcctggtgtaatgtgatctgaaaaatctggattggatactctgctgagtgctaatgtctaccttttggttttctgttgaatatgaggcatagctgacggaaaaaaaaaaaaaaaaaaaa

SEQ ID NO: 7400 - protein, 490 aa, Panicum virgatum
  misc_feature: Ceres CLONE 1909352
  misc_feature (1)..(422): Pfam Name: Adenylsucc_synt Pfam Description: Adenylosuccinate synthetase
  misc_feature (1)..(422): Pfam Name: Adenylsucc_synt Pfam Description: Adenylosuccinate synthetase
  misc_feature (1)..(422): Pfam Name: Adenylsucc_synt Pfam Description: Adenylosuccinate synthetase
  misc_feature (1)..(422): Pfam Name: Adenylsucc_synt Pfam Description: Adenylosuccinate synthetase
  misc_feature (4)..(420): Pfam Name: Adenylsucc_synt Pfam Description: Adenylosuccinate synthetase
  misc_feature (1)..(422): Pfam Name: Adenylsucc_synt Pfam Description: Adenylosuccinate synthetase
  misc_feature (1)..(406): Pfam Name: Adenylsucc_synt Pfam Description: Adenylosuccinate synthetase
  misc_feature (1)..(422): Pfam Name: Adenylsucc_synt Pfam Description: Adenylosuccinate synthetase
  misc_feature (1)..(422): Pfam Name: Adenylsucc_synt Pfam Description: Adenylosuccinate synthetase
  misc_feature (1)..(490): SWISSPROT Homolog: EC 6.3.4.4 Adenylosuccinate synthetase, chloroplast precursor
  misc_feature (37)..(490): SWISSPROT Homolog: EC 6.3.4.4 Adenylosuccinate synthetase, chloroplast precursor
MSLYTLNHLAAAGAGIGKPLSPAAPAAARSVRLLPKARLPGPVSAAAAATASARADPAEDRVSALSQVSGVLGSQWGDEGKGKLVDVLAPRFDVVARCQGGANAGHTIYNSEGKKFALHLVPSGILHEGTLCVVGNGAVIHVPGFFEEIDGLESNGVSCDGRILVSDRAHLLFDLHQVVDGLREAELENSFIGTTKRGIGPCYSSKVTRNGLRVCDLRNMDTFGDKLDVLFKDAASRFQGFEYSKNMLKQEVERYKRFAEHLEPFIADTVHVLNESIQQKKKILVEGGQATMLDIDFGTYPFVTSSSPSAGGICTGLGIAPRVIGDLIGVVKAYTSRVGSGPFPTELFGEEGDRLRKAGMEFGTTTGRPRRCGWLDIVALKYCCQINGFSSLNLTKLDVLSDLPEIKVGVSYNKTDGQKLQSFPGDLDTLEQVQVNYEVLPGWQSDISSVRSYHELPQAARRYVERIEELVGVPVHYIGVGPGRDALIYK

SEQ ID NO: 7401 - DNA, 1912 bp, Panicum virgatum
  misc_feature: Ceres CLONE 1909409
  misc_feature: Encodes the peptide sequence at SEQ ID NO. 7402
acctgctctccctctctcactcgtccccatcaccccccctctctctctctcccctctcacctcggctccaatggcggacgctgaagctaacacccaaccccccgacgccgcggagtccccgatcgcttcgctctccccctcctccgtcggcgccgcggatgccgacgcgatcgagaagcagctcgccgggctgggcatcgccgtcgccggcggaggcgggttcccggagccctcgggctgggacgacgtccccgtccccgtcgccgtcggcggcggcgatgaagtcgccggggagaaggtgcgggggcccccaccggcgccggcgggggcggcagatggcaaggtgcgcttcccgcgccggcctggggagccggactgcagctactacctcaagttcggcacctgccgcttcgggatcaagtgcaagttcaatcacccgtcgcggaagaagaaaagcagcagggcgagagggagtgggagcagcgggagcggaagcaacagcagcagcaataaaacatcttcgcctgatgatgatcaggctcctagagaagaatacgaaggccttgttccagatatttcagattctgtgacctttcatgataaggggagttcatctaactcaggaaatcataggaagacatcaaatgaggttattgatataaagaagggaagaatagagtcaaaggaaaagatttcagaagagcttgaaaagggggtttatttcaagaagttagatgagacaaatatcacaaaccagaagattttgaaaggtgtcaaggataaaagaaaggaaacctttttggaagggagtgttcaggaggaatgcaagtattattcaacaccaggtggatgcaaatttggtacagcttgcaagtacctccaccgcgaggggaaagaagggaaagcagaggttgaaaaggtcgagctgaactttcttggtcttccactgagaccaggtgaaaaggagtgcccgttctatatgcgcactgggagctgcaaatttgccactaactgcaaatttcaccacccagatcctagtaatgtcgcttcaaaagaaccagttttggaacatgagaatggggataatccacagcaaagtgcccaaggaccctcgcagccaagtgttccggtttggcctgaacagagagcattgaatgagcaacatgttccttttctagctccagcaccatcgtacagtgcaggaatgattccacctcaaggaatgtatccctctcctgactggactgggtatcatcaggttcctgtgaatccatattatcctcctggggtcccttttcctccttttccagctcctcatatgaatcacccgatttataaggctgctgatataccaggacatcagcaactaccttctgatgaatatccagagagacctggccaaccagaatgccagcattttgttaagagtggtttctgcaaatacaggatgaaatgcagatttcaccatccaagattgtgccagcctgctccgctatcaggtcttagccctattggcctgcctatcaaacctgaccaacctgtgtgcacatactatggtcgcttcggtgtttgcaagtatggcccagcttgcatgttcaaccaccccttcaacttcgggcctcccgtaccggcagcagggccacccctccctggccaataccaccccacacctggaaacttcaccgtctagtgggcacggagacgagcgattttcctgaggtcgccgcgagtgctcgtaataacttccacctgtaaaatagctgtaagtggctggcggtagagatccggcttgcaaatcgcaacgaagttgcacaaagctgggtacattgcctttgggattcatggaaaaccatcagaacctgttgacattactgtaaactttacgctgtacagcaagttacagttcgtacac

SEQ ID NO: 7402 - protein, 539 aa, Panicum virgatum
  misc_feature: Ceres CLONE 1909409
  misc_feature (1)..(27): Pfam Name: zf-CCCH Pfam Description: Zinc finger C-x8-C-x5-C-x3-H type (and similar)
MADAEANTQPPDAAESPIASLSPSSVGAADADAIEKQLAGLGIAVAGGGGFPEPSGWDDVPVPVAVGGGDEVAGEKVRGPPPAPAGAADGKVRFPRRPGEPDCSYYLKFGTCRFGIKCKFNHPSRKKKSSRARGSGSSGSGSNSSSNKTSSPDDDQAPREEYEGLVPDISDSVTFHDKGSSSNSGNHRKTSNEVIDIKKGRIESKEKISEELEKGVYFKKLDETNITNQKILKGVKDKRKETFLEGSVQEECKYYSTPGGCKFGTACKYLHREGKEGKAEVEKVELNFLGLPLRPGEKECPFYMRTGSCKFATNCKFHHPDPSNVASKEPVLEHENGDNPQQSAQGPSQPSVPVWPEQRALNEQHVPFLAPAPSYSAGMIPPQGMYPSPDWTGYHQVPVNPYYPPGVPFPPFPAPHMNHPIYKAADIPGHQQLPSDEYPERPGQPECQHFVKSGFCKYRMKCRFHHPRLCQPAPLSGLSPIGLPIKPDQPVCTYYGRFGVCKYGPACMFNHPFNFGPPVPAAGPPLPGQYHPTPGNFTV

SEQ ID NO: 7403 - DNA, 1251 bp, Panicum virgatum
  misc_feature: Ceres CLONE 1909460
  misc_feature: Encodes the peptide sequence at SEQ ID NO. 7404
agcggcatcgcggcgcgcgagctgcataccacaccatcccccacctcggcggcggcggcggcgtttgtgcgtgcctgcgaagagaggaaccgaggtgcggggaactcggagaggagtgaggatgccacggccggagtttcaggcgccgccggatgtgttctacaacgaatcggaggcccgcaagtacaccacctcctcgcgtatcatcgaaatccagtcgaggatttcggagagggcgctggagctgctcgctctccccaacgatggcgtccccaagctgcttctcgacataggatgcggttctggacttagtggcgagacattgacggagcatggccaccactggattggctatgatatttcgaagtctatgctcgatgttgccttggagcgtgaaacagaaggtgacctactacttgcagatatgggtcagggactgggcttgcgaccaggagttattgatggtgcaattagtatttcagcagttcagtggttatgcaatgctgacaaatcctctcatgatccaagactgcggttaaaggctttctttggttcgttatatagatgcctagctaggggagcaagagctgttctacaattttatgctgataatgtgaagcagagtgaaatgattgtgacttttgccatgcgtgctggttttgctggtggagtggttgttgactggcctcatagttcaaaagcaaagaagtcctaccttgtcctcacttgtggcccgccttcgattaatacatcgcttccaaagggtaaaggtgaaaatggcgagatgtgcagcgacgatgatgacgagagcagtgatgaagatggtgacaaaacagtgggcatatatgaaagaaataggtcgaagaagaggcagaagacgaaaaagaatgggaaaggcaaggattggctcttgaagaaaaaagagcagatgagaagaagaggccatgatgtgccggccgacacgaagtacacagggcggaagcggaagacctacttctaactatgtcgtgcccatacccagccgtgctcgttatgctggctgtttattcgtagttttgtactggtagttcattagcatcagcaaaaatttctgtaagagtgagatggatgccgggtcgctgtagtgctattcacagctgtaccgacgtcttgcagttttgacaatgttgtgataaaacgatgccatttttgttgaacatctgttactgtgagtatagctggttatttgcgtaaaaaaaaaaaaaaaaaaaa

SEQ ID NO: 7404 - protein, 292 aa, Panicum virgatum
  misc_feature: Ceres CLONE 1909460
  misc_feature (1)..(104): Pfam Name: Methyltransf_11 Pfam Description: Methyltransferase domain
MPRPEFQAPPDVFYNESEARKYTTSSRIIEIQSRISERALELLALPNDGVPKLLLDIGCGSGLSGETLTEHGHHWIGYDISKSMLDVALERETEGDLLLADMGQGLGLRPGVIDGAISISAVQWLCNADKSSHDPRLRLKAFFGSLYRCLARGARAVLQFYADNVKQSEMIVTFAMRAGFAGGVVVDWPHSSKAKKSYLVLTCGPPSINTSLPKGKGENGEMCSDDDDESSDEDGDKTVGIYERNRSKKRQKTKKNGKGKDWLLKKKEQMRRRGHDVPADTKYTGRKRKTYF

SEQ ID NO: 7405 - DNA, 3767 bp, Panicum virgatum
  misc_feature: Ceres CLONE 1909541
  misc_feature: Encodes the peptide sequence at SEQ ID NO. 7406
aaaaatccgagcattatctccgtcttcctcgcgcctctcccgccgcgccccgaaccaccgcatcctcacccctcccgccatgcactgcctcgccccccatttcctcctcctcccattacccaccgccttgcgccacgcgctccctcaaacccaaaccccaccccttcctctacgactcccctcccgcgccgctcggctccacctcgcctcggcgcgctcgccgtcccgcgccgccgcctccgtctccgacgacgacgaggatgaggaggaggtcgacgtggacgacgacgacgacgacgacgagataggcatccgcgacgcggacgacaagtacgaggacggggatgaggtcgatgaggaggcggtggacgaggacatcggcggcgaggacgaggaagaggcggaagacgaggacgacgagcgggaggatacctcggcgcggaggcgggaatcggaggagtacaagtcgcgccgggtagcgaagctggtcgctgaggtgcgggagttcggggaggacatcatcgactacaatgagctcgccgggatctacgactttcccatcgacaagtttcagcgcttggcaatacaagcatttttgagaggttcatctgttgtagtttctgcacctacaagtagtggaaagacattaatagcagaagctgcagctgttgcaacagttgctagaggaaggcgtctcttctacacaactccattaaaggccttgtcaaatcagaagtttcgtgatttccggaatacctttggtgatcataatgttggtcttcttacaggagattctgctatcaacaaagatgctcagatcctaattatgacgacagagattttgcgtaacatgctgtaccaaagtgttggcatgacagcatctgaaggtagattatttcaagttgatgtcattgttttggatgaagttcattatttgagtgatatctcacgtggcactgtttgggaagaaactgtcatatattgtccaaaggaagtccagcttatatgcttgtcagctactgttgcaaatcctgatgaactagcgggctggataagtcagattcatggtaagacggagctagtaacatcaaacaaacgtccggttccacttacgtggcacttctcaaagaaatacgccctacaaccacttcttgatggaaaggggaagaaaatgaataggaaactgtggatgtctaactttcaaaacttggcatccccaaagagtgagttctattatgtgaaaggaaagaggagacttaggacaaataaaaatgagcaaggtaatagaagccctttggacatatcaaaacaggttcggttgtcaaagcatgaactcagcaatatgcgccgctcccaagttccactaatacgcgacactttatcacaactttgggaaaatgacatgcttccagctatttggtttatttttagtagaagagggtgtgatgcagctgttgagtatcttgaggattgcagattgttgcatgacactgaggctagtgaagttgaactggaactcaggagattcaagatgcaatatcctgatgctgtccgagaaagtgctgtaaaaggactcttgcgaggagttgctggccatcatgctggttgcttgccactgtggaaatcattcattgaagaattatttcagcgtggccttgttaaagtagtttttgcaacggaaacccttgcagcagggattaacatgcctgcgaggacagctgtgatttcttctctcagcaaaagaatagatgccgggcgtcagctcttaaccccaaatgaactattccagatggcaggccgtgctggaaggagagggattgatacgattgggcatactgttcttgttcagactccatatgaaggacctgaagagtgttgtgacattatatttgctggacttgagccacttgtctcacaattcactgcatcatatgggatggttttgaacctccttgctggttccaaagttactcataatcagaaagaatcagatgatcttaaggtcaagcgctctggaagaactttagaagaagctcgaaagctagtggagcaaagctttgggaattatgttgggagcaatgtaatggttgctgccaaagaagagattgaaagaatacaggaagaaatacaatacctctcttcagaaattaccgatgaatctattgaccgaaaatgcagggaagaattatcagaggaagattatgctgagatttcccttttacaaaagagactaaaggaagagaagcagatcagaaatgaactgaaaaaaaggatggaactggagagaatggctgcatggaaaaatcggctggaagaatttgaaagtggccatcttcctttcatgtgtctgcagtataaggacaaggattcaattcagcacactatccctgctgtatttattggaaacctcaaattatttgctgatcaaaagattgcgaacatggtggaagaagaagattcacttggtataggcaagcataaagttgacagtggggaacaactttattggccatcttactacgtagctttaagttcagataattcatggtatctgttcacagagaaatggataaaaactgtctacaagacaggtcttcctgctgtcccttctgttgaagggggcacgctccctcgagaaatcctgaagcagctccttttgcgtgaagagatgatgtgggataaacttgcgaaatcagaatatggttctttgttaagcacagatggttctctagacacttggtcgtggagtctcaatgttccagtgcttaatagcctttcggaagacgatgaggtagaacgattctccctggaacatcaagatgcagtagaatgctacaagcaacagaggaggaaggtttcacacttgaagaaaacaatcaagagtactaagggcttcaaagaattccaaaagatcattgacatgagaaactttacaaaagaaaagattgagcgcttggaagctagatccagacgcttgactcgacggataaaacaaattgaaccaactggttggaaagaatttctccagattaacaaagttatacaagaggctagagcattagatatcaacactcaggtaatctatcctttgggtgagacggcagcagctatacgaggagaaaacgagctatggcttgctatggttcttaggaacaaggtcctcttggatctaaagccatctcaattggcagcagtttgtggaagtttagtgtccgaagggatcaaacttcgtccttggaaaaatagcagttatgtatacgaaccttcttctgttgtcaccggtgttataagctatttagaagagcagagaaactcgctcatcgatctccaggatagacataatgttaagataccctgcgaaatagatgcccagtttgctgggatggttgaagcctgggcttcagggttgacctggagggagataatgatggactctgcaatggatgacggagatttagcccgtctgctcaggcgcacaatcgacttactagctcagattccgaaattaccagacattgatccagttctccaaaagaatgcacaaattgcttgcagcgtcatggaccgagtacccattagtgagcttgccggttgaaagcctgaagcatgtaagtcctacaaacgcagagttcccttctctgccctcttattctacatttgttatatgtaggaaattctttgttgtactatggcgagttattacctgatattaacaaagatatcatttttccaagcgattgatatcttcaaaaaaaaaaaaaaaaaaa

SEQ ID NO: 7406 - protein, 1171 aa, Panicum virgatum
  misc_feature: Ceres CLONE 1909541
  misc_feature (1)..(160): Pfam Name: DEAD Pfam Description: DEAD/DEAH box helicase
  misc_feature (1)..(83): Pfam Name: Helicase_C Pfam Description: Helicase conserved C-terminal domain
MHCLAPHFLLLPLPTALRHALPQTQTPPLPLRLPSRAARLHLASARSPSRAAASVSDDDEDEEEVDVDDDDDDDEIGIRDADDKYEDGDEVDEEAVDEDIGGEDEEEAEDEDDEREDTSARRRESEEYKSRRVAKLVAEVREFGEDIIDYNELAGIYDFPIDKFQRLAIQAFLRGSSVVVSAPTSSGKTLIAEAAAVATVARGRRLFYTTPLKALSNQKFRDFRNTFGDHNVGLLTGDSAINKDAQILIMTTEILRNMLYQSVGMTASEGRLFQVDVIVLDEVHYLSDISRGTVWEETVIYCPKEVQLICLSATVANPDELAGWISQIHGKTELVTSNKRPVPLTWHFSKKYALQPLLDGKGKKMNRKLWMSNFQNLASPKSEFYYVKGKRRLRTNKNEQGNRSPLDISKQVRLSKHELSNMRRSQVPLIRDTLSQLWENDMLPAIWFIFSRRGCDAAVEYLEDCRLLHDTEASEVELELRRFKMQYPDAVRESAVKGLLRGVAGHHAGCLPLWKSFIEELFQRGLVKVVFATETLAAGINMPARTAVISSLSKRIDAGRQLLTPNELFQMAGRAGRRGIDTIGHTVLVQTPYEGPEECCDIIFAGLEPLVSQFTASYGMVLNLLAGSKVTHNQKESDDLKVKRSGRTLEEARKLVEQSFGNYVGSNVMVAAKEEIERIQEEIQYLSSEITDESIDRKCREELSEEDYAEISLLQKRLKEEKQIRNELKKRMELERMAAWKNRLEEFESGHLPFMCLQYKDKDSIQHTIPAVFIGNLKLFADQKIANMVEEEDSLGIGKHKVDSGEQLYWPSYYVALSSDNSWYLFTEKWIKTVYKTGLPAVPSVEGGTLPREILKQLLLREEMMWDKLAKSEYGSLLSTDGSLDTWSWSLNVPVLNSLSEDDEVERFSLEHQDAVECYKQQRRKVSHLKKTIKSTKGFKEFQKIIDMRNFTKEKIERLEARSRRLTRRIKQIEPTGWKEFLQINKVIQEARALDINTQVIYPLGETAAAIRGENELWLAMVLRNKVLLDLKPSQLAAVCGSLVSEGIKLRPWKNSSYVYEPSSVVTGVISYLEEQRNSLIDLQDRHNVKIPCEIDAQFAGMVEAWASGLTWREIMMDSAMDDGDLARLLRRTIDLLAQIPKLPDIDPVLQKNAQIACSVMDRVPISELAG

SEQ ID NO: 7407 - DNA, 1764 bp, Panicum virgatum
  misc_feature: Ceres CLONE 1909588
  misc_feature: Encodes the peptide sequence at SEQ ID NO. 7408
aaacctcctcgtccgcctccgcctcgtcctcctcccctgccactctcaagccccgcgggcgccgcattgctcgccgccgcctcggttcctcctgcgtccccttctgtatttggtggtttggtctgggtttggttgcgaggaggagagaggcggagtttgatcggaggaggggaaaatgtgggcggcgcggttggtcggggagcgccggatgcggcagatccagcgcttcgcgcggaacgccaagctcaccgtcgtctgcctcttcctcaccgtcctcgtgctccgcggcaccgtcggcgccggccgcttcggcacgccgcagcaggacctcatcgagctccgccagcacttcgtctcccacccgcatcgggcgctcgccgagcaccacgacgccaggtccaggggctccgccacgaccaccaccaccaccacgtcctcctcctcctccggacgcggcgacgacgagcccgacccgccgccgaggacgctcagggacccgccctacacgctgggccccaagatcaccgactgggacgagcagcgcgccgcctggcaccgccgccacccggagacgccgcccttcctcaacgacgtgaagccgcgggtgctgctcgtcaccggttcctcccccaagccctgcgagaaccccgtcggtgaccactacctcctcaagtctatcaagaacaagatcgactactgccgcgtccacggcatcgagatcttctacaacatggcgctgctcgacgccgagatggccggattctgggccaagctcccgctcatccgggcgctgctcctggcgcacccggaggtcgagttcctctggtggatggactccgacgccatgttcaccgacatggcattcgagctcccatgggagcgctacgggccgtacaacctcgtcatgcacggctgggacgagatggtctacgacgacaaaaattggattgggctcaacactggcagcttcttgctgcgcaactgccagtggtcgcttgagatgctggatacctgggcgccaatggggccaaagggccctgtccgcattgaggctggcaaggtgctgaccaagtccttgaaggatcgaccagtatttgaggctgatgatcagtcggccatggtgtacatcctcgccactcagcgcgagaaatggggtgacaaggtgtacctggagaatgggtactacctccacggctactggggcatcttggttgataggtatgaggagatgcttgagaattataagccagggcttggggatcaccggtggccgctcgtcactcactttgtcggttgcaagccttgcggcaaatttggggactaccctgttgagcgttgtctcaaacagatggaccgtgcattcaattttggggataaccagatcttgcagatgtatgggttcacgcacaagtcgcttgcaagcaggagagtgaagaggatcaggaatgagactagtaacccactcaagatgaagggtgagcttgggttgctccaccccgcattcaaggctgtgaagacttccacatgataattagagtacaattccacttgttattttgtttcttcgttctagatcctgttgggtctgaatctgaagtgttctttttgtagaatcgggtgacagcaggagtttgggttgggatcatgggatggatatgttgtaatgtgagatgttaggaaaatgatgttatgtttatttgttggcataagttatgtcttacactgctagaaattgagttaatgaatgaactcaagttattggtc

SEQ ID NO: 7408 - protein, 450 aa, Panicum virgatum
  misc_feature: Ceres CLONE 1909588
  misc_feature: Great-hit functional homolog of the protein sequence encoded by LOCUS At3g62720
  misc_feature: Great-hit functional homolog of the protein sequence encoded by LOCUS At4g02500
  misc_feature (2)..(245): Pfam Name: Glyco_transf_34 Pfam Description: galactosyl transferase GMA12/MNN10 family
  misc_feature (5)..(450): SWISSPROT Homolog: EC 2.4.2.39 Xyloglucan 6-xylosyltransferase
  misc_feature: Useful for making plants with altered cell wall content and/or composition
MWAARLVGERRMRQIQRFARNAKLTVVCLFLTVLVLRGTVGAGRFGTPQQDLIELRQHFVSHPHRALAEHHDARSRGSATTTTTTTSSSSSGRGDDEPDPPPRTLRDPPYTLGPKITDWDEQRAAWHRRHPETPPFLNDVKPRVLLVTGSSPKPCENPVGDHYLLKSIKNKIDYCRVHGIEIFYNMALLDAEMAGFWAKLPLIRALLLAHPEVEFLWWMDSDAMFTDMAFELPWERYGPYNLVMHGWDEMVYDDKNWIGLNTGSFLLRNCQWSLEMLDTWAPMGPKGPVRIEAGKVLTKSLKDRPVFEADDQSAMVYILATQREKWGDKVYLENGYYLHGYWGILVDRYEEMLENYKPGLGDHRWPLVTHFVGCKPCGKFGDYPVERCLKQMDRAFNFGDNQILQMYGFTHKSLASRRVKRIRNETSNPLKMKGELGLLHPAFKAVKTST

SEQ ID NO: 7409 - DNA, 1120 bp, Panicum virgatum
  misc_feature: Ceres CLONE 1909693
  misc_feature: Encodes the peptide sequence at SEQ ID NO. 7410
cccccccaaacccatttccttcctgcctccacgacccagcccaggcccggcggtgcctctccctctcgtctccggatcggcaagagcccagctgctgccggattcacacgacacctcgtcgtctctctctctctctctctctctctctctctctctctctctctctctctctcggcccatggcgcagcgcgacaagaaggtggaggagccgacggagctgcacgcgccggagctcacgctctgcgccaacagctgcggcttcccgggcaacccggcgaccaagaacctctgccagaactgcttcctggccgcctcggcctccgtgtcgccgccgtcgccctcctcctcctcctcgtcgccctcgccggcggtgttcgacaagccgcggccggcggtcgcccctaccgccgtgtggccgccgttccccgcggccgccgaccggcccccggcgggccccgcggagtccccctccaaggcgccccggacgtcgtcgtcggtcaaccggtgccacagctgccggaagcgggtcgggctgacggggttccggtgccgctgcggcgagctcttctgcggcgcgcaccggtactcggaccgccacgactgcggctacgactacaagggcgttgcccgggacgccatcgcccgggagaaccccgtcgtgcgcgccgccaagatcgtcaggttctgagagctggggagcaccggaggagaccacgcagctcagctccacgccgatcgtcgatccatctcccgcgctccggaatccccctctctgtttttctcttttctttcctttttacaaaagtttaaaaaggtgattagtcgaggtgctatcatcatgctgttcttgagaattccacaaagaagaagaagaagatgatgatgatcaaggaaaaaggaggagcggatcatggcaaatcatgatgaaggaaaaagggaatcgagagcacagtgcgatgataatgttgtagcggtggttgggggtggagataggggtcggtttggtgtgttgtcctactacaaatcacaatcttctattaaatttttcttccatctctctctgtataaactaaattataattggaatctccctattgcccaaaaaaaaaaaaaaaaaaaa

SEQ ID NO: 7410 - protein, 169 aa, Panicum virgatum
  misc_feature: Ceres CLONE 1909693
  misc_feature (1)..(41): Pfam Name: zf-AN1 Pfam Description: AN1-like Zinc finger
MAQRDKKVEEPTELHAPELTLCANSCGFPGNPATKNLCQNCFLAASASVSPPSPSSSSSSPSPAVFDKPRPAVAPTAVWPPFPAAADRPPAGPAESPSKAPRTSSSVNRCHSCRKRVGLTGFRCRCGELFCGAHRYSDRHDCGYDYKGVARDAIARENPVVRAAKIVRF

SEQ ID NO: 7411 - DNA, 2029 bp, Panicum virgatum
  misc_feature: Ceres CLONE 1909709
  misc_feature: Encodes the peptide sequence at SEQ ID NO. 7412
ctcctcagctcaggcgagcagcagagccgagcactagcagaccctcctcctcaaattcccgaccaggcgaccaccaccatttgcccttccggcgaagccaaccacttcacctgctcagcgcgatggggtccgtcccggaggacaccgccgcggccgtgttccgctccaagctcccggacatcgagatcccgcgcagcctctcactgcaggcctactgcttcgagcggctccccgaggtgtcctcccgcccgtgcctcatcgacgggcagacgggcgccgtccacacctacgccgacgtggagctcctctcgcggcgcgcggcggcggcgctgcgcgcgctcggggtgggcaagggggacgtggtcatgaacctcctccgcaactgccccgagttcgccttcgtcttcctgggcgccgcgcggctgggcgcggccaccaccacggccaacccgttctacaccccgcacgagatccaccgccaggcggccgcggcgggggcgagggtgatcgtcaccgaggcctgcgccgtcgacaaggtgcgcgccttcgccgccgagcgcggcgtgcccgtggtgtccgtcgacggcggccccgggggctgccccctgctccgggacctcatggacgccgccgagccgctcgccgccgacgaggaggtccaccccgacgacgtcgtcgcgctgccatactcctccggcaccaccgggatgcccaagggcgtcatgctcacgcaccgcagcctcgtcaccagcgtcgcgcagcaggtggacggcgagaacccgaacctgtacttccggcaggacgacgtggtgctctgcgtgctgccgctgttccacatctactcgctcaactcggtgctgctggcgggcctgcgcgccgggtgcgccatcgtgatcatgcgcaagttcgagaccggcgcgctggtggagctggtgcgcgcgcacggcgtgaccgtggcgcccttcgtgccgcccatcgtggtggagatcgccaagagcccccgcgtcggcgccgccgacctcgcctccatccgcatggtcctgtccggcgccgcgcccatgggcaaggacctccaggacgcgttcatggccaagatccccaacgccgtgctcggccaggggtacgggatgacggaggcagggcccgtgctggccatgtgcctggccttcgccaaggagccgttcgaggtcaagtccggctcctgcgggaccgtcgtccggaacgccgagctgaagatcgtcgaccccgacaccggcgcgtcgctgggccggaacctgccgggcgagatttgcatccgcggcgagcaaatcatgaaaggttatctgaatgatccagaagccacaaagaataccattgataaggatggatggctgcacaccggcgacattggttatgttgatgacgacgatgagatcttcattgttgacaggctcaaggagataatcaaatacaagggcttccaagtaccgcctgcagaacttgaggcccttctcctcacacatcctgaaattaaggatgctgctgttgtctcaatgaaagatgaacttgccggtgaagtccccgttgcattcattattcggactgaagattctgagatcagtgaggacgagatcaagcagtttgttgcaaaggaggttgtgttctacaagaggatcaacaaagttttcttcacggattccattccgaagaatccttctggcaaaatccttaggaaagacctgagagcacgacttgctgcagggattcctagcgaaacacagtccaaaaactaagcctgatattgatcccgatccccaccccaccaaaacacaagtttctacacccttgtcaaaaatcatgctgtaatattcatgagatggcagtaatacatatagaaaggccaagcaatccctattgattcttttagatgggtaaagtatactttgtttatttgttctatgtattgtatcatgtatagataccctttttgaccccaaaaaggctgattattataccatatctttgttcagaaaaaaaaaaaaaaaaaaaa

SEQ ID NO: 7412 - protein, 549 aa, Panicum virgatum
  misc_feature: Ceres CLONE 1909709
  misc_feature: Great-hit functional homolog of the protein sequence encoded by LOCUS At1g51680
  misc_feature: Great-hit functional homolog of the protein sequence encoded by LOCUS At3g21240
  misc_feature: Great-hit functional homolog of the protein sequence given in SEQ ID NO 9251
  misc_feature (1)..(541): SWISSPROT Homolog: EC 6.2.1.12 4-coumarate--CoA ligase 1
  misc_feature (12)..(541): SWISSPROT Homolog: EC 6.2.1.12 4-coumarate--CoA ligase 2
  misc_feature: Useful for making plants with altered cell wall content and/or composition
  misc_feature: Useful for making plants with altered lignin content
MGSVPEDTAAAVFRSKLPDIEIPRSLSLQAYCFERLPEVSSRPCLIDGQTGAVHTYADVELLSRRAAAALRALGVGKGDVVMNLLRNCPEFAFVFLGAARLGAATTTANPFYTPHEIHRQAAAAGARVIVTEACAVDKVRAFAAERGVPVVSVDGGPGGCPLLRDLMDAAEPLAADEEVHPDDVVALPYSSGTTGMPKGVMLTHRSLVTSVAQQVDGENPNLYFRQDDVVLCVLPLFHIYSLNSVLLAGLRAGCAIVIMRKFETGALVELVRAHGVTVAPFVPPIVVEIAKSPRVGAADLASIRMVLSGAAPMGKDLQDAFMAKIPNAVLGQGYGMTEAGPVLAMCLAFAKEPFEVKSGSCGTVVRNAELKIVDPDTGASLGRNLPGEICIRGEQIMKGYLNDPEATKNTIDKDGWLHTGDIGYVDDDDEIFIVDRLKEIIKYKGFQVPPAELEALLLTHPEIKDAAVVSMKDELAGEVPVAFIIRTEDSEISEDEIKQFVAKEVVFYKRINKVFFTDSIPKNPSGKILRKDLRARLAAGIPSETQSKN

SEQ ID NO: 7413 - DNA, 1535 bp, Panicum virgatum
  misc_feature: Ceres CLONE 1909752
  misc_feature: Encodes the peptide sequence at SEQ ID NO. 7414
aaaccatcctcttgtacgtctaagctaagtgcgaagcacaggcacggctcgccgcagcacgagcgtgtgtgtaacgaaccatggacgtggaggcgcggaatgagtcgccgccacccgcgcgcagcaaggcgatgcaccacctcatggtggcgctcaactgcgctatgctcgggatcggcatcacgggcggccagctcctcagtcgcctctactacaacgagggcggccaccggcagtggctcgccgcgtggctccagaccggcggctggccgctgctgctggtccccgtggcggcgtcctacgccggccgccgcgcgcgcgcgcgcggccgtggcgccgcggcagtcctgctcgccccgccgcgcgtcctgctgggcgccgcgggcatcggcctcctcgtcggcgccgacgacttcctctacgcctacgggctggagttcgtgcccgtctccacctccgcgatcctcatctcgacgcagctcgccttcacggtgctcttcgcgttcctcatcgtgcggcagcggctcacgccgccgaccgtgaacgccgtggcgctcctgacgacgggcgccgtcatgctgggcctgcacgtgtcctcggaccgcggcccgggcgtcagcaggggccagtactggctgggcttcgtgctcacgctcggcgccgccgtgctgtacgggctgatcatgccgctcgtcgagctcgcgtacaagcacgccgcggaggccggttccgccctgacgtacgcgctggtggtggagatgcagctggtcatggggttcgtcgccaccgcgttctgcaccgtcggcatgatcgtcaacaacgacttccaggcgatcccgagggaggcgaagcacttcgagctgggggaggcccggtactacacggtgctggcgtggtcggcggtgctgtggcagttcttcttcctgggcgccgtcggggtcatcttctgcgtgcacacgctgctggcgggcatcctcatcgccgtgttcatcccagtcacggaggtggccgccgtcatcttcctgcacgagaagttcagcagcgagaagggggtggcgctggtgctctcgctctggggcctcgcgtcctactcctacggtgagtggagcgaggccagggccaagaagaagacggccgaggccgccgcggaggcccagggcccgtgagagtcgcgtgctttgcgactgtggacgacggtgatgcgagaggctctgttgatctcttccagttgtactccctgtgtgtgttgtgtggtttgtggccgtgtcgatggatggagtcgcgtgagtcgtccccccctgcaactgtgggatggtctgcatttctcagtccagttgagttgggtgatgcaggggtaaatggtagtactttgctgcatggtgcatggaggtgccatagtagtcccgtcccgtacacgaaagtatgaaactgctctcgcgccaattatatttgaagtggtagcaaagcgattcccgcactttgtaacccgatcctgggtattatattgtctgaaaaaatataatttttttgtctcg

SEQ ID NO: 7414 - protein, 361 aa, Panicum virgatum
  misc_feature: Ceres CLONE 1909752
  misc_feature (1)..(153): Pfam Name: TPT Pfam Description: Triose-phosphate Transporter family
MDVEARNESPPPARSKAMHHLMVALNCAMLGIGITGGQLLSRLYYNEGGHRQWLAAWLQTGGWPLLLVPVAASYAGRRARARGRGAAAVLLAPPRVLLGAAGIGLLVGADDFLYAYGLEFVPVSTSAILISTQLAFTVLFAFLIVRQRLTPPTVNAVALLTTGAVMLGLHVSSDRGPGVSRGQYWLGFVLTLGAAVLYGLIMPLVELAYKHAAEAGSALTYALVVEMQLVMGFVATAFCTVGMIVNNDFQAIPREAKHFELGEARYYTVLAWSAVLWQFFFLGAVGVIFCVHTLLAGILIAVFIPVTEVAAVIFLHEKFSSEKGVALVLSLWGLASYSYGEWSEARAKKKTAEAAAEAQGP

SEQ ID NO: 7415 - DNA, 1407 bp, Panicum virgatum
  misc_feature: Ceres CLONE 1909798
  misc_feature: Encodes the peptide sequence at SEQ ID NO. 7416
cgtgagacaggttagttttaccctactgatgaccgtgccgcgatagtaattcaacctagtacgagaggaaccgttgattgacacaattggtcatcgcgcttggttgaaaagccagtggcgcgaagctaccgtgtgtcggattatgactgaacgcctctaagtcagaatccaagctagcaaccggcgcctgtgcccgccgctcgccccgacccacattagggcgttcgcgccccaagggcccgtgccattggctcagtctgcccggccgatgtgccgtggcaggccgcctcgaagctcccttcctcacgggcggcgggctgaatcctttgcagacgacttaaatacgcgacggggcattgtaagtggcagagtggccttgctgccacgatccactgagatccagccccgcgtcgcacggattcgtgcgatccccgtgtccgtgaggaagaaaaaggcgtcgtgctctgggctccgtcgccgccccgctctgcaaggccagcaaccggcagccgccgtcgattacgtgaggagtcggaggggggaggaggggaggggagggcagcgaggcgacgatcgatggagacggtggaggaggacgtagaggagcacagctggcgggaggtggtgctgccgcgcctcgtccccgtggtgcccgacgcgccgccggcgctcgagcgggagaccggggagcggcgacgcggcagggacctcctcgtcgccgtcgacttcggccccaactccaagcacgccttcgactgggcgctcgcgcacatcgcgcgcgtcgccgacacggtccaccttgtccacgccgtctccaatgtgcataatgagattgtgtatgacaaaagtcgggagctaatggaggatctggctattgaggcattcaagactttattggtccgtaccaaggcacgaattgttgaaggggatgttggaaaagtaatatgccgagaagcagaccgactgaagccagcagctgtcattcttggtacacgtggtagaggccttattcaaagtgtgctgcagggaagtgtcagtgagtattgcttccacaactgtaaagcggcaccaattatcattgtgccaggcaaagaagctggtgaacagtctgtgctttgaaggaagataagcgggaggcagtggttgttgtgctttcagtttaggtgtagagtgttgtatattgttgttggtttgttgtgggaacattatttaggtgctttgtttgtaatctgaagttctgaaccctctgtattgtttggctctgaaggaacgtttagaaattgagtgtaacagacaaacatataacaggagaaatgtacttgtattgccattgctgacagaatactccattagtacagttgctacgaataaagaatctttagccacgaaaaaaaaaaaaaaaaaaaa

SEQ ID NO: 7416 - protein, 180 aa, Panicum virgatum
  misc_feature: Ceres CLONE 1909798
  misc_feature (1)..(129): Pfam Name: Usp Pfam Description: Universal stress protein family
METVEEDVEEHSWREVVLPRLVPVVPDAPPALERETGERRRGRDLLVAVDFGPNSKHAFDWALAHIARVADTVHLVHAVSNVHNEIVYDKSRELMEDLAIEAFKTLLVRTKARIVEGDVGKVICREADRLKPAAVILGTRGRGLIQSVLQGSVSEYCFHNCKAAPIIIVPGKEAGEQSVL

SEQ ID NO: 7417 - DNA, 1770 bp, Panicum virgatum
  misc_feature: Ceres CLONE 1909813
  misc_feature: Encodes the peptide sequence at SEQ ID NO. 7418
aaaaaaaaaaaaagcagctcagagctaattgcctccgtttaggcgccgcacccagaccgccccgcggcgcccacgccaagccaagcgcccattttctcgcgcggcgtccgtccgcgcggcgagaaactctccccgcttaacgctccgctccgtcactccggcggcggctgctcggttcgccgccggccgaccaacctctgcgctgggcatcggctgccgggcggcgcgcggccgcgctcggtgctcgcttcgggcgcggcgcctgagcaggctataaataaggacggcgtgcggcgttcaagcagagcagtaggggggggggggggggagatctaggggagggagcgtgatggcgtcaraaatgaacaaraacgtcaaggkcctcgacsagcaggaggtcacctcscaccarcgcggcgaccagggcgtcggcgcccggcccggcggcgcggcggcggargaccaggcccaggcggatcarctggcgcggcaggcgtccatcatgtcgctgacgctggaggagctgcagagctccctctgccagccggggcgcaacttcgggtccatgaacatggaccaattcctggccaacatatggaacccccaggagttccaagccccccccggcgggtgcaagcaggacgcggcggaacaagaggcggcggcgacaggggtgggtgggaacggagggagcgggctggttcccaaggggtcgttcgctctgccgccgccgctgtccctgaagacggtggaggaggtctgggcggaaatcaaccagggcccggcggacgcgggggcccacccggcgccgcaggccgtcttgcagccccaggccgggagcggcggcgtcgccgccaacgggcggcaggtgacgctgggcgagatgaccctggaggacttcctggtcaaggccggcgtcgtgcggggcgccttctccgccgggcacggccaggcggtcggcatggtcccggccgcgccgatgggccacatgccgcaggggcagctcgcggctcccatgatgtaccaggtggcgccggccaacgccgtgttcccggtgatgggcgacggcatggggtaccacaacgggtaccccggggccatggcggtggtgccgccgccgccgccgtcccagtgcgtggcgcccgccgtgagcccggggtcgtcggacgggatgagcgccatgacgaaggcggagatgatgagctgcattggcaacggagggatggtccggaacggcggcggcgcgaggaagcgcgactcccccgaggacggctgcaccgagaagacggtggagcgccggcagcgccgcatgatcaagaaccgcgagtcggcggcccggtcacgagccaggaagcaggcgtataccgtggagctcgaggccgaactgaaccatctcaaggaggagaacgcgcgcctcaaagccgaggagaatacaattctgctgtcgaagaaaaagatgctggtggagaagatgatcgagcaggcgagggagaacgtcagcgccaagaagagcggtcgcgggctgcgccactgcggcagcgccaagtggtgaaatgtgaccagcgcggctcgcattgtgcagagtccaatccgcttgcttccgtcggaagcgctgctgtacctgcaacagcgtcggtagtagcaacgtcgttagtaacagcacgcgatgtgatcgctgtaaaatggttgatgagcacgagctgtgcgttggcctgctgctgtttataagccgtgcgtcgtagtacaaacaataaacccgctgtaaggccc

SEQ ID NO: 7418 - protein, 400 aa, Panicum virgatum
  misc_feature: Ceres CLONE 1909813
  misc_feature (1)..(66): Pfam Name: bZIP_1 Pfam Description: bZIP transcription factor
  misc_feature (1)..(56): Pfam Name: bZIP_2 Pfam Description: Basic region leucine zipper
  misc_feature: The sequence is a functional homolog of  SEQ ID NO 1761 in the  10/374,780 US patent application
  misc_feature: The sequence is a functional homolog of  SEQ ID NO 1762 in the  10/374,780 US patent application
  misc_feature: The sequence is a functional homolog of  SEQ ID NO 338 in the  10/374,780 US patent application
  misc_feature: The sequence is a functional homolog of  SEQ ID NO 770 in the  10/225,066 US patent application
  misc_feature: Useful for making plants with modulated growth and phenotype characteristics
  misc_feature (4)..(4): Xaa is any aa, unknown, or other
  misc_feature (11)..(11): Xaa is any aa, unknown, or other
  misc_feature (14)..(14): Xaa is any aa, unknown, or other
MASXMNKNVKXLDXQEVTSHQRGDQGVGARPGGAAAEDQAQADQLARQASIMSLTLEELQSSLCQPGRNFGSMNMDQFLANIWNPQEFQAPPGGCKQDAAEQEAAATGVGGNGGSGLVPKGSFALPPPLSLKTVEEVWAEINQGPADAGAHPAPQAVLQPQAGSGGVAANGRQVTLGEMTLEDFLVKAGVVRGAFSAGHGQAVGMVPAAPMGHMPQGQLAAPMMYQVAPANAVFPVMGDGMGYHNGYPGAMAVVPPPPPSQCVAPAVSPGSSDGMSAMTKAEMMSCIGNGGMVRNGGGARKRDSPEDGCTEKTVERRQRRMIKNRESAARSRARKQAYTVELEAELNHLKEENARLKAEENTILLSKKKMLVEKMIEQARENVSAKKSGRGLRHCGSAKW

SEQ ID NO: 7419 - DNA, 1534 bp, Panicum virgatum
  misc_feature: Ceres CLONE 1909821
  misc_feature: Encodes the peptide sequence at SEQ ID NO. 7420
aaggaccgaggactgctcatagaagcagctgcctctcactcatagccacatcctctacctcgacggcggtccttcctcctgacctcctcctccaagtccctagaggctagaggttctggattagtttgaacggctgaggaacaacataaagtgctaagtgtctattctaaatactaaaagcaaaaatggaggataatctaccagtcaatgtccgggagtatcaagaactcgccaagaaagcactaccaaagatgcactatgattatatcaatgggggagcggaggatgagtacacactgagggagaatattgcagcatatggaagaattctgttacggccaagggttcttatagatgtcagcaagatagacatgtctacaactttgttaggatataatatgccatcgccaataattgtcgctccaacaggagcacacaaattagcaaatccagagggggaggtggccacagcgcgagcagcagcagcgtgtaagaccgtaatggttctttccttctcatccagctgcaaaatcgaggaggtcgcctccagttgcgacgccattcgcttttatcaattatatgtgtacaagagaagggatgtttcagcaacattggtgcgacgggctgaaagtttaggatttaaggcaattgttctgacagttgacacgcctgtgcttggtaggcgtgaagctgatatcagaaacaagatggttgctccacggatgccaaaccttgaaggcctgatgtcattcgatgatgatcttgacagtgaaggcggctccaagctggaaagattcgcgcatgagacgctggatccatccttgtcatggaaggacgtggagtggctcaagtccataaccagcctgccgatcctgctcaagggcatcgtcaccgccgaggacgccaggaaggccgtggaggttggggcggccggcgtgatcgtgtccaaccacggcgcccggcagctggactacgcgccgcccaccatctccgcgctcgaagaggtggttaaggcggtggcgggggccgtgccggtgctggtggacggcggggtccggcggggcaccgacgtgttcaaggcgctggcgctgggcgccacggcagtcatggtggggaggccggtgttctacgggctggcggcgcgcggggaggccggggcgaggcacgtgatcgagatgctgaaccgggagctggagctggccatggcgctctgcggctgccggagcgtcgccgaggtcaccaggcggcacgtcctgacggagggcgaccggatcagggccctgctgtgagcctgcctttgacccatccagtcagggacggttgcgatgtgagcgcatgcatgtgacattgattgatcgctccaaaaatttaaaccatagtgcattgaaggttggcagaatctgtgctggatcaagctctctgttctgcttctgtgagaacttggtcattgtatcttgggatccacctctggaataacatgagaacatcgtgaggcaaataagcaactttcgaacaaaaaaaaaaaaaaaaaaaa

SEQ ID NO: 7420 - protein, 367 aa, Panicum virgatum
  misc_feature: Ceres CLONE 1909821
  misc_feature (1)..(342): Pfam Name: FMN_dh Pfam Description: FMN-dependent dehydrogenase
  misc_feature (8)..(361): SWISSPROT Homolog: EC 1.1.3.15 Peroxisomal (S)-2-hydroxy-acid oxidase
MEDNLPVNVREYQELAKKALPKMHYDYINGGAEDEYTLRENIAAYGRILLRPRVLIDVSKIDMSTTLLGYNMPSPIIVAPTGAHKLANPEGEVATARAAAACKTVMVLSFSSSCKIEEVASSCDAIRFYQLYVYKRRDVSATLVRRAESLGFKAIVLTVDTPVLGRREADIRNKMVAPRMPNLEGLMSFDDDLDSEGGSKLERFAHETLDPSLSWKDVEWLKSITSLPILLKGIVTAEDARKAVEVGAAGVIVSNHGARQLDYAPPTISALEEVVKAVAGAVPVLVDGGVRRGTDVFKALALGATAVMVGRPVFYGLAARGEAGARHVIEMLNRELELAMALCGCRSVAEVTRRHVLTEGDRIRALL

SEQ ID NO: 7421 - DNA, 1240 bp, Panicum virgatum
  misc_feature: Ceres CLONE 1909845
  misc_feature: Encodes the peptide sequence at SEQ ID NO. 7422
agaagcagccgcgagcttccaccgccttcctcccgtgctttttctcgaccgacgaccagagtcatcagaccatctcagattcacagtcgcagctagcgagagagagagaggagaagggaggacggagtgatagagacgacgacggcggcgatgaggaggtggcgagaggaggtggtggcgctgtcgctgcgcgggtacggctacggcaacgaggatgatgaccggccggagaagcctcggcggtacggggtgacggagatgcggagccctttctactccttccgccccgccaaccaggcgctccaggaaatattggattctcttggtcctttcgttgacggtttgaagttttctggtggatgccatagtttgatgggaaaagaactggtcagagagattactgatttagcccataagcatgacatatacgtgagcacaggtgactgggcagagcatcttttacgtcagggaccctcttctttcaagcaatatgtggaggaatgcaaggccttagggtttgacacaattgagctgaatgctggatctctcaagctccctgaagaagctctcctgagattggtccgcctcatcaagagtagcggtctgagggcaaagccactgttttcggtgaagtttgacagttctgatattcctgcatctggtgatagggcgtttggagcgtacatagctccagtcaaagagcggacctcagaaagaatcgaagatgtggacctgctgattaggagagcagagagatgcttggaggctggggcagatatgatcatgatcgatgctgatgacgtttgccagcatgctgactccctgagggcagacatcgttgcaaagatcataggccggctcgggctcgagaagacaatgttcgaagcttcgaaccccagcacctccgagtggttcgtcaaacgatacggcccaagggtgaatctcttcgtcgaccactcggacgtgatggatctggagcgcctccgggggttcaacatgctcagaagcaacccttcctcccgtttcgcctcaccgttcttcctgatgtaacgagcttttcctgaaacccggaggtgagacgattccagtgtccatggaattgtagttgcgcgccactggccgtgcagcttactatggcctgtgtaacttgttaccagcgaccaatgagctggcatctgctgtgttatcaacaactgctcaaataattggttttgcatagcaaaaaaaaaaaaaaaaaaaa

SEQ ID NO: 7422 - protein, 299 aa, Panicum virgatum
  misc_feature: Ceres CLONE 1909845
  misc_feature: Great-hit functional homolog of the protein sequence given in SEQ ID NO 9680
  misc_feature: Useful for making plants with modulated heat sensitivity
MRRWREEVVALSLRGYGYGNEDDDRPEKPRRYGVTEMRSPFYSFRPANQALQEILDSLGPFVDGLKFSGGCHSLMGKELVREITDLAHKHDIYVSTGDWAEHLLRQGPSSFKQYVEECKALGFDTIELNAGSLKLPEEALLRLVRLIKSSGLRAKPLFSVKFDSSDIPASGDRAFGAYIAPVKERTSERIEDVDLLIRRAERCLEAGADMIMIDADDVCQHADSLRADIVAKIIGRLGLEKTMFEASNPSTSEWFVKRYGPRVNLFVDHSDVMDLERLRGFNMLRSNPSSRFASPFFLM

SEQ ID NO: 7423 - DNA, 1490 bp, Panicum virgatum
  misc_feature: Ceres CLONE 1909872
  misc_feature: Encodes the peptide sequence at SEQ ID NO. 7424
agtcactcgccgtggtcttgtgggtgggttgaggagttgacttacagtagcagacactctggcagctcggcagcaaatcctgatccagttttttaaaaaatgctgataatctcccaccaaatcccaccaaactggtttcaatcccaccattcttgacttcttgtcgccagtcgccccgcgtgggacttcccccgagttgttgggttggcttcgaggctcgagcaggagagagagtgtgtagtgctagctggatcggatcggctgctgctgcggttgccggcggcggcggcggcggcatgagggtgctggtgacgggcgcgacggggtacctgggcggccgcctttgcgcggcgctggccgacgctgggcacgccgtgcgcgcgctcgcccgccgctccagcgacgtctccggcctggcccccggcgttgacattgcgtacggcaacgtcaccgacgcggactccctcgccgccgccttcgacggctgcgacgccgtgttccacgtcgccgcggccgttgagccgtggctccccgacccctccgttttccacaaagttaatgtgagaggactggagaatgtgttgaaggctgccaagagaacaccaactgtgaagaagatagtttacacatcgtcattctttgcaattggaccaactgatggttatgttgcagatgagacacagatgcatccagggaaagccttttgcactgagtatgagaaatcaaagtttcttgcagataggattgcactgcaggcagcaacagagggtgtgccgatcaccattgtctatccaggcgtcatctatggccctggaaaactttcaactggaaaccttgtctcccgcattttaatcgagaggtttaatgggcgtttgcctggttacataggagatgggtatgatagacaatcattctgccatgttgatgatgttgttagtgggctcatagcagctatggagaagggcagagtgggcgaacgatatctcctcactggagaaaatatgtcattcaagcaaattttcaatatggctgctaatatcacaaacacaaaggcacccctattccatgtaccgctctggttgattgaagtatatggctggatttcagtttttgtttctcgcatcaccggaaagctcccacttatcagttacccggctgtgcatgttcttagacatcaatggtcgtactcatgtgacaaagcaaagatggaattgggtagtccaaggaacttaactgagggtctatcggaagtgctcttgtggctcaaggatgaaaaacagataaaattttaatgatccacctttttttctacttctcacctgtaacatttcacatacactgacatgtatctttagatatactgtttatttgctgcgtactttgatgttgcattatggtttatcatatcaaccagaagtaatcatgtaatgctgtattgtgcaataaaggaagaacaaatgcaattttcagaaaaaaaaaaaaaaaaaaaa

SEQ ID NO: 7424 - protein, 331 aa, Panicum virgatum
  misc_feature: Ceres CLONE 1909872
  misc_feature (1)..(239): Pfam Name: Epimerase Pfam Description: NAD dependent epimerase/dehydratase family
MRVLVTGATGYLGGRLCAALADAGHAVRALARRSSDVSGLAPGVDIAYGNVTDADSLAAAFDGCDAVFHVAAAVEPWLPDPSVFHKVNVRGLENVLKAAKRTPTVKKIVYTSSFFAIGPTDGYVADETQMHPGKAFCTEYEKSKFLADRIALQAATEGVPITIVYPGVIYGPGKLSTGNLVSRILIERFNGRLPGYIGDGYDRQSFCHVDDVVSGLIAAMEKGRVGERYLLTGENMSFKQIFNMAANITNTKAPLFHVPLWLIEVYGWISVFVSRITGKLPLISYPAVHVLRHQWSYSCDKAKMELGSPRNLTEGLSEVLLWLKDEKQIKF

SEQ ID NO: 7425 - DNA, 1356 bp, Panicum virgatum
  misc_feature: Ceres CLONE 1909909
  misc_feature: Encodes the peptide sequence at SEQ ID NO. 7426
accaccgcacacaagtgacccacgcgtcgacgaagagagagccccacccgcgcggcgccaaccatggcgtcctctgcgccgccggaccagccgccgcgccccgtgcgcttcggcatcctgggctgcgcctccatcgcgcgcaagctcgcgcgcgccatgctgctggcccccggcgccgccgtggccgccgtggggagccgttccgaggagaaggcccgcctcttcgccgccgacaacggcctcgacgtcgccaccacccgcctccacgggacctacgaggcgctcctcgacgacccggacgtcgacgtcgtctacctcccgctccccaccagcctccacgtgcgctgggccaccgccgccgccgcgcggggcaagcacctgctcctcgagaagcccaccgcgctctgcgccgccgacctcgacgccatcctcgccgcctgcgacgccgcgggggtccagttcatggactcaaccatgtggatgcaccacccgcgcaccgccaagatgcgggagctcgtcgacgacaaggacgccatcggcgacatcagagtcgtaaacagcgtgttttgctttcgagcaaatgaggatttcctccagaatgacatcagggtaaagccagacctcgatgccctgggggcactaggcgatgccgggtggtactgcatccgtgcaatcttgtgggctgttgactacgagctgcccaagaccgtgattgcactgcgtgatcctgtcaagaaccgatctggtgtgctacttgcctgtggtgcgacattgtactgggcggatggcaagaccgccaccttcagcagctcctttctcaccaatctcaccatgtacatcaccctagttggcacaaatggcactctccatgtcactgactttgtcatcccgtatgaagaaaagtctgcagagttcagtgtgtcctcgaagtcaaaccttgctccactcgacatcggatgggatccacttccaagcaagcacgtcgtcacgacggacctgccgcaggaggccctcatggttcaggaattcgcgaggcttgtgcagaacatccgggatgctggtggcaagcctgaggggaagtggccggctatcaccaggaagacgcaggtggtgttggatgcagtgaaagcttcgattgacaaggggtctgagccagttgagattgccaactaaatgacacaaacagctgctcgtcctggtgaaaattctgtacgcaatggcttgcacttgatatatatttactctacttatatgatctatcctacacgagaccattacttgtaataatctgtcaaagaaaacgttgcaacgtatcaagtcagacgtgatttcggataaaaaaaaaaaaaaaaaaaa

SEQ ID NO: 7426 - protein, 369 aa, Panicum virgatum
  misc_feature: Ceres CLONE 1909909
  misc_feature (1)..(114): Pfam Name: GFO_IDH_MocA_C Pfam Description: Oxidoreductase family, C-terminal alpha/beta domain
  misc_feature (1)..(125): Pfam Name: GFO_IDH_MocA Pfam Description: Oxidoreductase family, NAD-binding Rossmann fold
MASSAPPDQPPRPVRFGILGCASIARKLARAMLLAPGAAVAAVGSRSEEKARLFAADNGLDVATTRLHGTYEALLDDPDVDVVYLPLPTSLHVRWATAAAARGKHLLLEKPTALCAADLDAILAACDAAGVQFMDSTMWMHHPRTAKMRELVDDKDAIGDIRVVNSVFCFRANEDFLQNDIRVKPDLDALGALGDAGWYCIRAILWAVDYELPKTVIALRDPVKNRSGVLLACGATLYWADGKTATFSSSFLTNLTMYITLVGTNGTLHVTDFVIPYEEKSAEFSVSSKSNLAPLDIGWDPLPSKHVVTTDLPQEALMVQEFARLVQNIRDAGGKPEGKWPAITRKTQVVLDAVKASIDKGSEPVEIAN

SEQ ID NO: 7427 - DNA, 1343 bp, Panicum virgatum
  misc_feature: Ceres CLONE 1909921
  misc_feature: Encodes the peptide sequence at SEQ ID NO. 7428
gtctctctctctccctctccctctctcccagcggcggcgcgcgcttcaacccgtcgctcctcgcaaccaaccctattccttcagcggcggcgcgccgggcggaacccgaaacgaccaccatggcggggggcaagatccagaagaagcgccacggcgcggcggggggcgcccgactgcagggcgggatcccgttcgagaagtccaaggggcagcacatactgcggaaccccgcgctggtggactccatcgtcgccaaggccgggctcaagcccaccgacaccgtcgtcgagattgggccgggcacagggaacctcaccaagcgcctgcttgaggcgggggtcaaggccgtcgtcgccgtcgagctcgacccgcgcatggtgctcgagctcaaccgtcggttccaggggcacccgctctcctcgcgcctcaaggttatccaaggagatgtcctcaaatgtgatctcccatactttgacatatgcgtggcaaacatcccgtaccagatctcatcaccccttacgttcaagcttctgtcacaccgtccaatctttaggtgtgctgtgatcatgtttcaacgggaattcgccatgagacttgtggcacagcctggagatagtctctactgtcgtctctctgtgaatgtgcagctcttgtctcgagtgtcgcatctcctgaaggttgggaggaacaacttcaggcctccgcccaaggttgattcatcagttgtgcgtatcgagcccaggaagcccctccctcctgtcagcttcaaggagtgggatggacttgtcaggatctgtttcaatcgcaagaacaagaccttgggctccatcttcaagcagaaacgcgtccttgagttgctagagaagaactacaagactatgcagtctctccagcttactcaagatgcagaaatgggtgaggagaagatgtctgcagatgatgttgcattgctagctaatatggttgaagatctgagcatggagactggtgatgagaaggaagatgatgagatggaaatggatgacgcagacatggcgggagaaggtgctgcaagcttcaaagaaaagattatgggtattttgcagcagggtgattttgcagaaaagagaggttctaagctgagccaagttgatttcttatacttgctctctctcttcaacaaagacggtatacatttctcatgatggattcgctaatgggttacctactatgcctactatgatatttacaaattttgcctgtttctttttcttatgcaagttgtataagttacataagacctttaagcttgtgcttatagaaatttttggataggtttctccgaaaaaaaaaaaaaaaaaaaa

SEQ ID NO: 7428 - protein, 354 aa, Panicum virgatum
  misc_feature: Ceres CLONE 1909921
  misc_feature (1)..(254): Pfam Name: RrnaAD Pfam Description: Ribosomal RNA adenine dimethylase
MAGGKIQKKRHGAAGGARLQGGIPFEKSKGQHILRNPALVDSIVAKAGLKPTDTVVEIGPGTGNLTKRLLEAGVKAVVAVELDPRMVLELNRRFQGHPLSSRLKVIQGDVLKCDLPYFDICVANIPYQISSPLTFKLLSHRPIFRCAVIMFQREFAMRLVAQPGDSLYCRLSVNVQLLSRVSHLLKVGRNNFRPPPKVDSSVVRIEPRKPLPPVSFKEWDGLVRICFNRKNKTLGSIFKQKRVLELLEKNYKTMQSLQLTQDAEMGEEKMSADDVALLANMVEDLSMETGDEKEDDEMEMDDADMAGEGAASFKEKIMGILQQGDFAEKRGSKLSQVDFLYLLSLFNKDGIHFS

SEQ ID NO: 7429 - DNA, 1735 bp, Panicum virgatum
  misc_feature: Ceres CLONE 1909961
  misc_feature: Encodes the peptide sequence at SEQ ID NO. 7430
gctggagcaaaaaaccaccgcacgcggcgaacccgaacccccccccccccctcggcccccggccccgaggccgagatcccaacggcgagaactccgcggccctcccatctgcctcgcgcggccgcgaatccggcggtgtctcccctccctgcgcgcccggaccgcggcggcgcggcgtggggcgccgcgccatggggtcggtgtcgctgaacgtggcgtcctcccggcgcggcgggcggcgcggcctggcgtgcctctgctcgcccgcgctgctcaacctcctcgtgctcctctccctcctgtccaccaacctcctcgcgctcctcgccttcctcgccccccgcgcccgcggccccgtccccgccgtcgccgccgaccgctccgcctccacctcctccgccgccatctccgcgcaggtggccgccatcgcgcgggagatcgacgccacccgcctcgtcccgcaccgcgccgccctgcccccggagctgctcctcttcctctccccgcacgcgctcccgctgggccgcgacgcgcgcacggggctcacccacatgccggcctccgtcgcgcacgcctgcttccgctccccgcccacgctcgccctgctcgccgccttcgcctcctacgagccgcgcgccgcgtgcccgcgcaacgccaccctcccgcaccgcctcctctccaagggctgcgagccgctgccccgccgccggtgcctctcccggggcccccgcgcgccgctcccgtcctccaacatgggcgtcgacagccgccgatgggtgaagccgcgccacgaccacgagttcctcatcgacgacgtcctgcggcttgccggcaccgcctccgccaagatccggatcggcttcgacgtcgccggcggcgccgccaacttcgccgcccggatgagggagcgcggggtgaccgtggtcaccacggtgctcgacaacgccgggaagcccatgaacgagttcgtggccgcgaggggcctgttcccgctgctgctctcgccggcgcaccgcttccccttctacgacggggtgttcgacctcgtgcacgtcgggaccaccgcgctggacgaaggcggggcgccggcgctggggcaggcggggacggaggaggcgctggaattcttcatgttcgatgtcgacagggtgcttcgcgccagcgggctgctctggattgacagctacatgtgccacagcgaagagcggaagcaggtggttgtgaggctaattcgaaggtttggctacaagaagctcaagtgggttgcaggagagaaggccggcacggggagctcaaagacggcaatgtacatctctgcggttttgcagaagccgggccggggttgaaatcaaatggatggttttgttttcttcttgatcagatctcagaggaagatgcaacagcttgcagcaggtctggccatccattgctggatttgctgccatgatcaggagcaggaggatcctatgtccattatccagcaaaatacatggagctcaaatcatgaagtcagggcagggaagacgaaagaatactcagttctatgtaaatatgtaatagcttagtttgatatgctttttggggcttgtaatctctaaattcttggcagctgtgtctgtgtgccatcaaaacagaatgtactacactactacatgctgtaaatatgtaacatgtttgtcctactggctactgcaacatacataccttcatgtcttaaaaaaaaaaaaaaaaaaaa

SEQ ID NO: 7430 - protein, 384 aa, Panicum virgatum
  misc_feature: Ceres CLONE 1909961
  misc_feature (1)..(96): Pfam Name: Methyltransf_11 Pfam Description: Methyltransferase domain
MGSVSLNVASSRRGGRRGLACLCSPALLNLLVLLSLLSTNLLALLAFLAPRARGPVPAVAADRSASTSSAAISAQVAAIAREIDATRLVPHRAALPPELLLFLSPHALPLGRDARTGLTHMPASVAHACFRSPPTLALLAAFASYEPRAACPRNATLPHRLLSKGCEPLPRRRCLSRGPRAPLPSSNMGVDSRRWVKPRHDHEFLIDDVLRLAGTASAKIRIGFDVAGGAANFAARMRERGVTVVTTVLDNAGKPMNEFVAARGLFPLLLSPAHRFPFYDGVFDLVHVGTTALDEGGAPALGQAGTEEALEFFMFDVDRVLRASGLLWIDSYMCHSEERKQVVVRLIRRFGYKKLKWVAGEKAGTGSSKTAMYISAVLQKPGRG

SEQ ID NO: 7431 - DNA, 1790 bp, Panicum virgatum
  misc_feature: Ceres CLONE 1910014
  misc_feature: Encodes the peptide sequence at SEQ ID NO. 7432
acactacaccacagatatccaccaagacaactgcattagtgagccatggcttctcctgtcaagagcaggaagctgcgcatcctcctcatgcccttcttcgccactagccacatcggcccattcaccaacttcgccgtccacctcacggctgcgcggccggacatcatcgaggccaccatcgccatcagcacggcgaacgccgcggtcgtacagtcagctcttgcacggcagcagagccccggcagcgtgacagcggtgagggtggcgacgtacccgttcccggtgatggatggcctcccaccgggggtggagaacctctcgaccgtcaaggccgcggatgggtggcggatcgccgtcgccgctttcgacgagaccctgatgaggcccggacaggaaggcctcatcagggagcactcgccggacgtcatcatcaccgacgcgcacttcttctggaacaccgacgtcgccgccgatctcggcgtgccatgcgtcgctttccaagtcatcggaaccttcgcggcgacggccatgacgcacctcagggatattggcatccatggcatcgctgaaggtgtggtggctctgcctcgagctgaaggcggcggcgacatactgatcccgcacacggagctgcctgagttcgtgaggagccagaaaatcatggatggccccgtcatggatcgggtcagctcaagcatggtaaggtgtgccggccgggccgtgaacaccttcttcgacctggagcaagggtactgcgagattttcgcgagcggtataaagacgaagccctcctactttgttgggcccgtctcgttgccgccgccggcggcggcaccggcagtgacagcaggagacagcgcaggagcaggggactcgccgccgtgcatcgaatggctcgacagaatgccacctcgatcggttgtgttcctgtgtttcggcagcttgacccatgtctccgacgcccagctcgtggagctggctctcgggctcgaagcctcggggaagccgttcctgtgggtgatcaggagggatgcgtggtcgccgcccgatgagtggatggatcgcgttggggagaggggcatgctcgtcacgggctgggcgccgcagacgcggatcctggaacaccaggcggtgggggcgttcgtgacccactgcgggtggaactccgtcatggaaacggtgaccgccggcgtgccggcgctgacgtggccgatggacttcgagcagttcatcatcgagcggctgctgaccgaggtcctggcgatcggggagcggctgttcccggagggtgccggggtgcggagcaccaggcctgaagagcacgacgtggtcccggccgaggtcgtggcgcggtcggtggccaagttcatggagcccggaggcggggcagacgcggcgaggagacgggtgaaggagctctccgcccgggctcgtgctgccgtggcggaaggcggctcctctcaccgcgatctgcagcggctgatcgacgacctcgtgcaagcaagaacagagcagcagcaaagtaatagcagcacccaccaaaagactattcctcacagcctctctgctgtggcttgaagttgaagcgagtaagcgactagctggtgccattctgaagcttccgaggttgaagcatgccaacaccagcaaagtactagtttttattgcaataaacttaggattgagtatcttttctggaaaacttattgattactcgttggggttaataatctgaaacccacgtatgctcgtgggtttgaagtttgttgtgttccaaaaaaaaaaaaaaa

SEQ ID NO: 7432 - protein, 510 aa, Panicum virgatum
  misc_feature: Ceres CLONE 1910014
  misc_feature (1)..(125): Pfam Name: UDPGT Pfam Description: UDP-glucoronosyl and UDP-glucosyl transferase
MASPVKSRKLRILLMPFFATSHIGPFTNFAVHLTAARPDIIEATIAISTANAAVVQSALARQQSPGSVTAVRVATYPFPVMDGLPPGVENLSTVKAADGWRIAVAAFDETLMRPGQEGLIREHSPDVIITDAHFFWNTDVAADLGVPCVAFQVIGTFAATAMTHLRDIGIHGIAEGVVALPRAEGGGDILIPHTELPEFVRSQKIMDGPVMDRVSSSMVRCAGRAVNTFFDLEQGYCEIFASGIKTKPSYFVGPVSLPPPAAAPAVTAGDSAGAGDSPPCIEWLDRMPPRSVVFLCFGSLTHVSDAQLVELALGLEASGKPFLWVIRRDAWSPPDEWMDRVGERGMLVTGWAPQTRILEHQAVGAFVTHCGWNSVMETVTAGVPALTWPMDFEQFIIERLLTEVLAIGERLFPEGAGVRSTRPEEHDVVPAEVVARSVAKFMEPGGGADAARRRVKELSARARAAVAEGGSSHRDLQRLIDDLVQARTEQQQSNSSTHQKTIPHSLSAVA

SEQ ID NO: 7433 - DNA, 1698 bp, Panicum virgatum
  misc_feature: Ceres CLONE 1910112
  misc_feature: Encodes the peptide sequence at SEQ ID NO. 7434
agcgaaccatcctccctccccgtccctgattcgcgagaccagcggggcacgagcgccaccgtcctgatcccgccccggctcctacgcagatctccccgccattgccaccgcgcttcccagattcgcacccttctcgccccagatccgaccgcggttctgatttccctagccgacacaggagcggtgctccgggcggcgtgattccggcggtttgattggaaagttttgatcttccgggggtgttcgttcgtttgtttgtcggtggtggtgcgtttggaggtcggcagagatgggcgtcggcggggagaagttccagctggggacggtgggggccctgagcctctcggtggtgtcctccgtctccattgtcatctgcaacaaggcgctcatgagctccctgggcttcaacttcgccactaccttgacaagctggcatctgctggttacattctgctcccttcatgtagcgttatggatgaaattctttgagcataagccttttgattcaagaactgtcatgggttttggagtacttaatggaatctccattgggctcctcaacttgagtcttggcttcaactctgttgggttctaccagatgactaagctggcgatcatcccgtgcactgtcattttagagacacttttcttcaggaagaagttcagccggagtatccagatgtccctttctgtgctccttcttggtgttggtgttgcaacggtcactgatctgcaactaaatgctgtggggtccatactgtccctgctggcaattatcacgacttgcattgctcaaattatgacaaacactattcagaagaagttcaaggtttcgtcaacccaactactctaccagtcttgcccttaccaatcgctaaccctgtttcttattggccccttccttgattgctttttgacgaaccaaaatgtatttgcttttaattacacttctcaagttgtgtttttcattgtgttgtcatgcttgatatctgtctcagtgaacttcagcacttttctcgttattggaaagacatctcctgttacttaccaagtcctgggccatctgaaaacatgtcttgttcttaccttcggatatgttttgcttcacgatccatttagctggagaaacatacttggaatcctaattgcagtagttggcatggtattatattcatatttctgcacagtggagacccagcaaaaaaatgccgaagtctccccacaacaggtgaaagaaagcgaggcagtccctttgatctcagactctttgagcaaagttgaaaatgggggcggtgttgctgacgatgagcctctgaaggtacccatgtagagctcaaagtactcgcgggagtgaaaaattcttccccttatcgatggcatcatacaggattcaatttagtaggcagatagtagggttggaagccaacccaggtgtaatgaatgtttcagttacatttttgggcttcttagcgtcgctgtctatagcggttaatggatctgtttcctaggaggatcttaccttcagagctcgcagatctaccatgaaactagacagcagatattgtatgattgtatctggatatgctccaaatatcttcttactgtaacttccgaagggggcatgccaatatccaaagatagacttcattctttttgtaccaaagatcaagataaccggagttgtgcaagatttggagc

SEQ ID NO: 7434 - protein, 346 aa, Panicum virgatum
  misc_feature: Ceres CLONE 1910112
  misc_feature (1)..(143): Pfam Name: TPT Pfam Description: Triose-phosphate Transporter family
MGVGGEKFQLGTVGALSLSVVSSVSIVICNKALMSSLGFNFATTLTSWHLLVTFCSLHVALWMKFFEHKPFDSRTVMGFGVLNGISIGLLNLSLGFNSVGFYQMTKLAIIPCTVILETLFFRKKFSRSIQMSLSVLLLGVGVATVTDLQLNAVGSILSLLAIITTCIAQIMTNTIQKKFKVSSTQLLYQSCPYQSLTLFLIGPFLDCFLTNQNVFAFNYTSQVVFFIVLSCLISVSVNFSTFLVIGKTSPVTYQVLGHLKTCLVLTFGYVLLHDPFSWRNILGILIAVVGMVLYSYFCTVETQQKNAEVSPQQVKESEAVPLISDSLSKVENGGGVADDEPLKVPM

SEQ ID NO: 7435 - DNA, 1533 bp, Panicum virgatum
  misc_feature: Ceres CLONE 1910136
  misc_feature: Encodes the peptide sequence at SEQ ID NO. 7436
ataacaagcagctcaaccagatcagaaccagagccctcggcagagcccatcccctctgcacatctcgccctctcctccctccattctcgcgccgcgcagtcctccgaccctcctctctagcctgccggagatggtgtcgctgaggtgcaccaccgcgcaccactccctcctcggctcgccgacctgcctcgcgggcccgcgccggcgggcgcgccccgtcgtgcgcgccgccgccgccgtcgaggccggcgcgcaggccaaggtctccctcatccggattgggacgcgcggaagtcagcttgctcttgcacaagcctatgaaactcgagacaaactgaaagcagcacactctgagttagctgaggagggggctattgagattgtcatcataaagaccactggggacattgtgttggacaaacctcttgcagatattggaggaaagggtttattcaccaaggagatagatgaagcactcttgaatggaatgattgacattgcggttcactcaatgaaagatgtcccgacatatcttcccgaaggaacaatattgccctgtaacctcccacgagaggatgtcagagatgcattcataagcttgactgcaaattcacttggagagcttcctgctggtagtataatcggaagtgcttccctgcggagacaatctcagattctacgtagatatccatcactcaaagtagttaacttcagaggaaatgttcagacacggttaaagaaactcgaggcaggaggtgtccatgctacattgttggcactggctggactaaagcggctaaatgtggcagaaagtgcaacatctttattatcagtggatgaaatgctccctgcagttgcccaaggtgctattggaatagcttgccgaagcaatgatgacaaaatgatggagtatttgtcctcattgaaccatgaagataccagattagctgtttcatgtgaaaaagaattctcggcggttcttgatggtaactgccgaactccaattgcggcctatgcttatcgtgataaggatgggaattgctcattccgaggtctattggcctcacctgatggatctaaagtatacgagaccgcaagaagtggaccgtactcttttgatgacatggttgctatgggcaaagatgctggtcatgagctgaaggcaaaggctggccctgacttctttgatcacttgcaacacttgcaatgaaaagagaaggtgcactttcagttggcactcttttgattagaaacagacggcccacgtagagtgttgagagatttgtttctgttttattctttctcctagttctgctagagcggtagagtcttgtaccagatgttgagctaccccatccaaacatgtaccgcctgttcttttagcactccgggttagaacatgaacgtccacggttttgtaatccccgtcaaagaggtatctgcgcagctatattataacattgcaaacggatgtaactttgcagatagtttgttgaaagttgagttctgaagcaaaaaaaaaaaaaaaaaaaa

SEQ ID NO: 7436 - protein, 359 aa, Panicum virgatum
  misc_feature: Ceres CLONE 1910136
  misc_feature (1)..(217): Pfam Name: Porphobil_deam Pfam Description: Porphobilinogen deaminase, dipyromethane cofactor binding domain
  misc_feature (31)..(353): SWISSPROT Homolog: EC 2.5.1.61 Porphobilinogen deaminase, chloroplast precursor
MVSLRCTTAHHSLLGSPTCLAGPRRRARPVVRAAAAVEAGAQAKVSLIRIGTRGSQLALAQAYETRDKLKAAHSELAEEGAIEIVIIKTTGDIVLDKPLADIGGKGLFTKEIDEALLNGMIDIAVHSMKDVPTYLPEGTILPCNLPREDVRDAFISLTANSLGELPAGSIIGSASLRRQSQILRRYPSLKVVNFRGNVQTRLKKLEAGGVHATLLALAGLKRLNVAESATSLLSVDEMLPAVAQGAIGIACRSNDDKMMEYLSSLNHEDTRLAVSCEKEFSAVLDGNCRTPIAAYAYRDKDGNCSFRGLLASPDGSKVYETARSGPYSFDDMVAMGKDAGHELKAKAGPDFFDHLQHLQ

SEQ ID NO: 7437 - DNA, 2018 bp, Panicum virgatum
  misc_feature: Ceres CLONE 1910292
  misc_feature: Encodes the peptide sequence at SEQ ID NO. 7438
aatcgtgcgcgaaggaaaaccagcttatttatagaattttattatatcttgaaggttgaagatccatttgaccaacaagaacgcaaaaagtgcccaaatcgcaatcctcctgctgcagtaataaagcacatagcataatgtaatccaggcaagcaagaccacaggtttgatctgagacttttttttaaaggactgggaaaagagcgactttattaacgcaaaaccgcagctgtgggcggcggccgtccgttctcctcccgcagttcgactcgctttccggcgggcgactggcgtgcgcctcttttgcttttgcttccgtccgcagttccgcctgccgctcttctttataagcaccaaccgtgtggccttgccgccccgagtcgccacgaaaccgcagggtcctgttgtccccgctgagacgcgatccagcccactgccgccatggcccccagcgtcgccgtggagaacctcaaccccaaggtcttaaaatgtgaatatgcagtacgtggggagattgtcattcatgctcagcgcttgcagcaacagctacaaactcaaccagggtctcttccttttgatgagatcctctactgcaacattgggaatcctcaatctcttggtcagcaaccagtgacattcttcagggagattcttgctctttgtgatcatccatccttgttggaaaaagaggagactaagtcattgttcagtgctgatgctatttctcgagcaaagcggattctttctagtattccaggaagagcaacaggtgcatacagtcacagccagggtatcaaaggacttcgtgatgcaattgctgctgggattgcgttacgtgatggattccctgcaaatgcagatgacattttcgtaactgacggcgcaagtcctggggtgcacatgatgatgcaattactgttaagggatgagaaagatggcattctgtgcccaattcctcagtaccctctgtactcagcctccatagctcttcatggtggaactcttatcccctattaccttgatgaaaaaaccgggtggggtttggagatctctgaacttaagaagcaactcgaagatgctcggtcaaaaggcattgacgttagggccttggtggttatcaatcctggaaatccaactgggcaggttcttgctgaggacaaccaatgtgacatagtgagattctgcaaaaatgagggccttgttcttctagctgatgaggtatatcaagagaacatctatgttgatgacaagaaatttaactctttcaagaagatagcaagatccattggatatggcgaggatgatctccctctagtatcatttcagtctgtttctaaaggatattatggtgagtgtggtaaaagaggaggctacatggagattactggcttcagtgcttccgtaagagagcaggtctacaagatagcttcggtgaacttatgctccaatatcactggtcaaatccttgccagccttatcatgaatccaccaaaggaaggggatgaatcatatgctgcctacaaggcagagaaagatggaatccttcaatctctagctcgtcgtgcaaaggcattggaggatgcattcaacaatcttgagggaatttcgtgtaacaaggctgaaggagcaatgtaccttttccctcagattcatctgccacagaaggcaattgaggctgctaaagcagctaagaaagcacctgatgcattctatgcgcttcgtctccttgaagcaactggaattgttgtggtccctggatccgggtttggccaagttcccggaacatggcatatcaggtgcacgatcctgccgcaggaagacaagatccccgccgtgatcacccgcttcaaggcgttccatgaggcgttcatggccgagtaccgcgactaagctgttacaccatgtgaatgaacatggggtcatgtaatttatttttttgtaatatcagtctgtaatttgaactcgaactctcctgcttcttcccttatatgaaagcgcagtgctcctgcaaacttttc

SEQ ID NO: 7438 - protein, 482 aa, Panicum virgatum
  misc_feature: Ceres CLONE 1910292
  misc_feature: Great-hit functional homolog of the protein sequence encoded by LOCUS At1g72330
  misc_feature (1)..(304): Pfam Name: Aminotran_1_2 Pfam Description: Aminotransferase class I and II
  misc_feature (1)..(357): Pfam Name: Aminotran_1_2 Pfam Description: Aminotransferase class I and II
  misc_feature (1)..(358): Pfam Name: Aminotran_1_2 Pfam Description: Aminotransferase class I and II
  misc_feature (1)..(358): Pfam Name: Aminotran_1_2 Pfam Description: Aminotransferase class I and II
  misc_feature (1)..(357): Pfam Name: Aminotran_1_2 Pfam Description: Aminotransferase class I and II
  misc_feature (3)..(331): Pfam Name: Aminotran_1_2 Pfam Description: Aminotransferase class I and II
  misc_feature (1)..(329): Pfam Name: Aminotran_1_2 Pfam Description: Aminotransferase class I and II
  misc_feature (1)..(308): Pfam Name: Aminotran_1_2 Pfam Description: Aminotransferase class I and II
  misc_feature (1)..(358): Pfam Name: Aminotran_1_2 Pfam Description: Aminotransferase class I and II
  misc_feature (1)..(329): Pfam Name: Aminotran_1_2 Pfam Description: Aminotransferase class I and II
  misc_feature (1)..(482): SWISSPROT Homolog: EC 2.6.1.2 Alanine aminotransferase 2
  misc_feature: Useful for making plants with modulated nitrogen use efficiency
MAPSVAVENLNPKVLKCEYAVRGEIVIHAQRLQQQLQTQPGSLPFDEILYCNIGNPQSLGQQPVTFFREILALCDHPSLLEKEETKSLFSADAISRAKRILSSIPGRATGAYSHSQGIKGLRDAIAAGIALRDGFPANADDIFVTDGASPGVHMMMQLLLRDEKDGILCPIPQYPLYSASIALHGGTLIPYYLDEKTGWGLEISELKKQLEDARSKGIDVRALVVINPGNPTGQVLAEDNQCDIVRFCKNEGLVLLADEVYQENIYVDDKKFNSFKKIARSIGYGEDDLPLVSFQSVSKGYYGECGKRGGYMEITGFSASVREQVYKIASVNLCSNITGQILASLIMNPPKEGDESYAAYKAEKDGILQSLARRAKALEDAFNNLEGISCNKAEGAMYLFPQIHLPQKAIEAAKAAKKAPDAFYALRLLEATGIVVVPGSGFGQVPGTWHIRCTILPQEDKIPAVITRFKAFHEAFMAEYRD

SEQ ID NO: 7439 - DNA, 2676 bp, Panicum virgatum
  misc_feature: Ceres CLONE 1910410
  misc_feature: Encodes the peptide sequence at SEQ ID NO. 7440
gaactgtggaaggcgaagttgtcttgcccaagcgagctgagtgggaggcggaggtgcggccatggcgcacctgctgctgcacggcaccctcgacgccaccatcctcgaggccgacaacctcgccaaccccacccgcgccaccggcggcgcccccggcatcttccgcaagttcgtggaggggttcgaggattcgctcgggctcgggcagggcgcgacgcggctgtacgcgacggtggacatcggccgggcgcgcgtgggccggacgcgggtcatcgccggggaccccgtgaacccgcgctggtacgaggcgttccacatctactgcgcgcacttcgccgccgacgtcgtcttctccgtcaaggcggcgcagcccatcggcgccacgctcatcggccgcgcctacctccccgtccgggacctcctcgccggccaggaggtcgaccgctggctcgacatccacgacgccgcccggaagccgctccgccacgggcccaagatacgggtgcgcctccggttccaggacgtggccgccgacccccgcgggtggggccgcggcgtcggcggcgcgcgctaccccggcgtgccctacaccttcttctcgcagcggcccgggtgcagggtcacgctgtaccaggacgcgcacgtgccggacgcgttcgcgcccaggatcccgctcgccggcggccgcctctaccagccgggcaggtgctgggaggacgtgttcgacgccatcagcaacgcgcgccatctcatctacatcaccgggtggtccgtctacaccgagatcacgctgctgcgggacggcgcgcgcccgcgccccggcggcgacgccaccctcggcgaactcctcaagcgcaaggccagcgagggcgtgcgcgtgctcatgctcgtgtgggacgaccgcacctccgtcgagtccctcggcatgaagtgggggttcatgagtacgcacgacgccgagacggccgagtacttccgcggcaccgacgtgcgctgcgtcctctgcccccgcaaccccgacgccggcagcagcgccgtcatgggcgcgcagatctcctacatgatcacccaccaccagaagatcgtggtcgtcgaccacgaaatgccggcaaagcacagcgaccgccgccgcatcgtcagcttcgtcggtggcctcgacctctgcgacggccgctacgacacgcagttccactccctgttccggactctggacacggcgcaccacaaggatttccaccagcccaacctcgcgggtgcgtccattgaaaatggcgggcccagagagccatggcacgacatccactccaagatcgaaggccctgccgcgtgggacgtgctctacaactttgagcagcggtggaggaagcaaggaggtggcatcgatctcctcgtcgacctcaaagctatggcagacctgatcataccgccatcgccagtgatgttccccgaagaccaggagacatggaacgtgcaactcttccggtccattgatggcggcgcatgctctggtttccctaataccccagagggcgcggctcaatctggtcttgtcacaggcaagaacaatgtccttgacaggagcatccaggatgcctacatccatgccatacgccgggccaagcacttcatctacatcgagaaccagtacttcctaggcagctcattcaggtggaaagccgacggcataaaaccagaggatattgaagcactgcatctgatccccaaagagctttcactgaagattgtgagcaagattgaggctggtgagcattttgcggtctatgtcgtgctgccaatgtggccagaaggtcctcctgctggtggatccgtgcaggcaatacttgactggcagaggcggacgatggagatgatgtactatgacatttctgttgcacttgaggcgaagaggatcgacgcaaatccaagggattaccttacattcttctgcttggggaacagggaggtgaaactgagtggcgagtatgaatctgcaggccgtccattggatgggacagactatgctcgggcacagaatgcacggcgcttcatgatctatgttcactccaagatgatgatagtcgacgacgaatacatcatcgttggatctgccaacatcaaccagcgctcaatggacgggggtagggactcagagatcgccatgggcgcataccagccatgccacctgaacaccaaagatcaggtcgcccgagggcaggtccatggcttccggatgtctctgtggtacgagcaccttggcatgctgcacgatgatttcctcaatccggacagcctgaagtgcgttcagagggtgaccgagatggctgacaagtactgggacctctacgccagtgacaacctcgacgccgacctccctgggcacctgctcaggtacccggtcaacatcacaaaggaaggcacagttacagagctccctggagcaaaatacttccctgacacaatggcgacggtgctcgggatgaaatctaagaacctgcctcctattctcactacttagagaaatgtttctttttctttaggaggtgcaagtttgctatcttctgaactgttcactactgcctcctggacatagttccagggtggaatgctgaattggctgctcagctcatttgaagtctgaacatttctgggtcaaaacaaaaaaaaaaaaaaaaaaaa

SEQ ID NO: 7440 - protein, 817 aa, Panicum virgatum
  misc_feature: Ceres CLONE 1910410
  misc_feature (2)..(39): Pfam Name: PLDc Pfam Description: Phospholipase D Active site motif
  misc_feature (1)..(817): SWISSPROT Homolog: EC 3.1.4.4 Phospholipase D alpha 1
  misc_feature (1)..(817): SWISSPROT Homolog: EC 3.1.4.4 Phospholipase D alpha 2
MAHLLLHGTLDATILEADNLANPTRATGGAPGIFRKFVEGFEDSLGLGQGATRLYATVDIGRARVGRTRVIAGDPVNPRWYEAFHIYCAHFAADVVFSVKAAQPIGATLIGRAYLPVRDLLAGQEVDRWLDIHDAARKPLRHGPKIRVRLRFQDVAADPRGWGRGVGGARYPGVPYTFFSQRPGCRVTLYQDAHVPDAFAPRIPLAGGRLYQPGRCWEDVFDAISNARHLIYITGWSVYTEITLLRDGARPRPGGDATLGELLKRKASEGVRVLMLVWDDRTSVESLGMKWGFMSTHDAETAEYFRGTDVRCVLCPRNPDAGSSAVMGAQISYMITHHQKIVVVDHEMPAKHSDRRRIVSFVGGLDLCDGRYDTQFHSLFRTLDTAHHKDFHQPNLAGASIENGGPREPWHDIHSKIEGPAAWDVLYNFEQRWRKQGGGIDLLVDLKAMADLIIPPSPVMFPEDQETWNVQLFRSIDGGACSGFPNTPEGAAQSGLVTGKNNVLDRSIQDAYIHAIRRAKHFIYIENQYFLGSSFRWKADGIKPEDIEALHLIPKELSLKIVSKIEAGEHFAVYVVLPMWPEGPPAGGSVQAILDWQRRTMEMMYYDISVALEAKRIDANPRDYLTFFCLGNREVKLSGEYESAGRPLDGTDYARAQNARRFMIYVHSKMMIVDDEYIIVGSANINQRSMDGGRDSEIAMGAYQPCHLNTKDQVARGQVHGFRMSLWYEHLGMLHDDFLNPDSLKCVQRVTEMADKYWDLYASDNLDADLPGHLLRYPVNITKEGTVTELPGAKYFPDTMATVLGMKSKNLPPILTT

SEQ ID NO: 7441 - DNA, 672 bp, Panicum virgatum
  misc_feature: Ceres CLONE 1910425
  misc_feature: Encodes the peptide sequence at SEQ ID NO. 7442
atcctcacatgtgcgcacttccaacctccctagctcggccagctgactcttcggcctcgtcgtatccatcgcctccgattccctggcgtttgcttcctccctgggaagtcatagctagctgctcgccctgtctaggtgaggagcgacgagctgagggtacgccgaatcacggtcgggatgaagagccggaggcagagcagcgggggcagctcgggcggcgcgacggccgctggggtggggaacacgcacagcagcggcggcgggtgcaagctggagaggaaggacgtggagaagaaccggcggctgcacatgaagggcctctgcctcaagctctcctccctcatcccgcccgccgccaggcgcgcgtccctgctctcggaggcggcggcgtccgcgtccaaccccaacaaggtgagaccctccgatcctctgctgcctcgattcctccccttctgtcgctcggccccatccgagccagcggatttctgcagtaatggcgtcctcggctcctctcccggcacacggcgtgtactacgcccatttccccctcccagatctagaactagcctcatgtctcagtctatccagcttgccaaaactaaaagaagaaaaatggagaagaacaagaaggcagctgaataatactaaatctgagctagaaatggggaggtg

SEQ ID NO: 7442 - protein, 154 aa, Panicum virgatum
  misc_feature: Ceres CLONE 1910425
  misc_feature (2)..(47): Pfam Name: HLH Pfam Description: Helix-loop-helix DNA-binding domain
MKSRRQSSGGSSGGATAAGVGNTHSSGGGCKLERKDVEKNRRLHMKGLCLKLSSLIPPAARRASLLSEAAASASNPNKVRPSDPLLPRFLPFCRSAPSEPADFCSNGVLGSSPGTRRVLRPFPPPRSRTSLMSQSIQLAKTKRRKMEKNKKAAE

SEQ ID NO: 7443 - DNA, 2194 bp, Panicum virgatum
  misc_feature: Ceres CLONE 1910448
  misc_feature: Encodes the peptide sequence at SEQ ID NO. 7444
aaagctttcaagtccctcggcaccgcatctgtctctcgccctccgccggctccccgcccctctacggctgtagcccttcccgagggcgatttcggagggagaggctcggtgatctcgtctctcgtggccggagaggatggatagcctcaggaggttcctaaacccgctggtgctcaacctgcagaagatggagctggagctcacctgccccgtctgcatgaagttgctcagcgcgcctacaatgctaccgtgccaccacacatcatgcagcaactgtgctgccacacggacttcgaatggttatagctgtgccatttgcaaatcggcatatcgttgtcaggatttaaggccagcttctcaccttgaggcgatagtgggcattctcaggagcctccgttctacagtcagcaccatgattctggaacaggatgctcaacttcacattcctgttgcaaagacagcatcccatggaacaccagaatcagggaataaaagtggggtagagaaatctgaccagatgaaatcttacaaccctgtcacttcaaagttagtatataaccaatcgactggacctgcgtttgggaacatggagggtgttcaaacaagagatactgcatttgagaacaaagctgctgatgcagctgttgcaccaacagtccttgtccaaaaggggcattctgggtcacaatcttctgatggccctggggatttggattgtgatagcaataatcttgaaggagaactgataacaagcaggtcacctcttcaaactgcactgaaaagagaggcaaatgtaatggatgaacataccagagaattgaagaagcaaaaatcaaacgatcaggttcaaagacaaacaaccatggccagtgcttggaaatgtgaattttgtcattcttcccaagtcactgagtgtactggccctttgtcgcattatctacatggggagccattacaggctgaccaagcttggaaatcaaatgttcagcatgtccatgagaaatgcattgaatgggctcctcaagcattcttcactggtgatattgcaaacaacttggagcctgagttggcccgtgcttctaagattaagtgtagtgtttgtggcttgaaaggtgcggcacttggctgccttgtgaagagctgccgcaagagctttcatgtcccatgtgcccacaggatcaaaggctgcagatgggatgaagaaaactttgttatgctttgttctactcattcttcaaaaaggttaccttgtgaaagatcaaagtcaaaaaagaagacccagctacagcaaccgtcatctgatactgatgatctgaattcaccttctccaatgcaaagcaatgaattttggactgccccacctgttatgactagtgaatgggtgatatgtggatctgccctcagtggccatgagagggaaatcttggacaaatttgagcatcgaactggcatcacagtaactaacagttggagctcaaatgtgactcatgtgattgctaatactgatgaacgtggagcttgttctaggacactcaaagttctcatggctattttagctgggaaatgggttctcaatgtaaattggctgaaggcctgtattgaggctagagaaccagtcccagaagagccctatgaggtcaggtgtgatgttcatggctctttcgatggcccccgcacaggaaggcttcgagcgatacaccaggcaccaagtctgtttgctgggttgaccttctatttcagtggccatttcatgccagcatacaagattaaccttgaagatttgattgcggcagcaggggggtcgattttggagaagagcgagctttctagtacatcattgattctctacagcgtagagccaccacaagggaacaatctagacacccttaatgagatcatcaaaaagagagaagctgaggctgaagaattggcagccacagttggctgcaaagttattcctcatacgtggcttctggattctattgcatcctgcacaatccttagttgactgcgtgacactgtacttaggttcaaacataggaatgtagttgctgctacttcctttttccgttcttaaaaaaaggagattagaatgtggttgacgtgatccaaaatatcttcagggttctgatgttgtaacatgcgtgtgcaactcaattcgaataaacttgcccaaaaaaaaaaaaaaaaaaaa

SEQ ID NO: 7444 - protein, 623 aa, Panicum virgatum
  misc_feature: Ceres CLONE 1910448
  misc_feature (1)..(38): Pfam Name: zf-C3HC4 Pfam Description: Zinc finger, C3HC4 type (RING finger)
MDSLRRFLNPLVLNLQKMELELTCPVCMKLLSAPTMLPCHHTSCSNCAATRTSNGYSCAICKSAYRCQDLRPASHLEAIVGILRSLRSTVSTMILEQDAQLHIPVAKTASHGTPESGNKSGVEKSDQMKSYNPVTSKLVYNQSTGPAFGNMEGVQTRDTAFENKAADAAVAPTVLVQKGHSGSQSSDGPGDLDCDSNNLEGELITSRSPLQTALKREANVMDEHTRELKKQKSNDQVQRQTTMASAWKCEFCHSSQVTECTGPLSHYLHGEPLQADQAWKSNVQHVHEKCIEWAPQAFFTGDIANNLEPELARASKIKCSVCGLKGAALGCLVKSCRKSFHVPCAHRIKGCRWDEENFVMLCSTHSSKRLPCERSKSKKKTQLQQPSSDTDDLNSPSPMQSNEFWTAPPVMTSEWVICGSALSGHEREILDKFEHRTGITVTNSWSSNVTHVIANTDERGACSRTLKVLMAILAGKWVLNVNWLKACIEAREPVPEEPYEVRCDVHGSFDGPRTGRLRAIHQAPSLFAGLTFYFSGHFMPAYKINLEDLIAAAGGSILEKSELSSTSLILYSVEPPQGNNLDTLNEIIKKREAEAEELAATVGCKVIPHTWLLDSIASCTILS

SEQ ID NO: 7445 - DNA, 1601 bp, Panicum virgatum
  misc_feature: Ceres CLONE 1910459
  misc_feature: Encodes the peptide sequence at SEQ ID NO. 7446
gtcccttgcaccattcgtgccggcccaaaggatcttgcttggcacgtccatggcgcccgcggaggagcccactgccgccactctagcgccgccgcctcacttcgttatcatccccctcgcggcgcagggccacaccatccccatggtcgacttcgcccgcctcctcgccgagcgcggcgcgcgcgcgagcatcgtcacgacgccggtgaacggcgcccggctgcgcggcgtcgctgaccaggccgcgcgcgccaagctcgcgctggaggtcgtcgagctcccgttcccgacgggcgtcgacggcctgccgccgggcatcgagaacgcggaccaggtcacggacgacaaccacttcatccccttgttcgacgccctgaagaggctcgccgggcccctcgaggcctacctgcgagggctggcggcgcgcccgagctgcgtcgtctccgactggtgcaacggctggacggccggcgtggccacaagcctcggcatcccccggctcttcttccacgggccgtcctgcttctactcgctctgcgacctcaactccgtcgaccacggactgcgcgagcataccgcggcggcgggtgaccaggacaagttcgtcgtgccggggatgccggtgcgcgtggaggtgaccaaggccacggcgccgggcttcttcaacgcgcccgggtgggaggcgctctgggccgagtgcgtcgaggccatgcgcgcggccgacggcgcggtggtgaacacgttcctggacctcgagggccagttcgtggcgtgctacgaggcggcgctcggcaagcccgtctgggcgctagggccgctctgcctcgccaacaagggcgacgccgaggccatggcggcgcgcgggaacaaggccgaggccgcccagcagagcgcggtcaccgcgtggctcgacgccaaggacgccggctccgtcgtgttcgtcagcttcggcagcctcgtgcggaagctcctgaggctgccgctcgaggtcggccacgggctcgaggactccggcaggccgttcctctgggtggtgaaggaggccgaggcggcggcgccggaggtgcaggggtggctggcggcgctggaggcgcgcacggcggggcgcgggctcgtggcgcgcgggtgggtgccgcagctcgccgtgctgtcgcaccgcgccgtcggcgggttcgtgacccactgcgggtggaactcgctgctggaggccgtcgcgcacggcgtgccggtggtgacgtggccgcacttcgccgaccagttcctgaacgagcggctggtggtggacgtgctcggcgtgggcgtgccgatcggcgcgacggcgccggtgatgatgttcgacgacgagaacatgccggtgggccgcgaggacgtcgcgcgggccgtggcggcgctaatgggcggaggggcggaggcggacgagaggaggaggaaggccagggagtacggggagaaagctcacagggccatggagaaaggagggtcctcgtacgagaacctgacgcagctcatagaaagcttcaggcaacgtggtggcaaacaaggctaagctcgaactgtgcatggagtgcgtcgaaaaaacagaaaaaaaaaaaaaaaaaaaa

SEQ ID NO: 7446 - protein, 498 aa, Panicum virgatum
  misc_feature: Ceres CLONE 1910459
  misc_feature (1)..(113): Pfam Name: UDPGT Pfam Description: UDP-glucoronosyl and UDP-glucosyl transferase
MAPAEEPTAATLAPPPHFVIIPLAAQGHTIPMVDFARLLAERGARASIVTTPVNGARLRGVADQAARAKLALEVVELPFPTGVDGLPPGIENADQVTDDNHFIPLFDALKRLAGPLEAYLRGLAARPSCVVSDWCNGWTAGVATSLGIPRLFFHGPSCFYSLCDLNSVDHGLREHTAAAGDQDKFVVPGMPVRVEVTKATAPGFFNAPGWEALWAECVEAMRAADGAVVNTFLDLEGQFVACYEAALGKPVWALGPLCLANKGDAEAMAARGNKAEAAQQSAVTAWLDAKDAGSVVFVSFGSLVRKLLRLPLEVGHGLEDSGRPFLWVVKEAEAAAPEVQGWLAALEARTAGRGLVARGWVPQLAVLSHRAVGGFVTHCGWNSLLEAVAHGVPVVTWPHFADQFLNERLVVDVLGVGVPIGATAPVMMFDDENMPVGREDVARAVAALMGGGAEADERRRKAREYGEKAHRAMEKGGSSYENLTQLIESFRQRGGKQG

SEQ ID NO: 7447 - DNA, 1724 bp, Panicum virgatum
  misc_feature: Ceres CLONE 1910498
  misc_feature: Encodes the peptide sequence at SEQ ID NO. 7448
agtaaccgcgtcccccatccgacaggctacagcgccccaacccctctcctgcacagccccccttccccgtcttctgctctgccggtcgcagccgtcttctgctctgctggtcgcagcagggctccactccccgccgggcatggcgcgcgccccgagcaccccgtcgctgctgctggcgctactcgtggcggcggcggcggcggtgaccgcgtcggaggcgtccagggcccccgctgccatcggcaactggacggaggagctgcgcggcgccgtgaggcgggcccggcacgggcgcgggtacgcgtggcgctcgcggtcgcggtcgcggcggcgcatgttcgagaacggcctcggccggacgccgcagatggggtggaatagctggaaccacttcggctgcgggatcaacgaggacctcatcaagcagacagctgatgcactggtcaacactggtctggcaaaactgggctacgaatatgttaatatagatgattgctgggcagaatctgacagggactaccagggtaactttgttgcaaatagacaaaccttcccctctggcatcaaggcactagcggattatgtgcatgcaaaagggctgaagcttggaatctacagtgatgctgggacacggacgtgcagtcaaaaaatgccaggatcacttgatcatgaagaacaggatgtaaaaacattctcatcttggggtattgattatctgaaatatgataactgtaatgatgctggcaggagtgtaatggagagatatactaaaatgagcaatgccatgaagacctatggaaagaacatcttcttctcgttgtgtgaatggggaagagaaaatcctgctacctgggcaggcagcatgggcaacagctggagaacaactgatgatatcgctgacaactggggcagcatgacatctcgtgcagaccagaatgaccgatgggcctcctatgccggacctggtggatggaacgatcctgacatgcttgaagtgggcaacggtggtatgtctgaggcggagtaccgctcccacttcagcatctggacacttgccaaggctcctcttctgatcgggtgcgatgtacgctcaatgagccagcagacgaaggacatactcagcaactgggaagtcattgctgtcaaccaagatagtctaggcgtccaaggaaagaaagtgcaatccaacaatggcttagaggtatgggctgggccgctcagcaacaacaggaaggctgtggttctctggaaccggcagggctaccaggcaaccatcaccgctcaatggtcaagcatcgggctcgcttcatccactgctgtcactgctcgcgatctatgggcgcattcgtcgttctcagctcagggccaattatcagcttcagtggcacctcatgactgcaagatgtatgttctgacgccaaagtaacttatggaagaacgagtccgtagcgtgggatgcagccattcaatcaggattcagaaaaaagtgtatgcacgcaaggatccttaagagttaagagaaggaaatgagatctcatttggctatacaaggcaagagagattcgagaaaaattcaaggcaagagtgttatgcagaaataatctgtaagtgtatttaaggcgccgtcaaatgtcgacgcattactgaaaatgtttgtcacaaaagttgcagcagtaataaattggcttgcccaccactatccccaaaaaaaaaaaaaaaaaaaa

SEQ ID NO: 7448 - protein, 428 aa, Panicum virgatum
  misc_feature: Ceres CLONE 1910498
  misc_feature (4)..(427): SWISSPROT Homolog: EC 3.2.1.22 Alpha-galactosidase precursor
  misc_feature (63)..(428): SWISSPROT Homolog: EC 3.2.1.22 Alpha-galactosidase precursor
MARAPSTPSLLLALLVAAAAAVTASEASRAPAAIGNWTEELRGAVRRARHGRGYAWRSRSRSRRRMFENGLGRTPQMGWNSWNHFGCGINEDLIKQTADALVNTGLAKLGYEYVNIDDCWAESDRDYQGNFVANRQTFPSGIKALADYVHAKGLKLGIYSDAGTRTCSQKMPGSLDHEEQDVKTFSSWGIDYLKYDNCNDAGRSVMERYTKMSNAMKTYGKNIFFSLCEWGRENPATWAGSMGNSWRTTDDIADNWGSMTSRADQNDRWASYAGPGGWNDPDMLEVGNGGMSEAEYRSHFSIWTLAKAPLLIGCDVRSMSQQTKDILSNWEVIAVNQDSLGVQGKKVQSNNGLEVWAGPLSNNRKAVVLWNRQGYQATITAQWSSIGLASSTAVTARDLWAHSSFSAQGQLSASVAPHDCKMYVLTPK

SEQ ID NO: 7449 - DNA, 2267 bp, Panicum virgatum
  misc_feature: Ceres CLONE 1910570
  misc_feature: Encodes the peptide sequence at SEQ ID NO. 7450
atcgagtcgagtcgagtcgaggaatcgtctcatcctcaacgcggtctcaatgggcaccaccacctgctgctcataagcaggaagcatccaggggtcgagtggaaggagaagaggagacgaccgcatccagattccagagttcagagagagcaaaacaaagcaagatggggagctacgcgtacaagtactgtatgtgcttcacccgcaagttccgatcccccgacgcgcagccgccgcccgacgtccgcgccgcccacctctcctactgctgcgccccttcttcttcttctgatccccagcaccagcaggggcaggggcatgcccatggcctccgccgcttcctctcccaagtccaggccgagtcacccgccgacgtcgaccgcatcctcgccatcctcgcgcccacttccgcggctcacggaatcgcccgcctcgtccacaggtcgccggcgccggcgccgcccacgctcgatgacttcttcggattcctcttctccgccgatctcaacccgccaatcactaaccaggttcaccaggacatgtcagccccgttctctcattatttcatattcactggccataattcctaccttaccgggaaccagctcaatagtgactccagtgacatcccaattataaaatcactacagagaggtgttagagtcattgagcttgatatgtggccaaattcttcaaagaacaatgttgatattcttcatggagggacattgactgcccctgtagaaatgatcagatgtttaaaatcaattaaagaatatgccttttgtgcgtccaattatcctcttgttattactcttgaggatcacctaacagcagacctccaagccaaagtagctgagatgctcattgaaacgtttggagatcttcttttcatccctagttcagacccattgaaagagtttccttctccagaagctctaatgaagaggataataatctcaactaaacccccgcaagaatacaaggagtttctgaaagctaaggataatcagaatggtagtggaaacatagctgatttaccagaccaaggaagcctgaggagaatagattcaaatgccgatgaatctgatggaaaggatgaactagatgagcaagatgaggaagattctgatgaggacgaccccaaatttcagcaggatactgcctgtgagtataggaaattgatcaccatccaagctggcaaaccaaaaggccatttacgggatgctctaaaggtagacccagacaaagtcaggcgactctctttgagcgagacacaggtagctaaagcgacagcttctcatggcgctgaagtcataaggttcactcagaagaatatactgagggtgtatccaaagggcacaagggttaactcttctaactatgatccaatgaatgcctggattcatggcgctcagatggttgcatttaacatgcaggggtatgacaaagcactccgattgatgcaaggatttttcagagccaatgggggctgcgggtatgttaaaaaacctgacttcttgctaacgacaggtccaaatggcgaggtatttgaccctaaagctagtttgcctgtgaagacaactctcaaggttaaagtatatatgggagatgggtggcgcatggatttcagtaaaactcatttcgactccttctcgcctccagatttctataccagggtagggatcgctggagtgaaggcggatagtgtgatgaagaaaacgcgggtcctggaagaccagtgggtgccggtgtgggacgaggagttcacgttcccgctgacggtgccggagctagccctgctgaggatagaggtgcaggagtacgacatgtcggagaagcacgacttcggcgggcagacggtgctgccggtgtgggagctgaagcagggcattcgtgctgtgcccctccacgatcgcaagggcgtcaggtacaagtccgtcaggctcctcatgcgcttcgattttgtctaggcatcagcagcagtccatagttgtgtcagccagtcagtgagagattgcgtttctctttcttgtgcatctagtgtgattgtgttgtgtattatacgtaaatgttatgaaataggaattattattactagtagtgtatacttccatctccatgtgattagtgtagattagagtagggggtgttacttccatcttgcgatcatgaatgtacgtatatactattgattttgttggaataatggaaggaagcagcacatcggctgctgtattttgttcgaaaaaaaaaaaaaaaaaaaa

SEQ ID NO: 7450 - protein, 602 aa, Panicum virgatum
  misc_feature: Ceres CLONE 1910570
  misc_feature (1)..(145): Pfam Name: PI-PLC-X Pfam Description: Phosphatidylinositol-specific phospholipase C, X domain
MGSYAYKYCMCFTRKFRSPDAQPPPDVRAAHLSYCCAPSSSSDPQHQQGQGHAHGLRRFLSQVQAESPADVDRILAILAPTSAAHGIARLVHRSPAPAPPTLDDFFGFLFSADLNPPITNQVHQDMSAPFSHYFIFTGHNSYLTGNQLNSDSSDIPIIKSLQRGVRVIELDMWPNSSKNNVDILHGGTLTAPVEMIRCLKSIKEYAFCASNYPLVITLEDHLTADLQAKVAEMLIETFGDLLFIPSSDPLKEFPSPEALMKRIIISTKPPQEYKEFLKAKDNQNGSGNIADLPDQGSLRRIDSNADESDGKDELDEQDEEDSDEDDPKFQQDTACEYRKLITIQAGKPKGHLRDALKVDPDKVRRLSLSETQVAKATASHGAEVIRFTQKNILRVYPKGTRVNSSNYDPMNAWIHGAQMVAFNMQGYDKALRLMQGFFRANGGCGYVKKPDFLLTTGPNGEVFDPKASLPVKTTLKVKVYMGDGWRMDFSKTHFDSFSPPDFYTRVGIAGVKADSVMKKTRVLEDQWVPVWDEEFTFPLTVPELALLRIEVQEYDMSEKHDFGGQTVLPVWELKQGIRAVPLHDRKGVRYKSVRLLMRFDFV

SEQ ID NO: 7451 - DNA, 1674 bp, Panicum virgatum
  misc_feature: Ceres CLONE 1910644
  misc_feature: Encodes the peptide sequence at SEQ ID NO. 7452
gcccccgaacggttcgcaaggcgagaaagcctctctctcctggtcggccagtgacatcaccaactcgtcgagaggagagagagagaaggagcacgagctcgttgccgattcgagaagagaagaggagtgagagagggagagcgagcgagggagggaagaagagcgaggggaaggagcaggaagcctgcgcccgaggcatcgggtcacggaatccgacaaaccctagccgccgttgatcgccgtctcaggccatggcagcgccggcgccggatcgggcggcgctgacggtggggccgggcatggacatgccaatcatgcacgacagtgaccggtacgagctcgtgcgcgacatcggctccggcaacttcggcgtcgcccgcctcatgcgcgaccgccggactagtgagctcgtcgccgtcaagtacatcgagcgcggcgagaagatagacgaaaatgtccagcgcgagataattaaccatagatcattgaagcaccctaatattattaggtttaaagaggtaattttaaccccaacacatcttgctattgtcatggaatatgcctctggcggtgagctttttgagagaatatgtaagaatgtgcgattcagtgaagatgaggctcggtacttcttccagcagcttatctcaggagtaagctactgccattcaatgcaagtatgtcaccgggatttgaagctggagaacacactgctagatgggagtgatgcacctcgcttgaagatatgtgactttggttattccaagtcatctgttcttcattcgcaaccgaagtcgactgttggaacacctgcttatatcgcacctgaagttctactgaaaaaagaatatgatggcaagattgctgatgtatggtcatgtggagtgaccctttacgttatggttgttggtgcatatcctttcgaagacccagaagagcctaagaacttccggaagacaattcagcgtatcttgaatgttcagtatgcaattccagataacgtgaacatatctctagagtgcaggcatctaatttccaggatttttgttggtgaccctgccatgcggataacaatacctgaaatacggaatcatagttggttcctgaagaaccttcctgctgatctgatggatgatgatagtatgagcaaccaatacgaggagcctgatcagccaatgcagactatggatcagatcatgcagattttgacagaggctaccataccacctgcttgttctcgcagtataaatatcctagctgatggactagacatggatgatgacatggatgaccttgaatccgactcggatcttgatgtggacagcagcggtgagattgtgtatgcaatgtgagccgcatctcagataaccatcttaccagtcttccaaagaaccgatcaggcatgggatgccctgttgttgtatactctggtaaagaactagcatccttttgtgaaaaaacgccctgtagttttccccgcatcgcaatcctgttgtgcattctgtggaacacagatgttgtaaccaaactggggttacttccctcggaaaactagcctcctcttgcttcatgtgtactgaggtttggatactctcaagcttcgacttgtgtgttactgttatatatgtactagttttactcctgttgatctgtgaaaaaaaaaaaaaaaaaaaa

SEQ ID NO: 7452 - protein, 366 aa, Panicum virgatum
  misc_feature: Ceres CLONE 1910644
  misc_feature (3)..(366): SWISSPROT Homolog: EC 2.7.11.1 Serine/threonine-protein kinase SAPK8
  misc_feature (7)..(366): SWISSPROT Homolog: EC 2.7.11.1 Serine/threonine-protein kinase SAPK10
MAAPAPDRAALTVGPGMDMPIMHDSDRYELVRDIGSGNFGVARLMRDRRTSELVAVKYIERGEKIDENVQREIINHRSLKHPNIIRFKEVILTPTHLAIVMEYASGGELFERICKNVRFSEDEARYFFQQLISGVSYCHSMQVCHRDLKLENTLLDGSDAPRLKICDFGYSKSSVLHSQPKSTVGTPAYIAPEVLLKKEYDGKIADVWSCGVTLYVMVVGAYPFEDPEEPKNFRKTIQRILNVQYAIPDNVNISLECRHLISRIFVGDPAMRITIPEIRNHSWFLKNLPADLMDDDSMSNQYEEPDQPMQTMDQIMQILTEATIPPACSRSINILADGLDMDDDMDDLESDSDLDVDSSGEIVYAM

SEQ ID NO: 7453 - DNA, 1628 bp, Panicum virgatum
  misc_feature: Ceres CLONE 1910666
  misc_feature: Encodes the peptide sequence at SEQ ID NO. 7454
gtctcgcgagcctcacacatccaactcaactcgcacccgagagaagaaagagagggggaaaaacgagtccaggcagcaaaaccctagcccgctccccgacgcgccaccgccggctgatggtttcgatgagcacgacgccgaagccgctctactccgccgccgccaacgccgccgccgccgtcgcaggcgggggcggggatgatgggggcgggggcgggaagcagctgccgcagcagcagcggatgcggggggcggcggtgatggcgccgccgccgatggcggtgccggccccagccccggcgcccgcggcgggggaggaagtgcggaaggtcaggaagccctacaccatcaccaagtcacgggagagctggacggagccggagcacgacaagttcctcgaggccctgcagcttttcgatcgtgattggaaaaagattgaagcatatgttggctcaaagactgttatacagattacgagccatgcacagaagtacttcttgaaggttcagaagaatggtgcaggcgagcatctgcctccaccccggccaaaacgaaaggcagctcatccatatccacagaaggcatctaaaaatgtttctcaagctgttttgtctcaacaactccctcagagggagcaaggctcagtcatgtctatggatacatcttctgctgttagagatgcaaatgcaaattcagcaatgccttcctgggacaatactcctgttcaacctttcagtgcaagtcatgtgcatggtgccattgcaacaaataactgctctagtagcatagagagcccatccggaacgtggccaacttctgaagcagttgagcaagaaaatgtggtcccaccactccgtgccatgccagatttcgcccgagtatacagcttcctgggaagcatatttgatccagataccagtgggcatttgcagaggttaaaagcgatggatccaattgatgttgaaacggtactactgcttatgagaaatctatcaacaaaccttactagtcctgactttgaagaacatctgaagttgctatcatcatatagttatggtagtgagggctacattaaatctgaaggcatggaaaatcttggatctcctcagagttgccatctcccattcatggtaacaagtgaatgagagaacactgcccattggtggtcgaagcttcagttgtttccatgaggcgttcttgtgtgctctctgtgctggagttgtggacggctgatctagcagtttatgaatgctagagacaggttatggcagtgacatctgtatatcttcgaataatatggtctaaccctaggctagttttgctcttcatgttcatgtagatagccagttttgtgcgctcatgcaatttttttcctgggtggggcctagatcgatatgttttttgttatacacacctgtgtgtgcatgcatgtaaatgtgtgatcatgtaatgtttgaggtactcctgggagtcgttgatcaagacaagacataacataccgaataatcatggccggtgattaccctcgttgactctataatgaaaagttttcaactgtggacctgtgtaaaactgtcctaagtcttgggaaagcgtgtggatggcgatattgatatctttttattggg

SEQ ID NO: 7454 - protein, 342 aa, Panicum virgatum
  misc_feature: Ceres CLONE 1910666
  misc_feature (1)..(46): Pfam Name: Myb_DNA-binding Pfam Description: Myb-like DNA-binding domain
MVSMSTTPKPLYSAAANAAAAVAGGGGDDGGGGGKQLPQQQRMRGAAVMAPPPMAVPAPAPAPAAGEEVRKVRKPYTITKSRESWTEPEHDKFLEALQLFDRDWKKIEAYVGSKTVIQITSHAQKYFLKVQKNGAGEHLPPPRPKRKAAHPYPQKASKNVSQAVLSQQLPQREQGSVMSMDTSSAVRDANANSAMPSWDNTPVQPFSASHVHGAIATNNCSSSIESPSGTWPTSEAVEQENVVPPLRAMPDFARVYSFLGSIFDPDTSGHLQRLKAMDPIDVETVLLLMRNLSTNLTSPDFEEHLKLLSSYSYGSEGYIKSEGMENLGSPQSCHLPFMVTSE

SEQ ID NO: 7455 - DNA, 2352 bp, Panicum virgatum
  misc_feature: Ceres CLONE 1910694
  misc_feature: Encodes the peptide sequence at SEQ ID NO. 7456
gaacggctgaaccctagcgccttcattttcctctccccggctccagcagccgccgcgcgctgcttcctccggccctctcccctccattgccgccgccgctcccctccgccaagctctacggcggccggcttccccttctctcccccatcccgcccccggtctccccttcaccgcctggcgccggcatcaccgccgtggcaatccgcactgaaaagcgcgtgcctgctgggagttcacggttccgtttcccttctctctcagtctctcctctctcttggtcgacctacttcctttcctggcggcgacgactgggcgagcggcggtgcaattcggtcttcgtcgggccctttgccggcgacgagcacacgtcagggaagtgcataccaagtaaagctaacaacctgaagtgaagctaaatatgttgtataaaagggaagcagaagagaggtagttgcttggagaatagctggtacctgttggacttgggtctggaactccaattgtgagtgcaactatacaaggataattaagacttaagagtgtgtggacagaggtctttcagtcgtcatatgaagttatccttttgatatacagctgaaggataataactatcatggatactactgcgaattcagatgtgcaaaaggctgaggaactgaaacttaaggcaaatgaggccttcaaggcaaacaagttctcgcaggctatagaactgtacagccaagcgattgaggtgaacagttcgaatgcagtttactgggcaaaccgtgcatttgcacatacaaaattagaagaatatggaagtgcggtgcaggatgctacaaaagccattgaaattgatcctagatattcaaaaggttattatagacgtggtgcagcatatcttgctatgggaaagttcaaggaagccctcaaggattttcaacaggtgaaaaaaatatgcccgaatgatccagatgcttcaagaaagttgaaagaatgtgagaaagctgtccaaaaaattcgctttgaagaagcgatttccgttggagatgcagaaaggcgctctgtggcagattctatcgactaccatgtcatagaagttgagccacagtatgcgggaccgagaattgacggtgaagaaataacattagattttgtcaaagcaatgttggatgaatttaagaagcagaaatgcatacataaaagatatgcatatcagattgtgttaaaaaccttggagttgttgcgttcgatgccttcacttgttgatgtcaatgttccaaatggtgggcattttacagtttgtggtgatgtgcatggccagtattttgacttgctcaacatatttgcactcaatgggctcccctcagaagaaaatccttacctcttcaatggcgattttgtggacaggggatctttctccgttgaagttatactcactctttttgctttcaaatgcctctatccaaaagctatgtaccttgcaagaggaaatcatgaaagcaagagtatgaacaagatatatggctttgagggtgaagtgagatcaaagctgggcgaaaaatttgttgaactatttgctgaagtcttttgctggttaccacttgctcatgtcatcaacaagaaggtctttgtagtccatggaggactcttcagtgttgatggggtgaaactttcagacattagatccattgatcgtttctgtgaacctcctgaagaaggtctaatgtgtgaactactatggagtgatcctcagcctcagcttggaagaggtccaagcaaacgtggtgttgctctttcctttggcgcagatgtgactaagaagtttttacaggaaaataaccttgatcttattgtccgatcccatgaagtaaaggatgaaggctatgaaattgaacatgatggaaagcttataacagtcttctctgcgcctaattattgtgaccagatgggcaacaagggtgctttcattcggttcacagctccggaaatgaaacctgatatcgttactttctcagccgtgccacatcctgatgtgaagccgatggcgtatgcaaataacttcctcaggatgttccaatgacagaagatggcaaccttgtttgtcaatttttattgtgtcgagttcatcgcgtccagtccatcgattgccaggtttggaaaacatgtgctgccttgatcaagtgatgtaagaagggatgcggctgttcatgcgcaacaatggtacatcttttggtcaaactcttgtaagaactagtaaacattcttgatcactagtagatcctagtttacttgtaaaattgctgaatcatcattttctatctcgtcatgtattggctaagtttctcagaaaaaaaaaaaaaaaaaaaa

SEQ ID NO: 7456 - protein, 483 aa, Panicum virgatum
  misc_feature: Ceres CLONE 1910694
  misc_feature (2)..(197): Pfam Name: Metallophos Pfam Description: Calcineurin-like phosphoesterase
  misc_feature (5)..(481): SWISSPROT Homolog: EC 3.1.3.16 Serine/threonine-protein phosphatase 5
MDTTANSDVQKAEELKLKANEAFKANKFSQAIELYSQAIEVNSSNAVYWANRAFAHTKLEEYGSAVQDATKAIEIDPRYSKGYYRRGAAYLAMGKFKEALKDFQQVKKICPNDPDASRKLKECEKAVQKIRFEEAISVGDAERRSVADSIDYHVIEVEPQYAGPRIDGEEITLDFVKAMLDEFKKQKCIHKRYAYQIVLKTLELLRSMPSLVDVNVPNGGHFTVCGDVHGQYFDLLNIFALNGLPSEENPYLFNGDFVDRGSFSVEVILTLFAFKCLYPKAMYLARGNHESKSMNKIYGFEGEVRSKLGEKFVELFAEVFCWLPLAHVINKKVFVVHGGLFSVDGVKLSDIRSIDRFCEPPEEGLMCELLWSDPQPQLGRGPSKRGVALSFGADVTKKFLQENNLDLIVRSHEVKDEGYEIEHDGKLITVFSAPNYCDQMGNKGAFIRFTAPEMKPDIVTFSAVPHPDVKPMAYANNFLRMFQ

SEQ ID NO: 7457 - DNA, 1790 bp, Panicum virgatum
  misc_feature: Ceres CLONE 1910699
  misc_feature: Encodes the peptide sequence at SEQ ID NO. 7458
aaaaggcgcgcaacatcatcgtcagaagagacaagcggcggcaaggggagaagagtagacggctgaggctagaagaagagcaggagctccctccctcctataagtagtagccgtagccccctcctctccacctccgatcccccgtttccctcacctctcagctctggcgcgcgcggcagagagagctagagagacagagagaggaccgggaggctgcgcgcgcgcgcggatcaaagcaaggagcttggtgttgtgaatggtgaagggcgaggcggaggcggagtgcacgcgggcgtcgctgctggggaggtatgagatcgggcgcaccctcggggagggcaacttcggcaaggtcaagtacgcgcgccacaccgccaccggcgcccacttcgccatcaagatcctcgaccgcagcaagatcctctcgctccgcatcgacgaccagataaggagggagatcgggacgctgaagctgctcaagcacccgaatgtcgtccgcctgcacgaggttgctgctagcaaaacgaagatttacatggtgcttgagttcgtcgacggcggcgagctctttgacaagattgctgtaaagaggaaactgtctgaacatgagggaaggaggcttttccagcagctaattgacggcgcgagctactgccacgataaaggtgtctaccacagggaccttaagccagagaacgttcttgttgatcggaagggcaacatcaagatctccgacttcggccttagtgctctacctcaacatctcgggaatgatggacttctgcacacaacatgtggcagccccaattacatcgctcctgaggttttgcaaaatagaggttatgatggctccttgtcggatatctggtcttgtggggtaatcctatatgtaatgcttgttggttaccttccgttcgatgacaggaatcttgttgttctttatcagaagattttcaagggagactgtcagatcccaaagtggctttcacctgctgcacaggaccttcttaggaagattcttgaaccaaatccaatgaaaaggatcaacatcatgggcatcaaagagcatgagtggtttcagaaggactacgttcctgccgttccatacgatgacgatgaagatttacttcctagttcagttctcccaatcaaagagcaaattgatgaatcagcacaagaaaagcctactcatatcaacgcttttcagttgatcggaatggcttcgtcccttgatctttctggtttcttcgaggaagaggacgtggctcaaagaaagattcggttcacatcaacacattcacccaaggatttatttgacaagatggagaatgccgtgaccgagatgggattcaaagtccataggggaccaagaaagctcaaagtattgaaaaattgcaaaacttccaagaactccaggagtcccgcatcatttttggtgtgcattgaggtgtttgagctagggccgtctttgtatgtcgtagaactgaaaaaatcccatggagattctatattgtatagacagttgtgtgagaggctctcagatgagctggcggtgtgcaagacagaggagattatgaggacagaatcgctgggtgactcagacatgtcgagccttgatggcgaagcactacctttgtctggtttctgatcattgcttccctgtgtggttttgggcacaggggacgagggacatactcgttcctgatgcagttctagattaggaaatcttgtacaaagcgtgtggcgcaaattagccaccatgttgaatattgttgtagcctgtctgttcc

SEQ ID NO: 7458 - protein, 463 aa, Panicum virgatum
  misc_feature: Ceres CLONE 1910699
  misc_feature (5)..(438): SWISSPROT Homolog: EC 2.7.11.1 CBL-interacting serine/threonine-protein kinase 1
MVKGEAEAECTRASLLGRYEIGRTLGEGNFGKVKYARHTATGAHFAIKILDRSKILSLRIDDQIRREIGTLKLLKHPNVVRLHEVAASKTKIYMVLEFVDGGELFDKIAVKRKLSEHEGRRLFQQLIDGASYCHDKGVYHRDLKPENVLVDRKGNIKISDFGLSALPQHLGNDGLLHTTCGSPNYIAPEVLQNRGYDGSLSDIWSCGVILYVMLVGYLPFDDRNLVVLYQKIFKGDCQIPKWLSPAAQDLLRKILEPNPMKRINIMGIKEHEWFQKDYVPAVPYDDDEDLLPSSVLPIKEQIDESAQEKPTHINAFQLIGMASSLDLSGFFEEEDVAQRKIRFTSTHSPKDLFDKMENAVTEMGFKVHRGPRKLKVLKNCKTSKNSRSPASFLVCIEVFELGPSLYVVELKKSHGDSILYRQLCERLSDELAVCKTEEIMRTESLGDSDMSSLDGEALPLSGF

SEQ ID NO: 7459 - DNA, 1729 bp, Panicum virgatum
  misc_feature: Ceres CLONE 1910770
  misc_feature: Encodes the peptide sequence at SEQ ID NO. 7460
tgcgtgcgtgcccgtgggtcggcgccggcgaggaggagcaatggcagcgcaggagagcgccgcgggcgggagccagcaggtggtgatgcggtggcggtacggggacgtgggcgacagcaacttcgcggtgcacgggcgcgccgtgccgctgctcgtgggcctgctctgcgccgtcgtcttcttcgtcgcgctctgcctctacatccgctggcggtgccaccggtacacgcccgacccggaggcggacgcgtcctcctcgtccgcggcggcggcggccacggcgtcgctgcccggcctcgacgccgacgccatccgccggttgcccttcacgctgtaccgcccgcccgcgtcgcccccgaatggcctcccgggtaaaggcgacaacggcggggacggggaggccgacgaacacgcggcggcgctgtgctcgatctgcatcagcgcgctggtggccggcgagaaggtgaaggtgctcccgccctgcggccactgcttccaccccgactgcgtcgacctttggctccggtcccaggccagctgcccgctctgccgatgcctcctcgcggccgccatcaacggaagcaacgacgccgtgtgagcagctgtttggttccgactaggtataaaaattttgattaataattaggggtattaaataaagataatttataaaattaacttcacgatcctacgctattttgcgagacgaatttaatggggtcgttggccgaataattagaggatggttacagtaatatcactgtagccaatcatcgattaattactgtcattacattcgtcttgaaaagttacacccatccgtgaaaaaaatttccaaataaatttcgtttaatatttcatacatgtgagatttttttgtcgagaattgtgtgcgctaccgtgctacgcaaaccaaacagtgcctgaatcaacacctgacagaaccaacacctgacagaacgaagcatccccatgacaagcggaccccagctgtcagcgtccccccaagacccggcctttgaatcagcgcgccatttaatgatggtcgccgcaatgaccgcgtcagatctactcgtcgtgagtgcgcttgttaaagaagcctgtgccctatttaattgcattcaaaattccaaaattttataagatttctcatcacatcaaattttttaacacatgcatgaaatattaaatctacacgaaataaaaaactaattgtatagtttgcttgtaaatcacgaaatgaatctaataagcctaattaatctatgacgaaacaataattactaaatacaagaggcgctggtttatttagggcctggtcgccaatggcgtcggaagatgcagtgcgtgtggcctggccagctgccctccggtcagtccccggagctctttggaggccggcgtggggtcacccctgacctcgccggccgctttcctactgctagtagctttctccgatcacggctctccaatgcaggggaaaagttgtgtagcatgtacatagcttttgagtatttataagcagatagaattttaacccctgcgggggtggttcaggtggaatctgtgttagcgtaacagctgcactggcacgggtaaaacgccctttaattatagttgtcaagctctccggtactatgttgcgcctccttttgttttgattccacggagcacagtccatacatgtacgcttttgtaaaagtgggttttgcaaatatctggaatttat

SEQ ID NO: 7460 - protein, 185 aa, Panicum virgatum
  misc_feature: Ceres CLONE 1910770
  misc_feature (1)..(42): Pfam Name: zf-C3HC4 Pfam Description: Zinc finger, C3HC4 type (RING finger)
MAAQESAAGGSQQVVMRWRYGDVGDSNFAVHGRAVPLLVGLLCAVVFFVALCLYIRWRCHRYTPDPEADASSSSAAAAATASLPGLDADAIRRLPFTLYRPPASPPNGLPGKGDNGGDGEADEHAAALCSICISALVAGEKVKVLPPCGHCFHPDCVDLWLRSQASCPLCRCLLAAAINGSNDAV

SEQ ID NO: 7461 - DNA, 2057 bp, Panicum virgatum
  misc_feature: Ceres CLONE 1910780
  misc_feature: Encodes the peptide sequence at SEQ ID NO. 7462
gtcaggattcagaaagcaatcgccaagaacatggaaaaccattcctgaaaatcggtgtccaaatctacctctctgcaggttgatccaaatggactaacactcccagccatccccgttcccttcctgctccattgatccgatggccgccacggccttccgcctccacccggccgccttcttctcagctcatccgcgcgaggccggggccaagaggccgctccgccattgcccacctcacaggatccttgtcccaagaagagcctgccttctccgggcaaagtcatcgaatgggctcccacagatcggcgcctcgttcggcaacaccaatgaagtagttcctgcagaggtgctagatgggaggccagccggagctgggccaccggagcagggagggagcaccgtcagcatcaccgtcgtcggcgcctccggcgacctcgccaagaagaagatcttccccgcgcttttcgccttgttctacgaggattgcctcccagagcattttacagtattcggttatgctcgtagtaagatgaatgacgcagagctcgggaccatgattagtaggactctaacatgccgaattgacaaaagggagaactgcggtgataagatggaacagtttctgcaaaggtgcttctaccaacctgggcagtacaacacagaggaggggtttgctgaattagaccggaagcttaaagaaaaagaggcaggcaggataccaaacaggctgttttacctgtccgtccctccaaacatattcgtcgatgtggtaagatctgctagccgcaccgcgtcttcttcaagcgggtggactagatttatagtggagaagccattcggccgcgactcggagtcctcaggggagctcactcggtccttgaagaagtacctggccgaggagcagatattcaggattgaccattatttgggcaaggagctggttgagaacctctcagtcctccgtttctccaacctcgtgttcgagccactgtggtcgaggaactacatccggaacgtgcagctcatcttctctgaagacttcggcaccgagggtcgaggcggctacttcgacaactacgggatcatccgggacatcatgcagaaccacctgctgcagatcctggcgctgttcgccatggagaccccggtgagcctggacgccgaggacatccgcaacgagaaggtgaaggtgctgcggtcgatgcggccgctgaagctggaggacgtggtggtggggcagtacaagggccacacccggggcggcaggtccttccccggctacgccgacgaccccaccgtgcccaagggcagcgtcacgcccaccttcgccgccgccgcgctcttcatcgacaacgcccgctgggacggcgtgcccttccttatgaaagccggcaaggcgctgcacaccagaagggcggagatccgggtgcagttccggcgggtgccgggcaacctgtaccggcggcggagcatcgggacggacctggacacggcgaccaacgagctggtgctccgggtgcagcccgacgaggcgatctacctgaggatcaacagcaaggtgcccgggctgggcatgcggctggaccgcagcgacctcaacctgctctactcggagcggtaccgccgcgagatccccgacgcgtacgagcggctgctgctggacgccgtcgagggcgagcaccggctcttcatccggagcgacgagctcgacgcggcgtgggccatcttcacgcccgtgctcagggagctcgaggacaggagggtggcaccggaactctacccctacggcagcaggggccccgtcggcgcgcactacctcgccgccaactacaacgtcaggtggggcgacatcgccggcgacgacggatccttctagacgtgcgtactgcagcatcgatccatccattgggcacgccgtgtgcagtgcagttgcgtgtgtgcattcatcctgttactcggagactcacagaattgaaaattaaagttgcttcccgcaagacaaaggggaagattgtgaataaagcagctctgctcagcaaaaaaaaaaaaaaaaaaaa

SEQ ID NO: 7462 - protein, 578 aa, Panicum virgatum
  misc_feature: Ceres CLONE 1910780
  misc_feature (1)..(297): Pfam Name: G6PD_C Pfam Description: Glucose-6-phosphate dehydrogenase, C-terminal domain
  misc_feature (1)..(298): Pfam Name: G6PD_C Pfam Description: Glucose-6-phosphate dehydrogenase, C-terminal domain
  misc_feature (1)..(298): Pfam Name: G6PD_C Pfam Description: Glucose-6-phosphate dehydrogenase, C-terminal domain
  misc_feature (1)..(298): Pfam Name: G6PD_C Pfam Description: Glucose-6-phosphate dehydrogenase, C-terminal domain
  misc_feature (1)..(298): Pfam Name: G6PD_C Pfam Description: Glucose-6-phosphate dehydrogenase, C-terminal domain
  misc_feature (1)..(308): Pfam Name: G6PD_C Pfam Description: Glucose-6-phosphate dehydrogenase, C-terminal domain
  misc_feature (1)..(298): Pfam Name: G6PD_C Pfam Description: Glucose-6-phosphate dehydrogenase, C-terminal domain
  misc_feature (1)..(298): Pfam Name: G6PD_C Pfam Description: Glucose-6-phosphate dehydrogenase, C-terminal domain
  misc_feature (1)..(298): Pfam Name: G6PD_C Pfam Description: Glucose-6-phosphate dehydrogenase, C-terminal domain
  misc_feature (1)..(298): Pfam Name: G6PD_C Pfam Description: Glucose-6-phosphate dehydrogenase, C-terminal domain
  misc_feature (84)..(575): SWISSPROT Homolog: EC 1.1.1.49 Glucose-6-phosphate 1-dehydrogenase, chloroplast precursor
  misc_feature (87)..(575): SWISSPROT Homolog: EC 1.1.1.49 Glucose-6-phosphate 1-dehydrogenase, chloroplast precursor
MAATAFRLHPAAFFSAHPREAGAKRPLRHCPPHRILVPRRACLLRAKSSNGLPQIGASFGNTNEVVPAEVLDGRPAGAGPPEQGGSTVSITVVGASGDLAKKKIFPALFALFYEDCLPEHFTVFGYARSKMNDAELGTMISRTLTCRIDKRENCGDKMEQFLQRCFYQPGQYNTEEGFAELDRKLKEKEAGRIPNRLFYLSVPPNIFVDVVRSASRTASSSSGWTRFIVEKPFGRDSESSGELTRSLKKYLAEEQIFRIDHYLGKELVENLSVLRFSNLVFEPLWSRNYIRNVQLIFSEDFGTEGRGGYFDNYGIIRDIMQNHLLQILALFAMETPVSLDAEDIRNEKVKVLRSMRPLKLEDVVVGQYKGHTRGGRSFPGYADDPTVPKGSVTPTFAAAALFIDNARWDGVPFLMKAGKALHTRRAEIRVQFRRVPGNLYRRRSIGTDLDTATNELVLRVQPDEAIYLRINSKVPGLGMRLDRSDLNLLYSERYRREIPDAYERLLLDAVEGEHRLFIRSDELDAAWAIFTPVLRELEDRRVAPELYPYGSRGPVGAHYLAANYNVRWGDIAGDDGSF

SEQ ID NO: 7463 - DNA, 1948 bp, Panicum virgatum
  misc_feature: Ceres CLONE 1910794
  misc_feature: Encodes the peptide sequence at SEQ ID NO. 7464
gagcaacccaaactttctccgttcccctccctgctcgccttcgccccgctggtgctcatctctttccgccgccgaatcctcctccgcccgcgccgtggtccctccctccctccctctctgccggatcctccggccgccggccgccgcgtcgagcggggttggaaatctgcccgtcccggtttttgcttggcaagatggcgaacatccgggcgcttctggtcggcttgtcgcgcacaaggggttccttagctgaggctggccgatgtgcttccatgaggccgtcactcctatcatcagtgggtggacattacaaggttcccatgccagcccattggttctcaacagggcttcctccacatctggtggttgggatgccagcattgtcccctactatgaaccaaggtaacattgcaaaatggagaaaacaggaaggagacaagatagaggttggtgatgtgatatgcgagatagaaaccgacaaagccactcttgaatttgaaagccttgaagaagggtatctggccaaaattttagcacctgaaggttcaaaagatgttcaggttgggcagccaattgctgtcacggttgaagagcttgatgatattaaaaatatacccgccgatacattgtttggaggtgaacaaaaggaagaacagtcaagagaaagtgcaccaaaaactgatgtagctaatgtgtctgaacaaagctcagtagtgagccgaatcagtcctgcagctaagttactcatcaaggaacatggactggatgtgtcttcactgagagcatcaggccctcgtgggacccttctgaaaggggatgttctggctgcactgaagtcaggcgcaatttcaatcccagccaaagaaaagaaggctccagcaacgccctcatctcagccaactcgtgatgcccaggctcaaccagccactacttcacaaaaggccgatacatatgaagatattccgaatagtcagatacgcaaggttattgcaaaaaggttgcttgaatcaaaacagacgactcctcatttatatctatccaaagatgttgtacttgatcccttgctcgctttcaggagcgaactgaaagagcaacatggcattaaagtttcagtaaatgatatcatcataaaagctgtggcaattgccttgcggaacgttcctgaagcaaatgcctactggaacagtgagaaggaagaagcccaaaagtgtgactcagttgatatatctattgctgttgccacagagaagggtctgatgactccaattataagaaatgctgatcaaaagaccatatcagcaatatcctcagaggttaagcagctggctgagaaggcaagagctgggaaacttgcacctaatgaatttcaggggggaactttcagtatctcaaatcttgggatgtaccctgtggaccatttctgtgcgatcattaatcctccacagtctggcatcttagctgttggtagaggtaacaaggttgttgagcctgttgtggacagtgatggaaatgagaaggccgctgcagttacaaaaatgagcttgacgctgtctgctgaccatcgtgtgtttgatgggcaagtaggagggaggtttttcacggagctggcatcgaatttcagcgacattaggagactgctactgtaaatggaaggaggtggctatcgtgttttgaagaattctttgcggcaatctgctcaagaaaagagaacatttagatgcaagttggagcccagttgcttgatcgacagcccatacagaagtaaccaattttgtaataattgtaataaaaaagaaagcattggcacctccacggtgattcttttgccccgtttaacgttagttgggaggcggcaaggcatgttctaagaatttttaacatggataaagatacagaggaatttttcatttttaacatggttctgcaacaaaaaaaaaaaaaaaaaaaa

SEQ ID NO: 7464 - protein, 483 aa, Panicum virgatum
  misc_feature: Ceres CLONE 1910794
  misc_feature (2)..(234): Pfam Name: 2-oxoacid_dh Pfam Description: 2- oxoacid dehydrogenases acyltransferase (catalytic domain)
  misc_feature (49)..(483): SWISSPROT Homolog: EC 2.3.1.12 Dihydrolipoyllysine- residue acetyltransferase component 1 of pyruvate dehydrogenase complex,
MANIRALLVGLSRTRGSLAEAGRCASMRPSLLSSVGGHYKVPMPAHWFSTGLPPHLVVGMPALSPTMNQGNIAKWRKQEGDKIEVGDVICEIETDKATLEFESLEEGYLAKILAPEGSKDVQVGQPIAVTVEELDDIKNIPADTLFGGEQKEEQSRESAPKTDVANVSEQSSVVSRISPAAKLLIKEHGLDVSSLRASGPRGTLLKGDVLAALKSGAISIPAKEKKAPATPSSQPTRDAQAQPATTSQKADTYEDIPNSQIRKVIAKRLLESKQTTPHLYLSKDVVLDPLLAFRSELKEQHGIKVSVNDIIIKAVAIALRNVPEANAYWNSEKEEAQKCDSVDISIAVATEKGLMTPIIRNADQKTISAISSEVKQLAEKARAGKLAPNEFQGGTFSISNLGMYPVDHFCAIINPPQSGILAVGRGNKVVEPVVDSDGNEKAAAVTKMSLTLSADHRVFDGQVGGRFFTELASNFSDIRRLLL

SEQ ID NO: 7465 - DNA, 1421 bp, Panicum virgatum
  misc_feature: Ceres CLONE 1911056
  misc_feature: Encodes the peptide sequence at SEQ ID NO. 7466
atcccttctcctccgtcccgtggcacgcgcgcgcgctcgcacgcacgtacgacccatcacccatgtcgtcagcgcgcgccgtctcgccggcggccgcggcgccgcctcccctcccgcgccgcctgaggcccgcgaggtgcacggcctgcgccgcggcgacggagacggccaccgcggggccggcgagggtggcgaccgtcagcaacagcggggactccctggcgatatgccgggtgctcaacggcatgtggcagaccagcggagggtggggccgcatcgaccgcgacgccgcggtcgaagccatgctcgcgtacgccgacgccggactcaccaccttcgacatggcggaccactatgggccagcagaggatttgtatggcatgttcatcaatagagtcaggcgggagcgcccacctgagttgcttgaagaaatcaaggggcttacaaagtgggtgccgcctcccgttaagatgacaagaagttacgttgaggataatatcaatagatctaggaagaggatggatgttgctgcattggacatgttgcagttccactggtgggattatgcaaatcctggatatttggatgcactaaagcacatcacagacctgaaggaggaaggcaagataaagaccgtagctctgacaaacttcgatacagacagactgcaaataattctagaaaacggaatcccagttgtcagcaaccaggttcaacattccatcgttgatatgcgccctcagcaaagaatggcagagctttgccagttaactggagttaaacttataacgtatggcacagtgatgggtggtcttttgtctgaaaagtttcttgacatgaacgtatcaataccttttgctgggcctcctctaaataccccatctttgcagaagtataagaggatggtcgatgcttggggtggctggagcttgttccagactttgttacaaactttaaagaaggtgtcattgaaacatggtgttccaatcgcaactgttgctgtgcgatacatactgaaccagacatctgttgcaggttccatggtaggtgtgagattgggactctccgagcacatcaaagacaccaactccatattctcacttgaactggatgaagaggacatgaacagcatcactgaggtatcgaagaagggcagaaatttgatggatattatcggggattgtggcgacgagtacagagcttagttgttcatgctgctgattggctcatataattgcgcccaattttcaatagctctgaatttttgtctgttttaagtctagcggctcagcgcgcagttgaggcaagcctgtacctgaatgtctattatcgagccccagcatgtaacctcctcggaggaaacaccagctataaaactgtaaatacacaacgatgcagatggctaatgcgttgatttgttc

SEQ ID NO: 7466 - protein, 380 aa, Panicum virgatum
  misc_feature: Ceres CLONE 1911056
  misc_feature (8)..(300): Pfam Name: Aldo_ket_red Pfam Description: Aldo/keto reductase family
  misc_feature (1)..(312): Pfam Name: Aldo_ket_red Pfam Description: Aldo/keto reductase family
  misc_feature (1)..(317): Pfam Name: Aldo_ket_red Pfam Description: Aldo/keto reductase family
MSSARAVSPAAAAPPPLPRRLRPARCTACAAATETATAGPARVATVSNSGDSLAICRVLNGMWQTSGGWGRIDRDAAVEAMLAYADAGLTTFDMADHYGPAEDLYGMFINRVRRERPPELLEEIKGLTKWVPPPVKMTRSYVEDNINRSRKRMDVAALDMLQFHWWDYANPGYLDALKHITDLKEEGKIKTVALTNFDTDRLQIILENGIPVVSNQVQHSIVDMRPQQRMAELCQLTGVKLITYGTVMGGLLSEKFLDMNVSIPFAGPPLNTPSLQKYKRMVDAWGGWSLFQTLLQTLKKVSLKHGVPIATVAVRYILNQTSVAGSMVGVRLGLSEHIKDTNSIFSLELDEEDMNSITEVSKKGRNLMDIIGDCGDEYRA

SEQ ID NO: 7467 - DNA, 1082 bp, Panicum virgatum
  misc_feature: Ceres CLONE 1911084
  misc_feature: Encodes the peptide sequence at SEQ ID NO. 7468
actgcggttatcgacagcaccaaacgagaggggaatcctgcacgaaccgagtcgccgcgagcacgaggtcatggcggattcgaccgcaccccgtccaaccgttctcgtcaccggcgccggcggccgaacaggccatattgtgtacaacaagctgaaagagagatccgagcaattcgtagcaagaggtctggtgaggacagaggagagcaaacagaaaattgggggagcagatgatgtttacatcgctgatataagggatgcagatcgtctagcgcctgctgttcagggtgctgatgctctcataattctcacaagtgccgtccccaagatgaaaccgggtttcgaccctagcaaaggcgggagacctgaattctactacgaagatggaatgtaccctgagcaggtggattggattggccaaaagaatcagattgatgccgccaaagctgctggggtgaagcatatagtgttggtgggatccatgggaggaacaaatcctaaccatccactgaacagtcttggaaatggcaacatactagtatggaagcgcaaggcagaacagtatttggcagacagtggagttctgtatacaataataaggcctggaggtttgcaagacaaagatgggggggtgagggagttaattgttgggaaggatgatgaacttctccagactgacacaaagtcaattcctagagctgatgaggctgaagtttgtgtacaggctctgcagtatgaagaggcaaagttcaaggcatttgatttggcatcaaagcctgaaggtgtgggcacaccaacaaaggatttcagggcgctgttcgcccagattactgctcggttttgagctatcacctaagaaacctacggcatgcccacattctaggtttccatggtgttccattccattgcttgtggacttgtactgcatatataaaactagtagcttgtgaatgatggagctttagtttagtgtgattgttacaaatcgcaatatcagaactgctgaaagaaaccagtgtgtttggggctgaagacctgaagttaaagaacactttctggttgaaaaaaaaaaaaaaaaaaaa

SEQ ID NO: 7468 - protein, 257 aa, Panicum virgatum
  misc_feature: Ceres CLONE 1911084
  misc_feature (1)..(223): Pfam Name: Epimerase Pfam Description: NAD dependent epimerase/dehydratase family
MADSTAPRPTVLVTGAGGRTGHIVYNKLKERSEQFVARGLVRTEESKQKIGGADDVYIADIRDADRLAPAVQGADALIILTSAVPKMKPGFDPSKGGRPEFYYEDGMYPEQVDWIGQKNQIDAAKAAGVKHIVLVGSMGGTNPNHPLNSLGNGNILVWKRKAEQYLADSGVLYTIIRPGGLQDKDGGVRELIVGKDDELLQTDTKSIPRADEAEVCVQALQYEEAKFKAFDLASKPEGVGTPTKDFRALFAQITARF

SEQ ID NO: 7469 - DNA, 1476 bp, Panicum virgatum
  misc_feature: Ceres CLONE 1911134
  misc_feature: Encodes the peptide sequence at SEQ ID NO. 7470
aaaaatactctccaacgacgaccaacgcgaggaaaggaggaagaagaagagaacaaaaaggggaggaggaaaaggaaaaacacctgagctagggtttggccgatcggctcccgccatggcgtcgacctccccgcgccgctcctccggcggggacccgtcctcgccgctcctcccctcgccggcctccccgtcgtcctccggcggtccgctcgggcggctcgcgggcctccgcggcgcggcgcggttcatccgccgcacggggagccgtcgcctgatgcgggagccctccgtggcggtgcgggagaccgccgccgagcacctcgaggagcgccagaccgactgggcctactccaagcccgtcgtcgtgctcgacgtgctctggaacctcgccttcgtcgccgtcgccgcggccgtcctcgccgcctcgccggccgagcggcccgccgtgccgctccgcgtctggctcgcgggctacgtgctccagtgcctcctccacgtcctctgcgtcaccgtcgagtacagtcgccggcgcagggaggcgggccaggacggcgcggctgatggggatttcaagctcagtattgtgaagcacttggagtctgcgaacacaatgttttccttcatatggtggatcgttgggttctattgggtatctgcaggtggtcaagctttatcacatgacgctcctcagctttactggctatctattgtttttctggcatttgatgttttctttgtggtcttttgcgttgcattggcttgtgtgattggaattgctgtttgttgctgtcttccatgcattattgcaatcttatatgctgtaactgatcagcaggagggagcatctgaagaagacataaacaacctttctaaatttaaattcaggacaatgggtgatcaagacaagctagttgctggcattgcagcacctgtgggtggagtgatgactgagtgtggcaccaaccctcctgtcgaacacattctttcagctgaggatgcagaatgctgtatctgcttgtgcccatatgaagatggtgccgaactgcgtgagctcccttgcaaccaccattttcactgcagctgcatagataagtggcttcacataaatgcgacgtgcccactgtgcaagttcaacattgtcaagagcaaccttgatagagaagaggtctaggtatcacaagacaaaaatcttgccaaagcttctcgacatctctcagctgtcgtgctctccattgctacttcatttgcaaacagagttgagattattggtcgtgtagtttcacagctataggtgatgcactgatatggttgcgatgttggttgtgaatatttagctgtttgttgcagcaatcgtacatcctctttctgctcgatctgactgcattgcagatttatatgtgcgtggacgcgccgccagtcatttgtaaaatgattaatgaatcggaggttagtacacaaaaaaaaaaaaaaaaaaaa

SEQ ID NO: 7470 - protein, 351 aa, Panicum virgatum
  misc_feature: Ceres CLONE 1911134
  misc_feature (1)..(41): Pfam Name: zf-C3HC4 Pfam Description: Zinc finger, C3HC4 type (RING finger)
MASTSPRRSSGGDPSSPLLPSPASPSSSGGPLGRLAGLRGAARFIRRTGSRRLMREPSVAVRETAAEHLEERQTDWAYSKPVVVLDVLWNLAFVAVAAAVLAASPAERPAVPLRVWLAGYVLQCLLHVLCVTVEYSRRRREAGQDGAADGDFKLSIVKHLESANTMFSFIWWIVGFYWVSAGGQALSHDAPQLYWLSIVFLAFDVFFVVFCVALACVIGIAVCCCLPCIIAILYAVTDQQEGASEEDINNLSKFKFRTMGDQDKLVAGIAAPVGGVMTECGTNPPVEHILSAEDAECCICLCPYEDGAELRELPCNHHFHCSCIDKWLHINATCPLCKFNIVKSNLDREEV

SEQ ID NO: 7471 - DNA, 1333 bp, Panicum virgatum
  misc_feature: Ceres CLONE 1911140
  misc_feature: Encodes the peptide sequence at SEQ ID NO. 7472
aaaattttctctctcactcgcatcgcaatcgcgtcgcatctcttcctcggttcctccggtggtctcctctgacctctgactccgcgcccactccccactgccactgccagcccagccagctccaccgcccccgatctggccgcccgccgctgctcccgagagcggccggaaccccagagctttgccggcggcgcatggatcccgccgcctcgtccgtggccgctgagctctggcggccgccgcaccaccacctcgcttccggcccccaacacgaggcctcttccgtcgtcaccgccgccgacctgggcaactgcggccgctccggcggcggctccagccgcaggaggccgcggcgcgagcgcgacgcgccgcccgaggaggagccagccaggctcgcctccacctccggcgccgccgccgccggtagcggcagcggcggccgagactcggccgacccagaagcaaaacgtttgaagcagatgacatctaatgaaagtaatgataaaataaggacagaagctgaaacaaattctgggaatgctagcaagtccattgataaaaaacctgcacctcaagagccaccgaaacaagactacatacatgtgagggctaggagaggtcaagcaacggacagccatagccttgcagaaagagcacggcgagagaaaataagtgaacggatgaaagttcttcaagatcttgtccctggatgcaataaggttatcgggaaagcatcagtccttgatgagataataaattatatccagtctttacagtgtcaagtggagtttttatccatgaagcttgaggcggttaatgcccatatgaacaatgcaactgtatcttttccatctaaagattttggtgctccagctccaccatataatacagcttctggtctgacattcaatccacaaacaccaagggaatacccccaggccttgacatcggattggcttcacatgcagattggcggtgcatatgaaagagtgacatgaataaaacaaggaaattgacaaaacaaaatttcttgtcgtagctaataaatagtgcaggggtcaatcaatgtccacggtgctaggtttcattcattttcctggttatcatgtcgccaaagttctttttttcccctaatttgggggcatagtgctgtagatgcattccacgttcgtctgggagcaagtctgtctttcattacttccatctgcttctgtgtacggattttgcgacaattcatatatgatgtatcccaggaaacttatgtagctcagattggtacaagaaaagatggaaattctgctgtatcgctttgtaaaaaaaaaaaaaaaaaaaa

SEQ ID NO: 7472 - protein, 267 aa, Panicum virgatum
  misc_feature: Ceres CLONE 1911140
  misc_feature (1)..(51): Pfam Name: HLH Pfam Description: Helix-loop-helix DNA-binding domain
  misc_feature: The sequence is a functional homolog of  SEQ ID NO 1930 in the  10/374,780 US patent application
  misc_feature: Useful for making plants with modulated growth and phenotype characteristics
MDPAASSVAAELWRPPHHHLASGPQHEASSVVTAADLGNCGRSGGGSSRRRPRRERDAPPEEEPARLASTSGAAAAGSGSGGRDSADPEAKRLKQMTSNESNDKIRTEAETNSGNASKSIDKKPAPQEPPKQDYIHVRARRGQATDSHSLAERARREKISERMKVLQDLVPGCNKVIGKASVLDEIINYIQSLQCQVEFLSMKLEAVNAHMNNATVSFPSKDFGAPAPPYNTASGLTFNPQTPREYPQALTSDWLHMQIGGAYERVT

SEQ ID NO: 7473 - DNA, 1132 bp, Panicum virgatum
  misc_feature: Ceres CLONE 1911175
  misc_feature: Encodes the peptide sequence at SEQ ID NO. 7474
attccccaatcggaccaaaccctagaagccatagaattcgatcggagatttggcatggcaatgtcagatcccccagccgccgtgatccccaagcccgacggcggcgacgacgacgagtcggtggagatccgggaggtgtgggcggacaacctcgaggaggagttcgccctgattcgtgacatcgtcgacgagttccctttcgtcgcgatggacacggagttcccgggcattgtctgccgccccgtcggcgccttccgctctccggcggactacaactacgccaccctcaaggccaacgtcgacatgctccacctcatccagctcggcctcaccttctccggcccgcgcggcgagctgccggccctcggcgctggccgccgccgctgcgtctggcagttcaacttccgcgagttcgacggcgcgcgcgacatcttcgcatccgactccatcgagctgctccgtcgcagcggcatcgacttccgccgaaatgccgagcgcggcgtcgatgcgcgccggctcgcggagctcctcatgtcctccggcgtcgtgctcaacgattcggtatactgggttaccttccacgcgggatacgactttgggtacctgctcaagatcctcacttgcaacagtctcccagacacgcaagccgggttcttcaaactcatgaagatatatttcccaaccgtgtacgacatcaagcacctcatgaagttctgcaacagcctgcacggcgggctgaacaagctcgctgaactgctcgacgtggagcgtgtgggggagtcccaccaggccgggtccgatagcctggtcacgtcctgcgcgttctggaagctcagggattcattcttcgctggctcaacagagaaatacgcaggcgtgctgtatgggctcaatgcagagaatggtgttagtgcacattgagggatggtactctatttgaattttagctttgtgaatggattgatttaggacagaaaaggtgacaagtgtgcaagagggctcaattaagaccaattctgtaggttaagtctgtctcactcagttccacctcatttggatgtaatcccatgtagtgttcttcagttgcttgttgaaatagttatttctctttcaaaaaaaaaaaaaaaaaaaa

SEQ ID NO: 7474 - protein, 288 aa, Panicum virgatum
  misc_feature: Ceres CLONE 1911175
  misc_feature (1)..(234): Pfam Name: CAF1 Pfam Description: CAF1 family ribonuclease
MAMSDPPAAVIPKPDGGDDDESVEIREVWADNLEEEFALIRDIVDEFPFVAMDTEFPGIVCRPVGAFRSPADYNYATLKANVDMLHLIQLGLTFSGPRGELPALGAGRRRCVWQFNFREFDGARDIFASDSIELLRRSGIDFRRNAERGVDARRLAELLMSSGVVLNDSVYWVTFHAGYDFGYLLKILTCNSLPDTQAGFFKLMKIYFPTVYDIKHLMKFCNSLHGGLNKLAELLDVERVGESHQAGSDSLVTSCAFWKLRDSFFAGSTEKYAGVLYGLNAENGVSAH

SEQ ID NO: 7475 - DNA, 1310 bp, Panicum virgatum
  misc_feature: Ceres CLONE 1911189
  misc_feature: Encodes the peptide sequence at SEQ ID NO. 7476
agattcagtactccgtagctagattcagctaagagcgaggcgcgagatggcagggggcgcagggcaggacgcggcgcgcgcgccgccggcgctaccgtggacggtgcgtctccagctcttcggcatcgtgacggccgccggcgccacgatgcggcgcgacggcacgatcaaccgcttcgtctacaacctcctcgaccgccgggtccgcgccagagcgcggccggacgggtccggcgtccggtccgccgacgtcggcgtcggcgcgccgcgcggcctgtgggcgcgcgtcttctcgccgtcgggggcggccggggcgccgctccccgtgctcatctacttccacggcggcggcttcgcgctgctctcggcggcctcggccccctacgacgccatgtgccgccggttctgccgcgagctcggcgccgtcgtcgtgtccgtcaactaccgcctcgcgcccgagcaccgctgccccgccgcctacgacgacggcgtggacatgctccgctacctcgcatccaccggcctcccaggcatctctgttccggtggacttctcccgatgcttcctcaccggggacagcgccggcggcaacatcgcccaccacgtggcgcgacgctggacggcaagcaccacctcctcagagtcgccgcctccgtccaacccaattcgcctcgctggcatcatcctggtgcagccgtactttggcggcgagcagcggacggacacggagctgaggctggacggcaaggcgccggtgctgaccatgcggggctcggactgggcgtggacggcgttcctgccggagggcgccgaccggaaccaccccgccgcgcacgtgaccgacgagaacgccggcctggacgacggcttcccgcctgcgatggtggtgatcggcgggctggacctgctacaggactggcagcggcggtacgccgacgtgctgcggcggaaggggaaagcggtgcgggtggtggagtacccggaggccattcacacgttctacttgttccccgtgctccccgactccggcaggctcgtcgaggagatgaaagcgttcatggaagagagcaacgcgtccgagctgactacttgatcaccgcttcgtcagttgaaatgcctcaatctagatctagctgtaagtgtattgccgttgctttatgtcgtttgtagttttgatcgtgtgacatatgagtgtaataggattagggtaatttagcagtcacttaatagttgcgttgtgtaaaggtggcaatgtatttcttttagcctagtggacatactactcagtccaaaaaaaaaaaaaaaaaaaa

SEQ ID NO: 7476 - protein, 348 aa, Panicum virgatum
  misc_feature: Ceres CLONE 1911189
  misc_feature (1)..(224): Pfam Name: Abhydrolase_3 Pfam Description: alpha/beta hydrolase fold
MAGGAGQDAARAPPALPWTVRLQLFGIVTAAGATMRRDGTINRFVYNLLDRRVRARARPDGSGVRSADVGVGAPRGLWARVFSPSGAAGAPLPVLIYFHGGGFALLSAASAPYDAMCRRFCRELGAVVVSVNYRLAPEHRCPAAYDDGVDMLRYLASTGLPGISVPVDFSRCFLTGDSAGGNIAHHVARRWTASTTSSESPPPSNPIRLAGIILVQPYFGGEQRTDTELRLDGKAPVLTMRGSDWAWTAFLPEGADRNHPAAHVTDENAGLDDGFPPAMVVIGGLDLLQDWQRRYADVLRRKGKAVRVVEYPEAIHTFYLFPVLPDSGRLVEEMKAFMEESNASELTT

SEQ ID NO: 7477 - DNA, 1291 bp, Panicum virgatum
  misc_feature: Ceres CLONE 1911211
  misc_feature: Encodes the peptide sequence at SEQ ID NO. 7478
acggtggggaccagtaccaccaagataagcttctcagctccgtctccgctcaagggccacagcccgcaaccgctcgccgcgcgcaagctccgtctccgctcaagggccacagcccgcaaccgctcgccgcgcgctcccccttcgagacgagccgcatcttctccccccgcgcgccgacccgctccggagagctaggcatggccgtcctcctccgcggcacgtccgccgctgccgccgcgaccgcggacccctcctcggcgctcctcgccaccaccttccgccgcgcccgcggctgcgggcttctcctgcctgccgcgccgcggccccgccgcgcgttcgcggcccgcgcctcggcgcagccgctcgaggtctgcgcgaaggagtccatcaccgtcccgggccgcctaggcgactgtccgttcacacaaagggttttgttgacaatagagcagaagcatcttccatatgatctaaagctagttgatctagctaataaaccagattggttatttgaaatcaatccagaaggtaaggtgcctattgtgaaggttgaggacaaatggatagctgattctgatgttataacacaagcattagaggagaagtaccctgaaccatccttggcaactccagcagacaaagcttcaatagggtcaaaaatattttccaccttcatcggtttcctcaaaagcaaagatcctagtgatggaacagaacgggcactacttgatgagctgacttcgtttgatacttatctgaaggataatggtccatttattaatggcggagcagtttctgctgctgatctctctctgggtcctaaactatatcacatggagatagctctgggtcacaagagttggtctgttccagattcactttcacatgtaaaacaatacatgaagtcaattttctcaatggattcttttgtcaaaactcaagctctgcaggaggatgtaattgctggatggcgcccaaaagtcatgggttaaatcacatttgtaaagtaacaagttcaggagagacatggctatcagaggatcaagatgcacatgttcgtcgcatgtgttaagtctgtacatgaaaggtgttgggtttttgttggagttttccagagcatagcatgtaaggtattcatatctgatctcctttgctttctctgtcagatagaaaatatcaataaaaatcagaaacctctcatggaattgagcattattgtcgaacaccgttctgttgaacaaaggggagctgttgtatagctgtttaacgcacaaaaaaaaaaaaaaaaaaa

SEQ ID NO: 7478 - protein, 264 aa, Panicum virgatum
  misc_feature: Ceres CLONE 1911211
  misc_feature (1)..(63): Pfam Name: GST_N Pfam Description: Glutathione S-transferase, N-terminal domain
  misc_feature (1)..(80): Pfam Name: GST_C Pfam Description: Glutathione S-transferase, C-terminal domain
MAVLLRGTSAAAAATADPSSALLATTFRRARGCGLLLPAAPRPRRAFAARASAQPLEVCAKESITVPGRLGDCPFTQRVLLTIEQKHLPYDLKLVDLANKPDWLFEINPEGKVPIVKVEDKWIADSDVITQALEEKYPEPSLATPADKASIGSKIFSTFIGFLKSKDPSDGTERALLDELTSFDTYLKDNGPFINGGAVSAADLSLGPKLYHMEIALGHKSWSVPDSLSHVKQYMKSIFSMDSFVKTQALQEDVIAGWRPKVMG

SEQ ID NO: 7479 - DNA, 1626 bp, Panicum virgatum
  misc_feature: Ceres CLONE 1911256
  misc_feature: Encodes the peptide sequence at SEQ ID NO. 7480
gaatccagtcaccatccgtgtatcacggtcagactgcgctccaggaatggcgccgcgccgcctgctccgagccggctgggggcctcaacgcccgtgcggctctcgccttgccgcggcgctgtgcgcggccgtggccgcgctggcgctggcacctgccgcggacgccacgtcggcatcgctcgtgggcatcaactacggccgcgtcgggagcaacctcccgccgccgcagtccgtgctgccgctgctcgagggcctcggcattggccgcgtgcgggtgtacgacgccgaccccgccgtgctgcgcgcgttcgcccggaccggggtcgagctcgtcgtcggcgtgccggacgagtgcctggccgccgtcgccgacccgggcggcgccgcgcagtggctgaagaggagcatcgtgccattcctgcaggacaccaagatcgccgtgctcaccatcggcaacgaggtgctcaccggcggcaacagctccgcgctctcgcgcgtcctgctcccggcgatgcagtccctgcacggcgcggtggccgcgctcggcctcgacaagcagatcaccgtcaccacggcacacaacctcggcgtgctcggcacgtcgtacccgccctcggcgggggccttccgcaaggacctgctcccctacctctgccccatcctggactacctcgcccggaccggctcgccgttcctcgtcaacgcgtacccctacttcgcctactccgacgaccccaagggcgtgcagctcgactacgcgctgctcgagccgggctacgccggcgtccaggaccccaactctcggctgcactacccgaacctcctcgtggcgcaggtggacgccgtgtaccacgccatcgcggcggccaacaccgcggcgtcgcgggtggtggaggtgcgggtctcggagaccgggtggccctccgcgggggccgccaacgagacgggcgcgacgccgcagaacgcggcgcggtacaacagcaacgcgatgcggctggtggcggagggcaggggcacgccgcttaagcccggggtgccgctgcgagcctacgtgttcgcgctcttcaacgagaacctcaagcccgggctggcgtccgagcgctactacggcctgttcaagcccgacggcacgccggcgtacgagctctccttcaagctgccgcgcgacaactccaccttcggccacggcggcggattcggcgggagtggcggcggcaacgccaatggcagcagcggatactttaacggcggcggaaacagcggcggctactacgacatctccgctgcggcgccggcgcgtgaccctccgggccgctggtggcggacgtgggcgcaggcggccgtggcagcagccgtgctggtggtggcggtgtgagatcacggcgtggcgccaccccgcactgccttgatggaacggcagatcgtcaggggtgggtaggtagatcatgtaggaacagggtggtgccgtcctggcgcagcggcatgccggcattgacgatgatgaccacctgatctcgtggtgctcgtttgctgtggtttctgggtgacctgatgcttttggtggcagccaagcgctcttagtcaagcaacattggattagtttccgaaaaaaaaaaaaaaaaaaaa

SEQ ID NO: 7480 - protein, 442 aa, Panicum virgatum
  misc_feature: Ceres CLONE 1911256
  misc_feature (1)..(324): Pfam Name: Glyco_hydro_17 Pfam Description: Glycosyl hydrolases family 17
MAPRRLLRAGWGPQRPCGSRLAAALCAAVAALALAPAADATSASLVGINYGRVGSNLPPPQSVLPLLEGLGIGRVRVYDADPAVLRAFARTGVELVVGVPDECLAAVADPGGAAQWLKRSIVPFLQDTKIAVLTIGNEVLTGGNSSALSRVLLPAMQSLHGAVAALGLDKQITVTTAHNLGVLGTSYPPSAGAFRKDLLPYLCPILDYLARTGSPFLVNAYPYFAYSDDPKGVQLDYALLEPGYAGVQDPNSRLHYPNLLVAQVDAVYHAIAAANTAASRVVEVRVSETGWPSAGAANETGATPQNAARYNSNAMRLVAEGRGTPLKPGVPLRAYVFALFNENLKPGLASERYYGLFKPDGTPAYELSFKLPRDNSTFGHGGGFGGSGGGNANGSSGYFNGGGNSGGYYDISAAAPARDPPGRWWRTWAQAAVAAAVLVVAV

SEQ ID NO: 7481 - DNA, 1300 bp, Panicum virgatum
  misc_feature: Ceres CLONE 1911325
  misc_feature: Encodes the peptide sequence at SEQ ID NO. 7482
ctctgatcctccccctgcccccagccgccctgctcagctcagctcaccctcgctcgccaccacaccgccgccgctcccctcgcccggatctcgccatgggcgtcgccaccaacggctcggcggcggagcaggcgcccgcgccggcgctcaagttcctcatctacggccgcacgggctggatcgggggcctgctgggcggcctctgcgcggcgcgcgggatccccttcgcctacggcgccggccggctcgagaaccgcgcgcagctcgaggccgacatcgacgccgcggcgcccacgcacgtgttcaacgccgcgggcgtcacgggccgccccaacgtcgactggtgcgaggcgcaccgcgccgagaccgtccgcgccaacgtcgtcggcacgctcacgctcgccgacgtctgccgcggccgcgggctcgtcctcatcaactacgccaccgggtgcatcttcgagtacgacgacgcgcacccgctcggctccggggtcggcttcaaggaggaggacacgcccaacttcgtcggatcattctactccaaaaccaaggccatggttgaagaactgctcaagaactacgagaatgtttgcacccttcgtgtaaggatgcctatttcatcagatctctccaatccccgcaatttcattaccaaaatcaccagatacgagaaggttgtcaacatcccgaattcaatgacaatactggatgaacttcttcccatctcaatcgaaatggcgaagagaaacctcactggaatatggaatttcacaaatcctggtgtggtgagccacaatgagatactcgagatgtacagagactacatcaacccaagcttctcttggaaaaacttcaatctggaagagcaagcaaaggtcatagttgcaccgaggagcaacaatgagctcgaccaaactaagttgaagaatgagttcccggagcttttgtccatcaaggagtcgctgatcaaatacgttttcgagccaaatcggaagacgtccaaggcttgagaaattgctggaaacaattgtatgttggtgctatttattccatctgaaatgacatttttctctatgccgatcatcaataagcacgcccccctgtttcgtgtgcattgtatttgaagcagataggtttctcatgggatgtcatgccatactccttgttacgttcagattattatacggagaaagacaaggtgtaatctagctcaactttcctccttggctattaacaataagatgggaatgaaccggggagcttcctctgttgtgccgaaaaaaaaaaaaaaaaaaaa

SEQ ID NO: 7482 - protein, 305 aa, Panicum virgatum
  misc_feature: Ceres CLONE 1911325
  misc_feature (1)..(144): Pfam Name: Epimerase Pfam Description: NAD dependent epimerase/dehydratase family
MGVATNGSAAEQAPAPALKFLIYGRTGWIGGLLGGLCAARGIPFAYGAGRLENRAQLEADIDAAAPTHVFNAAGVTGRPNVDWCEAHRAETVRANVVGTLTLADVCRGRGLVLINYATGCIFEYDDAHPLGSGVGFKEEDTPNFVGSFYSKTKAMVEELLKNYENVCTLRVRMPISSDLSNPRNFITKITRYEKVVNIPNSMTILDELLPISIEMAKRNLTGIWNFTNPGVVSHNEILEMYRDYINPSFSWKNFNLEEQAKVIVAPRSNNELDQTKLKNEFPELLSIKESLIKYVFEPNRKTSKA

SEQ ID NO: 7483 - DNA, 1271 bp, Panicum virgatum
  misc_feature: Ceres CLONE 1911365
  misc_feature: Encodes the peptide sequence at SEQ ID NO. 7484
accagcaaccaccaaaaccaaagtagctaccagaggaagaggctcttgctgtgttgggacactctagtctggaccaagtgccgagcagacaacccgaagcgattcctgttccgatccgtggtgcgcgctcatggatggcacaatctccaatccgccaggcacaaggattgccgtggtcaccggcgggaacaaagggatcgggctcgaggtgtgccggcagctggccgccagcggcgtcaccgtcgttctggcagcccgggacgagacgaggggcgcggccgccgcggagaagctccgagagcagggggtcgccggcgtcatcttccatcagctcgacgtcaccgatgcttcaagcatcgctcggctggcggagttcctcaaggcccgtttcgggaggctggacatcctggtcaacaacgctgccattggcgggatcgagcttgtagacgatccgtcttttggtccaaaacccgtgggcgagcagttcgatggcatggattggcaccagagaattggatggatgtataaaaacagccggcagacctacagcacggcgaaggagggcctgcagacgaactactacggcacaaagcacgtcaccgaggctcttctgcccctcctgcaatcctcctccgacggcagggttgttaacgtcagctccggctttgggctgctaagatacttcaggagtgaggagctgaagcaggagctgaacgacgccgacaacctcaccgaggagaggctggacgagctgctggacacgttcctgcgggacttcgaggctggggcgcccgcgctgggggctcgcgggtggccggacgagttcgcgtcgtacaaggtggccaaggcggccgtgaacgcctactcgaggatcatggcgaggaggcacccggagctgcgcgtcaactgcgcgcatcccggctacgtcaggaccgacatgaccaggaactcggggctcctcacgcccgaggagggggcgagcaacgtcgtgaaggtggcgctgctccccgccggtgggccgaccggcgccttcttcgcgatggggaaggaggcgtcgttcctctgacggtgaacagagacactggccactgcacgcgcggctctgtttagttcgaataaagatcaccatcgctcctctgtttaattcgatacatatcctttccacctttccaagtccaatcttggaaaaaagatgtaacgaattttgcaatttttaggtcgtgcggaccatactttggttttcagaactacaaaaaaaaaaaaaaaaaaaa

SEQ ID NO: 7484 - protein, 311 aa, Panicum virgatum
  misc_feature: Ceres CLONE 1911365
  misc_feature (1)..(84): Pfam Name: adh_short Pfam Description: short chain dehydrogenase
MDGTISNPPGTRIAVVTGGNKGIGLEVCRQLAASGVTVVLAARDETRGAAAAEKLREQGVAGVIFHQLDVTDASSIARLAEFLKARFGRLDILVNNAAIGGIELVDDPSFGPKPVGEQFDGMDWHQRIGWMYKNSRQTYSTAKEGLQTNYYGTKHVTEALLPLLQSSSDGRVVNVSSGFGLLRYFRSEELKQELNDADNLTEERLDELLDTFLRDFEAGAPALGARGWPDEFASYKVAKAAVNAYSRIMARRHPELRVNCAHPGYVRTDMTRNSGLLTPEEGASNVVKVALLPAGGPTGAFFAMGKEASFL

SEQ ID NO: 7485 - DNA, 1524 bp, Panicum virgatum
  misc_feature: Ceres CLONE 1911593
  misc_feature: Encodes the peptide sequence at SEQ ID NO. 7486
acagattcctagagacccccacaaaaaggaaagaggggaagagagaggggcgacgcaggggttgcagagaaaagagaatacacccccgccattcgcgccccagaggctgggaactccaaagaggaacagggtccatggagggtggaggcgcaggaaatggtttcactgggacggcgcagacaaaggggactgggggtgatggctccgccaagccgctgcccccttgctgcgtcaaggccagggccgcggcggctgagtctgaggccaagtgtcatgctacagtggtgtcgggatggttcaccgaaccacggtcacgatgcggtaaagcaagcaaagttcaatactacaataacccgatgtggccaggagaggcccactccttgaaagtggagaagatcttgtaccaggggaagtcaccataccaagaagtcttagtttttgagtcgtcaacctatggtaaagtccttgtgcttgatggcattgttcagttgactgataaggatgaatgcgcgtaccaagaaatgattactcacctcccactttgttccatttcatcccctaaaaaggttttagttattggtggtggtgatggtggtgtactccgagagatttccagacatagttctgtggagtctattgacatatgtgaaattgatcagctggttattgatgtttgcaaagatttcttcccacaactgtctgttggatttgaagatcctcgtgttcaacttcatgttggtgatgctgtggagttcttgagaaatgctcctgaaggtacatatgacgctatcattgttgattcatcagacccaatagggcctgctcaggaacttgtggagaagcctttttttgatacaattgctagagccttgaggcctggtggagttctttgtaatcaagctgagagtatgtggttgcatacacatctgattcaggatatgctttcaatttgccatgagactttcaagggttctgtgcactatgcatggactagtgtcccaacatacccgagtggagtgattgggtttttgctatgtgccaaagaaggcccaccggtcaacttcctgactcctataaatccaattgaaaaacttgagggagctacaaaagctggaagggagatcagattttataattcagagatgcatagggcagcatttgttcttccgacctttgtgaaaaaagagctagaagcgtattgcgtttccaccggaagggaagagccagaggaaacagctgcaacagcaccgaagattactgttacttcgaagagcgaaattctcactgcatcctagaccagggctcacgacccatcatgcgatatcaagaaatagttccttcccggccctcttgggtatccagtggataaactcagcaatgtgccatcccatattgtaaccatctgttaataattcatgctctgaatgatgagatgagattagcatgttctgaagagaaaagacgagctggcagtgcaatgtatgatttgagcgatgaacatttcaaaaaaaaaaaaaaaaaaaa

SEQ ID NO: 7486 - protein, 386 aa, Panicum virgatum
  misc_feature: Ceres CLONE 1911593
  misc_feature (1)..(260): Pfam Name: Spermine_synth Pfam Description: Spermine/spermidine synthase
  misc_feature (35)..(350): SWISSPROT Homolog: EC 2.5.1.16 Spermidine synthase 1
  misc_feature (73)..(354): SWISSPROT Homolog: EC 2.5.1.16 Spermidine synthase
MEGGGAGNGFTGTAQTKGTGGDGSAKPLPPCCVKARAAAAESEAKCHATVVSGWFTEPRSRCGKASKVQYYNNPMWPGEAHSLKVEKILYQGKSPYQEVLVFESSTYGKVLVLDGIVQLTDKDECAYQEMITHLPLCSISSPKKVLVIGGGDGGVLREISRHSSVESIDICEIDQLVIDVCKDFFPQLSVGFEDPRVQLHVGDAVEFLRNAPEGTYDAIIVDSSDPIGPAQELVEKPFFDTIARALRPGGVLCNQAESMWLHTHLIQDMLSICHETFKGSVHYAWTSVPTYPSGVIGFLLCAKEGPPVNFLTPINPIEKLEGATKAGREIRFYNSEMHRAAFVLPTFVKKELEAYCVSTGREEPEETAATAPKITVTSKSEILTAS

SEQ ID NO: 7487 - DNA, 1300 bp, Panicum virgatum
  misc_feature: Ceres CLONE 1911687
  misc_feature: Encodes the peptide sequence at SEQ ID NO. 7488
gcaaaccacaatatacaagagacggcagcagttgcatagaaccatggagctagcgggccaggccttgcttgacgctcagcttgacctctggcaaaacacattcgcctatgtcaagtccatggccctcaaatctgccatagacctccgcatcgccgagaccatccaacaccatggaggcggtgccaccctctcccaaatagccaccagagctatggtccctccggccaagatcccctgcttgagccgcctcatgcgcgtgctcacggccactggtgtcttcaatgcccaaaagacacgatcgggcattagcagctgcgagcagctcttttactcgctcacaccgatgtcctgcctccttgttggctcacgaaaccaggcccccatcaccactatgttactccaatcgaccctcgtctcctccttgtttgagcttggtgggtggctccggcgtgagctgcccgaaccatgcatgttccagctgaggaacgatcacacactttgggagctagccgacagtgacccaaagttcaacgcgctcttcaacaacgggatgaactcagacactgaattcatcatggacattgttgtcaacgagttcggggaggtattccacggggtagactcattgatcgacgtcgctgggggacatggcgccgcggcacatgccatcatgaaggcgttcccgcatctgaaatgcagtgtgctagaccttggccatgttgttgcagatgctcccaacgacaccaacgtgcactatatcgctggcaatatgtttgagaccgtgccaccagcgagcatgatatttctcaagtgggtcttgcatgactggggcgacgaagaatgtgtcaagatattgaagaactgcaaagaagctattgctccaagagacaaaggtggaaaggtggtaatcatagatattgtgattggtgcaggacagtccgacaagcagcggaaagagatgcaggtcgtctttgatatgttcatcatgtttatcaatggcattgagagagatgagaaccagtggaagaagatcttcttcgaagcaggattccgcgactacaagataacaccagttcttggcgttcggtcaatcattgaggtctacccatgacgtccatgcaatatatcagcaattcagcatcttttccaataagttttaaataagtttgcatgttgacagacagtggggtgtgtgtgtgtgacgagttttatcgacactcgcgtgtagttactctcattatcaatatactgctgtgtgtatgtccccatacacatttatcaaaaaaaaaaaaaaaaaaaa

SEQ ID NO: 7488 - protein, 355 aa, Panicum virgatum
  misc_feature: Ceres CLONE 1911687
  misc_feature (13)..(253): Pfam Name: Methyltransf_2 Pfam Description: O-methyltransferase
MELAGQALLDAQLDLWQNTFAYVKSMALKSAIDLRIAETIQHHGGGATLSQIATRAMVPPAKIPCLSRLMRVLTATGVFNAQKTRSGISSCEQLFYSLTPMSCLLVGSRNQAPITTMLLQSTLVSSLFELGGWLRRELPEPCMFQLRNDHTLWELADSDPKFNALFNNGMNSDTEFIMDIVVNEFGEVFHGVDSLIDVAGGHGAAAHAIMKAFPHLKCSVLDLGHVVADAPNDTNVHYIAGNMFETVPPASMIFLKWVLHDWGDEECVKILKNCKEAIAPRDKGGKVVIIDIVIGAGQSDKQRKEMQVVFDMFIMFINGIERDENQWKKIFFEAGFRDYKITPVLGVRSIIEVYP

SEQ ID NO: 7489 - DNA, 1207 bp, Panicum virgatum
  misc_feature: Ceres CLONE 1911898
  misc_feature: Encodes the peptide sequence at SEQ ID NO. 7490
ggaaacaaggccgcattctttattgcgttcactccagcctcgtgaagcttccggcgccgcgccgcccgcgcgcggacgcggagaactatatgataaacctgcatcggtttcgtcttgcgtccggatctccatctcccacgagcccacgacggcgtgccactctctctgcgtccccacacctcgccgccgtcctccttcctcctcgtcgcagaccgccctcgcgagcaagctagctagctatagggaccatgtggctgtcgccgccgccgttcctgtacgcgccgacgccgttcgtgttggcggtgtcggcgacggccgccgtcgtggtagccttcctggccatctcggagttcctcggcgacaacctggcctactccaagttctcgcgcggcggcctcggcaagaagccgcagccgatctcccggcgcctgccgagccgcggcgcgatgctgctgatctacgcgccggcgctggccgccgcgctggcgtccttcgcggtgcctggcgccgtatccggaccccgcgagcgcgccctggccgccgccatcgccgcgcacttcctcaagcgggtcctggaggtggcgttcgtgcaccgctacagcgggagcatgccgctgcccacggcgctgatcatctcctcctactacctctccaacgccgtggccatggtctacgtgcagcgcctgagccgcggcctgcccgagccgcgcgtcgacctgctctgccccggcgcgctcgccttcgccgtcggcctagccggcaacttctaccaccactggctgctctcgaggctgagggccggtcacggcgccggcggcggagacggcggagagaaggcgtacaggatccccacggggggtatgtttgggctcgtcgtctgcccgcactacctctttgagatcgccgtcttcttcggcttcgccatgatctcgcagacgctctacgcgctcaccgtcgcgctcggaaccgccgcgtacctcgccggccggagttacaccaccaggaagtggtacgcgtccaagttcgaggacttcccggcgagcatcaaagctcttgtgccgtacgtgtggtgatccctcgatcggcaggctgggagagcacgagatgagcgctgactttgtgcgaactagtactatcagagtacggttatctgaaggatctatctccttgtaagttgattaatatttaaaaaaaaaaaaaaaaaaaa

SEQ ID NO: 7490 - protein, 274 aa, Panicum virgatum
  misc_feature: Ceres CLONE 1911898
  misc_feature (1)..(111): Pfam Name: Steroid_dh Pfam Description: 3-oxo-5-alpha-steroid 4-dehydrogenase
MWLSPPPFLYAPTPFVLAVSATAAVVVAFLAISEFLGDNLAYSKFSRGGLGKKPQPISRRLPSRGAMLLIYAPALAAALASFAVPGAVSGPRERALAAAIAAHFLKRVLEVAFVHRYSGSMPLPTALIISSYYLSNAVAMVYVQRLSRGLPEPRVDLLCPGALAFAVGLAGNFYHHWLLSRLRAGHGAGGGDGGEKAYRIPTGGMFGLVVCPHYLFEIAVFFGFAMISQTLYALTVALGTAAYLAGRSYTTRKWYASKFEDFPASIKALVPYVW

SEQ ID NO: 7491 - DNA, 1441 bp, Panicum virgatum
  misc_feature: Ceres CLONE 1911929
  misc_feature: Encodes the peptide sequence at SEQ ID NO. 7492
gccgatttggacgccactggcagcagcagcaccaccgccagccgccgctccagctcctccgtttctccggtgcaacccgccgccgcccacctcagactcagataaagccaccgcgcgcggcctggcaatggcaccgacggaggcggagcagcacccgcggagggcgctggcgctcgcggcgcacgacgcctccggccgcgtcacccccatccggatctcgcgaagggacactggagacgacgatgtcgctataaaggtactgtactgtgggatatgccactctgacctgcacactgttaagaatgagtggaggactgccatctacccagttgtccctgggcatgagatcgccgggctggtcaccgaggttggcaagaacgtgcagaagttcagcgtcggcgacagggtcggcgtcgggtgcatggccaacacttgccagtcctgcgagagctgcgaggcagggctcgagaactactgctccaagatcgtcttcacctacaactcccgcgacagggacggcaccgtcacctgcggtggctactccgacatggtcgtcgtgaaccagcacttcgtcatccggttccccgacggcatgcccctcgacaggggcgcgcccctgctctgcgctgggataaccgtgtacacccccatgaagtaccacgggctgaacgagcccggcaagcgcatcggcgtgatcggcctcggtgggcttgggcatgtcgccgtgaagttcgcgaaggcgttcgggatgagggtgaccgtgatcagcacgtccccggagaagagggaggaggccatggagaagcttggcgcggatgactttgttgtcagcagcgatgctggtcagatgaaggccgcgaagggcacaatgcacggcattataaacacggcctctgcaagcatgtccatgtacccttacctcgctctgctcaagccccagggcaagatgatcttgcttggcctgcctgagaagcctctgcagatctctgccttctctttggttgctggcggcaagactctggccgggagctgcatggggagcatcaaggacactcaggagatgatggactttgccgctaagcacgagttgacggcggacgttgaggtggttggcgccgatgatgtgaacgatgcactggagcgcctcgccaagggcgaggtcaggtaccgcttcgtcatcgacatcagcaacacccttgctacggcgtgactagcgggctcaccggtctcagccttgtagctagctacggcttatcacgacaccagattctgatcagtaaacgtactaagggtgttacttgcttaagcatactattgtgagttggtgtaatgtgcaagtcagcaagtgagataagggaaggaatatttggaataaaaagaagctctatggtttgaatgcaactataatgtttgtcttgtgcaaaaaaaaaaaaaaaaaaaa

SEQ ID NO: 7492 - protein, 360 aa, Panicum virgatum
  misc_feature: Ceres CLONE 1911929
  misc_feature: Great-hit functional homolog of the protein sequence encoded by LOCUS At2g21730
  misc_feature (1)..(117): Pfam Name: ADH_N Pfam Description: Alcohol dehydrogenase GroES-like domain
  misc_feature (1)..(359): SWISSPROT Homolog: EC 1.1.1.255 Mannitol dehydrogenase
  misc_feature: Useful for making plants with altered cell wall content and/or composition
MAPTEAEQHPRRALALAAHDASGRVTPIRISRRDTGDDDVAIKVLYCGICHSDLHTVKNEWRTAIYPVVPGHEIAGLVTEVGKNVQKFSVGDRVGVGCMANTCQSCESCEAGLENYCSKIVFTYNSRDRDGTVTCGGYSDMVVVNQHFVIRFPDGMPLDRGAPLLCAGITVYTPMKYHGLNEPGKRIGVIGLGGLGHVAVKFAKAFGMRVTVISTSPEKREEAMEKLGADDFVVSSDAGQMKAAKGTMHGIINTASASMSMYPYLALLKPQGKMILLGLPEKPLQISAFSLVAGGKTLAGSCMGSIKDTQEMMDFAAKHELTADVEVVGADDVNDALERLAKGEVRYRFVIDISNTLATA

SEQ ID NO: 7493 - DNA, 1567 bp, Panicum virgatum
  misc_feature: Ceres CLONE 1911935
  misc_feature: Encodes the peptide sequence at SEQ ID NO. 7494
agaggagaggccgcgagcccacccaacagcacgaggcacgagcgctctcgctcacgagtcacacacacttcccacccaatccatccgccaccgccgcccgatccctccctccgatcctcgccggaatggcgggctcctccgcggtctgggccgcgcaccgcgccagctgcaggccccagcacccgtcctcctcctcctcgtcccagcgcccgcgccggggcgccggcgtcctcccgctcccgcccaggcggggcggcgcctccctcgccgccgccgcggccaccgccaccgcggcgccgcccgtggcgaggacggcgtcggaggaggccgtctacgaggtcgtgctgcggcaggcggcgctcgtggagggcgccgtcgcgagcgcggcggcggcgcggcggcgcccgcgctgggcggaggagaaggaggaggaggggctccgcgggtggggcctcctcggcgacgcctacgaccgctgcggcgaggtctgcgccgagtacgccaagaccttctacctcggcacacagcttatgactcctgaaaggcgcaaagctgtctgggcaatctatgtatggtgcagaagaaccgacgaactagtggatggtcctaacgcgtcgtacatcacaccgactgctcttgatcggtgggagaagcggctagaagatcttttcgaaggccgtccgtatgacatgtacgatgcagccctctcagacacggtgtcaaagtttccggtagatatccagccattcaaagatatgattgaagggatgaggcttgacttgtggaagtcgaggtacaggacctttgatgagctctacctctactgctactacgtcgctggcacagttggcctcatgacagttcctgtaatgggcatcgccccagactcaaaggcctctactgagagcgtgtacaatgctgcactggctcttggcatcgctaaccaactgacgaatattctcagagatgtaggcgaagatgcaaggagagggagaatataccttccactggacgagcttgcacaggcaggtctgacggaagatgacattttcagagggaaagtgactgataagtggaggagattcatgaagggccagattcagcgtgccaggttgttcttcgacgaggctgagaagggtgtggcccatctagactctgcgagcagatggccggtcctcgcgtccctctggctgtacaggcagatcctcgatgccatcgaggcgaatgactacaacaacttcaccaagcgcgcctatgttggcaaggcgaagaagctgctgtcgctgccagccgcgtacgcaagagcagctgttgggtcatgatgcgtctgaagatcagatgttcattttttttttcttctctcagcttggtgttcccttttttttctttcatttttgggagatctgttgggtgttgtatataatcagcttcagttgcctgcatggcataagcctgtgtgtcacacacagttgttagtctaggggaccaggtccctcaatactcagctcttgtcacgacacagaatggaaagaaagttagaattcaagaagcattattagttgtggat

SEQ ID NO: 7494 - protein, 398 aa, Panicum virgatum
  misc_feature: Ceres CLONE 1911935
  misc_feature (3)..(275): Pfam Name: SQS_PSY Pfam Description: Squalene/phytoene synthase
  misc_feature (1)..(275): Pfam Name: SQS_PSY Pfam Description: Squalene/phytoene synthase
  misc_feature (1)..(275): Pfam Name: SQS_PSY Pfam Description: Squalene/phytoene synthase
  misc_feature (1)..(270): Pfam Name: SQS_PSY Pfam Description: Squalene/phytoene synthase
MAGSSAVWAAHRASCRPQHPSSSSSSQRPRRGAGVLPLPPRRGGASLAAAAATATAAPPVARTASEEAVYEVVLRQAALVEGAVASAAAARRRPRWAEEKEEEGLRGWGLLGDAYDRCGEVCAEYAKTFYLGTQLMTPERRKAVWAIYVWCRRTDELVDGPNASYITPTALDRWEKRLEDLFEGRPYDMYDAALSDTVSKFPVDIQPFKDMIEGMRLDLWKSRYRTFDELYLYCYYVAGTVGLMTVPVMGIAPDSKASTESVYNAALALGIANQLTNILRDVGEDARRGRIYLPLDELAQAGLTEDDIFRGKVTDKWRRFMKGQIQRARLFFDEAEKGVAHLDSASRWPVLASLWLYRQILDAIEANDYNNFTKRAYVGKAKKLLSLPAAYARAAVGS

SEQ ID NO: 7495 - DNA, 1388 bp, Panicum virgatum
  misc_feature: Ceres CLONE 1911944
  misc_feature: Encodes the peptide sequence at SEQ ID NO. 7496
acattttgccattcgcccccagaaggcccatctctctctctctctctctctctctctctgacccgccccctttcccctcggtggctcggtctcacttgcctcctcacctcgccttcgccatggcgttcttctctcaccaccatctccagcagccgcacccgcagcaggccccgccgccgccgcagcatcagcaacagccggtgcttccttccttcaggaacgcgctgccagtgccggtggatggccagatcccggcgccctttgccttcttcaacccgccgcctgccttcccggagcagcccgcgcaggcaccgctggtggatgcggtggggttgacggcggccgcggggcttgggtggaggcagccgagggagcaagagctgcttggggagaactcccagatgtcgtccatcgatttcctgcagacgggctcggcagtgtcaacggggctggcgctgtctcttgaggaccggcgccacggcgggggcgggggcgggggcggcggggctgagaactcctcgggcgattccccgctgctcctgctgcccatgctggacgatgacatctcccgcgaggtgcagcggcttgatgctgatatggaccggttcattaaagctcagagtgaacggctaaggcaatctatattggagaaagttcaggcaaagcaatttgaggcactggcctctgttgaggacaagatactacggaaaatacgggataaagaggctgaagtggagaccattaacaaaaggaactctgaacttgaggatcagattaagcagttggcagtggaagttggtgcgtggcaacaaagggccaagtacaatgagagcatgatcaatgcactcaagtacaacttggagcaggtatgtgcccatcagagcaaggatttcaaggaaggttgtggtgatagcgaggtagatgacacggcatcctgttgcaatggtggtgccgtcaatttgcaactgatgccgaaggagaacaggcaaccgaaggatttgacggcctgcagggtctgtaattcaagcgaggcatgcatgctcttgttgccttgtcggcatctttgcctatgcaaggagtgcgagagcaagctgagcttctgccccctgtgccagtcctcgaagatacttggcatggagatatatatgtagaatagaatttatgtaccacatgagtatcttacgaggtatcttacaagatactgctgtgttaatatgccaatctattgccaaactttagaacctgtgtaccactatgacctgccacttgatcgaaaagactgccgtttatggtagatttgcctcagcaaatttcatcagactttaatgcttaatttgtaataaacttcttagtagagttgattttgtcaaaaaaaaaaaaaaaaaaaa

SEQ ID NO: 7496 - protein, 343 aa, Panicum virgatum
  misc_feature: Ceres CLONE 1911944
  misc_feature: Great-hit functional homolog of the protein sequence given in SEQ ID NO 9446
  misc_feature (1)..(35): Pfam Name: zf-C3HC4 Pfam Description: Zinc finger, C3HC4 type (RING finger)
  misc_feature: Useful for making plants with altered Lignin content
MAFFSHHHLQQPHPQQAPPPPQHQQQPVLPSFRNALPVPVDGQIPAPFAFFNPPPAFPEQPAQAPLVDAVGLTAAAGLGWRQPREQELLGENSQMSSIDFLQTGSAVSTGLALSLEDRRHGGGGGGGGGAENSSGDSPLLLLPMLDDDISREVQRLDADMDRFIKAQSERLRQSILEKVQAKQFEALASVEDKILRKIRDKEAEVETINKRNSELEDQIKQLAVEVGAWQQRAKYNESMINALKYNLEQVCAHQSKDFKEGCGDSEVDDTASCCNGGAVNLQLMPKENRQPKDLTACRVCNSSEACMLLLPCRHLCLCKECESKLSFCPLCQSSKILGMEIYM

SEQ ID NO: 7497 - DNA, 1378 bp, Panicum virgatum
  misc_feature: Ceres CLONE 1912010
  misc_feature: Encodes the peptide sequence at SEQ ID NO. 7498
ctagctagatagcttcgagactccagtgagatggctccggttggccttctgctcgtcggtgtcgtgaccgcggtggcggggctgcttctcgaggcggcggtgccggcgagtgccgcactgccgcgggtggagcacccgcccaaggccggcgggacgctcgccgtcctcgccgtcggtgactggggccggcgtgggcagttcaaccagaccttggtcgcccagcagatgggagtggtggggcagaagatggacatcgacttcgtcatctccaccggcgacaacatctacgacgacggcatcgccaacaccagcgacccgctcttcaaggagtccttctccaacatctacaccgccaagagcctccagaagccttggtacctcgtccttggcaaccatgactacactggcaacccgctcgcgcagctggaccccgccattcgcaacgtggacagcaggtacaccgccattgcaaagtcgttcatcgtcaactcaggaattgcggatttcttcctcatcgacacgataccattcatcctccattactggaacaagaccaagtttgattggagaggggttgctcctcgcgacacctacatcacaaacctcctcaaggatctggggtacgcgctgacggagtccaaggccgcctggaagatcgtcgtcggccaccaccccatcagcagcggctgcggccacgggaacaacactgagctcgaggagctgcttctcccggtcctcaaggcccacggcgtcgacatgtacgtgaacggccatgaccattgcctgcagcgcatcagcagcagagacagccatcttgagttcctgacgagtggcggcgggtccaaggcatgggctggcaagttcaaggccacccccgacaaggtggagttcctctacgacgggcagggcttcatgtcgatgcggctgagcaagacggaggcccacctcgccttctttgacgtcaccggcaaggcactgcactgctggggcctcaccaagaatgcagccgctgggcgctagcttagctggactcttgcctatagctgtcaggcaacagtacgattagttgagcaaagcacgtacaaggaaattaatcgtttgcataataaactgtaagcagttgttgttattgtgttgttgttgttgttagttgtgtgcatgtgagtgtgcaagtgtgatggtgtgaaatatttgtaccctactcccttcgttctaaaatgtaggtcgttttgacttttctaggttcatatattttgctatgtacctagacatatgttatatctaggtgcatagtaaatactatgaatctagaaaagtcaaaacgacctacattttggacggatggagtatatataagagaaamtctcatattccacgg

SEQ ID NO: 7498 - protein, 329 aa, Panicum virgatum
  misc_feature: Ceres CLONE 1912010
  misc_feature (1)..(212): Pfam Name: Metallophos Pfam Description: Calcineurin-like phosphoesterase
MAPVGLLLVGVVTAVAGLLLEAAVPASAALPRVEHPPKAGGTLAVLAVGDWGRRGQFNQTLVAQQMGVVGQKMDIDFVISTGDNIYDDGIANTSDPLFKESFSNIYTAKSLQKPWYLVLGNHDYTGNPLAQLDPAIRNVDSRYTAIAKSFIVNSGIADFFLIDTIPFILHYWNKTKFDWRGVAPRDTYITNLLKDLGYALTESKAAWKIVVGHHPISSGCGHGNNTELEELLLPVLKAHGVDMYVNGHDHCLQRISSRDSHLEFLTSGGGSKAWAGKFKATPDKVEFLYDGQGFMSMRLSKTEAHLAFFDVTGKALHCWGLTKNAAAGR

SEQ ID NO: 7499 - DNA, 1528 bp, Panicum virgatum
  misc_feature: Ceres CLONE 1912043
  misc_feature: Encodes the peptide sequence at SEQ ID NO. 7500
atcgctactggccccagccatcctcccccaccagactgtacaattacaaagctccgcactcgcatgctcttcgccccctcacgcttgccgctccagcgcttcccgcctcgccgtctccgcctcgttccgggctccccgatggcctccacgctcgccatcctcaggccctccgcgccggcaccgctcgcggggccacggggccgggttgccgcgccggctaccgcgagggtggcgctgtcgtccagatctaggtacttatcggccagggtgtcgctcgggtcggaggtggcggtgggcgacgcgctcttcgctgactacaagcccaccaccgcttttctcttccccggtcagggtgcccaaactgttggaatgggcgcagaggctcaaagtgttccagccgctgccaaactgtttaaccaggcaaatgacatactcggatacgatttgttggatctttgcaccaatggaccaaaagaaaagcttgactcaacagtgatcagccagccagctatatatgttaccagccttgcagcagtagaggtactacgtgcacgagatggaggcaaagatgtgatcaactctgttgatgttacatgtggtctcagcttgggagaatacactgcacttgcatttgctggtgcttttagctttgaggacggactgaagcttgtcaagctaagaggagaagctatgcaggatgcttcagatgctgccaatagtgcgatggttagtgtaattggtctagattcagaaaaggtgcaagagctatgtgatgctgctaatgaggaagtagatgaaaaggaaagagttcagattgcaaactttctctgtccagggaattatgcagtttctggtggtgtaaaaggtatcgaagtggttgaagccaaagcaaaatccttcaaggctagaatgacggttcgccttgctgttgctggtgccttccatactagtttcatgcaaccagctgtttcgagattggaatctgcattggctgccactgagattcgaacaccaagaattccagtcatctccaatgttgatgcacatccccactcagatcctgatacgatcaagcagattttggcgcggcaggtaacctctcctgtacaatgggagaccactgtgaagactcttatgggcaagggacttgataaaagttatgaactcggaccaggaaaggttatagcaggtattctcaagaggatcaacaaaggtgctgtcattgagaacatcggtgcttgagatggtagaattttaagatttctgggccagataataagggatctgatgacctccggatgttaccaagtttcatagcagaggggtggtgaaatgaggggcgagagtgaactacagcgattattgtaggacttcttcatagagctgggcaattttcagttatgttgtttaccgccattgttgaattttgatcgtgatgtaaaattgatacctgtaaactttatatagtatcaaatgatcatttgaactgaagtagtttcaccgtatttaaaaaaaaaaaaaaaaaaaa

SEQ ID NO: 7500 - protein, 392 aa, Panicum virgatum
  misc_feature: Ceres CLONE 1912043
  misc_feature (1)..(300): Pfam Name: Acyl_transf_1 Pfam Description: Acyl transferase domain
  misc_feature (1)..(303): Pfam Name: Acyl_transf_1 Pfam Description: Acyl transferase domain
  misc_feature (1)..(303): Pfam Name: Acyl_transf_1 Pfam Description: Acyl transferase domain
  misc_feature (1)..(303): Pfam Name: Acyl_transf_1 Pfam Description: Acyl transferase domain
MLFAPSRLPLQRFPPRRLRLVPGSPMASTLAILRPSAPAPLAGPRGRVAAPATARVALSSRSRYLSARVSLGSEVAVGDALFADYKPTTAFLFPGQGAQTVGMGAEAQSVPAAAKLFNQANDILGYDLLDLCTNGPKEKLDSTVISQPAIYVTSLAAVEVLRARDGGKDVINSVDVTCGLSLGEYTALAFAGAFSFEDGLKLVKLRGEAMQDASDAANSAMVSVIGLDSEKVQELCDAANEEVDEKERVQIANFLCPGNYAVSGGVKGIEVVEAKAKSFKARMTVRLAVAGAFHTSFMQPAVSRLESALAATEIRTPRIPVISNVDAHPHSDPDTIKQILARQVTSPVQWETTVKTLMGKGLDKSYELGPGKVIAGILKRINKGAVIENIGA

SEQ ID NO: 7501 - DNA, 1477 bp, Panicum virgatum
  misc_feature: Ceres CLONE 1912056
  misc_feature: Encodes the peptide sequence at SEQ ID NO. 7502
atcctggctttccttcctgctcgctttctcctcctcgtgaagcgagcgagcgccgcgattccatttccatcccgggacggcttcgcaagtcgcaacggccgcggcgcagatccacacacaacccacggacagacaaaaccgccgcagaggttttcaaatcccggggcggatttccggccagagagaaagagagagagagagctggaagccgcgccgcgccgagatcctgtcttcgaattcgtcgtcctgccgcgccggtgaggcggcaagcgagcgagccagctaggcggccatggggaacagcatataccggttcctgtgcggcctgtgcgcgtcctcgtcggcggagcacgggctccacggcgcgcatcccgccgtcgccgcgctcggccgcgacatcctcagcttcggggccaactcgcaggttccggacgggctgagccggcacgtcgtctcctccaagaaagcgcaggcgaattggtacaagaagctgctggtggcatggaagaaagcccggccgccgccgaagacgcccgaggaagccgcgcgcttcgttgtgcagacgctcaagaaccaccagaaagcagatgtggagggcttcttggctttctacggcctgccacatccgaacgcggcagcaggcgctcccgctgctcctgctcacccgccgcccaaacctcagggcgccaagttcgagctgcacacgctgcccattgaccccaagtctgtggccgacggcgacaccatcaacgtgtacgtggacacggccgacccccgagagtctggcagcgtgccccgcgaggtgcagaaggcggcggcggagcgggccaaggcgcgggccgctaagaactaccagaaggccgacgcgctgcagaaggtcatagtggacgcaggatacaggccagtccctaacgcgagaggcgaagaggtgctcgccaagaagtacaggatcaggctaaggggcatcgatgcgccggagagcgcgatgccgtacggcaaggaggccaaagaggcgctgctgaagcttgtccagggaaagagcctgaaggtctacgtgtacgacgaggaccggtacggtagatgcgtcggagacatctactgcgatggcgtattcgtgcaggagcaaatgctgaagaagggatttgcatggcactacaccgcctatgaccaacgcccggagctagccaagtgggagaaacaagcacagactggccggaagggcctgtgggcgtcgtccaagccgcagaaaccatgggagtggcggaaggataagcgcaacgggacggcatgaacattgaacggacctcagggtgccgtgtgtgtcagtgtcatgtacaatattgtagccatgagcagctgattattttatttgaggtgctgcataatgtattgtttggaacttggaagtcctgttgttgaacatcgatagactgaccgaatgcctttgttctgtgatcaaaaaaaaaaaaaaaaaaaa

SEQ ID NO: 7502 - protein, 332 aa, Panicum virgatum
  misc_feature: Ceres CLONE 1912056
  misc_feature (1)..(178): Pfam Name: SNase Pfam Description: Staphylococcal nuclease homologue
MGNSIYRFLCGLCASSSAEHGLHGAHPAVAALGRDILSFGANSQVPDGLSRHVVSSKKAQANWYKKLLVAWKKARPPPKTPEEAARFVVQTLKNHQKADVEGFLAFYGLPHPNAAAGAPAAPAHPPPKPQGAKFELHTLPIDPKSVADGDTINVYVDTADPRESGSVPREVQKAAAERAKARAAKNYQKADALQKVIVDAGYRPVPNARGEEVLAKKYRIRLRGIDAPESAMPYGKEAKEALLKLVQGKSLKVYVYDEDRYGRCVGDIYCDGVFVQEQMLKKGFAWHYTAYDQRPELAKWEKQAQTGRKGLWASSKPQKPWEWRKDKRNGTA

SEQ ID NO: 7503 - DNA, 1716 bp, Panicum virgatum
  misc_feature: Ceres CLONE 1912196
  misc_feature: Encodes the peptide sequence at SEQ ID NO. 7504
accaagaatggcgacggcgaacccgacggtggtgttggttcccgtgtggggcgtcggccacttcctccccatgatcgaggccggcaagcggctgctggcggcagcgagccgcggcggccggcccctcacactcacggtgctcatcatgccggcgccgacggcgaagcgcgcgtccgagatcgccgagcacatccgcgacatggaacaggaccaggcatcggccaacctcggcatccgcttcctctacctccccgcagcgccgccgccggccccggccgccggagccggggcgagctactctggcccggaggagttcatctccctcagcatgcagcagtacacgccccacgtgcgggcggccatcgccggcctgacgtgccccgtggccgccgtcgtggtcgacctcttctgcacgccgctgctcgacgcggcccgcgacctcggcgtgccggcctacgtgtacctcatctgcagcgccgccatgtgcgcgctcctgctgcgcgccccggcgctcgacgacgagttgtccgccggcggcggcgccggcgaggacgcccagttcgaggcggacgtgcacgtgcccgggctcccggcgcccgtgccgccgtcctgcctcccgacggggctggccgacaggaccgtccctgcctacgactggttcgtctacaacggccggcgctacacggaagccgccggcctcatcgtcaacacggtggccgaggtcgagccacgcgtgctcgcggccatcgccgacgggcggtgcacgcgcggcgtccgccccccgccggtgtacaccgtggggccggtccttgcggatttcacctcaccggagcaggagcagggagaagagcacgagtgcgtgcggtggctgcacgcgcagccgccgcgctccgtcgtgttcctgtgcttcgggagctcgcggcacctcacagcggagcaggcgggggaggccgcggtcgcgctggagcgcagcgggcggcgcttcttgtgggtgctgcgcggcccgccggcgcccggcgagaagctgacgtcggacggggaccacctcgcggcgatgctcccggcggggttcttggagcggactgcgcgccggggcatggtgtggccgcggtgggcgccgcagcgggagatcctggcgcacgccgccgtcggaggcttcgtgacgcactgcggctggaactcggccctcgagagcctcgccgccggcgtgccgatggtgccgtggccgtgggccgccgagcagcactacaacgcgttcgtgctcgcggccggcggcgtcggggccgcggtgcgcgtggaggtggacaggggcagggacagcttcgtggaggccgcggagctggagcgcgcgatcgggagcctgtttggggacggagaggaagggaggaaggcgagggagacagcaatggagatgaaggcggcgtgccggacggcggtcgaggagggtggctcgtcgacggcgtccttgcggaggctctgcgacgcgctccaccgtggcgcggtggctgtgctcccagaccctgcaggacagtgaggtctgagttcatggctccagactgcatgcagaccgatgtttggttaattgagttgatttagtaagcttcttttttcacgacgagcaaacaaaatgggaacagaacgaggggattgggtattgggagtagcttcgttgattgtatgtaaatgttgctcgctttaatttgtttgggcttttcc

SEQ ID NO: 7504 - protein, 508 aa, Panicum virgatum
  misc_feature: Ceres CLONE 1912196
  misc_feature (3)..(151): Pfam Name: UDPGT Pfam Description: UDP-glucoronosyl and UDP-glucosyl transferase
MATANPTVVLVPVWGVGHFLPMIEAGKRLLAAASRGGRPLTLTVLIMPAPTAKRASEIAEHIRDMEQDQASANLGIRFLYLPAAPPPAPAAGAGASYSGPEEFISLSMQQYTPHVRAAIAGLTCPVAAVVVDLFCTPLLDAARDLGVPAYVYLICSAAMCALLLRAPALDDELSAGGGAGEDAQFEADVHVPGLPAPVPPSCLPTGLADRTVPAYDWFVYNGRRYTEAAGLIVNTVAEVEPRVLAAIADGRCTRGVRPPPVYTVGPVLADFTSPEQEQGEEHECVRWLHAQPPRSVVFLCFGSSRHLTAEQAGEAAVALERSGRRFLWVLRGPPAPGEKLTSDGDHLAAMLPAGFLERTARRGMVWPRWAPQREILAHAAVGGFVTHCGWNSALESLAAGVPMVPWPWAAEQHYNAFVLAAGGVGAAVRVEVDRGRDSFVEAAELERAIGSLFGDGEEGRKARETAMEMKAACRTAVEEGGSSTASLRRLCDALHRGAVAVLPDPAGQ

SEQ ID NO: 7505 - DNA, 1279 bp, Panicum virgatum
  misc_feature: Ceres CLONE 1912214
  misc_feature: Encodes the peptide sequence at SEQ ID NO. 7506
gcattcgctcatacatcgcaagccatcgatcgaccgggtaggtacaatacaatggcctccggcggcggcaagggctgcatgttggtcggttcgttcctgcgagcggcggcgctcgggctggtggtcctggcgtcggcggcgccggtggctcggtcgtggagcaaggaggggcacatgctcacctgccagatcgcacaggatctgctggagcctgacgccgcgcacgccgtgaggaacctgctcccggaggacgtgggcggcgacctgtcggcgctgtgcgtgtggccggaccaggtcaggcactggtacaagtacaggtggagcggcccgctccacttcatcgacacccctgacaaggcctgcaccttcgactacgcgagggactgccacggtcctgacggcgccaaggacatgtgcgtcgccggcgccatcgccaacttcacgtcccagctgctgcactacaagcacggcagcgccgaccgcaagtacaacttgaccgaggcccttctgttcctgtcacacttcatgggagatgttcatcagccgatgcatgtggggttcacgagcgaccaaggcggtaattccatagacctgcggtggttcaggcacaaatccaacctccatcacgtgtgggacagggagatcatacagacagctctcgctgaattctacgacaaggacatgggcactttccggaagcaacttgagcacaacctcaccaagggtacctggtctgacgacgtatcatcttggggagactgtgaagacctcatgtcgtgcccaaccaagtacgccacggagagcataagcttggcgtgcaagtgggcctacagcggcgtccacgaaggggaaaccctatccgacgactacttcgagtcgaggctgcccatcgtgtcgcggcggatcgcgcaggggggagtgaggctggccatgttcctcaaccggatcttcggccaccacaaccgcgctgttcgttccgtcgctgaccctatctatgtttctacgatggcccaagaacacgacacggcggcgccatcctgaccaacgccggcggctaaaatttggatagaatctgaatccacacgcccataccttgcaatctgactgccctcctctcctgcgtacacacacacacatgtgcagtgcatttgatttgtggtatactagcagcttgtgcaaagatgattgattgatcttatgtatatgatgagcaacacggctatggcctatatatggacgacggtgtatgccttgattttaaaaaaaaaaaaaaaaaaaa

SEQ ID NO: 7506 - protein, 329 aa, Panicum virgatum
  misc_feature: Ceres CLONE 1912214
  misc_feature (1)..(266): Pfam Name: S1-P1_nuclease Pfam Description: S1/P1 Nuclease
MASGGGKGCMLVGSFLRAAALGLVVLASAAPVARSWSKEGHMLTCQIAQDLLEPDAAHAVRNLLPEDVGGDLSALCVWPDQVRHWYKYRWSGPLHFIDTPDKACTFDYARDCHGPDGAKDMCVAGAIANFTSQLLHYKHGSADRKYNLTEALLFLSHFMGDVHQPMHVGFTSDQGGNSIDLRWFRHKSNLHHVWDREIIQTALAEFYDKDMGTFRKQLEHNLTKGTWSDDVSSWGDCEDLMSCPTKYATESISLACKWAYSGVHEGETLSDDYFESRLPIVSRRIAQGGVRLAMFLNRIFGHHNRAVRSVADPIYVSTMAQEHDTAAPS

SEQ ID NO: 7507 - DNA, 1483 bp, Panicum virgatum
  misc_feature: Ceres CLONE 1912228
  misc_feature: Encodes the peptide sequence at SEQ ID NO. 7508
cttccacgccccgctgccccggctgcccaccgctccgcctcctcctccctcctttgatgcgcgaggggccgtggggtccaccgcctcccgccgcgcgcctctcgcccccgctcccggtgctgctcctctccctcctgctcgcggggcggccggcctcttcctgctcctgccgctcggaggaaggcgcgggggtggcggcggcggcagcagcgcgcatggggctcgacggggacgggccgccggacgccgccggcggtatcagtaacagtgaaaatgggcgctgcatttatggagttgcaagttctcctgggaaaagagcatcgatggaggacttttatgaggcaaggatagacgacattgatggagagaaagttggaatgtttggcgtatatgatggtcacggtggagtgagagcagctgaatatgtcaagcagcaccttttcagcaatttaattaaacacccaaagttcatcactgataccaaggctgcaatcgccgaaacttacaaccacacagattcagaatttttgaaagctgatagtagtcagactcgagatgctggctcaactgcctcaacagctattattgtaggtgatcgtttgcttgttgcaaatgtcggagattctagagccgttatatctaaaggaggacaggctattgctgtttcaagggatcacaaacctgatcagtcagatgagagacagagaattgaggatgctgggggctttgttatgtgggctgggacatggcgtgtgggtggtgttcttgccgtctctcgagcatttggcgataaactcttgaagcagtatgttgttgctgacccagaaatcaaggaggaggtggtcgacagctcccttgaattcctcatccttgctagcgatggactctgggatgtcgtcactaatgaggaagctgttgccatggtgaagcctattcaggatccccaggaagcagcagacaagcttctccaagaagcttccaaaaggggaagttccgacaacatcacagttgtcattgtccgcttcctagatggaacgacctctggtgacaaatcaggcgaagagaaagagaaagagtctgccaatgaccaaacttcctagttgctcatgtagaatcatcaatcatgcatgcgttcttctggctgttgtatctgatgctcgaagtagatgccccgccgccgtgcgtccgcgcagctgttccgcaaggaaactgacttgccccattcgtcatcctgcttttgctcttgctcctggccggcctagatggacgacagggctggtgctgttactgtatgatccaaggtggactctttcatttccattaagctttgtaatgtagcttttccgttgctgttgattcatgaatcgtgcttagatgttttcttcgcagcaagtgcgtgtgaaactgttggaacgattttaagcaagctgtgcaccgcagtatgtaacaattaatctctcaacaaaaaaaaaaaaaaaaaaaa

SEQ ID NO: 7508 - protein, 347 aa, Panicum virgatum
  misc_feature: Ceres CLONE 1912228
  misc_feature (3)..(241): Pfam Name: PP2C Pfam Description: Protein phosphatase 2C
MREGPWGPPPPAARLSPPLPVLLLSLLLAGRPASSCSCRSEEGAGVAAAAAARMGLDGDGPPDAAGGISNSENGRCIYGVASSPGKRASMEDFYEARIDDIDGEKVGMFGVYDGHGGVRAAEYVKQHLFSNLIKHPKFITDTKAAIAETYNHTDSEFLKADSSQTRDAGSTASTAIIVGDRLLVANVGDSRAVISKGGQAIAVSRDHKPDQSDERQRIEDAGGFVMWAGTWRVGGVLAVSRAFGDKLLKQYVVADPEIKEEVVDSSLEFLILASDGLWDVVTNEEAVAMVKPIQDPQEAADKLLQEASKRGSSDNITVVIVRFLDGTTSGDKSGEEKEKESANDQTS

SEQ ID NO: 7509 - DNA, 965 bp, Panicum virgatum
  misc_feature: Ceres CLONE 1912236
  misc_feature: Encodes the peptide sequence at SEQ ID NO. 7510
gcagcgggcacggggacggcgcggccgccgcagcccgcgcacaacagctcaccgcaggcctctccctcgaccctgtgttttaaagcaggctgcgctcctctctgttcctcatcgatagtagagcagagcagagcagagcagagcagagtcttcctcaacccatcctcgctcccctacaccaattcgttcagcgatctttcgtgcttggccctcctgcgctgcacatggcatcccccgccgccgccggagccgccgggcgccgcatcgtggtggccgtggacgagggcgaggagagcgcgcacgcgctcgcctggtgcctcgccaacgtcgtctccccggcgggcggcgacacgctcgtgctcgtgcacgcgcgccgcccgcgccccgtctacgccgccatggacagcgcagggtacatcatgacctcggacgtgctggcgagcgtggagcggcacgccagcgccgtctcggcggcggccgtcgacaaggccaggcgcctctgcgccgagcacccgcacgtggcggtggagacgctggtggagagcggggacccgcgggacgtgatctgcgacgccgccgacaaggtgggcgccgacctgctcgtcatgggcagccatggatacggcttcttccagagggcgttcctgggcagtgtcagcaaccactgcgcgcagaactgcaaatgcccggtcctcatcgtcaagaggcccaaggagtagaccggtccttgcaaatgctgcatcttgccagcctgtagcatcatatatgtaaatatttttttaatcctcccatggcaactggtttcttgttcgagaacatgatcagagcactacagtttttttttttttttttgctggaataagagattcagacagagtatttcgtcaactattgtacagcatattctgttctctgaatctgagagcaaagtggttggtcgtctttaaaaaaaaaaaaaaaaaaaa

SEQ ID NO: 7510 - protein, 164 aa, Panicum virgatum
  misc_feature: Ceres CLONE 1912236
  misc_feature (1)..(150): Pfam Name: Usp Pfam Description: Universal stress protein family
MASPAAAGAAGRRIVVAVDEGEESAHALAWCLANVVSPAGGDTLVLVHARRPRPVYAAMDSAGYIMTSDVLASVERHASAVSAAAVDKARRLCAEHPHVAVETLVESGDPRDVICDAADKVGADLLVMGSHGYGFFQRAFLGSVSNHCAQNCKCPVLIVKRPKE

SEQ ID NO: 7511 - DNA, 1238 bp, Panicum virgatum
  misc_feature: Ceres CLONE 1912290
  misc_feature: Encodes the peptide sequence at SEQ ID NO. 7512
actggtccagtggtcctcacccgtctcttccgccgccgccgccgccatgccgcacctcgttcgcgagcggctctacttcggcgatatcaaagacgccatcgccgccctcacagagtcctccggcaccccgacctttacccacgtcctctcggtcgtcagctccgtctccatctccttcatcaccgactgccgcccgggcctcgcaatcccaacggaagaggtccaccgagtcgtcgccggcgaggagggcgcaccacctgcagctgcagtgccccccgggacgctgatgcgggtggtggagcgcgctggggacggcctgcgggtaacgcggatggccgtgccgctgcgggacacggaggcggagaacctgctcgaccacctcgagccttgccttgatttcgtcgatgagggtaggaaagttgggaacgtcctcgttcattgcttcgccggggtatccaggagtgcttccatcattgttgcttatcttatgagatcagagcagaaatctctggaagcattagaatctttaaaggaagtttctgagtcggcatgcccgaatgatggttttcttgaccagttgaaattgtttgaggaaatgggcttcaaagttgatacttcaagtcctttgtacaagaggttccgcttaaaattattaggtcaatcctacaaatttggggagaaaataggcagctatatatttgaagatgaccctggcctttctccacaatctggctcttgtcaagattcttcaaagacagagcaacacaaaacagcttaccgctgcaggaaatgcaggagaatcattgctgtggaggacaatgttataagtcatgttcctggtgagggtgaatcttgctttgactggaaccgaaggaagagtggtcgtccatacaacaacacagaacaagattgctcgtctttatttgttgagcctctgaaatggatgactccagtagaagatggtgctttggaggggaagctatcgtgcatccactgtggagctaggttaggatacttcaactggtcaggaatacagtgcaactgcggcagttgggttaccccggccttccaaattgttaagagcaaagttgatatcagcaccatctaaacattggagaaatttgagggattaggagtgtgacacactggtggctttaagatttcgtatataatgtatgcacgatatgtacacaatgaacaacatattgtatgttttgccaaaaaaaaaaaaaaaaaaa

SEQ ID NO: 7512 - protein, 353 aa, Panicum virgatum
  misc_feature: Ceres CLONE 1912290
  misc_feature: Great-hit functional homolog of the protein sequence given in SEQ ID NO 9450
  misc_feature (1)..(92): Pfam Name: DSPc Pfam Description: Dual specificity phosphatase, catalytic domain
  misc_feature: Useful for making plants with modulated biomass
  misc_feature: The plant is abnormally small.
MPHLVRERLYFGDIKDAIAALTESSGTPTFTHVLSVVSSVSISFITDCRPGLAIPTEEVHRVVAGEEGAPPAAAVPPGTLMRVVERAGDGLRVTRMAVPLRDTEAENLLDHLEPCLDFVDEGRKVGNVLVHCFAGVSRSASIIVAYLMRSEQKSLEALESLKEVSESACPNDGFLDQLKLFEEMGFKVDTSSPLYKRFRLKLLGQSYKFGEKIGSYIFEDDPGLSPQSGSCQDSSKTEQHKTAYRCRKCRRIIAVEDNVISHVPGEGESCFDWNRRKSGRPYNNTEQDCSSLFVEPLKWMTPVEDGALEGKLSCIHCGARLGYFNWSGIQCNCGSWVTPAFQIVKSKVDISTI

SEQ ID NO: 7513 - DNA, 1014 bp, Panicum virgatum
  misc_feature: Ceres CLONE 1912302
  misc_feature: Encodes the peptide sequence at SEQ ID NO. 7514
ctcccctttccgtcgcgcatctgaagcgaggtgtcgtggcgattttgactcggatcatggtgcgcagctcgagcaggtagaggagagccgacctgaggcgggcggggcttgggaggcgcggatcgtaggggcaggggaagccgagggagcgaggaggatggtgctggtgctcgcgctgggggatctgcacatcccgcaccgggcgcccgacctgcccgccaagttcaagtccatgctcgtgcccggcaagatccagcacatcatctgcaccggcaacctctgcatcaaggaagtccatgactctctaaaaagcctttgtcctgatctccacataaccagaggtgaatatgatgaggatgctcggtacccagagactaagacacttacaattggtcaatttaagctcgggctgtgccatggtcatcaggttgttccgtggggcgacctagactccctggcgatgcttcagcggcagctggacgtggacatcctggtgacggggcacacccaccagttcaaggcgtacaagcatgagggcggcgtggtgatcaaccccgggtcggccacaggcgcctacagcagcatcacctatgacgtgaacccgagcttcgtgctgatggacattgatggcctgcgcgtggtggtgtacgtctacgagctgatcgacggtgaggtgaaggtggacaagattgacttcaagaagacggccacgacgatgcatgcgtagctctggctctcagcacggcgcagaggacactgaaatggattccggacatgtctagttccttcctgttgccctcactccccacccctccgaagctacctgaagtctttttttttcccctaccgattgtgctcgcctgttcatttgtaaaaaaaaaagacagctgcttttacggattagttgaccagattgtcagggtggatgttaaatgctgagcgtgtagtgaatttgaagttttaatcaagaacaggcgaaccttgatttgtgtttaaaaaaaaaaaaaaaaaaaa

SEQ ID NO: 7514 - protein, 189 aa, Panicum virgatum
  misc_feature: Ceres CLONE 1912302
  misc_feature (1)..(119): Pfam Name: Metallophos Pfam Description: Calcineurin-like phosphoesterase
MVLVLALGDLHIPHRAPDLPAKFKSMLVPGKIQHIICTGNLCIKEVHDSLKSLCPDLHITRGEYDEDARYPETKTLTIGQFKLGLCHGHQVVPWGDLDSLAMLQRQLDVDILVTGHTHQFKAYKHEGGVVINPGSATGAYSSITYDVNPSFVLMDIDGLRVVVYVYELIDGEVKVDKIDFKKTATTMHA

SEQ ID NO: 7515 - DNA, 1654 bp, Panicum virgatum
  misc_feature: Ceres CLONE 1912319
  misc_feature: Encodes the peptide sequence at SEQ ID NO. 7516
aaaccacccaaccccacattcacacccccgcctcggcgtctctatccacacccccgcacccatggccaccgccgcaatcgggaccagccctagccgcgccagcaccccgtcgtcccgcgccgccgcggggagcgcgcgacccgcgcgcgcggtgctgagggtggcggcggcagcggcgtccgttggtccggggagggggaggagggccgcggcggcaatgcagccggcgaaggcggtggccctggaggcgcccccggtggaggcggggagcggcgcggctgtcgcggggttgccgaggcccgacgcgatggggaggttcggcaagttcgggggcaagtacgtgcccgagacgctgatgcacgcgctcaccgagctcgaggccgcgttccacgcgctcgccaccgacgacgagttccagaaagagcttgacggcatcctcaaggactacgtcggccgtgagagccccctgtactttgcggagcgcctgaccgagcactacaagcgcgccgatggcacaggcccgctcatctacctcaagagggaggatctgaaccacaccggcgcccacaagatcaacaatgctgtcgcgcaggccttgctcgccaagcggcttgggaagcagcgcatcattgccgagaccggggctggccagcacggtgttgccactgccacggtgtgcgcccgttttgggctgcagtgcatcatctacatgggtgcccaagatatggagaggcaggcgctcaatgttttcaggatgaggcttcttggtgcagaggtcagggcagtgcattctgggacagcaaccctgaaggatgcgacttcggaggctatccgtgactgggtcactaacgtggagaccacacactacatcttgggctcggttgctggtccgcacccatacccaatgatggtgagggagttccataagattattggccaggagacccggaggcaggccatggacaagtggggtggcaagcctgatgtgttggttgcttgtgttggtggtggatccaatgctatgggcctcttccatgagtttgttgatgatcaagatgtgagactgataggagtggaagcggctggtcatggtgttgatactgacaagcatgcagcaactttgacaaagggtgaagttggagttctccatggctcaatgagctatttgctgcaggatgctgatggacaagttattgaaccccactccatcagtgcagggctggactaccctggtgttggacctgagcacagtttcttgaaggatattggacgtgctgagtatgacagtgtgacagatcaggaggcactggatgcattcaagcgcgtctctcgtctggagggtatcatccccgccctggagacctcccatgccctcgcctaccttgagaagctctgcccgaccctgcctgacggcgtgagggtggtggtgagctgcagcggacgaggggacaaggatgtgcacaccgccagcaagtacctcgaagtctaatagaacaccaaagaggaggctgaatgaaggcttttccttgtcaaaagttgtgaagggtccgatgataatttagcactgttccttctgataaattacccaataatacccggaagcttgtattgtattactccctccttccccgtttataaggcatacacgtatatc

SEQ ID NO: 7516 - protein, 475 aa, Panicum virgatum
  misc_feature: Ceres CLONE 1912319
  misc_feature (1)..(475): SWISSPROT Homolog: EC 4.2.1.20 Tryptophan synthase beta chain 2, chloroplast precursor
  misc_feature (4)..(475): SWISSPROT Homolog: EC 4.2.1.20 Tryptophan synthase beta chain 1, chloroplast precursor
MATAAIGTSPSRASTPSSRAAAGSARPARAVLRVAAAAASVGPGRGRRAAAAMQPAKAVALEAPPVEAGSGAAVAGLPRPDAMGRFGKFGGKYVPETLMHALTELEAAFHALATDDEFQKELDGILKDYVGRESPLYFAERLTEHYKRADGTGPLIYLKREDLNHTGAHKINNAVAQALLAKRLGKQRIIAETGAGQHGVATATVCARFGLQCIIYMGAQDMERQALNVFRMRLLGAEVRAVHSGTATLKDATSEAIRDWVTNVETTHYILGSVAGPHPYPMMVREFHKIIGQETRRQAMDKWGGKPDVLVACVGGGSNAMGLFHEFVDDQDVRLIGVEAAGHGVDTDKHAATLTKGEVGVLHGSMSYLLQDADGQVIEPHSISAGLDYPGVGPEHSFLKDIGRAEYDSVTDQEALDAFKRVSRLEGIIPALETSHALAYLEKLCPTLPDGVRVVVSCSGRGDKDVHTASKYLEV

SEQ ID NO: 7517 - DNA, 1366 bp, Panicum virgatum
  misc_feature: Ceres CLONE 1912373
  misc_feature: Encodes the peptide sequence at SEQ ID NO. 7518
gcatatgcccttgtcactcatgccacaagcgagtgcgccacgggccaccaggcgcgatgccgcgcagagcgcatatctccgctgacatcttcaccctcatgggcaacacgaggccggccggcatggcgagcgcgagggcggcggcggcggcgccgacgtcgtggtgcggccactgcggcatgagcatcgccgcgccgtcgacggggcccggctcctccagcgtccggtgcgcgttctgccaccggctggcgcgcgtcgagcgccaccgcggcatgacgctcgcggcgccctcgccgccgcgggccgacgtcgtccccgcggggctcgaggtcgcggcgggctactaccccagcgtgagcggcaagaagcgcgcgctcctcgtcggcgtgagctacaggggcaccgcgcacgagctcaagggcacggtcaacgacgtcaaggagatgaggcgcctcctctgcggcaagtttgggttccccggcgactgcatcctggagctcactgagaacgagagggacccggcgagggtgccgacgagggcgaacctgctgcgggcgatgcggtggctcgtggagtgctccggcagcggcgactcgctggtgttccacttctccgggcacggcgtgcagaagctggacctgaacgacgacgaggtggacgggtacaacgaggcgctgtgcccggcggacttcgagcagagcggcaagatcctggacgacgagatcaacgagaccatcgtccggccgctgggcaggggcgtgaagctgcacgccgtcgtggacacctgccacagcggcaccatcctcgacctcccctacctctgccgcctgtccaggacggggtactggcagtgggagaatcacgaccggcccagcggggcgcggaagcgccccaacggcggcctggccatctccatcagcggctgcagcgacgaccagaagtccgcggacgccagcggattttcggagtcgtcgtcgtcttcgatcggcgccatgacggacagcttcatcaaggcggtggaggcggagccggggacgacgtacgggcggctgctgagcgcgatgagggcgaggatccgcgacgggcaggggagccgccgcctccccggaaggcttggctccttcgtccgctggatgatcccgtccagcggcgtgcaggagcctcagctgtgctcgtcagagatgtttgacatctaccggaagccattcctcctctgatctgctcgtcgacgactgataattcgggacttgaattatttggatgtgtgctgtactagtactactgtggtgtgtatgaacatactgtatattgcatttcaatttacgtcctgtcagagtgtatggcggaaaaaaaaaaaaaaaaaaaa

SEQ ID NO: 7518 - protein, 386 aa, Panicum virgatum
  misc_feature: Ceres CLONE 1912373
  misc_feature (1)..(287): Pfam Name: Peptidase_C14 Pfam Description: Caspase domain
MPRRAHISADIFTLMGNTRPAGMASARAAAAAPTSWCGHCGMSIAAPSTGPGSSSVRCAFCHRLARVERHRGMTLAAPSPPRADVVPAGLEVAAGYYPSVSGKKRALLVGVSYRGTAHELKGTVNDVKEMRRLLCGKFGFPGDCILELTENERDPARVPTRANLLRAMRWLVECSGSGDSLVFHFSGHGVQKLDLNDDEVDGYNEALCPADFEQSGKILDDEINETIVRPLGRGVKLHAVVDTCHSGTILDLPYLCRLSRTGYWQWENHDRPSGARKRPNGGLAISISGCSDDQKSADASGFSESSSSSIGAMTDSFIKAVEAEPGTTYGRLLSAMRARIRDGQGSRRLPGRLGSFVRWMIPSSGVQEPQLCSSEMFDIYRKPFLL

SEQ ID NO: 7519 - DNA, 1106 bp, Panicum virgatum
  misc_feature: Ceres CLONE 1912378
  misc_feature: Encodes the peptide sequence at SEQ ID NO. 7520
gcagcagttcccggccgtgagagcagcagcagctggagcagagccccccgcagtgatagatggaggcagccagcaggcagaagctgggagtgggcatggacagtaccgtcgcctccctctcgcctctgcgccacccctcagcgtcgtcggcatgcaagctgaggacggcggcgagtactgctagtcgccctgcagcagccagtccgcggctgctcaagctaaaccagaggatcatcagtacagctccaggagccagtagtaactcaccaccagcccggccaagatcatggccgcgtgctaattcggcgaagaggaccgcagcacagccgccgcagagggagaaggacctcgtcttcgtggccggcgccaccggaagagttggctcccgagccgtaagggagctcatcaagcttggcttccgtgtccgcgctgccgtcaggaacgcgcagagggcgtcgacgctggtgcagagcgtccagcagctgaaactagacgacaacgacgacgcagctgcaatttcgcccgcagcgaggcttgagattgtggagtgtgacctggagaagcagccgcaggaaggcatcgtgaaggccataggcaatgcttcattggtggtgtgctccattggtgccagcgagaaggagatcttggatgtgacggggccataccgcatcgactattcggccaccagcaaccttgtgcaagcggcaactgctgctgccatggtcgagcacttcatcctggtcacgtccctgggcaccagcaagatcggcttccctgcgttcctcttgaacttgttctggggagttctgttctggaagagacgagctgaagaagcactcatcgccagtggcatcccctacacggtaggcaggtcggccggcactcttcctgctatagtgctaagctctgcttcgtccaggggcgtggcgtccgtagctaggaattcatttttttcattgttaggaaagggccaaccgtgctaatttagctaataatttaatcaaattcaaaattttcaatgtaaaatttcagatcacagaggggctaggcccctgcgccctctactggctacgcccctgcttacataaaaaaaaaaaaaaaaaaaa

SEQ ID NO: 7520 - protein, 307 aa, Panicum virgatum
  misc_feature: Ceres CLONE 1912378
  misc_feature (1)..(172): Pfam Name: Epimerase Pfam Description: NAD dependent epimerase/dehydratase family
MEAASRQKLGVGMDSTVASLSPLRHPSASSACKLRTAASTASRPAAASPRLLKLNQRIISTAPGASSNSPPARPRSWPRANSAKRTAAQPPQREKDLVFVAGATGRVGSRAVRELIKLGFRVRAAVRNAQRASTLVQSVQQLKLDDNDDAAAISPAARLEIVECDLEKQPQEGIVKAIGNASLVVCSIGASEKEILDVTGPYRIDYSATSNLVQAATAAAMVEHFILVTSLGTSKIGFPAFLLNLFWGVLFWKRRAEEALIASGIPYTVGRSAGTLPAIVLSSASSRGVASVARNSFFSLLGKGQPC

SEQ ID NO: 7521 - DNA, 1448 bp, Panicum virgatum
  misc_feature: Ceres CLONE 1912384
  misc_feature: Encodes the peptide sequence at SEQ ID NO. 7522
gtgagcttagcggagagactcggagacgccacaccggatcgaatcgaagctgacaccctccctccctacccaattcgagccgccggagaagcttccgtcggggcggcggcatgaacaagcggccccgcgacgacccgtcctcctccttcgcctccgcgcccaagcgcccctacggcgcaggcagcgggtatggcgcgcagcagggctactcggaggagcggagcagcgcgcggcgggtggcggaccactacagcgcgcgctccaaccagacgctcgaggagcgcgagaacagccccatcatccacctcaagaagctcaacaactggataaagagtgttctgatccagctatacacatgcccaggcgactgcgtgctcgatcttgcttgcgggaagggaggtgatttgataaagtgggacaaagccaaggttggctattatgtgggggttgatattgccgaaggctcgataaaggattgcatgactcgctacaatggtgatacagatcaacagcgcaggaagaagttcagttttcctgcgcgacttatttgcactgattgttatgaggctcgtcttgatgagtatttatatgaggatgccccatttgacatatgtagctgtcagttcgctttacattattcatggtcaactgaagcacgcgctagacaagccttggcaaatgtgtctgcattgcttcgccctggaggcatttttattgggacaatgcctgatgctaacgtcattatcaaaaggcttcgagaatctgaagggttggaatttgggaacagtgtttattggattagctttggtgaagagtatgctgagaagaaattccctgcatccaggccttttggtatcaagtacaagtttcacttagaggatgctgtcgattgtccagaatgggttgttccattccatctcttcaaattactggcagaagagtatgatctcgagctggttctgatgaagaacttccatgaatttgtacacgagtacttgcaaaagccagagtttactgaactgatgcggaggctaggtgcccttggtgatggaaggcatgaccaaagtacactgtcccagaatgagtgggaagtctcatatctctatcttgcttttgtcctgcggaagcgagggcaaccgcctagccaacggagatccagcaatgcaaacagaggcaagatgttcctcaatgagggcgatatcgagttcctcgggatatagtcaagtgtaccaatatagagcttactaacagcttaccgattctatgctccacatagcataaaagaaagttgtaactttagtggctcacctgtttgttcctccaatttgtatctgttgtataactccacaaacttaaatgtataaaccaaggactcataatgcagttttgcagtaatgaattaatgaataataataggattcataactcaaaaaaaaaaaaaaaaaaaa

SEQ ID NO: 7522 - protein, 369 aa, Panicum virgatum
  misc_feature: Ceres CLONE 1912384
  misc_feature (1)..(369): SWISSPROT Homolog: EC 2.1.1.56 mRNA cap guanine-N7 methyltransferase 1
  misc_feature (7)..(367): SWISSPROT Homolog: EC 2.1.1.56 mRNA cap guanine-N7 methyltransferase 1
MNKRPRDDPSSSFASAPKRPYGAGSGYGAQQGYSEERSSARRVADHYSARSNQTLEERENSPIIHLKKLNNWIKSVLIQLYTCPGDCVLDLACGKGGDLIKWDKAKVGYYVGVDIAEGSIKDCMTRYNGDTDQQRRKKFSFPARLICTDCYEARLDEYLYEDAPFDICSCQFALHYSWSTEARARQALANVSALLRPGGIFIGTMPDANVIIKRLRESEGLEFGNSVYWISFGEEYAEKKFPASRPFGIKYKFHLEDAVDCPEWVVPFHLFKLLAEEYDLELVLMKNFHEFVHEYLQKPEFTELMRRLGALGDGRHDQSTLSQNEWEVSYLYLAFVLRKRGQPPSQRRSSNANRGKMFLNEGDIEFLGI

SEQ ID NO: 7523 - DNA, 1616 bp, Panicum virgatum
  misc_feature: Ceres CLONE 1912426
  misc_feature: Encodes the peptide sequence at SEQ ID NO. 7524
gcgcccgccccccgccaccactccgccgaacaccttgtgctctgctctgctgcctgcgtgcacccgttcccgcaacccccgcacgccatggccgcggccatcctccgccgcctcacccccgccgccaccgccagcccgcgctcggcgccgcagctgccgcaactcgcacgcggggtctccgactccacggacgcgatcaccgtggagacctcggtgcccttcatgtcccacatcgtggacccgccgtcccgctccgccaccacctccgcgcgcgagctcctctccttcttccgcgacatggccctcatgcgccgcgccgagatctcggcggactcgctctacaaggccaagctcatccgcggcttctgccacctctacgacgggcaggaggccgtcgccgtcggcatggaggccgccatcacccgcgccgacgccatcatcaccgcctaccgcgaccactgcgcctacctcgcgcgcggcggggacctcgtcgccgccttcgccgagctcatgggccgacgggacggctgctccaggggcaaggggggatccatgcacttctacaagcgggacgccaacttcttcggcgggcacggcatcgtcggcgcccaggtgccgcttggctgcggcatcgccttcgcgcagaggtacaggaaggagggcaccgtcaccttcgacctctacggcgatggcgccgccaaccaaggccagctcttcgaggcgctcaacatggccgcgctctggaagctgcctgtcatattggtctgcgaaaacaaccactatgggatggggactgcagagtggagggcatccaagagccctgcttactacaagcgcggggactatgtgcctgggttgaaggtcgatggaatggatgttcttgctgtgaaacaagcttgcaaatttgccaaagatcatgtccttgaaaatggaccgattattcttgagatggacacctatagatatcatgggcactctatgtcagatcctggtagcacgtaccgcaccagggatgagattgcagggataagacaggagcgtgatccaatcgaaagggttaggaagctcatattggctcatgatttcgcaacgccccaagagctaaaggacatggaaaaggagataaggaagcaagttgacgcagccattgctaaagcaaaggagagtccaatgcccgatccgtctgagctcttcacaaacgtttatgtcaacgactgtggtttggagtcctttggggtagacaggaaggtggtgaggaccgttcttccgtaggctggcaaacaaggacagttattatgcatggacatatcacatatatggtgcgtaccgaggacatctacactagtaccgaatacagacgaagggatcctcactcctgggcgttgctttttctgctacgaaataagcctctcttttcgtgaaggcatacggctgatggattctgtttctgcatcacgcctcaatggccattcccttttgtctgtatccctgtttatgatttgctctgaccgttgagttgtgtgacaatgtgcagctgaaaccttctcgcgtgtgatgcagatgtaacctcttctggctaatgaattatgttcacggaaaaaaaaaaaaaaaaaaaa

SEQ ID NO: 7524 - protein, 394 aa, Panicum virgatum
  misc_feature: Ceres CLONE 1912426
  misc_feature (1)..(298): Pfam Name: E1_dh Pfam Description: Dehydrogenase E1 component
  misc_feature (1)..(298): Pfam Name: E1_dh Pfam Description: Dehydrogenase E1 component
  misc_feature (1)..(298): Pfam Name: E1_dh Pfam Description: Dehydrogenase E1 component
  misc_feature (1)..(298): Pfam Name: E1_dh Pfam Description: Dehydrogenase E1 component
  misc_feature (1)..(298): Pfam Name: E1_dh Pfam Description: Dehydrogenase E1 component
  misc_feature (1)..(298): Pfam Name: E1_dh Pfam Description: Dehydrogenase E1 component
  misc_feature (1)..(298): Pfam Name: E1_dh Pfam Description: Dehydrogenase E1 component
  misc_feature (1)..(298): Pfam Name: E1_dh Pfam Description: Dehydrogenase E1 component
  misc_feature (1)..(298): Pfam Name: E1_dh Pfam Description: Dehydrogenase E1 component
  misc_feature (1)..(298): Pfam Name: E1_dh Pfam Description: Dehydrogenase E1 component
  misc_feature (31)..(394): SWISSPROT Homolog: EC 1.2.4.1 Pyruvate dehydrogenase E1 component subunit alpha, mitochondrial precursor
  misc_feature (9)..(394): SWISSPROT Homolog: EC 1.2.4.1 Pyruvate dehydrogenase E1 component subunit alpha-2, mitochondrial precursor
MAAAILRRLTPAATASPRSAPQLPQLARGVSDSTDAITVETSVPFMSHIVDPPSRSATTSARELLSFFRDMALMRRAEISADSLYKAKLIRGFCHLYDGQEAVAVGMEAAITRADAIITAYRDHCAYLARGGDLVAAFAELMGRRDGCSRGKGGSMHFYKRDANFFGGHGIVGAQVPLGCGIAFAQRYRKEGTVTFDLYGDGAANQGQLFEALNMAALWKLPVILVCENNHYGMGTAEWRASKSPAYYKRGDYVPGLKVDGMDVLAVKQACKFAKDHVLENGPIILEMDTYRYHGHSMSDPGSTYRTRDEIAGIRQERDPIERVRKLILAHDFATPQELKDMEKEIRKQVDAAIAKAKESPMPDPSELFTNVYVNDCGLESFGVDRKVVRTVLP

SEQ ID NO: 7525 - DNA, 1829 bp, Panicum virgatum
  misc_feature: Ceres CLONE 1912538
  misc_feature: Encodes the peptide sequence at SEQ ID NO. 7526
gtggcggccgacgcatctcaccgtactgagcgccaagcttcccaaaccatggcggcggcgaacatgctctcgcgctccctcctccccgccctaaaccctagcccgtccgcccaccggaaccgcggcaccgccgccgtctccttcccccgggcccgccgcctgtcatccgtgcgcgcctccgtctccacggcctccccgtccccgccgccgcagccggcggccgcggcgccgccgaagcactgcttcagccgcggagccgatgggtacctgtactgcgagggggtgcgggtggagaacgcgatggcggcggcggcgcggagccccttctacctctacagcaagccgcaggtcctccgcaacttcgccgcctaccgcgaggcgctcggggggctccgctccgtcgtggggtacgccgtcaaggccaacaacaacctccccgtgctgcgcctcctgcgcgagctcggctgcggcgccgtgctcgtcagcggcaacgagctccgcctcgcgctacaagcgggattcgaccccaccaggtgtatatttaacggaaatgggaagacattggaagatctcaagttagctgctgagagcggggtatttgtaaatgtggacagcgaatttgatttggagaatattgtcagagctgcaagggctacaggaaagagagtgcctgttttgcttagaataaatccagatgtggatccgcaggtacatccgtatgttgccactggaaataaaacttccaaattcgggatccgcaatgagaaattgcaatggtttctggactctatcaagtcatactcgaatgatatcaagttggttggtgttcattgtcatctggggtctactattacaaaggttgatatattcagagatgctgcagttcttatggtaaattttgttgatgaaattcgagcacaaggttttgagttggagtacctgaacatcggaggtggtttgggaatagattaccaccacaccgatgcagtcttgcctacacctatggatctcatcaacactgtgcgagaattagttctctctcgagatcttactcttatcattgaacctggaagatccttgattgctaatacttgctgcttcgtcaatagagtaactggtgttaaatctaacggtacgaagaatttcattgttgttgatggcagcatggcagaactcatcagacctagtctgtatggagcataccagcatatcgaactggtctctcccccctctcctggtgccgaagtagctacctttgatattgtcggaccagtttgtgagtctgcagatttccttggaaaagatagggagcttccaacacctgatgagggagctggactggttgttcatgatgcaggtgcctactgcatgagcatggcttccacctacaacctgaagttgagaccgccagagtactgggtggaagaggacggttctatcgtaaagatcagacatgaagagaagcttgatgactacatgaagttctttgatggtcttccagcttagacatttatctgcaactgcgacaggaacacgttttcttgggggataattagactttcttgccaagtttattttactttcttgtggttgtagtggaatgtgtgacaggataataattaatttggtttgttgctgtatcctccagattttctgtgatgcgcaagtcttaggcaccatgtttgtaatatactgttatttagaaccagaagttattacctggatgaaaaggcacagtgaataagtctgccgtccgaatgcatgcaaagtcttggacgatgaatagatataaaagcttatggttggcggaaaaaaaaaaaaaaaaaaaa

SEQ ID NO: 7526 - protein, 485 aa, Panicum virgatum
  misc_feature: Ceres CLONE 1912538
  misc_feature: Great-hit functional homolog of the protein sequence given in SEQ ID NO 9709
  misc_feature (1)..(227): Pfam Name: Orn_Arg_deC_N Pfam Description: Pyridoxal-dependent decarboxylase, pyridoxal binding domain
  misc_feature: Useful for making plants with modulated biomass
  misc_feature: The plant is abnormally small.
MAAANMLSRSLLPALNPSPSAHRNRGTAAVSFPRARRLSSVRASVSTASPSPPPQPAAAAPPKHCFSRGADGYLYCEGVRVENAMAAAARSPFYLYSKPQVLRNFAAYREALGGLRSVVGYAVKANNNLPVLRLLRELGCGAVLVSGNELRLALQAGFDPTRCIFNGNGKTLEDLKLAAESGVFVNVDSEFDLENIVRAARATGKRVPVLLRINPDVDPQVHPYVATGNKTSKFGIRNEKLQWFLDSIKSYSNDIKLVGVHCHLGSTITKVDIFRDAAVLMVNFVDEIRAQGFELEYLNIGGGLGIDYHHTDAVLPTPMDLINTVRELVLSRDLTLIIEPGRSLIANTCCFVNRVTGVKSNGTKNFIVVDGSMAELIRPSLYGAYQHIELVSPPSPGAEVATFDIVGPVCESADFLGKDRELPTPDEGAGLVVHDAGAYCMSMASTYNLKLRPPEYWVEEDGSIVKIRHEEKLDDYMKFFDGLPA

SEQ ID NO: 7527 - DNA, 1376 bp, Panicum virgatum
  misc_feature: Ceres CLONE 1912606
  misc_feature: Encodes the peptide sequence at SEQ ID NO. 7528
gcgggctcgggcgcgcaccggcagcagcagcctctcatctctttcgccggttggcgcggcgcggttttttattacctgacgcgacacgcgactgcgcggcccggcccggccggccaccggctagtacagcggcctgcgcctgcaggtcaggccctcaggcagcagcgcgctcgcgtactcgcagtcgcttccttggatcactcgcaagctgccactcacgcctccctccctcccaccttctactagagtatttcttcgctcgggtcgggtcggctcgcccgaggctgccgatctctctccgcgaaggcattgactttgcgcgggcgcgtggcgatggacgcggcgggcatggcagcgggcgcgcccatactgccgccggacgcgtccccgccgccggccgccgggcagggcgcggcgttcccgatcgccatcgtcatcgccatcgggttcatggtcacctcgctcatcctcatcagctactacttcctcgtcgtccggtgctggctccgcggcggcagcggcggcggggggcccaggtccggcctgctccaccgcgcgcgccgcgaggagctcctggaccgggtgtccgcggtcttcttcaccgacctggaggccgccgagcaccccggcgggctcgacccggacgtcgtcttcgcgctccccgtcgtcaagtaccgccgggcccgggcagcgtcggcggcgctcgagtgcgccgtgtgcctcgccgagttcgcgccgggcgagcggctcaagcagctgcccagctgctcccacgccttccacatcgattgcatcgacacctggctccaccacaacgtcagctgcccgctctgccgcaccgtcgtcacgggcggcgtcgcgctcccactcgcccgcgacgaccacgacgcgtcctgccgcgagctgcagctcggcgacgacggccgcatcgtcggcgccgccgccaggacgacggggtacgggagctcctgcaggttcccgaccaaaagcggcgccgcgcaggagcccatcacgcgctccttctccatggactgcttcgccggcggcctcggccggaagccgccgcagaaggagcctcctgctggtagctcggaggccgggccgagcagcgccgccgcctccgaccgccccgacagcggcaccggcgagactagcgggcggttccgtcggctgctctcgtcgttcgggctcggccggagctcgcggagcacggtgctgccgatccaactggacccgtgacggcggcgacgggttcgtgccctctcgtcgctcgctccattaaccagtttctttagatgattaattgagtcgtgtcgtgtgcatgcagtgtacagcatagcagagactttgggttggaaaaaaaaaaaaaaaaaaaa

SEQ ID NO: 7528 - protein, 301 aa, Panicum virgatum
  misc_feature: Ceres CLONE 1912606
  misc_feature (1)..(42): Pfam Name: zf-C3HC4 Pfam Description: Zinc finger, C3HC4 type (RING finger)
  misc_feature: The sequence is a functional homolog of  SEQ ID NO 150 in the  10/225,068 US patent application
  misc_feature: The sequence is a functional homolog of  SEQ ID NO 1537 in the  11/479,226 US patent application
  misc_feature: The sequence is a functional homolog of  SEQ ID NO 2534 in the  10/374,780 US patent application
  misc_feature: Useful for making plants with modulated growth and phenotype characteristics
MDAAGMAAGAPILPPDASPPPAAGQGAAFPIAIVIAIGFMVTSLILISYYFLVVRCWLRGGSGGGGPRSGLLHRARREELLDRVSAVFFTDLEAAEHPGGLDPDVVFALPVVKYRRARAASAALECAVCLAEFAPGERLKQLPSCSHAFHIDCIDTWLHHNVSCPLCRTVVTGGVALPLARDDHDASCRELQLGDDGRIVGAAARTTGYGSSCRFPTKSGAAQEPITRSFSMDCFAGGLGRKPPQKEPPAGSSEAGPSSAAASDRPDSGTGETSGRFRRLLSSFGLGRSSRSTVLPIQLDP

SEQ ID NO: 7529 - DNA, 1341 bp, Panicum virgatum
  misc_feature: Ceres CLONE 1912627
  misc_feature: Encodes the peptide sequence at SEQ ID NO. 7530
cccgtccgcctctctctctctctctctctctctctctctctcttccctcaatccctcccccctcccctcccctccgctccgtgggcggagtccccgtccccgcccccaaatcgccccttccctaagcacagcaccaccggcagcgcgcgggaggagaggagaggagaggggggggggggaggcagggcgggtcgggcgagatgagcgactccttctgcccggactgcaagaagcagacggaggtggcgttcgaccactccgcgggggacaccgtgtgcaccgagtgcggcctcgtcctcgaggcgcactccgtcgacgagacctccgagtggcgcaccttcgccaacgagtccaacgacaacgaccccgtccgtgtcggcgggcccaccaacccgctcctcaccgacggcggcctctccaccgtcatcgccaagcccaacggcgcgcagggcgacttcctctcctcgtcgctcggcaggtggcagaaccgcggctccaaccccgaccgatccctcatcctcgccttccgcaccatcgccaacatggccgacaggttgggtcttgtggctactattaaggaccgagccaatgaaatctacaagaaggttgaagatctcaagtctatcaggggaagaaatcaagatgctatactagctgcttgtctgtatattgcttgtagacaagaagataggcctagaactgtgaaagaaatatgttcagttgctaatggagcaacgaagaaagaaattggcagagcaaaagaatttatagtgaaacagctggaagttgagatggggcaatctatggagatgggaaccattcatgctggagattttctgaggcgtttctgttcaactcttgggatgaacaatcaagctgttaaagcagcccaggaggcagttcaacgctcagaggagcttgatataaggaggagccctatctcaattgcagcagcggtaatttatatgataacccaactctcagaggacaaaaaaccacttaaagatatttccttggctactggtgtggcagaaggcaccatcagaaattcatacaaggatctgtatccctatgcttcaagacttatccctaacacttacgccaaggaggaagacctaaagaatctctgcacaccttaggaagcttttttttttttctttttcattgttacataagtcggaattagatttgtcaaagaagagtgatgttgtccctggtgactgtactgtccctggttaactttatgtgggcatgagaacaaaagttgtcctcatcagatcgaatttctttcagtgatggcaagtttcgtacattacctaccaaaaaaaaaaaaaaaaaaaa

SEQ ID NO: 7530 - protein, 312 aa, Panicum virgatum
  misc_feature: Ceres CLONE 1912627
  misc_feature: Great-hit functional homolog of the protein sequence given in SEQ ID NO 9547
  misc_feature: Useful for making plants with altered terpenoid content
MSDSFCPDCKKQTEVAFDHSAGDTVCTECGLVLEAHSVDETSEWRTFANESNDNDPVRVGGPTNPLLTDGGLSTVIAKPNGAQGDFLSSSLGRWQNRGSNPDRSLILAFRTIANMADRLGLVATIKDRANEIYKKVEDLKSIRGRNQDAILAACLYIACRQEDRPRTVKEICSVANGATKKEIGRAKEFIVKQLEVEMGQSMEMGTIHAGDFLRRFCSTLGMNNQAVKAAQEAVQRSEELDIRRSPISIAAAVIYMITQLSEDKKPLKDISLATGVAEGTIRNSYKDLYPYASRLIPNTYAKEEDLKNLCTP

SEQ ID NO: 7531 - DNA, 1070 bp, Panicum virgatum
  misc_feature: Ceres CLONE 1912639
  misc_feature: Encodes the peptide sequence at SEQ ID NO. 7532
ccaccaagtcagtcatcactctcctccatcagtgatcacttggtagtcttccttgagctctcgcgaccggcgcctcccaccgtccctcagtagtagtgatcagtccgtcgcaatggcatccgctggcgtcatctccacgctcctggcgcctccccttgtccactcctcccccgtcgcctccgcctctccgctcccggcgcacgcgctcccatccctccgccgccgcccccggtccctgcccacggtccgcgccgtccagacgcagggggcgggtgtccagacgcagcagggcggcgccgcccggaagggcgccatccagcgctggaccagcgcgcccgtcgccgccatcggccccgccaccgacgacgagtccatcttcctcatcaccctcgacctctccggcgccccggcgctcgtggacgcgtacacgaccccagggcagtacctcctggcccgcgtcccctccggggagaagctctccccggcgtacatgtgcatctcctcggcgccgcgctccgggctccagttcgatctgctcgtcaagcccgtgccggggaccacgtcggagcagctgtccaagctccgcgtcggcgaggttgtggagctcggccccgtcatggggcgcgggttcgccatccagcacatacactgttggagaacggcttattagtgccggtcacaggacgtgttagtgccggtccctgtgaccggcactaaatggccggcactaacgtgacagacgttagtgccggctactctgaccggcactaacgtgcgtatgttagtgccggtccgtattaccagccggcactaacgtgcctgcccccgcccgagtcctgacagtaaggttagtgccggctgatataactagccggcactaaatgttttttcttctttatgtttcttttcttttcatttttatacgtatggctatgcgtatttctagcgtatgggactacatagtcgtactctttgcattgcacagtattattagaacagcatattacactaacattatatatttatatatatatttgtcatgtatggaacaaaaaaaaaaaaaaaaaaaa

SEQ ID NO: 7532 - protein, 185 aa, Panicum virgatum
  misc_feature: Ceres CLONE 1912639
  misc_feature (2)..(102): Pfam Name: FAD_binding_6 Pfam Description: Oxidoreductase FAD-binding domain
MASAGVISTLLAPPLVHSSPVASASPLPAHALPSLRRRPRSLPTVRAVQTQGAGVQTQQGGAARKGAIQRWTSAPVAAIGPATDDESIFLITLDLSGAPALVDAYTTPGQYLLARVPSGEKLSPAYMCISSAPRSGLQFDLLVKPVPGTTSEQLSKLRVGEVVELGPVMGRGFAIQHIHCWRTAY

SEQ ID NO: 7533 - DNA, 1206 bp, Panicum virgatum
  misc_feature: Ceres CLONE 1912668
  misc_feature: Encodes the peptide sequence at SEQ ID NO. 7534
acgaacaaaaaaaattcgctccacatcagagattcagactattcagaggggacgacccccgcctcctctctcgtgacgcgaggtcgcgagcaacctctcctcccattgccggatcgtcctcgcctcccaacccatacgcgtcagacgagaggcggcgagcacgcgtaatgaaggggggtggcgtcatcagggcctccggcggaggcgccggtggcgtggggctgatgcggacgcggctgcggctacccgtggtgctcctctcctgctccctcttcttcctcgccggcttcttcggctcgctcctcttcacccaggatccggaggaggcggacatgccggtgccgagggagcggctgctggaggcggcgttgcccgagatgccctacggcgagtccggcgaggcggcgccgtccttgatcccataccagattttgagctggcaccctcgtgcattgtactttccacaatttgcgacatcagaacagtgtgaaaatatagtaaaaaatgcaaaggaaagacttgcaccatcaacattagctctgaggagaggagaaactgcggagagtaccaagggaatcaggacaagttcgggaacattcctcagtgctaatgaagacccaactggaacccttgcagaagttgagaaaaagattgcaagggctaccatgatacccagaaatcatggggagccctttaatgtcctgcggtatgagattggacaaaggtatgcttcacactatgatgcatttgacccagcccagtatggtccgcaaaaaaatcaaagggtggcgtctttcttgctttatctcacggatgttgaagaagggggagaaacaatgttcccatatgagaattgggagaatatgaatataggctatgattatgaaaagtgcattggcctaaaggtaaaaccaaggaagggcgatggactgttgttttactccctcgcagtaaatggcaccattgacccgacttcacttcatggtagctgccccgtgatcaagggtgagaaatgggtcgccacaaaatggatgagaggcaatatagtttagagattgagaggcacaagggtcaagacgccctccaaaatagatcatacgcacatatactaaccattttttttacttgttcaattgctgtggacattgatggaatagtgaaaagaacttgtaaccattctgttttcaaaaaaaaaaaaaaaaaaaa

SEQ ID NO: 7534 - protein, 294 aa, Panicum virgatum
  misc_feature: Ceres CLONE 1912668
  misc_feature (1)..(119): Pfam Name: 2OG-FeII_Oxy Pfam Description: 2OG-Fe(II) oxygenase superfamily
MKGGGVIRASGGGAGGVGLMRTRLRLPVVLLSCSLFFLAGFFGSLLFTQDPEEADMPVPRERLLEAALPEMPYGESGEAAPSLIPYQILSWHPRALYFPQFATSEQCENIVKNAKERLAPSTLALRRGETAESTKGIRTSSGTFLSANEDPTGTLAEVEKKIARATMIPRNHGEPFNVLRYEIGQRYASHYDAFDPAQYGPQKNQRVASFLLYLTDVEEGGETMFPYENWENMNIGYDYEKCIGLKVKPRKGDGLLFYSLAVNGTIDPTSLHGSCPVIKGEKWVATKWMRGNIV

SEQ ID NO: 7535 - DNA, 1236 bp, Panicum virgatum
  misc_feature: Ceres CLONE 1912715
  misc_feature: Encodes the peptide sequence at SEQ ID NO. 7536
ccatcacagttcacaacctcgaagtcgaaacacacagctcacctcagtgtgtgaatcgaagctcgaatagctagctgctgctactactgctagtacgtactagctgatcgagtagtagctggtcggctactcgatccctctccgctgtgcgtagcagcttctgtcttctgttcgcaacaagcccggcacaacgatggcggtggcggcgaagacgacgacgcccgcggcagccgggagtggccggatcaggcggtacgcgctgctgctggcgctgtgggactcggagtacgcgaagcaggtgtacggcgggtaccgcaacgtcttcgtcgccgcgttcggggaggaggacgcgggcgagaggtgggactgcttccgcgtgatcgccagcgagttcccggcgccggaggacctggcgtcgtacgacggcttcgtggtcagcggcagcccgcacgacgcgtacgccgacgacccctggatcgcccgcctctgcgcgctcctccggacgctccacgccatggggaagcgggtcctcggcgtctgcttcggccaccaggtcctgtgccgcgcgctgggcggcagggtcggcaaggcgcggaacggatgggacgtcggggtgaggaaggtgaccttggtgcgagacggcttcggcttactgggggatctcgaggagctcccgtcgagcgcgtccctcgtcgaggtccaccaggacgaggtgtgggagctccctcctggggcgacggtgctggcctactcagagaagacgcgcgtggaggcgttcgcggtgggggagcacgcgctgggcatccagggccacccggagtacaccgccgacatcctccacaacctcgtcgaccgcctcaccggccagagcgccatcccggcgagcgtcggcgaggaggcgcggcggacggtggcggagaccggcggccctgaccgcgcgttctggacgggcctctgcaagaggtttctcggaggtggaggaagcagcccgcggtctgctgcggcggtgcgtgagagtggcacggcgccggaggtgacgatgatgaccagcctcgccgtcaccggctgcttcggtagcgccgccgccgctccaatggtccagttgttggctcgcagcgctagctttgctggagttgcacgtacgtagcagccttttcgccgcatggtaggcgaggcgttgacttcaatataattcaagatactttggtgtgtgtacaaaaaaaaaaaaaaaaaaaa

SEQ ID NO: 7536 - protein, 317 aa, Panicum virgatum
  misc_feature: Ceres CLONE 1912715
  misc_feature (1)..(168): Pfam Name: GATase Pfam Description: Glutamine amidotransferase class-I
MAVAAKTTTPAAAGSGRIRRYALLLALWDSEYAKQVYGGYRNVFVAAFGEEDAGERWDCFRVIASEFPAPEDLASYDGFVVSGSPHDAYADDPWIARLCALLRTLHAMGKRVLGVCFGHQVLCRALGGRVGKARNGWDVGVRKVTLVRDGFGLLGDLEELPSSASLVEVHQDEVWELPPGATVLAYSEKTRVEAFAVGEHALGIQGHPEYTADILHNLVDRLTGQSAIPASVGEEARRTVAETGGPDRAFWTGLCKRFLGGGGSSPRSAAAVRESGTAPEVTMMTSLAVTGCFGSAAAAPMVQLLARSASFAGVART

SEQ ID NO: 7537 - DNA, 1280 bp, Panicum virgatum
  misc_feature: Ceres CLONE 1912721
  misc_feature: Encodes the peptide sequence at SEQ ID NO. 7538
aaccaaagttgtgctagcctttctgtctgtccgccaccgagaggcgagagcccccgtgtgttgctttcctcgccgatggaggaaaccctagccgtcgaatccgccgccggcgaggcgcccgccgcagtggcgtcggagcggaaggaagagacgctcgaggaggtgctctccaggcacaggaaagaaaaatccaaactccaggataaagaaacaagcctgaagaaagctgctgccaaaggaagcaaagcggagcagaaggctaagaaaaagcaagtagaagaagagattacacgcctgtcagctgagttagaggcgaaacatgctgcggagcttgcttcttttgggtacaaaccctcaggcagctcagaaaagggtaaccttgacaacctagtgaaggccatagctggtgtttccatgtccagcaatttggattccgcaaagcccagcaagggtgcacggcgacgagagaagaaggcaaaggaggaagctgctcgggagcaacggatccaagaagaacaaagcaatcttgtcagcgaccgcatgctggaaaaggagaagcttgaaagtaagcttgagcccttggggctgaccattcaagaaataaagccagatggccactgcctgtaccgtgctgtcgaaaaccagttgttgctccattccaagggcactgcacggtacagctaccaggacctacgacagatgacagccaagtacatgagggagcacgcagacgacttcctcccgtttttcttagcagaaggcaaggctgagactgggtcagatccctctgagagctttgagaagtactgccaggagatcgagtccacggcagcctggggtggacagcttgagcttggtgcgctgacccactgcctcaagaagcacatcgtggtctactcaggctccttcccagatgtggaaatgggccaggaatacaaatctggatccggaggtagtagtgtgggggatgctagcatcaggttgtcctttcataggcatgcgtatggtcttggtgagcactacaactcggtgattccaactgagtcatcataacaaaagaaaatcactctctgatatgtttgattgtttactggtcttgcatgttggagtttaaagtttaaacacagtagatgacttgtttttggttgctgctaaattttccatctcgtcggtcgttgatggttgagtgtaccaatcaaagctgtactcgggaggttgcttcccaaacaattttgctctcaccagtattatgttgcaatcaaaaaaaaaaaaaaaaaaaa

SEQ ID NO: 7538 - protein, 325 aa, Panicum virgatum
  misc_feature: Ceres CLONE 1912721
  misc_feature (1)..(138): Pfam Name: OTU Pfam Description: OTU-like cysteine protease
MEETLAVESAAGEAPAAVASERKEETLEEVLSRHRKEKSKLQDKETSLKKAAAKGSKAEQKAKKKQVEEEITRLSAELEAKHAAELASFGYKPSGSSEKGNLDNLVKAIAGVSMSSNLDSAKPSKGARRREKKAKEEAAREQRIQEEQSNLVSDRMLEKEKLESKLEPLGLTIQEIKPDGHCLYRAVENQLLLHSKGTARYSYQDLRQMTAKYMREHADDFLPFFLAEGKAETGSDPSESFEKYCQEIESTAAWGGQLELGALTHCLKKHIVVYSGSFPDVEMGQEYKSGSGGSSVGDASIRLSFHRHAYGLGEHYNSVIPTESS

SEQ ID NO: 7539 - DNA, 1375 bp, Panicum virgatum
  misc_feature: Ceres CLONE 1912798
  misc_feature: Encodes the peptide sequence at SEQ ID NO. 7540
atttttgcctgccttcggattgcaccgtgcacgggggagaagggcacgcggagagaggatgagggggctcctcgggcgccggcggcagccgccgccgctcccgctcttccccgccgccaagcgctcgtccgctccggcgagcctcctcctcgcccgcatccgccgtatcctcccggagagccggctcctccggctgctcctcctactcgcgctcttctccctcgtcccgccggccttcttccacctccgcctgcgccgcttccaccgcatgcgcgagaggaagtgcgggtggatcacgagcccgcccatggtgtgcgcgcacggcggcgactccaccaatgcgtttcccaactcgatggaggcatttcggatggctctggacgcgcgggtcgactgcgtggaggtggacatctccaggtcctccgacggcgtgctcttcgcactgcacgacagggatctgcaaaaaatgtctggtaattccactgccaaagttggccactggagcacagatgagataaaagcactaggtacaaggtttcagctatcgaaaagtgtccgaaacgaggacgttcctaaagcagaagatgctctggcaatgatatcacagtcggttcggcaggtgattctggatgtgaaagttggcctaccttcatttgagaaaggtttagctgaagatgtattgtctcttctgaagaaaacaaattgcaaaaattgtcttgtgtgggcaaaaagcgatgacctagggagagagatgatcaagttgtctaaagatgttgtggttggttatattgttatggttgataaatccactggtagaagaactgagttggtgcggtttgaaggggctaaagttgctggtgtatatcatcctttgatccacgaaaaagtcgtgaaggtcatgcggagacatgataagaaagtttttgcatggactgttgacgataccaactccatggagaagatgctatctgagcatgttgatgccattgtgaccagcaacccttccctcctgcagcagcttatgcatgagacaagaactgaatgcatggaagatgggtttgccttaccattggatttctaattcttagtgcacattaccatcactgcaggtttgggaacaaaagagtaagactttttttatagattagatgatgatttatttgaacttttacactttgatagatcattgagataggccttaacaaaatatagttaacttgccatgaatctttttttggtttcattttactgctctgctggaatagataaagtcatagtggcattatgacaatattatcattgattcataggatcatgctttcacgattgaatttcaagtatgtttctcaatttttaaaaaaaaaaaaaaaaaaaa

SEQ ID NO: 7540 - protein, 340 aa, Panicum virgatum
  misc_feature: Ceres CLONE 1912798
  misc_feature (86)..(251): Pfam Name: GDPD Pfam Description: Glycerophosphoryl diester phosphodiesterase family
MRGLLGRRRQPPPLPLFPAAKRSSAPASLLLARIRRILPESRLLRLLLLLALFSLVPPAFFHLRLRRFHRMRERKCGWITSPPMVCAHGGDSTNAFPNSMEAFRMALDARVDCVEVDISRSSDGVLFALHDRDLQKMSGNSTAKVGHWSTDEIKALGTRFQLSKSVRNEDVPKAEDALAMISQSVRQVILDVKVGLPSFEKGLAEDVLSLLKKTNCKNCLVWAKSDDLGREMIKLSKDVVVGYIVMVDKSTGRRTELVRFEGAKVAGVYHPLIHEKVVKVMRRHDKKVFAWTVDDTNSMEKMLSEHVDAIVTSNPSLLQQLMHETRTECMEDGFALPLDF

SEQ ID NO: 7541 - DNA, 1762 bp, Panicum virgatum
  misc_feature: Ceres CLONE 1912815
  misc_feature: Encodes the peptide sequence at SEQ ID NO. 7542
gatcgaggccccgcatcacacaccactccactcccccacctccggcgatggccggccgcgtcccgggcgccgccgcgtcctcgcccctcccccgcgcgctcctcctgctcgcggcgctcgcgctcttcaccctatccttcctctccctccgctccctccgccccgccgcggggccctcgctccccaccgccggggtcacctcctcgctcggcgccgccgacaagccccgccccatcctcccgctccagcactcctcgtcggcgtaccactcgcccgaggcgttcgcggcggggtacgcggagatggagcggagcttcaaggtgtacatctacccggacggcgaccccaagacgttctaccagacgccgcggaagctcacgggcaagtacgccagcgagggctacttcttccagaacatccgcgagagtcggttccgcaccgacgaccccgacaaggcgcacctcttcttcgtgcccatctcgccgcacaagatgcgcggcaagggaacttcatatgagaatatgacagtgatagttaaggactatgtagaaggattgataaacaagtatccgtactggaacagaacactaggtgcagaccacttctttgtcacctgccatgatgtaggtgtgagagcatttgaaggacttccattcatggtgaaaaactctattagagttgtatgttcgccaagctataatgttgactttatacctcacaaggatattgctcttcctcaagtcctacagccatttgctctgcctgaaggaggaaatgatattgagaacaggacaattcttggattttgggctggccatcgcaattccaaaataagagttattttggcacgagtctgggagaatgacacagagcttgctatcagtaacaatcggattagtagagctattggagagctagtttatcagaagcagttttaccttacgaagttctgtatctgtcctggtggctctcaagttaacagcgctcgtatatctgactcaatacactatggttgtgttcctgttattttgtcagattattatgatttgcctttcaatgatgcccttgactggagaaagtttgcggttatacttagggagagagacgtgtatcaactaaagagtattctgaaatctatatcacaagaggagtttgcttcattgcacaaatctctggtccaggtgcagaaacactttgtgtggcattcacctcctgtcccatatgatgcatttcacatggttatgtacgaactatggctgcggcataatgtgatcaagtactgaagcatactctagtgagttttgattgctaacctatacgaccgatccatcagaaatatactgccaagtctgacagcctactgccaagtctgacagcctgctggtgctaccttgaatggggccatttgttcctttgctcttagaatctccagctggatggatcattgaatataatgggtagctagttagctatgcatattgcactagagagcatctgcatgaaagtaggtcaacgttgagcatatatcatacaactggagtccagttaataaatggatgcgttaattctttcaacaatagttggttttccacatattgcaatcctttcctctagatatttttgtatttcatagatcaatctgcctggttgatcgcatgctgtttctcatgcaatttttgtgttcagacttgtaagtaatgtacaatattattgacgaaaaataaattaattttatctgactgaaaaaaaaaaaaaaaaaaaa

SEQ ID NO: 7542 - protein, 411 aa, Panicum virgatum
  misc_feature: Ceres CLONE 1912815
  misc_feature: Great-hit functional homolog of the protein sequence encoded by LOCUS At4g38040
  misc_feature: Useful for making plants with altered cell wall content and/or composition
MAGRVPGAAASSPLPRALLLLAALALFTLSFLSLRSLRPAAGPSLPTAGVTSSLGAADKPRPILPLQHSSSAYHSPEAFAAGYAEMERSFKVYIYPDGDPKTFYQTPRKLTGKYASEGYFFQNIRESRFRTDDPDKAHLFFVPISPHKMRGKGTSYENMTVIVKDYVEGLINKYPYWNRTLGADHFFVTCHDVGVRAFEGLPFMVKNSIRVVCSPSYNVDFIPHKDIALPQVLQPFALPEGGNDIENRTILGFWAGHRNSKIRVILARVWENDTELAISNNRISRAIGELVYQKQFYLTKFCICPGGSQVNSARISDSIHYGCVPVILSDYYDLPFNDALDWRKFAVILRERDVYQLKSILKSISQEEFASLHKSLVQVQKHFVWHSPPVPYDAFHMVMYELWLRHNVIKY

SEQ ID NO: 7543 - DNA, 1298 bp, Panicum virgatum
  misc_feature: Ceres CLONE 1912834
  misc_feature: Encodes the peptide sequence at SEQ ID NO. 7544
ctttccggtctctgcactgcagcttcctgcagtgctggctgctcctcgggcgcagcgtccagctgctgctctacgcctctactgctgcatgctctgtgctctctctcctccttgcagcggcagccctctccccccgttcctgtgatcctgtcacccaccggcccgtccatcctctcccacctatatatgccagcttgctctgcctcccagggccagtgtgtgcgctctacaagtctacagctttgtgcttccgtctcagcgtttcagagctgctgctgcgagcctgcgacttggctgttggagcacagcagcgtgcacagggtagataggaggagacaggaagggcaaggccgaaggcgaggggagagatggcttggaatggccgcttcggcgacgaggaggggaggggcctggagctcagcctcggcctcccggcctacttctccaggtcgccaacccaggctgcagctttggagaaggggagcgctggctctactgccgccgctgctgctcgagcaaagggaagcaattgcttcaaggcgaggccggcggcagctgctccggtcgtcggatggccgccggtgcgcgcattccggcggaatctcgcctcgtcgtcctccaagctgccgtcccacgagccatcaggccagaggggcagtgatcccacaggcgccggcaaggccgttcaggccggcaagaaggggctgttcgtcaagatcaacatggacggcgtccccatcggccggaaggtcgacctcagggcccacgccggctacgacacgctctccgccgccgtcgaccacctcttccgcggcctcctcgccgctcaaacatcaggaggggagcaggaggtgatcaccggggtcttgaacggcagcggcgagtacacgctggtctacgaggacgaggagggcgaccagatgctagtcggagacgtgccatgggagatgttcatcagcacggcgaggcgtctgcgcgtgctgaggagctccgagctgagcccgtcttcgctaacaacagatagcaggaagagagcagcagctgagtgctggaccggtggctctggagttggagtctgaactctgaagtctgaacatgctgcgtcttttccgcaagccatttgtgtaaatcttcaagtagtttcttctatcatactcttagtattttgcctatcatgctagagaagcaagaaccaagagttgatcggtgatgttagaatcatgcaatgctaggatctgtgtcaaaacttattttgaatggaagtttggctgtgctatcaaaaaaaaaaaaaaaaaaaa

SEQ ID NO: 7544 - protein, 236 aa, Panicum virgatum
  misc_feature: Ceres CLONE 1912834
  misc_feature (1)..(197): Pfam Name: AUX_IAA Pfam Description: AUX/IAA family
  misc_feature: The sequence is a functional homolog of  SEQ ID NO 1757 in the  11/479,226 US patent application
  misc_feature: Useful for making plants with modulated growth and phenotype characteristics
MAWNGRFGDEEGRGLELSLGLPAYFSRSPTQAAALEKGSAGSTAAAAARAKGSNCFKARPAAAAPVVGWPPVRAFRRNLASSSSKLPSHEPSGQRGSDPTGAGKAVQAGKKGLFVKINMDGVPIGRKVDLRAHAGYDTLSAAVDHLFRGLLAAQTSGGEQEVITGVLNGSGEYTLVYEDEEGDQMLVGDVPWEMFISTARRLRVLRSSELSPSSLTTDSRKRAAAECWTGGSGVGV

SEQ ID NO: 7545 - DNA, 1240 bp, Panicum virgatum
  misc_feature: Ceres CLONE 1912858
  misc_feature: Encodes the peptide sequence at SEQ ID NO. 7546
actccctccatcccttggcatgcaaacttccacagccacagtgtcggctggtgctgcttgctagctgctggcacctttcgcttggtcggtgccaccaaacagaaaaggccaagccatggggggcagcctgagcctcgtgccggtgctcgactacttcgcccggcgcgagttgctcgccgccggcctccgcccgagcgccgtcacgctgccgtacccggacggcggcgccggggcgacgtgcaccgtccactactgggccccgccgggggagccgcgcctcccgccgctcctgctcgtccacggcttcgggccccgggccacctggcagtggcgctgccaggtgggcccgctctcacgccacttccacgtcgtcgtgcccgacctcctgggcttcggcggcagcacgtacccgttcgacacggcgccgccgccgtcggaggccacgcaggccgcgacgctggccgcgctgctggacgcgcttcccgggatggaggggaggcgcgtggccgccgcgggcacgagctacggcggcttcgtcacctactggctggcgcgcgccgcgggggccgcccgggtgggccccgtggtgatcgcgagctccgacctgctcaagacggcggccgacgacagggggttcctgaagcgcgccggcgaagggtggagcggagtggaccagatcctcctccccgccgagcccgccgcgatgcggaagctcctggagctggcctcctaccgcccgccgccgcgagcgatgacgccggacttcctgctccgggacttcatccagaaactcttcacggagaacagggagcgccttgttcatctcctcaaggggattacagtcggcacggagaaattccaagtgacaccaatacctcaggacgtgttgattgtatggggagaccacgaccagctgttcccgttggagaaggcgtttgcggttcagaggtctctgaacgggagcgctaggctggaggtcgtcaagaagaccggccacgctccgcagctggaggacccggcccggttcaacaagctcatgctggacttcttgctggctgctcacaagcctgacccctcggtttagtggcggctcgcagtaagatgcattgttgattggtagccttggtttgtttgtaataagacttggctcggcgcctctcagtccattcactggtacagatttgctctatatgacaacatctcaagaaataattcatctgaaaaaaaaaaaaaaaaaaaa

SEQ ID NO: 7546 - protein, 322 aa, Panicum virgatum
  misc_feature: Ceres CLONE 1912858
  misc_feature (1)..(229): Pfam Name: Abhydrolase_1 Pfam Description: alpha/beta hydrolase fold
MGGSLSLVPVLDYFARRELLAAGLRPSAVTLPYPDGGAGATCTVHYWAPPGEPRLPPLLLVHGFGPRATWQWRCQVGPLSRHFHVVVPDLLGFGGSTYPFDTAPPPSEATQAATLAALLDALPGMEGRRVAAAGTSYGGFVTYWLARAAGAARVGPVVIASSDLLKTAADDRGFLKRAGEGWSGVDQILLPAEPAAMRKLLELASYRPPPRAMTPDFLLRDFIQKLFTENRERLVHLLKGITVGTEKFQVTPIPQDVLIVWGDHDQLFPLEKAFAVQRSLNGSARLEVVKKTGHAPQLEDPARFNKLMLDFLLAAHKPDPSV

SEQ ID NO: 7547 - DNA, 768 bp, Panicum virgatum
  misc_feature: Ceres CLONE 1912967
  misc_feature: Encodes the peptide sequence at SEQ ID NO. 7548
gccgtccgctagggttttaagccgcagccgcagcacacgccgccggaggagcgcgactgcggcgagaaggggagaagcagcagctcgagggccggccgagcgagagatgaggctcctaacgcacaacatgctggcgtccaacgtccggggcgcgacgaccggctacccgctgaagctggaggcggccaagtgggtgaccaaggaggtggagctcaacgccgacttcctccgcagcctcctccccaagatcgactggcgcgccctcgtcgctgccacccgggcgctcggccttcctgagctcctccccgaggagcagccgcccgaggaggagatcttcgccgagggcgctgccgacgtcgagggcagcgccatccgccgcatccaccacgcgctcctcgagacccacgtccaggagggctccctcgtctgccccgataccagccgctgcttccccatcgataagggcatccccaacatgatgctgcacgaggacgaggtctgatgcgttagtctcgccatggtctcctttacttacacatgctcgttgtcggctgtcataaaagagttcaaggcttgttgacttctcggattgtggttgttaaatataaatgatggcgttataatttgaatggatgagccgtgtttttatgtttggaattgcgttttttgtcagtaatttggtacggctgaaatcgtaaggtacaacggaaattgcatacagtaatttgacacttcagccttttcaattaaaaaaaaaaaaaaaaaaaa

SEQ ID NO: 7548 - protein, 131 aa, Panicum virgatum
  misc_feature: Ceres CLONE 1912967
  misc_feature: Great-hit functional homolog of the protein sequence given in SEQ ID NO 9227
  misc_feature: Useful for making plants with modulated biomass
  misc_feature: The plant is abnormally small.
MRLLTHNMLASNVRGATTGYPLKLEAAKWVTKEVELNADFLRSLLPKIDWRALVAATRALGLPELLPEEQPPEEEIFAEGAADVEGSAIRRIHHALLETHVQEGSLVCPDTSRCFPIDKGIPNMMLHEDEV

SEQ ID NO: 7549 - DNA, 2119 bp, Panicum virgatum
  misc_feature: Ceres CLONE 1913008
  misc_feature: Encodes the peptide sequence at SEQ ID NO. 7550
gcccagtggtcagtaccggctcgctctcggctctcccccttccggccttcccttcctctcctcccccgttgcttgcttcgccttttattcccttgtttcctgattggcgctttcgtgatggcccttttttttctggccgcctcgggcttcgatgctgcccgccgccctgtttctatttttcgggcggcggccgggtttcggataaggcggtgtcccaatttcccggagcgaagccgtcgtggcggggatcctgttgcttttgggccggcgaatttcgggacggagttcttccgccggttggatcggggagacatggttgctgaccttgttggcgctgtaatttctgtagtgggatcaggggtactctgatttctgcggctagcttgttgggtgctggttagcgtcgttgttcgagtgtccagtactccagttgacctagaactcctgtgcacttcagcagttccggctgtgtcggatggtgttttgcctcacttttgttcggcagttcttgctgattccgatgttcaattgttcagactcgaggctcgtcggagagcctctgctctgtgcctccatccgtgctcgaattggtgctggtgtttcattcccagtgttcatgtgccgcatgatacgcgagcatatccggctttcagtctcgatcctcgtttgtgacgtactgccactgttcagctgtgtttgacttttccatggctcgcatgccacagaaacagaacgcggccggcggggctgcgagggtgatcaccgagcatcatggagtcgcgcccggacggaacgaacctggtggagcccagagggcccggtgccgcgctgccttcaggcggcgcggcgatgcagcagccgtggtggacgagctccggggccgggctcggtgcagtggcgcctgccgttgtggcgccggggagcggggcagggatcagcctgtcgagcagcccggtaggtagtagtggtggtgccggggctgccaaaggcgctgcgagtgacgagagcagcggggattcacggagatctggggaaccaaaagatggaagtgctggtcaagaaaagaaccacgccacatcacagatgcctgctttgatgtcagagtatttgacaccatattcacagctggaactgaaccaatcaattggttcagcagcatatcagtacccagatccttactacgctggaatgattcctccatatggcactcaagctctggctcatttccagctgccaggattatcccactctcgcatgccattacctcttgaagtatcggaggagcctgtttatgtaaatgcaaagcagtaccatggaattttaagacgaaggcagtcacgtgccaaggctgaacttgagaaaaaggtggtcaaaaccaggaagccctatcttcatgagtctcatcatcaacacgcaatgagaagggcaagaggaaatgggggacgcttcctgaacacaaagaaaagtgacaatggtactccgaatggtaatgctgaacctaagaaaggagatcaaaactccgagcatctccgtgtccctcctgacttactacagctacgacagaacgaggcatgatgtagttggtcttgcatcctagaacagtggtttctgcccgcaggcataggcacttgagagaccggactcctgccccagcgccgcgctgccatcttagcgacctgccttggttgtgcaaggcggcccaaggctcgttcacctgagtgagcttggtaccaggtcctggcagagcgctcttgtgggcgcaggtgtccgtataagtgttcaatgccatgggttaggtctgctgttttcaggcaattcattcttggctttcgcatcccgcccttgtgtgtaactggtgtgctgtaacttgtaagtgaaactaatgttgtgttcgcttgtcggcgtcctgcggaacatctgtataattaagatcaacttcgtattgactccgtattgctgtgaatttgagctgtaaacatggccaaagctgaaactcgttgttcaggggtagcaattcatactggtctgttgggtgttcagcaatcagcaacacccgtcttgtactgaatattccagtgcaaaaggcagatgcttgttttaaaaaaaaaaaaaaaaaaaa

SEQ ID NO: 7550 - protein, 267 aa, Panicum virgatum
  misc_feature: Ceres CLONE 1913008
  misc_feature (1)..(57): Pfam Name: CBFB_NFYA Pfam Description: CCAAT-binding transcription factor (CBF-B/ NF-YA) subunit B
  misc_feature: The sequence is a functional homolog of  SEQ ID NO 1263 in the  10/374,780 US patent application
  misc_feature: The sequence is a functional homolog of  SEQ ID NO 1518 in the  10/666,642 US patent application
  misc_feature: The sequence is a functional homolog of  SEQ ID NO 472 in the  10/666,642 US patent application
  misc_feature: Useful for making plants with modulated growth and phenotype characteristics
MESRPDGTNLVEPRGPGAALPSGGAAMQQPWWTSSGAGLGAVAPAVVAPGSGAGISLSSSPVGSSGGAGAAKGAASDESSGDSRRSGEPKDGSAGQEKNHATSQMPALMSEYLTPYSQLELNQSIGSAAYQYPDPYYAGMIPPYGTQALAHFQLPGLSHSRMPLPLEVSEEPVYVNAKQYHGILRRRQSRAKAELEKKVVKTRKPYLHESHHQHAMRRARGNGGRFLNTKKSDNGTPNGNAEPKKGDQNSEHLRVPPDLLQLRQNEA

SEQ ID NO: 7551 - DNA, 1858 bp, Panicum virgatum
  misc_feature: Ceres CLONE 1913056
  misc_feature: Encodes the peptide sequence at SEQ ID NO. 7552
gaagggtttttcgcggccgtttacccgtgccgacgaaccccgaccgccgcctccgccgccgccgcctacgcgaacacgctaccgccgcccgttgcggcaacccgccgacgccgatagtccctcctcttccccaaaccagccactgcttttggtctccgtgcggccgtccgatggccaagcggctcgccgccgccgagaaagaggtgctggttgaggtcgtgaggttcacccagaagaacgggttgaaaggctctgatggggggtggaaggagtttctttctcggaatgacaagaagtttggtgattcagtaagcgaccctagaaagcgctcaagggatgtgctgctcgccttcctgcaaaccttctccaaggatttccaaaagtacttcggcaaattggtgaagcgtcaaaaggaaagaagtgctgttcagcagtatatgaactattttcctgacaaggtttctcccgagcagaaacttgttcaactgacagcagagcacccagagtacaggaaaaattattgcttcccatcataccaggagggatggaaagtgctgcggataggagaagtctctagtttggtgagctcgagtgctatgttggcaattgactgcgagatggtcctttgtgatgatggcacggaggctgtggtccgagtatgtgttgtagacaacaatcttgaggtgaagctggacatacttgtaaatccttctaaagctattactgactatagaacacacatcactggtgtatctaagaaggatttagaaggagtcacatcatcgctagttgatgttcagaaatcgctcaagaggatcttggccaaaggaaagattttgatcggccagagcttatatagagatttatgtgccttaaagattgattactctcaagttattgatacagcatacatctttaagtatgcaaatttacctactacgacatcagcttccttaaatagtttgtgcaagtctgttttagggtattctgttcgagaagacggagaaccacataattgcttaaaggatgcagaagctgcaatgaatctagttcttgcaaagcttaagcatggatttcatgatcccattaaagttgctgcaagctgtgtatctgaatctgatgcattgaagttacttgctcatagaataccagtgcacctgccttgccaagagctgtgcaaagttttctctgggaaccccagtattgatgacaagattgattcaaggattcgaggtgaattttattcaacatgtatttcgttcaatgagatagatgaagtagagaaggcttttgaagcactggatggacaaatgactaaggactctggtgggcggcttcaaaagtatgtgctgatgaagcgcgacagtggagatgtggtgagtttctacgtccggaagatggtatatgcttctcagccaaaccagttcgagtttccaaagaagagaccacagcctactgaggaagcagaaccaaagaaagaacaagctgatggggatcagcaaaagaagaaacggaagagtaagaagcacctgaactaggcacaggtgtctgattgaatgaagaattttcgtgatcttctggttacagattgatgctgaaagaccatgaagaggggtttggagggagcagtttggtcggaggttggtgaaaccaattttggagaagggtgtacgagagaaatagtattggtttgtctggttgcttaggcgggcatttgataattcttcaattagactgacgtagttgggcatgtggtttgtcaaagtatgcttgtcgttagtaaattttatttctgtaattctgtatgctctcagttgcctagcgtttctgttttatggaaaaaaaaaaaaaaaaaaaa

SEQ ID NO: 7552 - protein, 455 aa, Panicum virgatum
  misc_feature: Ceres CLONE 1913056
  misc_feature (1)..(152): Pfam Name: Exonuc_X-T Pfam Description: Exonuclease
MAKRLAAAEKEVLVEVVRFTQKNGLKGSDGGWKEFLSRNDKKFGDSVSDPRKRSRDVLLAFLQTFSKDFQKYFGKLVKRQKERSAVQQYMNYFPDKVSPEQKLVQLTAEHPEYRKNYCFPSYQEGWKVLRIGEVSSLVSSSAMLAIDCEMVLCDDGTEAVVRVCVVDNNLEVKLDILVNPSKAITDYRTHITGVSKKDLEGVTSSLVDVQKSLKRILAKGKILIGQSLYRDLCALKIDYSQVIDTAYIFKYANLPTTTSASLNSLCKSVLGYSVREDGEPHNCLKDAEAAMNLVLAKLKHGFHDPIKVAASCVSESDALKLLAHRIPVHLPCQELCKVFSGNPSIDDKIDSRIRGEFYSTCISFNEIDEVEKAFEALDGQMTKDSGGRLQKYVLMKRDSGDVVSFYVRKMVYASQPNQFEFPKKRPQPTEEAEPKKEQADGDQQKKKRKSKKHLN

SEQ ID NO: 7553 - DNA, 2383 bp, Panicum virgatum
  misc_feature: Ceres CLONE 1913065
  misc_feature: Encodes the peptide sequence at SEQ ID NO. 7554
gcggtattatccatccaccacgcgaactcctcttcccacgccgcctcgcctgcctcctcttccacccctcgccgtccctcgccctcctctgcgcccgtgcgctcgcctcgaaaccccccggcgccgcgctaaaaccctagccctcgaattccccttcgcccgcgcggagcagacgagcccgctcccctgttgcccatggcgtcctcgggggccgccgccaacctatgggtgctgctcggcctcggcatcgccggggtcctgctggcggcgcggaagctgaagcgccccgcgcgccccgaccacggcgccttcatcgcccgcctcgagctcctcccgccgccgcagcctccgccgccgcaggcgccccacccgctcaccggtctctgcttcgccatcgctgacgcattgcatgtcagtggttatattacaagttttggtagtcttgaatgggcaaagacacatgatgcagagacgcaaacatctccggtggtttcagctcttgttgatggtggtgctgtttgtgttgggaaaactgttattgacgagatggcatacagtatccatggagagaataagcattttgataccccaacaaatcctgctgctccggatcgagtgccaggtggatgctcaagcggatcggctgttgcagttgctggaggaatggtagattttgccctgggtattgactcaattggaggagtaaggataccaggtgcttattgcggtgtcttggcgttcaggccttcacatgctgttgtttccagtggtggtatcattcctgttgcacctagcctggacacaataggctggtttgcaagggatccaagtgtgttgcgtcgtgttgggcatcttctccttagacttaattatgctgatattcgcccacctagacatttttacatagctgatgattgctttgaactttcgaagatacctgctagaaggcttactcaggtggtgtcaaaatcggtggagaagctttttggaagacaagtcactcgtatgaatcttgaaaattatttatcttcaaaaatatccagcctgaggaactattcaaatgggcataagaatggggattcaaggttcccgtcgttgctggcactttgtaatgccatgcgatctcttcacaagcatgaatttaaagatcagcatatggagtggataaactcagtcaagcctgctgtggatgctcgcacagtcagtaatttatctgaggatggtgattcagatattgatggctaccaagatgtgagaaacaaagcacgcttggctctaggcgcgcttcttaaggatgatgggattttggtcattccaattgctttgggatgccccccaaagcttaatgctaaggaactctcttctgaaagctacaattgccagacattatgcctttcatctttagctagtatgtccgggtgttgccaggtttcgattcctttgggtactcatgacaagtgtcctgtttcggtttcattcattgcaaggcacggttgtgatcgttttttattggataccattcaaaccatgtatgcgaccatccaagagcaagtggatatcctggcaaaatctaatgtttcaagtaaacaggcgatgaatgaagaagcggctgaaactgctaaagagaaaggtaatgttgcatttaaggaaaaacaatggcaaatggcggtaaatttctatacggaagcaattaaattaaatggaaaagtggctacatactatagcaacagagctgctgcctttcttgaactaactagctaccgtcaagctgaggcagattgcacaagtgccattgatcttgatccaaagatcgtgaaagcatatttacggagaggaactgcaagggaaatgatgggttattataaggaggctgttgaagatttcaaccatgcccttgttctagaaccgatgaacaagacggctggtgttgccattaacaggttaaagaagttgtttccgtaaatacgaatctgttgaactgtctccgcatgaagatgtgatggcatcagattttgtgcacacacaagttgtgcgtgtcccggggagtgggatcgaagtacctggagctcaaccgacggatgctgctgcacatgctttatgctctcacaaggttccaagtcatcacagctggtggcaagttggcaactgattttaagagctgtggtcagttacagtcaatttacccggttccaaccccccaaagttttggaaaagcagaaaataaaacacagatttttggaagttgaccacagtaaactatttcttcaaaagtgctttacgggtgtcctcggtcccccatcgtgtataatatcagcttcaccaattatttgttcaaacgctttgccaataaaaccttttcctgcaaaaaaaaaaaaaaaaaaaa

SEQ ID NO: 7554 - protein, 588 aa, Panicum virgatum
  misc_feature: Ceres CLONE 1913065
  misc_feature (1)..(420): Pfam Name: Amidase Pfam Description: Amidase
  misc_feature (1)..(432): Pfam Name: Amidase Pfam Description: Amidase
MASSGAAANLWVLLGLGIAGVLLAARKLKRPARPDHGAFIARLELLPPPQPPPPQAPHPLTGLCFAIADALHVSGYITSFGSLEWAKTHDAETQTSPVVSALVDGGAVCVGKTVIDEMAYSIHGENKHFDTPTNPAAPDRVPGGCSSGSAVAVAGGMVDFALGIDSIGGVRIPGAYCGVLAFRPSHAVVSSGGIIPVAPSLDTIGWFARDPSVLRRVGHLLLRLNYADIRPPRHFYIADDCFELSKIPARRLTQVVSKSVEKLFGRQVTRMNLENYLSSKISSLRNYSNGHKNGDSRFPSLLALCNAMRSLHKHEFKDQHMEWINSVKPAVDARTVSNLSEDGDSDIDGYQDVRNKARLALGALLKDDGILVIPIALGCPPKLNAKELSSESYNCQTLCLSSLASMSGCCQVSIPLGTHDKCPVSVSFIARHGCDRFLLDTIQTMYATIQEQVDILAKSNVSSKQAMNEEAAETAKEKGNVAFKEKQWQMAVNFYTEAIKLNGKVATYYSNRAAAFLELTSYRQAEADCTSAIDLDPKIVKAYLRRGTAREMMGYYKEAVEDFNHALVLEPMNKTAGVAINRLKKLFP

SEQ ID NO: 7555 - DNA, 1928 bp, Panicum virgatum
  misc_feature: Ceres CLONE 1913116
  misc_feature: Encodes the peptide sequence at SEQ ID NO. 7556
cccggcgaccatttttcttcgattccagtcgacggtgtccgctccacgcccctcgcgcaaccgtcatctccatcctccgccctccgcttcctctccgctgcgccgccgccctgtgggtcgtcacccgccgccaccacgcccggccaacccgcgctcgccgacgccgtcacgccggcccgcgcgccccatcctgcgcctccccgtcgccccctctctcgcgattggacagggagcgagcactccgagggcgcgcgatccccgaggcacggggcgcggcctcgccgtcgcctgggtggccgcttcgagcccagtttccctccggcccggctcggattttgcgggatccggccaagaaatcccgcggttggtgagggggaggatagggaggggggaggggatatgggcgtcggtgcggagcccaaggaggacgcggcgggcactggttctgcggcggcggcggaggagggggcgagcggcaaggaggaaaaggcggccgcggtgtcctgctcgatctgcctcgacgcggtgctcgccgccgccggggagaggtccaccgccaggctgcagtgcggccacgagttccacctagactgcattggatcagcatttaatgccaaaggggttatgcaatgccccaattgccgcaaaattgagaaagggaattggctttatgcaaatggttcccgatctgcacatgatgtcaacatggacgagtgggctaatgatgaagacctttatgacgttagctactcagaaatgccatttcgcttccattggtgcccattcggtcgcttagcacaactcccatctttatttgaggaaggagaatcatcacctccagttacttttcatgacttcatgggacagcatgtgtttacggagcaagtagctgtatctgctgcaccagggacaactcatccttgcccgtatgtggcatacttgcatcctcttccaccactgacatcatcgtcaagctcccatgtccctgagagaacaatggatcgtcctgcataccatgatcattggaaccccctggctgggccatcagatgttaggcccatgcaaacagtgcaacctgctgatttccatcataaccattgggcgcatatgccccattcctatgctcagcccaacagcaataatgagcagccaggaatcccttttgggacaagggctgcacgggttgatggtgatagccagcgtcgagcatctgttgtttctccatcgtacttcagtaacgggtctggttctagatctagagctcccaatgttcctccattaatgccgcaatttatgagggctcatggcagcatcagcgaacagtatcagcagaattcatcatctagcctatttgctggggctcataggtccggaggcatgcgacctgccccagcacctctaccagagaaccccacattttccttgttcccaccgggttcatctggccataattcaatggagactgatgatgtgggaggaagccggttctatgcctgggagcgtgaccggttcgccccttacccattgatgccggtggactgcgagacgagctggtggacctcacagcagtcgcacagcacatcagagcccacatctgtgccaaggaggctatttgggcaatggcttggtgtcggcaggtcatcccctgaaaacagatcgcccgagggctcttcatatcggcaatttcactcacctcggatgtagaccctgctgcgagaatccaagttaatttggaatccgagttgcttgtaagaaacgatgggaaaacccattgtattaaattaagccggtctgcgccataaactttgtgactatttgaggggccagaaacaggaacggcccggctgagaggatttgatttggtttatgtgaattccatctcgtacatatttgaaatcaaattgggataaaaaaaaaaaaaaaaaaaa

SEQ ID NO: 7556 - protein, 434 aa, Panicum virgatum
  misc_feature: Ceres CLONE 1913116
  misc_feature (1)..(46): Pfam Name: zf-C3HC4 Pfam Description: Zinc finger, C3HC4 type (RING finger)
MGVGAEPKEDAAGTGSAAAAEEGASGKEEKAAAVSCSICLDAVLAAAGERSTARLQCGHEFHLDCIGSAFNAKGVMQCPNCRKIEKGNWLYANGSRSAHDVNMDEWANDEDLYDVSYSEMPFRFHWCPFGRLAQLPSLFEEGESSPPVTFHDFMGQHVFTEQVAVSAAPGTTHPCPYVAYLHPLPPLTSSSSSHVPERTMDRPAYHDHWNPLAGPSDVRPMQTVQPADFHHNHWAHMPHSYAQPNSNNEQPGIPFGTRAARVDGDSQRRASVVSPSYFSNGSGSRSRAPNVPPLMPQFMRAHGSISEQYQQNSSSSLFAGAHRSGGMRPAPAPLPENPTFSLFPPGSSGHNSMETDDVGGSRFYAWERDRFAPYPLMPVDCETSWWTSQQSHSTSEPTSVPRRLFGQWLGVGRSSPENRSPEGSSYRQFHSPRM

SEQ ID NO: 7557 - DNA, 1945 bp, Panicum virgatum
  misc_feature: Ceres CLONE 1913227
  misc_feature: Encodes the peptide sequence at SEQ ID NO. 7558
acaagaagatcgttctgatggcacaccctgctcttctcctggtgctcctcctcctcatctcttcccctgcgatttcttcctccaagagaatcctgcccaagttttcggccatcttctactttggcgactccgttcttgataccggcaacaacattcgtctccctacggtggccttggccaaccatgttccttacgggagggacttcccagggaagaagccgacagggaggttctccaatggccggctcgttccagacctcctcaaccagaggctgcagctcaaggaactctctccgccatacctggattcaaagctgtcgaacaacgacatgatgacaggggtcaactttgcgtctgcgggttcagggttcgatgaccagacgtcgcagctggccaataccctgccaatgttcgaagcagtcaagcaggtgaacctcttcaaggactacctcctccggctcaggaacattgttggagataaggacgcttccaggatcattgccaactccctgatttttatcagctcaggaaccaacgatttctcacattactaccgttcgtcaaagaagaaaaagatggacattggtgcataccaagatactgttatccagatggtacaagctcgtgtcaaggaactacatgaacttgggggccgacaattctccttggcaggccttcccccgtttggttgcacacctatccaaatcacattgagcagagaccctgacagggcatgtgtggatgagcaaaactgggatgctcagatctataactctaaacttcaagaattacttccagcattgcaaggctcactccatggaagcaaaattgtgtacttagatgcatacagggctctcatggagatccttgaggagcccgcgaaatatggatttacagaaacaacacgaggatgttgcgggactgggctcagagaggttgccctgctttgcaatgcattcactcctatctgcaagaatgtgtcgtcccatgtattttacgatgctgtgcacccaacagaaaggggcactaacgcccgggcgtcctggaggcttggacggtcgccgcgccgccctgtgacgccgctcagcccgccgccgacgccgtgccctcgcctggagggagacctggacggtcgccccgccgccctgtgacgccgctcagcccgccgccgacgccgtgccctcgcctggaggcctggacgctcgccccgccgccctgtgacgccgctcagcccgtcgccgacgccgtgccctcgcctggagacctggacgctcgccccgccgccctgtgatgccgctgagcccgtcgccgcgtccctccgggctcccggcggcctccaacccgcgcccctccctccgggctgctgcggccggcgtcgaggacggcgcctccctccaagctgctgccggcctccagaggagaaaagagcagcgccgcgtgaacactcggcgatcggccgccctccggtaccctccaccgtacgtcacctgccgtggcgacggggcctacagcgagcacgacgcgtacggcgtcggaggcaacgggcggcctggcgagcgccgcggggtcggaggagaggacggccgcgagcacggcgcggccggggtcggaggagaggtcggcggcgagcacggcgcggccggggtcggcggcgagcacggtgcggtcgggggttggaggagaggtcggcgtccaggagcttgaagaggaaggggatggagaggggggaggatgaggcggcggcgtgggcagagagcagatggagccggacggcgacgacggcctgcagcggaaccctaacttagatgaagatgaatataatcatctttttatttttctttagaataaatgaaatattcatctaactagaaattactatgatacccttgattgaaaaaaaataactacggaaaaggaattgccacgaaaaaaaaaaaaaaaaaaa

SEQ ID NO: 7558 - protein, 377 aa, Panicum virgatum
  misc_feature: Ceres CLONE 1913227
  misc_feature (1)..(301): Pfam Name: Lipase_GDSL Pfam Description: GDSL-like Lipase/Acylhydrolase
MAHPALLLVLLLLISSPAISSSKRILPKFSAIFYFGDSVLDTGNNIRLPTVALANHVPYGRDFPGKKPTGRFSNGRLVPDLLNQRLQLKELSPPYLDSKLSNNDMMTGVNFASAGSGFDDQTSQLANTLPMFEAVKQVNLFKDYLLRLRNIVGDKDASRIIANSLIFISSGTNDFSHYYRSSKKKKMDIGAYQDTVIQMVQARVKELHELGGRQFSLAGLPPFGCTPIQITLSRDPDRACVDEQNWDAQIYNSKLQELLPALQGSLHGSKIVYLDAYRALMEILEEPAKYGFTETTRGCCGTGLREVALLCNAFTPICKNVSSHVFYDAVHPTERGTNARASWRLGRSPRRPVTPLSPPPTPCPRLEGDLDGRPAAL

SEQ ID NO: 7559 - DNA, 1713 bp, Panicum virgatum
  misc_feature: Ceres CLONE 1913267
  misc_feature: Encodes the peptide sequence at SEQ ID NO. 7560
accaaacaaatgaacgctgtcaccagcagttgaacgccctttttccttcctccacttcccaccccaaatccgaaaccaccccggaatgacgagcgccgacccgaccgtcgtcttggttccagtctggggcatcggccacttcttgcccatgatcgaggccggcaagcggctgctcgcgcgcagcagccgccctctcacgctcaccgtgctcatcatgccggcgccgaccgagaagcgcgggtccgagatcgcccagcacatccgcgaggtggagacggagtccgccggcctcggcctcgccatccgcttccaccacctcccggcagccgagcgcccggctgtggcgacttacacgggccccgaggagttcatctccctcaacgtgcagccgtacgtgccccacgtgagggcggccgtgtccggcctggcgtgcccggtggccgcggtcgtggtggacatcttctgcacgccgcttctcgacgcggcgcacggcctcggggtgccggcctacgtgtacctcatctgcagcgcggccatgtgcgcgctcctgctgcgctccccggcactcgacgacgaggccgccggcgccggcgagttcgaggacatggacggcggcgcggtgcacctgccgggcctcccgccggtgcccgcgtcctgcctcccgtcgggactggtggacaggaaggtcccgacgtacaggtggttcctgtacaacggcaggcgctacacggaggccgccggcatcatcgtcaacaccgtcgccgagctggagccacacgtgctcgcggccatcgccgacggccggtgcacgcgcgggagccgcgctccgacggtgtacgccgtcgggccggtcctcgccgcgacgattactgctactactccgccggagcagcagcaggaacagccggagcacgagtgcgtgcggtggctccactcgcagccgccggcgtccgtgctgttcctctgcttcggaagcgcgcggttcttcaccgcgcagcaggcgcacgaggccgcgcacgccctggaccacagcggccaccgcttcctgtggatcctgcgcgggccgccggagcacggcacgaagctgtcctcggacggggacctcgccgagctactcccgccgggcttctcggagaggacgaagggcaggggcctcgtgtggcccaggtgggcgccgcagaaggagatcctggcgcacgccgccgtcggaggcttcgtcacgcactgcggctggaactcggtgctcgagagcctgtggttcggcgtgcccatgctgccgtggccgtgggccgccgagcagcactacaacgccttcacgctggtggccgccatgggggtcgccgtcgcgatggaggtgcgtaggaaggaggacaatttcgtggaggccgtggagctggagcgggcagtccgagctctcatgggaggcgccgaggggaggacggcgagggagaaggcgacggagatgaaggcggcttgccggatggccgtcgaggagggcggctcatcgtatcagtccttgcagaaactctgtgatgcactccatcaaggtgcagtgctcccaagaatgtttcctcaggatacatgaaaatagcgggaataatgtgattgatgagagtgttcctgtttcagttttatgtgcgtgtgtgtattttcccaacctactactctcaatcaaggctaccgaccttcacttaaaaaaaaaaaaaaaaaaaa

SEQ ID NO: 7560 - protein, 499 aa, Panicum virgatum
  misc_feature: Ceres CLONE 1913267
  misc_feature (2)..(151): Pfam Name: UDPGT Pfam Description: UDP-glucoronosyl and UDP-glucosyl transferase
MTSADPTVVLVPVWGIGHFLPMIEAGKRLLARSSRPLTLTVLIMPAPTEKRGSEIAQHIREVETESAGLGLAIRFHHLPAAERPAVATYTGPEEFISLNVQPYVPHVRAAVSGLACPVAAVVVDIFCTPLLDAAHGLGVPAYVYLICSAAMCALLLRSPALDDEAAGAGEFEDMDGGAVHLPGLPPVPASCLPSGLVDRKVPTYRWFLYNGRRYTEAAGIIVNTVAELEPHVLAAIADGRCTRGSRAPTVYAVGPVLAATITATTPPEQQQEQPEHECVRWLHSQPPASVLFLCFGSARFFTAQQAHEAAHALDHSGHRFLWILRGPPEHGTKLSSDGDLAELLPPGFSERTKGRGLVWPRWAPQKEILAHAAVGGFVTHCGWNSVLESLWFGVPMLPWPWAAEQHYNAFTLVAAMGVAVAMEVRRKEDNFVEAVELERAVRALMGGAEGRTAREKATEMKAACRMAVEEGGSSYQSLQKLCDALHQGAVLPRMFPQDT

SEQ ID NO: 7561 - DNA, 1168 bp, Panicum virgatum
  misc_feature: Ceres CLONE 1913328
  misc_feature: Encodes the peptide sequence at SEQ ID NO. 7562
acaaatcagctcaacgaccaaagagcgtctagccgcccgccgcccgccgcccgcgctcgcaaaggagaccaacagacagacaccgcgcggcgcgcagcatgcgtccagtagctcgccacgtcggcctcgcggcggccgcgctcctcgccgccgccctcctgctcggcggcgccgccagggcgcaggaggagacggagcacgaggaggagttcagctacgcccgcggcggcgagcacgggccggagcactggggcgagatcaagccggagtgggcggcgtgcggcgccgggcggatgcagtcgcccatcgacctctcccacgagcgcgtctcgctggtgcgctccctcggctacctcgaccacgcctaccgccccgcccaggcctccatcgtcaaccgcggccacgacatcatggtgaggttcgaggacgacgccggcggcctggtgatcaacggcacggcgtaccagctgaagcagctgcactggcactcgcccaccgagcacaccgtcgacggccgccgctacgacctggagctgcacctggtgcacgagagcgccgagggcaaggccgccgtgatcggcatcctctacgaggccggcggccgccgcgacccgctcctccaccagatggagccgttcatcaggcggatcgccgacaagcgggaccgggaggagcgcgtcggcgtggtggacccccgcgccgtgcgcggcagggccagcgtgtactaccggtacatgggctccctcaccgtgccgccctgcaccgagggggtcatctggaccatcctcaagagggttcagaccgtgtccaagtaccaactggagcttctcagggaagccgtgcacgatgacatggagaagaacgcgaggccactccaggaggtcaacagcagagacgtcagcatcttccggcctagcgcccgtaaacactagtaggcccttggtagtgatgtgcgggctgacgtggatgcgccagtagtaatgtactgtagttcagagtagtgtggctgatgaatattatttgtaattctttctatttatgtgcctttattcgttacatgcgtaaatagtgaaggcattatcacttcatgtcaaagttgatgtccatgttataaccagtaggggactcaccactcctgttccatcaacaaaaaaaaaaaaaaaaaaaa

SEQ ID NO: 7562 - protein, 277 aa, Panicum virgatum
  misc_feature: Ceres CLONE 1913328
  misc_feature (2)..(228): Pfam Name: Carb_anhydrase Pfam Description: Eukaryotic-type carbonic anhydrase
MRPVARHVGLAAAALLAAALLLGGAARAQEETEHEEEFSYARGGEHGPEHWGEIKPEWAACGAGRMQSPIDLSHERVSLVRSLGYLDHAYRPAQASIVNRGHDIMVRFEDDAGGLVINGTAYQLKQLHWHSPTEHTVDGRRYDLELHLVHESAEGKAAVIGILYEAGGRRDPLLHQMEPFIRRIADKRDREERVGVVDPRAVRGRASVYYRYMGSLTVPPCTEGVIWTILKRVQTVSKYQLELLREAVHDDMEKNARPLQEVNSRDVSIFRPSARKH

SEQ ID NO: 7563 - DNA, 1140 bp, Panicum virgatum
  misc_feature: Ceres CLONE 1913414
  misc_feature: Encodes the peptide sequence at SEQ ID NO. 7564
cagttcgcagcaggagcagcccccttccagttccagcgtcgaccggccaccgatcccctcttcctccgcgcctcgccgccggccgccgcttccttccccgcggcacaatcgcgcccaaggagcggcagcgcccggctagctcctcatcgcgcccccgccaaatgggcgcccgcggccgcgacctcaccgctctcctcgccatccgccgcagcggcagccgcctgttcaagcggtaggcccgccgcctgcgcgtcgaggtggccggcgggtggggacaggggacgaggggaggtggggggaaactcggatcgcaaccacagcagcagccatgttggggtcggggctcaacctggtcagcgcggcgctcggcttcggcatgaccgcggccttcatcgcgttcgtctgcgcgaggttcgcctgctgccgcgcccgcggcgatgactccggaccgccgccgtcgctggacttctccgcggatctcgacggcgcggcagagcatactcgttctgggttggaacctttggttattgctgcaattcctacaatgaagtataactgtgaggccttttgttccgaagatgatgctcagtgctccatatgtttaggtgaatacaaggagaaagatgttcttagaatcataccgacatgtcgccacaactttcaccttgcctgcttagatttatggttgcagaagcagacgacttgcccgatatgtcgggtctcactgaaagagctgcagggtgccatgacttctgcatgtagcatccagcaactcaccaccgtcccagagaattctgttgacccaaccgctcagtgtgtccttcctgtttgtcaagatcagaggggtcaaagcaatagccaggagaggaacgaatcagtagaagtggttattgaaattcgacagtgaattgaacatagacatgactgtaggagcgaagtgatggagttctgtagagctgttgataatcttgtccaccgcaacatcacgatgtttgatctcaaaattcagatgaagcatctttagtacatttcattccatgtggtaggtcggaatgttgtaatgagaccgaattttcttcagtgtcaaagctgcaaaaaaatatcctaccttgtggttcccaaaaaaaaaaaaaaaaaaaa

SEQ ID NO: 7564 - protein, 192 aa, Panicum virgatum
  misc_feature: Ceres CLONE 1913414
  misc_feature (1)..(42): Pfam Name: zf-C3HC4 Pfam Description: Zinc finger, C3HC4 type (RING finger)
MLGSGLNLVSAALGFGMTAAFIAFVCARFACCRARGDDSGPPPSLDFSADLDGAAEHTRSGLEPLVIAAIPTMKYNCEAFCSEDDAQCSICLGEYKEKDVLRIIPTCRHNFHLACLDLWLQKQTTCPICRVSLKELQGAMTSACSIQQLTTVPENSVDPTAQCVLPVCQDQRGQSNSQERNESVEVVIEIRQ

SEQ ID NO: 7565 - DNA, 1219 bp, Panicum virgatum
  misc_feature: Ceres CLONE 1913430
  misc_feature: Encodes the peptide sequence at SEQ ID NO. 7566
ctccagccaccgatcgtgacgtcccaatcgagcggagcaatcagtaatcacgccacaatctcacacaccgccattgcccgcggcggcagcagcagcagcgcgatgggagtggagtcggaatgcgacaggataaagggcccctggagccccgaggaggacgaggcgctgcggcggctcgtggagcggcacggcgcgcggaactggacggcgatcgggcggggcatccccggccggtcgggcaagtcgtgccggctgcggtggtgcaaccagctgtcgccgcaggtggagcggcggcccttcacgcccgaggaggacacggcgatcctggccgcgcacgcgcggctcggcaaccggtgggccgccatcgcgcgcctgctccccggccgcaccgacaacgccgtgaagaaccactggaactcatcgctcaagcggaagctcgccaccgcggcggcgccggaggccgccgactccgagcggccgtgcaagcgcgcgagccccgggccggggagcccgacggggtcggagcgcagcgagctcggccacggctccggcgtcggcggcgcgcaggtgttccgccccgtcccgcgcgcgggcgggttcgacgccatcggcgccgcggacgcgcgccctccgccgccgcgggacgaggacccgatcacctcgctctccctctcgctgccggggctagaccaggcgtcctcggggttccgccacgacagcgcccggagccacttccaggagctctccccctcgcgctccccgtcgcccccgtccccgccctcctcgtcctcctcctccaccaccggcccctacccgttcagcggcgagctggtggcggcgatgcaggagatgatccgcgcggaggtgcgcaagtacatgtccggcgcggggctccgcgccgggtgcgtcgccggtgccttgggcgaggcgtgcatgccgcagctcgtggagggcgtgatgcgcgccgccgcggagcgcgtcggcgccgtcgtcaccagccggccgtagggaaccgagaccaaatcagatcgaatcaatgcgaagcattgtgttaattaagatccgatccggtgtagccctgcagtactagtactagactactgccactactattaggccttctccaatggtcgactctctaatggtcgactctttgctagatcttaaattgtttaatcgatgaacagtgctaaaatagcaaaaaaaaaaaaaaaaaaaa

SEQ ID NO: 7566 - protein, 301 aa, Panicum virgatum
  misc_feature: Ceres CLONE 1913430
  misc_feature (1)..(47): Pfam Name: Myb_DNA-binding Pfam Description: Myb-like DNA-binding domain
  misc_feature: The sequence is a functional homolog of  SEQ ID NO 128 in the  11/375,241 US patent application
  misc_feature: The sequence is a functional homolog of  SEQ ID NO 166 in the  10/412,699 US patent application
  misc_feature: The sequence is a functional homolog of  SEQ ID NO 1942 in the  10/374,780 US patent application
  misc_feature: The sequence is a functional homolog of  SEQ ID NO 2272 in the  10/374,780 US patent application
  misc_feature: The sequence is a functional homolog of  SEQ ID NO 373 in the  11/479,226 US patent application
  misc_feature: The sequence is a functional homolog of  SEQ ID NO 914 in the  11/435,388 US patent application
  misc_feature: Useful for making plants with modulated growth and phenotype characteristics
MGVESECDRIKGPWSPEEDEALRRLVERHGARNWTAIGRGIPGRSGKSCRLRWCNQLSPQVERRPFTPEEDTAILAAHARLGNRWAAIARLLPGRTDNAVKNHWNSSLKRKLATAAAPEAADSERPCKRASPGPGSPTGSERSELGHGSGVGGAQVFRPVPRAGGFDAIGAADARPPPPRDEDPITSLSLSLPGLDQASSGFRHDSARSHFQELSPSRSPSPPSPPSSSSSSTTGPYPFSGELVAAMQEMIRAEVRKYMSGAGLRAGCVAGALGEACMPQLVEGVMRAAAERVGAVVTSRP

SEQ ID NO: 7567 - DNA, 1416 bp, Panicum virgatum
  misc_feature: Ceres CLONE 1913432
  misc_feature: Encodes the peptide sequence at SEQ ID NO. 7568
atcttcttcaacctctagctagctgttcgatcgatcgatctctgctactcaccaatcaccatctcgcagaggggacgatggtgagcaacgacgccgacacggccgctcccaagcagcaggcgtcgtccatggcccccaaccccggcaaggccacgatcctcgccctcggccacgccttcccgcagcagctcgtcatgcaggactacgtcgtcgacggcttcatgaagagcaccaactgcgacgacccggagctcaaggagaagctcaccaggctctgcaagacgacgacggtgaagacaaggtacgtggtgatgtcggaggagatcctgcggagctacccggagctgacgcaggagggctcgccgacgatgaagcagcgcctcgacatctccaacaaggcggtgacgcagatggcgacggaggcgtcgctcgcctgcgtccgcgcctggggcggcgcgctctccgccgtcacccacctcgtctacgtctcctccagcgaggcccggttccccggcggcgacctgcacctggcgcgcgccctcgggctcagccccgacgtccgccgcgtcatgctcgccttcaccggctgctccggcggcgtggcggggctccgcgtcgccaagggcctcgccgagagctgccccggcgcgcgcgtcctgctcgccacctccgagaccaccatcgtcggcttccgcccgcccagccccgaccgcccctacgacctcgtcggcgtcgccctcttcggcgacggcgccggcgccgccctcgtcggcgccgaccctgcccccgccgagcgcccgctcttcgagctccacgcggcactgcagcgcttcctcccgggcacggacaagaccatcgagggccgcctcacggaggagggcatcaagttccagctgggccgggagctgccccatctcatcgaggcgcacgtcgaggacttctgccggaagctcatggcggagcgggagggcctcgccgccggcgaggcgatggggtacgacgacatgttctgggcggtgcaccccggcggcccggcgatcctgaccaagatggagggccggctcggcctcgccggcgacaagctccgcgccagccgctgcgcgctccgcgacttcgggaacgccagcagcaacaccatcgtctacgtgctggagaacatggtggaggagacccggcggcgcaaggcggcggcggcgaaggaggccggcgacggggaggactgcgagtgggggctcatcctggccttcggccccgggatcaccttcgagggcatcttggccaggaacctgctggcaaccgcgcgcccctgaactgaactgaactggtgttggtgttcacagcattgtcatttctttacaagatcagggaaataactgaggctccaagaattcctcccaaaaaaaaaaaaaaaaaaaa

SEQ ID NO: 7568 - protein, 410 aa, Panicum virgatum
  misc_feature: Ceres CLONE 1913432
  misc_feature (4)..(226): Pfam Name: Chal_sti_synt_N Pfam Description: Chalcone and stilbene synthases, N-terminal domain
MVSNDADTAAPKQQASSMAPNPGKATILALGHAFPQQLVMQDYVVDGFMKSTNCDDPELKEKLTRLCKTTTVKTRYVVMSEEILRSYPELTQEGSPTMKQRLDISNKAVTQMATEASLACVRAWGGALSAVTHLVYVSSSEARFPGGDLHLARALGLSPDVRRVMLAFTGCSGGVAGLRVAKGLAESCPGARVLLATSETTIVGFRPPSPDRPYDLVGVALFGDGAGAALVGADPAPAERPLFELHAALQRFLPGTDKTIEGRLTEEGIKFQLGRELPHLIEAHVEDFCRKLMAEREGLAAGEAMGYDDMFWAVHPGGPAILTKMEGRLGLAGDKLRASRCALRDFGNASSNTIVYVLENMVEETRRRKAAAAKEAGDGEDCEWGLILAFGPGITFEGILARNLLATARP

SEQ ID NO: 7569 - DNA, 1600 bp, Panicum virgatum
  misc_feature: Ceres CLONE 1913465
  misc_feature: Encodes the peptide sequence at SEQ ID NO. 7570
gatgccgtcgcgcacctcctctccctcgccccccacacgcttccctctccgccccgcaccgtggcgcctccccccgccgccgcgatgccgctcgcggcagaacccgacgaggcgcttgaggaaggggggaatcagcagcagctgctggtggcgacgaagggcgggcccgcgctcgaggggctggtggtggggagctactgccacgacgtgctgatccggggcgggcgcgtggtgggggagacgctcggcggggctgccgccttcgtctccaacgtgctcgatgccgcgtcgcctcgggaggaggaggagctggaggcggccccgttcgtcgtggtttccaaggtggggcgcgacttcgcctacgcctccgcgccggcgcccgctcggcgcccgccgctgctctgcgcgtcgccgaccacgtccttccacgcgcagttctccgaggccgccgcctcggcgcacgcccccgaccgggagctccggcgcgtgcgcgcctgcgacccgatctaccccgccgacctccccgatcgccgcttcgcctacggcctcgccgtcggcgtcgccggggaggtgctaccggagacgctcgagcggatgatccggctctgccgcgcagtgctcgtggacgcgcaggcgctgatccgggcgttcgacgccgacggcgccgtctgccacgtgtcgcttgaagatactccgtacgcgcggcttctcccccgggtggcgttcctcaaggcgtcgtcggaggaggcgccctacgtgggggtggagacggcgaggcggcggtgctgcgtgatcgtgacggaggggagggacgggtgccggctgttctgggacggaggggaggcgcgcgtcgcaccgttccccgccgtccaggtggaccccaccggcgccggagacagctttctggctggttttgcggccgggctgttgtggggactttctgcaacggacgcggcgctgctggggaacttttttggtgctgccgcggtctcgcaggtcggcgtgcccaccttccatcccaagatgttgcaggctgttaaagaaatacttgaagataagacaacaaaacgatcaagtccatgtataaatggaaccacttttaccttggaaaggtcaaatatgcacgatgagttacacacggctctccaagaaacagcgaggctgatgtctgaacagcagcaagctgatccagcaaacggcaatggtggtgatatttgctcgacctaggaactgagttcatcaggaggcagttagacgccaaactgtggcagaataacgcagcactacaatccagatttcacattgaggtctgtgtaaacacctagccaacaagagaagaaagtctgtgcatacgagatgtgccagtttatactgccatccagatgacgagggttcggttctgcctgtaatagctgatgagaaaaatgaagccaaccgatcagctgggctgtgtcctgctgtgtacgctgaacgagtgtgctcttttgagctttcgaacattcgtgcggttacattgactcttaccgcattttaccctgcctgaaggctacgaaatttgtctgactgaactgagaacggcaaaaaaaaaaaaaaaaaaaaa

SEQ ID NO: 7570 - protein, 380 aa, Panicum virgatum
  misc_feature: Ceres CLONE 1913465
  misc_feature (1)..(79): Pfam Name: PfkB Pfam Description: pfkB family carbohydrate kinase
MPLAAEPDEALEEGGNQQQLLVATKGGPALEGLVVGSYCHDVLIRGGRVVGETLGGAAAFVSNVLDAASPREEEELEAAPFVVVSKVGRDFAYASAPAPARRPPLLCASPTTSFHAQFSEAAASAHAPDRELRRVRACDPIYPADLPDRRFAYGLAVGVAGEVLPETLERMIRLCRAVLVDAQALIRAFDADGAVCHVSLEDTPYARLLPRVAFLKASSEEAPYVGVETARRRCCVIVTEGRDGCRLFWDGGEARVAPFPAVQVDPTGAGDSFLAGFAAGLLWGLSATDAALLGNFFGAAAVSQVGVPTFHPKMLQAVKEILEDKTTKRSSPCINGTTFTLERSNMHDELHTALQETARLMSEQQQADPANGNGGDICST

SEQ ID NO: 7571 - DNA, 1417 bp, Panicum virgatum
  misc_feature: Ceres CLONE 1913494
  misc_feature: Encodes the peptide sequence at SEQ ID NO. 7572
gtaatctgctcggtctctgttcccctccccctatctccctttccttctctgccactgccgccgcctctcgccgcgtcgccggcggcggacgacgcggaggctcattccgccgattttccagtcgagcggcggcggcggcgtaaccctcctgctcatccccgccggccctccgttctccaacgcccgtcatcggccgcgcagatccgtgcgtcccgacttggatcgacttcgtcgtctgtgcggcgggcgcggcttactctcctcaatttctgggcgttgcaggatccaagcagccatggatgagtggattcgccaggccgagttgtgggggcgccaggcggaggcctggatccgtcagcagcccccggagcagatctacgtcgcggccgcggtggtcgccctcacagtcctggtgcttatcgcagcatcttgtctgaaatcctcgaaaccgaacaccatagtgctatctgggcttagtagcagtggcaaaactactcttttctaccagcttcgggatggatcatcacatcaaggaactgtgacttcaatggaagaaaacaatgatacatttgttctgcattcggagaaagaaaggaaaggcaaagtaaaacctgtgcatattattgatgttcctggtcatccaaggctcaaacccaagcttgatgaagtcctgcctaaagcagctggggttgttttagttgttgatgctcaagatttcttgtccagcatgcaagctgcagcagagtatctgtatgacattctgacaaaggcaagtgtagtgaagaaaagggttcctgtgcttatattctgcaacaagactgataaagttacagcccattcgaaggaattcatcaagaagcagttggaaaaagaaataaacaagctccgcgaatcaaggaaggccatttcatcagctgacatctctgatgaggtccagcttggtgtccctggagaggcattcaacttcaaccagtgccagaacaaggtgacggtcgcagaaggcgctggcttgaccggcaatgtttcggctgtcgagcaattcatccgtgactatgtggaggcgtagatcctaattggctcacaggaagacggcaagactcaaagacatccattgcgccaatctggagttcctgcatatacctacctttatctggtttgctgacctttttagagaatcttagcattgcattgctaacacctgacagttaatgggtatgagtgtacacagcgtgttaattaagaactatacctggctgtatggttcttctttttcactatccaactttgatacttccttggtactgttttgttgcagctggaattacactgagggtatgcaattttttagctacaaaaagtttgtgttatgcaatgtgttggtgtcttggtttggatccaaaaaaaaaaaaaaaaaaaa

SEQ ID NO: 7572 - protein, 256 aa, Panicum virgatum
  misc_feature: Ceres CLONE 1913494
  misc_feature: Great-hit functional homolog of the protein sequence given in SEQ ID NO 9268
  misc_feature: Useful for making plants with modulated cold sensitivity
MDEWIRQAELWGRQAEAWIRQQPPEQIYVAAAVVALTVLVLIAASCLKSSKPNTIVLSGLSSSGKTTLFYQLRDGSSHQGTVTSMEENNDTFVLHSEKERKGKVKPVHIIDVPGHPRLKPKLDEVLPKAAGVVLVVDAQDFLSSMQAAAEYLYDILTKASVVKKRVPVLIFCNKTDKVTAHSKEFIKKQLEKEINKLRESRKAISSADISDEVQLGVPGEAFNFNQCQNKVTVAEGAGLTGNVSAVEQFIRDYVEA

SEQ ID NO: 7573 - DNA, 1263 bp, Panicum virgatum
  misc_feature: Ceres CLONE 1913522
  misc_feature: Encodes the peptide sequence at SEQ ID NO. 7574
gacgtgtcaccatcaggaggctttccctccattccaccccaaacccgcggacctccggtctcgcctccgcggctccgcgccccttcctcctccacgccctaaccctaagctacccccctcgtcgccggcgatgagcagcctccgagccatctcctccctcctctacatctattcctcatccgccgccgcagggcgaggcgcctggcagctggggttcgcaccggcgctcggcgggagcttccggatcccgtcgagttcggggccgcccgcgttcgtgctcgatgaggtcgcgagggcggccggcggggcgcggaggagggcatccacgcgcgcggcaagctgggattcggagaagtcgccgtacgagacgcttgagttgggcagggatgcagacgaggagaccataaagacagcatacagaaaattggctaagttctatcaccctgatgtttatgatggcaagggaacccttgaggaaggggaaactgctgaagcccgtttcatcaaaatccaagcagcatatgagctgttgattgataatgaaaggagaaaggcatatgatagtgagcatcatgtgaatccaatgaaggcttctcaggcatggatggagtgggtaatgaagaagcgaaaagcttttgaccaacgtggtgacatggctgtggctgcctgggctgagcagcagcaacgcgaaatgacactacgggcacggcgtctctcacgctcaaaggttgatcctgaagaggaaaggaagctatttgcaaaggaaaagaagacatctatggaattctacagcacaactctgaagagacatacccttgtcttgcggaagagggatattatgcgcaagaaggcggaggaagacaggaacaaggagatcagtagacttctagcggcggaagggcttgagctggatacagatgaagatgaagacaaaacctttttagggtaacacttttgatacttacccctgatttattgctgtcctccattccatcaacagttgaagatccagtcacaatgatacacaaggcagaagaattggcctcatgggaaaccctaaagcctggagatttacatggagaaatgttgtatcagaatataaccctctcggtgcgaagtttagtatttacgtggggaatagtaacatccaccggacgctagagctgtagtagggctgtacaagcaaactcttgtaaatgcaaactatcttgaaatgtaaacttcatgggatggattgaaatcgaaaaaaaaaaaaaaaaaaaa

SEQ ID NO: 7574 - protein, 272 aa, Panicum virgatum
  misc_feature: Ceres CLONE 1913522
  misc_feature (1)..(69): Pfam Name: DnaJ Pfam Description: DnaJ domain
MSSLRAISSLLYIYSSSAAAGRGAWQLGFAPALGGSFRIPSSSGPPAFVLDEVARAAGGARRRASTRAASWDSEKSPYETLELGRDADEETIKTAYRKLAKFYHPDVYDGKGTLEEGETAEARFIKIQAAYELLIDNERRKAYDSEHHVNPMKASQAWMEWVMKKRKAFDQRGDMAVAAWAEQQQREMTLRARRLSRSKVDPEEERKLFAKEKKTSMEFYSTTLKRHTLVLRKRDIMRKKAEEDRNKEISRLLAAEGLELDTDEDEDKTFLG

SEQ ID NO: 7575 - DNA, 1697 bp, Panicum virgatum
  misc_feature: Ceres CLONE 1913577
  misc_feature: Encodes the peptide sequence at SEQ ID NO. 7576
atgggcacatgacagtgggttccgccttcaactaacgctccggttcgtctccccacctcgcgccgccgccgccgcgcgggtcgccggattccgccgccccctcgttctcctcgccccttccgagtcctgactcccgagagttagttcatttcttcgggggacgaatcccccgcgggtcatggcgtcactggcttccccctccttctccatccacaccgtcccggggcgggcgcgccttgctgctgccgcgggggcgccaccgcggcggcggagattggctgtggtgcgggcgaaggtgcgggagatattcatgccggcgctgagctcaacgatgacggaggggaagattgtctcctggaccgccgccgagggggaccgcgtcgccaagggcgaccccgtggtggtcgtcgagtcagacaaggccgacatggacgtggagacgttccacgacggaatcgtcgcagccgtcctcgtcccggccggcgggaccgcgcccgtgggcgcccccatcgccctcctcgccgagtccgaggaggaggtcgcgctggcgcgggcgcgcgcacagtccctctcccagggacagagccaggaacagccctctccccatgccaccgcagccgccgccaccccggcaccacctcctccagcgacaaaaggcgttgcgacgccttatgccaagaagctcgcgaagcagcacagggtggacatcgccggggttgtcggcacggggccacacgggcgcgtcacggcggctaacgttcaggcagctgctggcatcaaaccgaagccaaaggtcactccacctccaccccctgccgccgttcgccctgcacctccgatggcctcgggtgcagtgctgccaccactgcccggtggcagggtggtgccgttcacaacaatgcaggcggcggtgagcaggaacatggtggagagcttgtcagtgccaacgttccgggttggctactccatgatcactgataagctcgatgcactttatgaaaaggttaagtcgaagggggttacaaagacagtgctgctggtgaaggcagcagccatggccctaacccagcaccctgttgtaaatgctagctgcagagatggaaagagcttcagctacaacactaatgtgaacattggagtggctgttgcacttgagggtggtcttcttacgcctgtcctggatgatgctgataagttggatatatatctgcttgcacaaaagtggagagttctgctcaagaaggcacgcaccaagcagctacaaccaaatgaatataactcagggacatttacactgtccaatttgggtatgtttggggtggatagatttgatgcaatccttccagctggtcagggagctatcatggctgttggagcatcaaaacctactgtggtggctgataaggatagttttttcagtatcaagagtgaaatgctggtgaatgttactgctgatcacagaattatctacggtgctgatttggcagcattcctgcagacgtttgcaaagattgttgaggatcctgcaagcctcacattgtaaagatagttccatatgatggttctatgatttctttgattcctaattgggagacattgccaataaataataatgctatatagagtttgtaaagggattaacagaagaataatgagccacttcttaattttgctcccaaaaaaaaaaaaaaaaaaaa

SEQ ID NO: 7576 - protein, 454 aa, Panicum virgatum
  misc_feature: Ceres CLONE 1913577
  misc_feature (1)..(225): Pfam Name: 2-oxoacid_dh Pfam Description: 2- oxoacid dehydrogenases acyltransferase (catalytic domain)
MASLASPSFSIHTVPGRARLAAAAGAPPRRRRLAVVRAKVREIFMPALSSTMTEGKIVSWTAAEGDRVAKGDPVVVVESDKADMDVETFHDGIVAAVLVPAGGTAPVGAPIALLAESEEEVALARARAQSLSQGQSQEQPSPHATAAAATPAPPPPATKGVATPYAKKLAKQHRVDIAGVVGTGPHGRVTAANVQAAAGIKPKPKVTPPPPPAAVRPAPPMASGAVLPPLPGGRVVPFTTMQAAVSRNMVESLSVPTFRVGYSMITDKLDALYEKVKSKGVTKTVLLVKAAAMALTQHPVVNASCRDGKSFSYNTNVNIGVAVALEGGLLTPVLDDADKLDIYLLAQKWRVLLKKARTKQLQPNEYNSGTFTLSNLGMFGVDRFDAILPAGQGAIMAVGASKPTVVADKDSFFSIKSEMLVNVTADHRIIYGADLAAFLQTFAKIVEDPASLTL

SEQ ID NO: 7577 - DNA, 1751 bp, Panicum virgatum
  misc_feature: Ceres CLONE 1913701
  misc_feature: Encodes the peptide sequence at SEQ ID NO. 7578
tttccattgctctcctcgacctctccaccaatccccacctcgtccaagcgccgccccatcaccgccgcacgcgaagatgctcgacatcaacctcttccgcaccgacaagggcggcaacccggacatcatccgcgagtcccagcgcagccggttcgcgcccgtcgagctcgtcgacgaggtcatcgccctcgacaaggcatggcgcgaaaggcagttcgagctggacaagatacgccaggagctcaacgccaccagcaagaagatcggcaagctcaaggctagcaagcaagaagaggaagcaaagaagctgatggagagcacggacgagattaagaagaggctggctgccaaggaagctgaggtgcaggaggctaagagcaccctcgacgccaagctcaccacgattggcaacatcgtgcatgcgtccgtgcccatcagcgacgacgaggcaaataatgccattgtacggacatggggagagaagagactggaggaaaatttgaagaatcacgtggatctttgcaggatgcttgacattgttgcattggagaagggtgctgacgtggctggtggtaggggttactatttgaaggatgaaggtgtcctcctgaacctggcattgataaatttcgggctagctttcctgagaaaacggggctttaagccaatgcaaactccttttttcatgaaaaaggaaactatgggaaaatgtgcccagctggcacagttcgatgaggagctttacaaggtaacaggtgacggtgaggataaatacctcatagccacatctgaacagccattgtgtgcttatcatttaggtgaccgaatttaccctgctgagcttccaataaaatatgctggttactctacctgcttccgaaaagaagctggttcgcatggaagggacacagctggcatcttcagagtccaccaatttgaaaagattgaacagttctgtgttacaagcccaaatggcaatgattcttgggaggtgcatgaagagatgttaaaaaattcagaagatttctatcaggagattggcctaccatatcaggttgtctccattgtctctggtgcacttaatgattctgcagctaaaaaatatgatttagaagcatggttccctgcatcgaaaacctttagagaattggtgtcctgttcaaattgcactgactttcaagcgaggaggcttggaattggttatggacagaaaaagaatgacgagcagtccaagcagtttgttcatatgctcaattctacgttgactgccactgagaggacactgtgttgtattctggaaaacttccagaaggaggatggtgttgaagtgccaaaggcgctgcaaccgtacatgggtggaatagatttccttcctttcaagcaacctctggatgtcaaacaagctgctgactcgaaatcaaacaagtccaaatctaagggaaatgctgcttgaggtggatgaggaacaagtcaaatgcatgcgatgcggaagtgatggacattgtgcatccttgtattaatttttggggagtaacagtacttatagcatgaccatgacgttgcaatttttctgtacccattttggtttcttggtttaccacactatctgattgcgtacttgcacactgatattgcatagggtttcttgcaatctataatgtttgagcaccatcatccctctctgctgttgctgtgcctctagaggcactgttattggtgtttgctgtctagaaaaaaaaaaaaaaaaaaaa

SEQ ID NO: 7578 - protein, 458 aa, Panicum virgatum
  misc_feature: Ceres CLONE 1913701
  misc_feature (1)..(434): SWISSPROT Homolog: EC 6.1.1.11 Seryl-tRNA synthetase
  misc_feature (1)..(453): SWISSPROT Homolog: EC 6.1.1.11 Seryl-tRNA synthetase
MLDINLFRTDKGGNPDIIRESQRSRFAPVELVDEVIALDKAWRERQFELDKIRQELNATSKKIGKLKASKQEEEAKKLMESTDEIKKRLAAKEAEVQEAKSTLDAKLTTIGNIVHASVPISDDEANNAIVRTWGEKRLEENLKNHVDLCRMLDIVALEKGADVAGGRGYYLKDEGVLLNLALINFGLAFLRKRGFKPMQTPFFMKKETMGKCAQLAQFDEELYKVTGDGEDKYLIATSEQPLCAYHLGDRIYPAELPIKYAGYSTCFRKEAGSHGRDTAGIFRVHQFEKIEQFCVTSPNGNDSWEVHEEMLKNSEDFYQEIGLPYQVVSIVSGALNDSAAKKYDLEAWFPASKTFRELVSCSNCTDFQARRLGIGYGQKKNDEQSKQFVHMLNSTLTATERTLCCILENFQKEDGVEVPKALQPYMGGIDFLPFKQPLDVKQAADSKSNKSKSKGNAA

SEQ ID NO: 7579 - DNA, 1451 bp, Panicum virgatum
  misc_feature: Ceres CLONE 1913724
  misc_feature: Encodes the peptide sequence at SEQ ID NO. 7580
atatagcggccggccttctcgtcaggtcaagcagttccgcactggtccggtagctcacctacagcaaatctgcagcagcagcctgcgccgttgcactgtgcaaaatttactctgctgcctgcaggctgcagcctcccttcttcctcatcctcttccgtttcttcttcgtccgatccctcgcgatggcgatgcgggcggaggtgctgttgctcgccgtggtcgtggcggccgcggccctcctgtcgtcgctcgactcgcgcagcgacgtgcggctgctggagataggggacggcgacctcgagctggtcccgctcgacggcgccgcggggccggagagcgtcgtcttcgacaggggcggcgaggggccgtacgcgggcgtgtcggacggaagagtcctcaggtggcggccggaggagcggcggtgggaggagcactcctgctcggcgccggagctgttggacagctgcagaggctcgcagaacccgggccgggaggacgagtgcgggcgtccactgggcctcaagttccacgacgagacgggggagctgtacgtcgcggacgcctaccacgggctcagagtggttgggccggaggagaacgtgtcccggccgctgctgccgccggagtggcaaggcagccgccccttcagcttcgccaacggcatcgagatcgactacgaaaccggagccatctacttcaccgagaccagtacaaggttccggagaagggagtttctgaacattgttatatccggcgacaataccggtagattgttgaaatatgaccccaagagcaacgaagtggaagtcttggttgatggtctatcttttgccaatggcttggctatgagcacggatgacacttaccttctccttgcagaaaccacaactggcaaaattctaaggtactggatcaagacaccaaaagcttcaaccctagaagaagttgcccagctaccttggtttccggataacatcaagatgagccctagaggagggttctgggttggtctccatgcaaagagagggaagatcgccgagtggtcgatctcgtacccttggctaaggagattgatattgaagctgccgatgcggcatgtccaacgtgcatcctggcttttgaatcggcttggccgtcaggttatagcgttgaggttgaatgaggatgggaaaacaatggaggcaattagtgttcacggtgctatccaaaaggttttcaaatcggttagcgaggtggaagaaagggatgggagcctgtggataggctctgttatggccccatttcttggagtttacaggttgtagaagtatttaaatggtatggttgaatatacatctgcatatatatggtagtcgtttaatagaggaaaataacattatacgcgtgtatatggtaccatttgctctataatatagtgaagattattatctgaaaaaaaaaaaaaaaaaaaa

SEQ ID NO: 7580 - protein, 373 aa, Panicum virgatum
  misc_feature: Ceres CLONE 1913724
  misc_feature (1)..(89): Pfam Name: Str_synth Pfam Description: Strictosidine synthase
MAMRAEVLLLAVVVAAAALLSSLDSRSDVRLLEIGDGDLELVPLDGAAGPESVVFDRGGEGPYAGVSDGRVLRWRPEERRWEEHSCSAPELLDSCRGSQNPGREDECGRPLGLKFHDETGELYVADAYHGLRVVGPEENVSRPLLPPEWQGSRPFSFANGIEIDYETGAIYFTETSTRFRRREFLNIVISGDNTGRLLKYDPKSNEVEVLVDGLSFANGLAMSTDDTYLLLAETTTGKILRYWIKTPKASTLEEVAQLPWFPDNIKMSPRGGFWVGLHAKRGKIAEWSISYPWLRRLILKLPMRHVQRASWLLNRLGRQVIALRLNEDGKTMEAISVHGAIQKVFKSVSEVEERDGSLWIGSVMAPFLGVYRL

SEQ ID NO: 7581 - DNA, 2027 bp, Panicum virgatum
  misc_feature: Ceres CLONE 1913749
  misc_feature: Encodes the peptide sequence at SEQ ID NO. 7582
acagctactcagctacctcctcttctcttctcttctgagctctccacagctcgcgcgcgcgcgcaccgtctgtttcccgggctcactctcgtgtccagtccagcgcgtgcgcgtgcgcgagccgccgcccccagtttcgaaccgacacagaaaagcgcgggcaccgaagccgacagggcgagagagctagtggcaagatggtgagcatggtcgccgacgacgagaagccgcagctgctgtccaagaaggccgcgtgcaacagccacggccaggactcgtcctacttcctggggtgggaggagtacgagaagaacccctacgaccccgtcgccaaccccggcggcatcatccagatgggcctcgccgagaaccagctctcgttcgacctcctcgaggcttggctggaggacaacccggacgcgctcggcctccgccgcggcggcgcctccgtcttccgcgagctcgcgctcttccaggactaccacggcatgccggccttcaagaatgcattggcgcggttcatgtccgagcagcgaggcttcagggtggccttcgaccccagcaacatcgtgctcaccgccggcgccacctcggccaatgaggcgctcgtgttctgcctcgccgaccacggcgacgcctttctcatccccacgccatactacccaggcttcgaccgcgacctcaagtggcgcaccggcgccgagatcgtgcccgtgcactgcacgagcgccaacggcttccgggtgacgcgtgacgcgctggacgacgcgtaccgccgcgcccagaggcgccggctgcgcgtcaagggcgtgctcatcaccaacccctccaacccgctgggcaccacgtcgccgcgcgccgacctggagctcctcgtcgacttcgtggccgccaagggcatccacctcgtcagcgacgagatctactccggcacggccttcgccgagccgggcttcgtcagcgtcctcgaggtggtggcggcacgcggcggcgcggcggcggacggcctggtggagcgcgtgcacgtcgtgtacagcctgtccaaggacctgggcctcccgggcttccgcgtgggcgccatctactcctccagcgccgccgtggtctccgcggccaccaagatgtccagcttcgggctcgtctcctcccagacgcagcacctcctggcgtcgctcctgggcgaccgggacttcactcggcggtacatcgccgagaacacgcggcgcatcaaggagcggcgcgcgcagctggcggagggcctgcgggcgatcggcattgaggtcctggagggcaacgcggggctcttctgctgggtgcggatgggcagcctgatgcggagccagtcgttcgagggcgagatggagctgtggaagaaggtggtgttcgaggtcgggctcaacatctccccgggctcctcgtgccactgccgcgagcccggctggttccgcgtctgcttcgccaacatgtccgccaagaccctcgacgtcgccctccagcgcctcgccgccttcgccgaggccagcggcaagggcgcccccgcgcgccgcggcctcgcccgcggccccgcccggaccatgagctgccccgtcgcccgcttcagctgggcgaaccgcctcaccccgggctccgccgaccggaagtccgagcggtagccgcgtgctcgatccgctagcggagcgctacgtactgttcataaaccaccgccacgtcgcggcggcactagctacggcacagcatcctcattagcagtaggtgattagtaacagtaattattccttcgttttgttattgttcgcgtaatttttccttgagcaccgtggtgcccgaggggccagccactgcagttgggtgcactaggtagataggagtactaggagcgatcgatccatgcccatgcatcgcatcgtgttttttttttaccgggaacccctcggggtgttccggtctgtactattggtgtatgtacgcagtcaccttctcattattacgaggattctctacttatctaaaaaaaaaaaaaaaaaaaa

SEQ ID NO: 7582 - protein, 484 aa, Panicum virgatum
  misc_feature: Ceres CLONE 1913749
  misc_feature (1)..(384): Pfam Name: Aminotran_1_2 Pfam Description: Aminotransferase class I and II
  misc_feature (1)..(385): Pfam Name: Aminotran_1_2 Pfam Description: Aminotransferase class I and II
  misc_feature (1)..(389): Pfam Name: Aminotran_1_2 Pfam Description: Aminotransferase class I and II
  misc_feature (1)..(363): Pfam Name: Aminotran_1_2 Pfam Description: Aminotransferase class I and II
  misc_feature (1)..(385): Pfam Name: Aminotran_1_2 Pfam Description: Aminotransferase class I and II
  misc_feature (1)..(385): Pfam Name: Aminotran_1_2 Pfam Description: Aminotransferase class I and II
  misc_feature (1)..(385): Pfam Name: Aminotran_1_2 Pfam Description: Aminotransferase class I and II
  misc_feature (1)..(385): Pfam Name: Aminotran_1_2 Pfam Description: Aminotransferase class I and II
  misc_feature (1)..(386): Pfam Name: Aminotran_1_2 Pfam Description: Aminotransferase class I and II
  misc_feature (1)..(385): Pfam Name: Aminotran_1_2 Pfam Description: Aminotransferase class I and II
  misc_feature (1)..(484): SWISSPROT Homolog: EC 4.4.1.14 1-aminocyclopropane-1-carboxylate synthase 1
  misc_feature (12)..(484): SWISSPROT Homolog: EC 4.4.1.14 1-aminocyclopropane-1-carboxylate synthase 3
MVSMVADDEKPQLLSKKAACNSHGQDSSYFLGWEEYEKNPYDPVANPGGIIQMGLAENQLSFDLLEAWLEDNPDALGLRRGGASVFRELALFQDYHGMPAFKNALARFMSEQRGFRVAFDPSNIVLTAGATSANEALVFCLADHGDAFLIPTPYYPGFDRDLKWRTGAEIVPVHCTSANGFRVTRDALDDAYRRAQRRRLRVKGVLITNPSNPLGTTSPRADLELLVDFVAAKGIHLVSDEIYSGTAFAEPGFVSVLEVVAARGGAAADGLVERVHVVYSLSKDLGLPGFRVGAIYSSSAAVVSAATKMSSFGLVSSQTQHLLASLLGDRDFTRRYIAENTRRIKERRAQLAEGLRAIGIEVLEGNAGLFCWVRMGSLMRSQSFEGEMELWKKVVFEVGLNISPGSSCHCREPGWFRVCFANMSAKTLDVALQRLAAFAEASGKGAPARRGLARGPARTMSCPVARFSWANRLTPGSADRKSER

SEQ ID NO: 7583 - DNA, 1994 bp, Panicum virgatum
  misc_feature: Ceres CLONE 1914067
  misc_feature: Encodes the peptide sequence at SEQ ID NO. 7584
gacccgcgacccctctcgctcgtgaccactcacgacgagtcacgactcacgcggcgcctcccccggtccccggaacaccgcccacctcgtcgcgtcgatctcgaactctcgccgccgccgcccgccccgcgcgacctcgcctcggccggacccgcgccgccccgagcgaatcgccgtccagagccctcgtgctccctccgcctcctcgggcgagaggacgcaggcggtggcggccgtagcagcagacgtgcggggcggtccggaggcatcggcacttgcgcgccctgcggcggcggagggcgggccttgtttctcggcgcgcggcggcggcgcgtggggaggccgcggggagcgcggcgatttaggagcggcgtccggcgcgcaggagaaacgagtgcccgcgggaacaaccattgaataatcatgagctcgctctgcccttttgctggagctaccactggtggtggcgtatgccctgcaaaatccgacaagagcagtgccggagtatgccctgcaaaatctgacaagagcataagtggtgtttgccctgtcaccggcaaggatcacagtagcgagcacaagggaagtactggccatgctgaggataagggcaccgatccccgtatggtgccagcaaagtgcccatttggctacgacagcaacacgttcaagctggggccgctcagctgcattatctgccaggcactgctccatgaaagcagcaaatgcaagccatgtgcccataaattctgcaaggcatgtatatcacgctttaaagactgtccactgtgtggtgctgacatagaggggattgagcctgataccgagcttcaagctctcgttgatcgcttcattgatggccatgccagaatcaagcgatcacatgctgcaggggatgcggaagcagcaggtggcaagaacaaagtcatatatgaggatgtttctatggaaagaggagcttttctggtgcagcaagctatgagggctttccacgcccagaacattgaaagtgcaaaatcaaggttgaccatgtgtgcagatgacatcagggaggagttgaaatcgtcagaagataacttagatctatgttctcagcttggagctgtgttaggaatgcttggggactgctgtcggaccttgggagacgccccttcagcaatcacatactatgaagaaagtgctgagttcctctcaaaactccccacaaaagatcttgagttggttcatactctctcggtttcactaaataaaattggtgaccttcgctactatgatggggatctccaatctgcaagaaactattatgcccgttcattggatgttcgcagaactgcagtaaaagaacattcagcaatagcttcccaggtcatagatctagcaacttctcttgcaaaagttgcggatgttgatagaaatcttgggaacgaaagtgccgcagttgagggttttgaggaagcgattcattgccttgagaagttgaagctggattcaaaacaagctaatcttgaacaacggcgcgtctcggttcttgacttcctacacaaccagttggcagataagtaagacttggtcatcctaagaatacaccaactctagatgtcttctcctggtgtgcaactccactattttttacttgttgcctacggaaggagttgtactagaaatgtcaattagcgcgttttatcagcacatgaaactttgtcgcgtcaccaaataagtactcaagcactgtaaatgtattatatttatgctcggcgaggagattgctcttgatggctgcgaatatgctccagcagtctatagccctctggttagaggtttgtccttgtcatagcctgggacagcgcgtaagatgtaacttgtgggaagttccatctcgccttaacgtgtcatgcgggaacgctaatcccgttgtatattgacaataagacagggaggtactcatgaaggatggcctttgtttgttttagagattcccaggtcaagctgtttgc

SEQ ID NO: 7584 - protein, 379 aa, Panicum virgatum
  misc_feature: Ceres CLONE 1914067
  misc_feature (1)..(35): Pfam Name: zf-C3HC4 Pfam Description: Zinc finger, C3HC4 type (RING finger)
MSSLCPFAGATTGGGVCPAKSDKSSAGVCPAKSDKSISGVCPVTGKDHSSEHKGSTGHAEDKGTDPRMVPAKCPFGYDSNTFKLGPLSCIICQALLHESSKCKPCAHKFCKACISRFKDCPLCGADIEGIEPDTELQALVDRFIDGHARIKRSHAAGDAEAAGGKNKVIYEDVSMERGAFLVQQAMRAFHAQNIESAKSRLTMCADDIREELKSSEDNLDLCSQLGAVLGMLGDCCRTLGDAPSAITYYEESAEFLSKLPTKDLELVHTLSVSLNKIGDLRYYDGDLQSARNYYARSLDVRRTAVKEHSAIASQVIDLATSLAKVADVDRNLGNESAAVEGFEEAIHCLEKLKLDSKQANLEQRRVSVLDFLHNQLADK

SEQ ID NO: 7585 - DNA, 2303 bp, Panicum virgatum
  misc_feature: Ceres CLONE 1914115
  misc_feature: Encodes the peptide sequence at SEQ ID NO. 7586
agcggaattccagattcgccaacagcggatactacagcttgtattgaagagttgaggcatcaaaaaaaaaagattcgccgacagcgagccggccggccttcccctcacgccgcgccactcccaacttgcgttcgctataacccactcgcagacgatgccccgcattcccctctgcttccctcctcccctgcccgcgcgttcccactcccctgcccgcgccgccaccgctctgctgcccgctcgcgccgtgcgccgctcggggggcttcgttacttgaacggtgagctagagcgagcaggttgatgagtgcgtcggcggccggcgacagcctcgtctagagcgagtcgttccgtggccggcaatgagggtgtacatcacggcggccgctgacgaagtggcgatgaagcccaaggcggagccgccgcagcctcagcagcagcagcaggcggcggcgcggcgcgggtgccgctccgccgtcgtcacggggctcctcgccggggtgctcttcctccgcgccgcgctcctcgccgtcgaggccggcgcctccctctgcccttccgcgaccgggtgcccggactggcgggcggggctcgggcgctggctccacggcggcgacgcgatggaggaattcatgaaggaatggaggaggactcacagggcggcgaccctgttggatcccgtggtggtggaagcggcgccggactccctggacgcgctcaaggcggagatgggcgcgatgctggcgtcctacgacggcggccggctcgacatggaggccgtggcggtcaagatgatggccatgctgttgaagatggaccggaaggtgaagaaatcaagggtccgggcgctgttcaaccggcacctggcctcgctgggcgtccccaagagcgtgcactgcctcacgctgcgcctggccgaggagttcgcggtgaactcggcggcgcgctccccggtgccgccgccggagcacgcgccccgcctcaccgacgcctcgtacctccacgtcgcgctcgtcaccgacaacgtgctcgcggccgccgtggcggtggcctccgccgcgcggagcgccgccgacccgggcaggctggtgttccacgtagtcacggacaagaagagctacgtgccgatgcactcgtggttcgcgctgcaccctgcgtcgcccgccgtcgtcgaggtcaagggcctgcaccagttcgactggcgcgacggcggcgtcatcgcctcggtcatgaggacggtcgaggaggtgcagaggagctcgctggactatcaccggtgtggcggatcagcggagagggagcacagacgcctcgaagcgtccaatccgagcacgttctcgctgctgaactacctcaagatccatctcccagagttcttccctgagcttgggcgggtgatgctcctcgacgacgacgtcgtggtgcgcaaggacttgaccgggctgtgggagcaggacctcgacgggaacatcatcggcgcggtcggctctcacgatggcggcggcatctgcgccgacaagaccttcggcgatcacctgaatttctcggagcctgccgtgtcaggcctcctcggctcgcaatgcgcctggtcgtggggcgtcaacatcgtcgacctcgacgcgtggcgacgaacgaacgttaccgagacgtaccagctctggctacaaaagaaccgggagtcgggattcaggctgtggcagatggcctcgctgccgccggctctgatcgcgttcgacgggcgcgtgcaggcgatcgagccgctgtggcatctgccgggcctcggctggcgcgtgccggaccccgaggtggcgcgcttctccgccgtcctgcacttcagcgggccgcggaagccgtggctggaggtcgcgttcccggagctgcggcagctgtggctcggccatctgaacgcgtcggatagtttcttacggggatgcggtgtcgtcgaatggcagtaaatggagcagcagaaaaatcgagcctggaggaaaacaagtacagtaatttggttcaggattaccggtgcagagctgggggttctgggagagggaagtaggtgttgcctgcagtctctcctcaccttcaggctctgcagtctgcacacgatgggtatattctagtcagttcagtgtgacactagaactgcttgatgttatatatactgaattactgaccaagggggccaggggggcatttattccggaccacagagtacttcacaaaacttccagagaaaccgtaatgtaggattcatcttcaactataagatgtacatggttgtttaaataaaaaaaaaaaaaaaaaaaa

SEQ ID NO: 7586 - protein, 530 aa, Panicum virgatum
  misc_feature: Ceres CLONE 1914115
  misc_feature (1)..(328): Pfam Name: Glyco_transf_8 Pfam Description: Glycosyl transferase family 8
MRVYITAAADEVAMKPKAEPPQPQQQQQAAARRGCRSAVVTGLLAGVLFLRAALLAVEAGASLCPSATGCPDWRAGLGRWLHGGDAMEEFMKEWRRTHRAATLLDPVVVEAAPDSLDALKAEMGAMLASYDGGRLDMEAVAVKMMAMLLKMDRKVKKSRVRALFNRHLASLGVPKSVHCLTLRLAEEFAVNSAARSPVPPPEHAPRLTDASYLHVALVTDNVLAAAVAVASAARSAADPGRLVFHVVTDKKSYVPMHSWFALHPASPAVVEVKGLHQFDWRDGGVIASVMRTVEEVQRSSLDYHRCGGSAEREHRRLEASNPSTFSLLNYLKIHLPEFFPELGRVMLLDDDVVVRKDLTGLWEQDLDGNIIGAVGSHDGGGICADKTFGDHLNFSEPAVSGLLGSQCAWSWGVNIVDLDAWRRTNVTETYQLWLQKNRESGFRLWQMASLPPALIAFDGRVQAIEPLWHLPGLGWRVPDPEVARFSAVLHFSGPRKPWLEVAFPELRQLWLGHLNASDSFLRGCGVVEWQ

SEQ ID NO: 7587 - DNA, 2027 bp, Panicum virgatum
  misc_feature: Ceres CLONE 1914132
  misc_feature: Encodes the peptide sequence at SEQ ID NO. 7588
aggcctcagctcataaataaacgccgccgctccgtttcccctagtcctggcatcctctcccatccctccctccctcttccgtctctccattcttctcttgcttttgccgaccagaagcatcgaggcatccgggtcatcttcacccccccccccccccgcgatccctctccaccacctccgggcaccatccgcgcgcgcgcactgttgccgagcaaggcaagcaggccggccttgcgagccccagcggcggcgcttattaatcgcgcgctgatcagcaggtgacgcaccggccggcgagaccacccagcgcgcgcgcgagagagagagtgggacggcagcgatggcggcggggctgccgccggcctccgagaggcggcttgcggcggtgctgctgctgcttctcggggtgaccgcggcggcggcttcggccggcgagcggcggggcctggcggcgcgggtggagggcccggcggcgcggcaccgccacgcgtacgccgcgatgatgtacatgggcacgccgcgggactacgagttctacgtcgccgtgcgggtgatgatgcgctccctcacccgggtccgcgccgacgccgaccgcgtcctcatcgcctccgccgacgtgccgcgcgactgggtccgcgcaatgacagaggaggatggtatgagggtggtgatagtggagaacctcaggaatccttatgcgagcagtctaggagggatcaacagaaggttcaagctgacgctgaacaagctttacgcgtggaccctggttgactacgagcgtgtcgtcatgattgattccgacaacatcttcctccagaacaccgacgagctgttccagtgtgggcagttctgcgctgttttcatcaacccgtgctacttccacactggtcttttcgtgctccagccttctatggatgtattcaagggcatgcttcatgacctggagattggccgtgaaaactctgatggtgctgaccaaggctttctggttgggtgctacccagacttgctcgacaaaccaatgtttcaccctcctgagaatggcacaaagctcaacgggacctatcgccttcctctcggctatcaaatggatgcatcctactactatctcaagctgcattggcatgtcccgtgtgggccaaacagtgtgatcacatttcccagcgccccttggttcaaaccttggtactggtggtcctggccaatcttgccactgggactttcctggcacaagcagcgctgggatgatctcgggtatgctgctgaaatgccagtaattctgatggaagttttaatgtacatagtgatcataacaatcactagattggcaaggccagggatgacaaaactgtgttataaccggcgacctgagaagcaaaatgccctggtgcagtggctgatcaagatgactgtgattgtggctatggtggctgcatattccattcctttctttgtgatcccacgcaccgttcatcccatcatgggctggtccatctacctatttggcgcactagccctttcagtgctcgtgatcaatgtttttctgctgccaccacttgccgtgcttacgacctggcttgcgattgttggtatgctctttgttatggcattcccatggtatcgtgatggtgttgtgagggttctggcaatctttgggtacgcgttctgctctgcacctttcttgtggacatccctggtgaggatgatggactcactgcagacgatgcttgagagggatccattcttccctcggcttggtgaaccgacgcaggatactgaattcagcaagctttactgattctattttgcaccgatttgagatgcttcatcaacacttggacaactgatctggatcggctaattcttgattcattctgacggtttcgctcaggcattctgctgtgttgatacttatgtacaaacatagcctgcagcaaccacgattgatacagatacaggaaagataggtcagctgtactgaattggaaaaaagaacatatttgctgcaaaaaaaaaaaaaaaaaaaa

SEQ ID NO: 7588 - protein, 485 aa, Panicum virgatum
  misc_feature: Ceres CLONE 1914132
  misc_feature (1)..(225): Pfam Name: Glyco_transf_8 Pfam Description: Glycosyl transferase family 8
MAAGLPPASERRLAAVLLLLLGVTAAAASAGERRGLAARVEGPAARHRHAYAAMMYMGTPRDYEFYVAVRVMMRSLTRVRADADRVLIASADVPRDWVRAMTEEDGMRVVIVENLRNPYASSLGGINRRFKLTLNKLYAWTLVDYERVVMIDSDNIFLQNTDELFQCGQFCAVFINPCYFHTGLFVLQPSMDVFKGMLHDLEIGRENSDGADQGFLVGCYPDLLDKPMFHPPENGTKLNGTYRLPLGYQMDASYYYLKLHWHVPCGPNSVITFPSAPWFKPWYWWSWPILPLGLSWHKQRWDDLGYAAEMPVILMEVLMYIVIITITRLARPGMTKLCYNRRPEKQNALVQWLIKMTVIVAMVAAYSIPFFVIPRTVHPIMGWSIYLFGALALSVLVINVFLLPPLAVLTTWLAIVGMLFVMAFPWYRDGVVRVLAIFGYAFCSAPFLWTSLVRMMDSLQTMLERDPFFPRLGEPTQDTEFSKLY

SEQ ID NO: 7589 - DNA, 1518 bp, Panicum virgatum
  misc_feature: Ceres CLONE 1914269
  misc_feature: Encodes the peptide sequence at SEQ ID NO. 7590
aaccacaccccgtcgtctccctcctccagcccaccccccccccccccccagctgctgcagctgtagcccccgccatggcgtcgttcgtcgcgcaccaccacgactcactgggggagagggaggggaggatggccgcgctgaggagtagcctcaggccgtgcgaggcggcggaggaggtggacgccgcgccggcggcgtgggggccggcggaaaggggtgccggccttttaggggacgggttctccgtcgaggacctgctggacctcgaggacctctacgaggtcgacaaggactgcaccgagctggtggcggcggcgccagcgccggcggccgtggaggacgacaagctgtccagtgactcccacgggtcgtcgatggtgtcgtacgagctcatgccgctcccgacgccagtgattgacctcccgctgccggcgcatgacgcggaggagctggagtgggtgtcccgcatcatggacgactcgcaagccgagctcccgccgccgccgaagctacaggcggcggccgtagcagcggccgcagcgcggcgtccgctggaacgcgcggtgccaacggcggcggcggcccctatgcggagcccgacgatttgcgcgctgtcgacggaggcgctggtgcccgtgaaggcgcggcgcagcaagcgctcgcgcgcctccgtgtggtcgctctccggcggcgcgccgctgtcggactcggcgtcatcgtcctccacggccaccacgtcgtcctgctgctcgtccgcctcgttctcgccgttcctcttcctgccggcggactcgccgcccgcgttctgggcggcgcacctcctcggcgaggcgccgcgcggcgcctccaagaagtccaagcacggcaagagcggcggcggcggcaagcccaagaggcgcgggcgcaagcccaagcaccacccggcgtcgcaccagttccgggcctcgcccgccgcgggccccggcgaccggcgctgcagccactgcggcgtgcagaagacgccgcagtggcgcgcgggacccgcgggcgccaagacgctgtgcaacgcgtgcggggtgcgctacaagtccgggcggctcctgccggagtaccggccggcgtgcagcccgacgttcgagagcagcatccactccaactcgcaccgcaaggtgctggagatgcggcgcaagaaggagggcgtcgtcctcttcccgccgggcccggcgccgctcccggccgccgcgccggccgtcgcgtctttctaagccggcgctgtacattttttcagcctgtcgtgtaccgtacctggatttttttcccctcccttccaccttctctattatcgtatcggttgtactagtagctagaactcagaactctaggagcttcattaggtcgaattaggtgtagggattaagatttccatggcttattattagctaggtttgctggggtatgcttggctctagtagttgtgccagtagcgagggtcttcccgagaaacgaccgaatgaattggaggtcttgcactcttgctgg

SEQ ID NO: 7590 - protein, 389 aa, Panicum virgatum
  misc_feature: Ceres CLONE 1914269
  misc_feature (1)..(36): Pfam Name: GATA Pfam Description: GATA zinc finger
  misc_feature: The sequence is a functional homolog of  SEQ ID NO 2634 in the  10/374,780 US patent application
  misc_feature: The sequence is a functional homolog of  SEQ ID NO 318 in the  10/225,066 US patent application
  misc_feature: The sequence is a functional homolog of  SEQ ID NO 609 in the  10/374,780 US patent application
  misc_feature: The sequence is a functional homolog of  SEQ ID NO 76 in the  10/666,642 US patent application
  misc_feature: Useful for making plants with modulated growth and phenotype characteristics
MASFVAHHHDSLGEREGRMAALRSSLRPCEAAEEVDAAPAAWGPAERGAGLLGDGFSVEDLLDLEDLYEVDKDCTELVAAAPAPAAVEDDKLSSDSHGSSMVSYELMPLPTPVIDLPLPAHDAEELEWVSRIMDDSQAELPPPPKLQAAAVAAAAARRPLERAVPTAAAAPMRSPTICALSTEALVPVKARRSKRSRASVWSLSGGAPLSDSASSSSTATTSSCCSSASFSPFLFLPADSPPAFWAAHLLGEAPRGASKKSKHGKSGGGGKPKRRGRKPKHHPASHQFRASPAAGPGDRRCSHCGVQKTPQWRAGPAGAKTLCNACGVRYKSGRLLPEYRPACSPTFESSIHSNSHRKVLEMRRKKEGVVLFPPGPAPLPAAAPAVASF

SEQ ID NO: 7591 - DNA, 1694 bp, Panicum virgatum
  misc_feature: Ceres CLONE 1914331
  misc_feature: Encodes the peptide sequence at SEQ ID NO. 7592
gatgctctacaccggctgccccagccagcccagccaccggctgaagattgcaaggaaccatgcccatggcctcccctccgccgcagagagagaagctgcgcgtccttctcatccccttcttcgccaccagccacatcggccccttcgcggacctcgccttccacctcgccgcggcccggccgggtgtcgtcgaggccaccgtcgccgtcaccccagcgaacgtcccggtcctccggtcggcgctcgcccggcgcggtcccagccgccacgccgccgcggtccagatcgcgacgtacgcgttcccggccgtggacggcctcccaccaggggtcgagaaccactccgccgtcaaggctgcggacgcgtggcgcatcgacgccgtcggcagcgacgagcagctaatgcggccagggcacgagggcctcgtcaaggacctctcgcccgacgcgatcgtctccgacatactcttccactggaacaccgacatcgccgccagtgtcggcgtgccgtgcgtcacgctccacgccatgggggcgttcccgatgctggccctgtcctgtttgacaggtgccgaggccacaggcggggcggtggctcttcccgggtttctaccaccggacgtacggatcccagtcaccgagctgcctgaggggttgaggagccagagtcaagacggcgtccgcgccagccgagaccaattaacttcagcgcacagtagctgtttcggactcatcgtgaacactttcttcgatctggaggacaggtattgcgaaatgtacatgcggcacatgaaacacgcctacttcgtcgggcccttgtcactgccgccgccaccgcagctggccgccggcgacgacggctcacggtgcatcgactggctggacaggaagccagcccagtcggtcgtgtacttgtgcttcggcaccttgtctcacacatctgaggctcagccccgcgagctcgccctcgggttagaagcctccgggaagccgttcctgtgggtggtcaggctggaggaatgggtgctgccggaggggtggaaggagcgcgtcggggacagagggatggtcgtcacagggtgggccccgcagacggcgatccttgcacacccggcggtgggggcgttcgtgacgcactgcgggtggaactcggtccaggagaccgtcgcggccggcatgccggtgctgacgtggccgaaggtgttcgagcagttcatcactgagaggttcgtgacggaggtgctcaagattggcgaacgcctgtggccggagggtgccggggtgaggagcacgaggtacgaagagcacgagctggtcccgagcgaggcagtggcacgagcggtggccaagttcatggagcccggaggggcaggggacgccgcgaggagcagggccaaggagctctccgcaaaggctcatgcggccatggcggaaggtgggtcctcgcacggcgacctgcgacgcctgattgatgatctcatcaaagaaaaatcggctggtgcagggacgacggtctgatactctggtttgagctcatgaagcttgtctttttttttcctttaagaataagagtgtctcatttatttctctgttttcggtttggattttccactgtttggttagcaagctccggtgttagtaatcctgtgcacgcctgtagttagaactgcattgcaaaaaaaaaaaaaaaaaaaa

SEQ ID NO: 7592 - protein, 485 aa, Panicum virgatum
  misc_feature: Ceres CLONE 1914331
  misc_feature (1)..(125): Pfam Name: UDPGT Pfam Description: UDP-glucoronosyl and UDP-glucosyl transferase
MPMASPPPQREKLRVLLIPFFATSHIGPFADLAFHLAAARPGVVEATVAVTPANVPVLRSALARRGPSRHAAAVQIATYAFPAVDGLPPGVENHSAVKAADAWRIDAVGSDEQLMRPGHEGLVKDLSPDAIVSDILFHWNTDIAASVGVPCVTLHAMGAFPMLALSCLTGAEATGGAVALPGFLPPDVRIPVTELPEGLRSQSQDGVRASRDQLTSAHSSCFGLIVNTFFDLEDRYCEMYMRHMKHAYFVGPLSLPPPPQLAAGDDGSRCIDWLDRKPAQSVVYLCFGTLSHTSEAQPRELALGLEASGKPFLWVVRLEEWVLPEGWKERVGDRGMVVTGWAPQTAILAHPAVGAFVTHCGWNSVQETVAAGMPVLTWPKVFEQFITERFVTEVLKIGERLWPEGAGVRSTRYEEHELVPSEAVARAVAKFMEPGGAGDAARSRAKELSAKAHAAMAEGGSSHGDLRRLIDDLIKEKSAGAGTTV

SEQ ID NO: 7593 - DNA, 1526 bp, Panicum virgatum
  misc_feature: Ceres CLONE 1914403
  misc_feature: Encodes the peptide sequence at SEQ ID NO. 7594
cacaaaacacagccctggaaaatcgacgacctaaattccagagagaggaaaaagaaaaatcccaatccccgccgccgcgagatcgccgggcgccgccatgtccactccagccgccgcctacttcgccgccgccgcgcgcaagcagtacttctgctaccaatgcaaccgcaccgtcctcatcgcggcctccgccgccgccgccggggagctctcctgccccgactgccacggcgacttcctcgaggaggtcaccgtcccggcccccaccttcatcccgctccccttccccttccccttcgcctccaccacgatccccgccgccagcaccgccccagccccagctgccggctccggcgggtccccttccctctcgtcctcgtcctcttccgccgcgacctcgccgtcccagaccaacgacatctcctccatcctcaacaccttcctcggactcggcgaacaatccggccgggtcggcggcggcgtgcgctccgccgccggcacggcgacccccgagaacgagcccgagcccttcgacccggtcacgttcttccagagctacctccataacctcatggagggaggggccaacatccaggtcctcctcgacgacgccagcctcagcctcggcccgggcctcggccttggccgcgtcggcggggcaagcttcggggactacttcgttggcccgggccttgagcaactcatcgagcagctcgccgagaacgaccctaaccgctatggcacaccgccagcagccaagtcggccctctccgctctccccaatgtcgtcgtgactcacgcaatggttgccgcggcagagggcgctgagtgtgccgtgtgcaaggatgatttctctcctggggaggtagccaagcagatgccctgcaagcacatctaccatgctgactgcatcgtgccctggctggagcttcacaactcatgcccaatatgtcgttttgagctccccactgatgatcctgattatgaggggcggaaggcctctattccgcagccgcctgttggaattgctgcggttgcatctgggagcactactgctgctgatgaaaggatggaggagagggaggagaatgctagggtggttgagaggaggttcaatgtgtcgctgccgtggccgttcagtggattgggagggcaaacatcgcagcaggatgggaacaatgggggcagcggtagcaactctcagggcagtggatcgcaagatggtggcgcgcccagcagcaagaattaagcaaaaatcaacctggaggttcacctcttggcgatccattcaaaagtctgcagtgttgccgtgactatacccacagacatgaaagaaccaagggaatttactgtctgtctgttatgtaacaatccgttcgttctagtttgtgtcctcggtgttcgttaggtcatatgtacacaaggcgcaaaaactgccccccgcagcagaatttgcgttttgagaacttttatgtgcagatttgttgattggtcccgcttcattagaaaaaaaaaaaaaaaaaaaa

SEQ ID NO: 7594 - protein, 383 aa, Panicum virgatum
  misc_feature: Ceres CLONE 1914403
  misc_feature (1)..(41): Pfam Name: zf-C3HC4 Pfam Description: Zinc finger, C3HC4 type (RING finger)
MSTPAAAYFAAAARKQYFCYQCNRTVLIAASAAAAGELSCPDCHGDFLEEVTVPAPTFIPLPFPFPFASTTIPAASTAPAPAAGSGGSPSLSSSSSSAATSPSQTNDISSILNTFLGLGEQSGRVGGGVRSAAGTATPENEPEPFDPVTFFQSYLHNLMEGGANIQVLLDDASLSLGPGLGLGRVGGASFGDYFVGPGLEQLIEQLAENDPNRYGTPPAAKSALSALPNVVVTHAMVAAAEGAECAVCKDDFSPGEVAKQMPCKHIYHADCIVPWLELHNSCPICRFELPTDDPDYEGRKASIPQPPVGIAAVASGSTTAADERMEEREENARVVERRFNVSLPWPFSGLGGQTSQQDGNNGGSGSNSQGSGSQDGGAPSSKN

SEQ ID NO: 7595 - DNA, 1491 bp, Panicum virgatum
  misc_feature: Ceres CLONE 1914450
  misc_feature: Encodes the peptide sequence at SEQ ID NO. 7596
acagtctttcacccctccccgtcggtctcgggttctcggcggcggagaggaaagcgaggtaggagatggccacctatttcatgctcaacaccggcgcccgcatcccctcggtggggctcggcacctacaaggccggccccggcgtcgtcggcgacttgatcgccgccgccgtcaaggccgggtaccggcacatcgactgtgcgcgcctgtacaacaacgagaaggagattggtgttgctctgaagaaagtcttcgatgacggcgtcgtcaagcgagaagacctgttcatcacctccaagatatggtgcagcgacctcgcacccgaagacgttccgctggcaatcgacagcactctgaatgatttgcagctggattaccttgatctgtatctgattcattggccctttcagataaagaaaggcagtgaagttagtcctgagaactttgtccagtttgatatgcccaagacttggcaagcagtggagaagctgtacgattcaggcaaagctcgcgcggtcggcgtgagcaactttacgtcgaagaagctggccgatttgcttgctatagcccgtgttcctcccgccgttaatcaggtggagtgccaccccggctggcaacaggcgagactccgagcgttctgccactccactggagttcatttctctgcgtatgcgcctctgggaaggatgaaagttgttgcgaataatccggtggtgacatcaatagccgagctcttggggaagactccggcgcaggttgccctacggtggggaattcaacagggtcagagcgtgcttcctaaaagtgccaatgagtcaaggttgaaggagaacattggcctgtttggttggtctattcctgacgaactgtgtgccaagttttctgaagttgaacaggttaagcagatcagaaacgattcatttgtgcaccctcagagtatgtacaaaacaattgaggagctgtgggacggtgagatctaaatgaaatcatcgccgttatgaaatcaaatccgtgacaagagttaacattcatgccatgaaattggcacactttttacctttggagggaaaaataatgaaataggaggcatcatgctgtcgttgtgaagttcgttcagaaagaaacgagcatggcgcggattctgttgcattttttacaggattaagtcatatcagcattgttttttttatcaagtcatgtcagcattgttgcatggtctgcctgaagatccagtggtgaggctaggaacaaagcatagaacaaacaaatttacaacaactctcttttcttttctgttctagtgcacgttgtttatcgatgcctcaatagctttggccgtagtttgttaaacaattgaaaaaccccggcctgtgggtttccactcggccttgggcatgtaagctttttcattcttctgcttaatacaatgaagctctccttcatattcccggcctgaccaagctttcactacaaaaaaaaaaaaaaaaaaaa

SEQ ID NO: 7596 - protein, 304 aa, Panicum virgatum
  misc_feature: Ceres CLONE 1914450
  misc_feature (1)..(278): Pfam Name: Aldo_ket_red Pfam Description: Aldo/keto reductase family
MATYFMLNTGARIPSVGLGTYKAGPGVVGDLIAAAVKAGYRHIDCARLYNNEKEIGVALKKVFDDGVVKREDLFITSKIWCSDLAPEDVPLAIDSTLNDLQLDYLDLYLIHWPFQIKKGSEVSPENFVQFDMPKTWQAVEKLYDSGKARAVGVSNFTSKKLADLLAIARVPPAVNQVECHPGWQQARLRAFCHSTGVHFSAYAPLGRMKVVANNPVVTSIAELLGKTPAQVALRWGIQQGQSVLPKSANESRLKENIGLFGWSIPDELCAKFSEVEQVKQIRNDSFVHPQSMYKTIEELWDGEI

SEQ ID NO: 7597 - DNA, 1382 bp, Panicum virgatum
  misc_feature: Ceres CLONE 1914598
  misc_feature: Encodes the peptide sequence at SEQ ID NO. 7598
actgtccatgaccactccggctgtcgacacggccacggccatcatcgccgccgctctgctggtactggcagccgccgcggccgtgctctgctcgtcggcgaccggcgaggatgagagcgccgccgtcggccgtggccgcccggtggtcccggcgatgtacgtgttcggggactcgctggtggacgccggcaacaacaacttcctgccgccgccggcgcccaaggcggtgccgccgaacggcatcgacctcccgctcacggtcttcccgcgggccgggcgctgcaccaacggctacaacctcgccgacatcatagcacagcacctaggattcaagatgagcccacctgcttacctctcactgacgccgctatcaagcatcgatctccttagaggacgaggtggcgccaactacgcatccggtggatctggcattctagacatcactgggaacgggacgatcaccctacgtaaacaagtcgagctgttcgcagagaccaaggcaacgatcatccggactggcctggtggatcgcgagaggctggacgacctgctggcccggtccttgtttctcatcagcaccggtggcaacgacttcgacgccttcgacggcgacgacggcgtgcccatgagccaggcgccggagttcatcgccggcatggtcgccgattacctcaagtacatcaacgagctgtacaagctgggagcacggaggctgtccttgctcaacatagtgcccgtcgggtgcctgccgagccaacgagccatcacggccaacggtgagtgcgacgccaagggcaactccctctcgcagatgttcaatgccctcctccggactgagatggccaaagctgttgtggcatccatgccgttcttgaagtactccatcgccagcctttacaacacctactccgacatgatcgccaacccggcgctagccgggctgcgtgaggtgaagagagggtgctgcggcggcggaaagttcaatggcgaggtcgtgtgcacaatggcctccagcctctgtgggaaccgcgacgagtaccttttctgggacatggtgcacgggacgcaggaggcctaccgctgggctgtcctctccttcttccacggttcgacgagggatgccgagcccatcaaccttgcacagctgatgcaagaacccttgtccatggcgacagctccctactcctccatctaatggttttatctttttgatatagaaataaagaagaataatatcctgggctcctggcctctaccttagagaaataagaaaggaatcatgctttgaaaatcatggttgagaggcgaagtgacacgagtttatatatcatggtacaagactctgaagaatttgctcgtgccaaaaaaaaaaaaaaaaaaaa

SEQ ID NO: 7598 - protein, 395 aa, Panicum virgatum
  misc_feature: Ceres CLONE 1914598
  misc_feature (1)..(320): Pfam Name: Lipase_GDSL Pfam Description: GDSL-like Lipase/Acylhydrolase
MTTPAVDTATAIIAAALLVLAAAAAVLCSSATGEDESAAVGRGRPVVPAMYVFGDSLVDAGNNNFLPPPAPKAVPPNGIDLPLTVFPRAGRCTNGYNLADIIAQHLGFKMSPPAYLSLTPLSSIDLLRGRGGANYASGGSGILDITGNGTITLRKQVELFAETKATIIRTGLVDRERLDDLLARSLFLISTGGNDFDAFDGDDGVPMSQAPEFIAGMVADYLKYINELYKLGARRLSLLNIVPVGCLPSQRAITANGECDAKGNSLSQMFNALLRTEMAKAVVASMPFLKYSIASLYNTYSDMIANPALAGLREVKRGCCGGGKFNGEVVCTMASSLCGNRDEYLFWDMVHGTQEAYRWAVLSFFHGSTRDAEPINLAQLMQEPLSMATAPYSSI

SEQ ID NO: 7599 - DNA, 1647 bp, Panicum virgatum
  misc_feature: Ceres CLONE 1914627
  misc_feature: Encodes the peptide sequence at SEQ ID NO. 7600
acagctcacgtcttgaaggagcgaaattacccgctgccggcgtcatcgttgcatccaaagcgtcgagctagattccacgcctaggcagaccgcagacgccagccttcccccgtgtgcgtcaccgcgtcttgtgcggatcggcagccagacgcgggcgcccgcagcagctcgcctcggccatggacgtggaagcgcgcaaggacgcggcgccgccggcgccggcgcgcggcaaggcgatgcaccgcctcctggtggcgctcaacatcgggatgctcgcgctgggcgccgtaggcgggccgctcctcagccgcctctacttcagcaagggcggccaccggcagtggctctccgcgtggctggagaccggcggctggccgctgctgctgctccccgtggcggcgtcctacgccttgcgccgcgcgcgcgaccggggcgccccggccctgctcgccccgccgcgcatactgctggccgccgcgggcctcggcgtggccacgggcgcggacgacttcatctacgcctacgggctcgcgtacctgcccgtgtccacctccgcgatcctcatcgcgacgcagctcgcgttcacggtgctcttcgcgttcctcgtggtgcgccagcggctgagcgccgcgtccgtgaacgccgtggccctcctcaccgtgggcgccgtcgtgctcggcctgcacgtctccggcgaccggcccgcgggggtcaccaggggccagtactggctgggcttcgccctcacgctcggcgccgccgcgctctacgggctggtcctgccgctggtcgagctcgcgtacaggcgcgccgccggcggcggccgcgccgtgacgtacgcgctggtgattgagatgcagctggtgatgggtttcttcgccacggccttctgcaccgtgggcatgatcgtgaacaaggatttccaggcgatcccgagggaggcgaagcacttcgagctgggggaggcccggtactacacggtgctggcgtggtcggcggtgctgtggcagttcttcttcctgggcgccgtcggggtcatcttctgcgtgcacacgctgctggcgggcatcctcatcgccgtgttcatcccagtcacggaggtggccgccgtcatcttcctgcacgagaagttcagcagcgagaagggggtggcgctggtgctctcgctctggggcctcgcgtcctactcctacggtgagtggagcgaggccagggccaagaagaagacggccgaggccgccgcggaggcccagggcccttgagagtcgcgtgctttgcgactgtggacgacggtgatgcgagaggctctgttgatctcttccagttgtactccctgtgtgtgttgtgtggtttgtggccgtgtcgatggatggagtcgcgtgagtcgtcgccacctgcaactgtgggatggtctgcatttctcagtccagttgagttgggtgatgcatgggtaaatggtagtactttgctgcatggggcatggaggtgccatagtagtaccgtaccgtacacgaaagtatgaaactgctctcgcgacaatttgaagtcgtagcaaagcgattaccgcactttgtaacccgatcccgggtattatattgtctgaaaaaatataatttttttttgtctcaaaaaaaaaaaaaaaaaaaa

SEQ ID NO: 7600 - protein, 360 aa, Panicum virgatum
  misc_feature: Ceres CLONE 1914627
  misc_feature (1)..(153): Pfam Name: TPT Pfam Description: Triose-phosphate Transporter family
MDVEARKDAAPPAPARGKAMHRLLVALNIGMLALGAVGGPLLSRLYFSKGGHRQWLSAWLETGGWPLLLLPVAASYALRRARDRGAPALLAPPRILLAAAGLGVATGADDFIYAYGLAYLPVSTSAILIATQLAFTVLFAFLVVRQRLSAASVNAVALLTVGAVVLGLHVSGDRPAGVTRGQYWLGFALTLGAAALYGLVLPLVELAYRRAAGGGRAVTYALVIEMQLVMGFFATAFCTVGMIVNKDFQAIPREAKHFELGEARYYTVLAWSAVLWQFFFLGAVGVIFCVHTLLAGILIAVFIPVTEVAAVIFLHEKFSSEKGVALVLSLWGLASYSYGEWSEARAKKKTAEAAAEAQGP

SEQ ID NO: 7601 - DNA, 1784 bp, Panicum virgatum
  misc_feature: Ceres CLONE 1914643
  misc_feature: Encodes the peptide sequence at SEQ ID NO. 7602
gccacgccacgctaccctcctccagtctcacccacgccggcgtcctcccgcctcccctcaccggcacgcacgcctcccccacgcgccgcgcgctcctttagcgctcggctcgtaggatgcgccacctgctcctgccccgtctcctcctcttctcccccgccatggctcgcgcttccgtgtccggctccgccgcggcggccaaagccctcctccccttaaaccccgcccgcggcgggagccgcctcccttccctgctccccgcgcgccgcctccctgcccccgggagcggccgcgcgttccgcggcgcctctctccggtgctacgcagccgccgccgccgcggtggccgagcagggccgcatcaaggtccagaaccccatcgtcgagatggacggggatgagatgacgcgggtcatatggagtatgataaaggataagctcatcttcccgtacctggagctggatgtgaagtactatgatcttggaattctcaacagggacgccaccaacgatgaggtcaccgtggagagtgcagaggctacattgaagtataatgtagctgttaagtgtgcaacaatcacgcctgatgagactagagtcaaagagttcaaactcaagtctatgtggcggagcccaaatggcacaataagaaatattctaaatggcactgtttttcgcgaacccatcttgtgtaaaaacataccacgtatattgtctggctggaagaaacctatctgcataggaaggcatgcatttggtgaccagtatcgagcaactgatatgattatcgatggtccaggaaagctcaagatggtatttgtgcctgagggagctgaggcggtggagctcgatgtctatgattttaaaggacctggtgtgtcattatcgatgtacaatgtagacgagtctattagggcttttgccgagtcctctatggctatggcactttccaaaaggtggcctctttatctcagcaccaagaacacaatcctaaagaagtacgatggcagattcaaagacatcttccaggaggtatatgaagagaactggaaggagaagtttgaggagaactcaatatggtatgagcaccggttgattgacgacatggtagcctatgctgtgaaaagtgagggtgggtatgtttgggcgtgcaaaaattatgatggagacgtccagagtgacttcctggctcaaggttttggttctctgggtctgatgacatcggtgctgttgtcttctgatgggaaaacattagaggctgaggctgctcacgggactgtcactagacatttcaggctacatcagaaggggcaggagacgagcaccaacagtattgcctcaatatttgcttggactcgtggattggaacacagagcaaagctggataaaaatgataggctgctggatttcacacacaaacttgaatctgcatgtgttgagacggtggaatctggcaagatgacgaaggaccttgcacttcttattcatggccccaaggtatcaagggagttctacctgagcaccgaggagttcatcgacgctgtcgctcagcaattgcgaggaaagattcagacaccagctgtggtgtaatcttgagcttggagcctgaaaccgagtgagccagtttcgctgtgcattcggcgcactttttttttttttgaactgtacacagcgagggaagcccccgctgtgaaaaaaaaaaaaacttcggcgcacttttgactgagacgagatggatctcaaacaaatttgttttgtgggttacaaaaaaaaaaaaaaaaaaaa

SEQ ID NO: 7602 - protein, 490 aa, Panicum virgatum
  misc_feature: Ceres CLONE 1914643
  misc_feature (1)..(390): Pfam Name: Iso_dh Pfam Description: Isocitrate/isopropylmalate dehydrogenase
  misc_feature (2)..(391): Pfam Name: Iso_dh Pfam Description: Isocitrate/isopropylmalate dehydrogenase
  misc_feature (1)..(397): Pfam Name: Iso_dh Pfam Description: Isocitrate/isopropylmalate dehydrogenase
  misc_feature (1)..(395): Pfam Name: Iso_dh Pfam Description: Isocitrate/isopropylmalate dehydrogenase
  misc_feature (1)..(390): Pfam Name: Iso_dh Pfam Description: Isocitrate/isopropylmalate dehydrogenase
  misc_feature (1)..(389): Pfam Name: Iso_dh Pfam Description: Isocitrate/isopropylmalate dehydrogenase
  misc_feature (1)..(390): Pfam Name: Iso_dh Pfam Description: Isocitrate/isopropylmalate dehydrogenase
  misc_feature (1)..(393): Pfam Name: Iso_dh Pfam Description: Isocitrate/isopropylmalate dehydrogenase
  misc_feature (1)..(394): Pfam Name: Iso_dh Pfam Description: Isocitrate/isopropylmalate dehydrogenase
  misc_feature (2)..(391): Pfam Name: Iso_dh Pfam Description: Isocitrate/isopropylmalate dehydrogenase
  misc_feature (81)..(484): SWISSPROT Homolog: EC 1.1.1.42 Isocitrate dehydrogenase [NADP]
MRHLLLPRLLLFSPAMARASVSGSAAAAKALLPLNPARGGSRLPSLLPARRLPAPGSGRAFRGASLRCYAAAAAAVAEQGRIKVQNPIVEMDGDEMTRVIWSMIKDKLIFPYLELDVKYYDLGILNRDATNDEVTVESAEATLKYNVAVKCATITPDETRVKEFKLKSMWRSPNGTIRNILNGTVFREPILCKNIPRILSGWKKPICIGRHAFGDQYRATDMIIDGPGKLKMVFVPEGAEAVELDVYDFKGPGVSLSMYNVDESIRAFAESSMAMALSKRWPLYLSTKNTILKKYDGRFKDIFQEVYEENWKEKFEENSIWYEHRLIDDMVAYAVKSEGGYVWACKNYDGDVQSDFLAQGFGSLGLMTSVLLSSDGKTLEAEAAHGTVTRHFRLHQKGQETSTNSIASIFAWTRGLEHRAKLDKNDRLLDFTHKLESACVETVESGKMTKDLALLIHGPKVSREFYLSTEEFIDAVAQQLRGKIQTPAVV

SEQ ID NO: 7603 - DNA, 1443 bp, Panicum virgatum
  misc_feature: Ceres CLONE 1917256
  misc_feature: Encodes the peptide sequence at SEQ ID NO. 7604
agcccatagccggccgggagtgggagatacttccatcaaggatagcacacaggatttttgttaaaaaaaaaaaaggatagcacacaggattcgcgccgcccgtgggaaaaggaggcgacgagtccacccacccgcattcgggctcgggcgccaccccgcgcacacaggattgccgctgcgcccgcggaccgccgtccactcgcggggccagagggagggagggaggggcggagcgatgggcgcgggggtggaggcggacgaaggggtgatggcgacggacttcttctggtcgcacacggacgagccgcacgcgtcgcgccgccgggagatcctggccaagtacccgcagatcaaggagctcttcggcccggatccgtgggccttcctcaagattgctgtgattgtttcacttcagctgtggactgctacattcctccgtgatgccagctggttgaagctcctgacagttgcctacttcttcggctccttcctgaaccacaacctgttccttgctatccatgagctgagccacaacctcgccttcacgaccccgtccctgaatcgctggctaggcatctttgcaaacctccccatcggtgtccccatgtccataaccttccaaaagtaccacctggagcaccaccggttccaaggcgtggacggcatcgacatggacatccccagccaggcagaggcgcacgccgtgaagaacgccatcagcaagtccgtgtgggtggtgctccagctcttcttctacgcgctgaggccgctgttcctgaagccgaagcccccaggcctgtgggagttcaccaacctcgccatccaggtcgcgctggacgccggcctggtctacctccacggctggaggtcgctggcctacctgatactctcgacgttcgtcggcggcgggatgcaccccatggcgggccacttcatctcggagcactacgtgttcagccccgaccaggagacctactcctactacggccccctgaacctgatgacctggcacgtggggtaccacaacgagcaccacgacttcccgaggatccccggcacgaggctgcacaaggtgaaggagatcgcgccggagtactacgagagcctgaggtcgtacaggtcgtggagccaggtgatctacatgtacatcatggaccagacagtcgggccgttcagccggatgaagaggaaggcgccgaagaaagactcgtagttgatggacctcctcctgcctgcgggtggaattttttttgtgtgtcgtctatgaactctattagagatgtttctgttggtgtaaacctgacgatccgttggaactgcgtgctatcacaagttttgcgagtaatttttacacgttccagaggtatactttccattatgtgtcacttggtgtatggtgaattagaaatggccacggttctttaaaaaaaaaaaaaaaaaaaa

SEQ ID NO: 7604 - protein, 325 aa, Panicum virgatum
  misc_feature: Ceres CLONE 1917256
  misc_feature (1)..(210): Pfam Name: FA_desaturase Pfam Description: Fatty acid desaturase
MGAGVEADEGVMATDFFWSHTDEPHASRRREILAKYPQIKELFGPDPWAFLKIAVIVSLQLWTATFLRDASWLKLLTVAYFFGSFLNHNLFLAIHELSHNLAFTTPSLNRWLGIFANLPIGVPMSITFQKYHLEHHRFQGVDGIDMDIPSQAEAHAVKNAISKSVWVVLQLFFYALRPLFLKPKPPGLWEFTNLAIQVALDAGLVYLHGWRSLAYLILSTFVGGGMHPMAGHFISEHYVFSPDQETYSYYGPLNLMTWHVGYHNEHHDFPRIPGTRLHKVKEIAPEYYESLRSYRSWSQVIYMYIMDQTVGPFSRMKRKAPKKDS

SEQ ID NO: 7605 - DNA, 1087 bp, Panicum virgatum
  misc_feature: Ceres CLONE 1917335
  misc_feature: Encodes the peptide sequence at SEQ ID NO. 7606
aagaaaaagccgaaattttagtgcgcagaccggagcctccacggaatcctgctctgtttttttccccgtggcccatggattcctcccgctgagctgagcgccgagggccgcccgacgcggcctctgatgagcgcggcctcgccggcggcgcggcggcgatggacctcccgtggctggatctgcccttcaccttcctcacgcttctcctcgccacgcgcctcgcctacgactactacggcgacgtcgctgcggccttcgccggcggcttctccatccaggtcttcctcttctactgcttcgcgcgctggtaccgccacgccatcgaggggcgcgccgccgcggcgggccgcgacgacccgtcgccgtcgaaccggcagcagcaggggggcgcggacgcggaggccccgcccgtcctgaccccgctgctgggcgcgcccggcggcgtgcgcgcgtcgactctggccagccggtgcttcgccgtggtcttcatggtgttcgtgccgctggtcatcgtcgtcttcgagcgcagccaggcggacgtcgtcgcctacgcgctctgcctcgccaacatcatcgtcatggtcgtctggctctcgccggacgccgggcccgcggccgccgccgccaagtcgctcctgcgcctcagcgacgacgaggacgacggcagcacgggcagcgccggcgccgacgacaagtgctgcgtctgcctcgccggcatgcgggaggaccaggagctccgggagctgccgcgctgcgggcaccgcttccacgacaagtgcatcggcaagtggctcaaggcgcacccgacgtgcccggtctgccgggccacggccgtgccgccgccgcaggagggcggcgacccgctcgacgacgacattagccccgtctagcgctctagctatcgttccccatgtttgattggtgcatctcgtctgacaaattcgtggtggtttgttgggaaatttgctgaacctgtgtatagttattatcgaaatcgctgttaggcatcgattggaattgttagcagtgcagtgatgtgtaaatacactcgtttttgtgcactttggaaaaaaaaaaaaaaaaaaaa

SEQ ID NO: 7606 - protein, 243 aa, Panicum virgatum
  misc_feature: Ceres CLONE 1917335
  misc_feature (1)..(42): Pfam Name: zf-C3HC4 Pfam Description: Zinc finger, C3HC4 type (RING finger)
MDLPWLDLPFTFLTLLLATRLAYDYYGDVAAAFAGGFSIQVFLFYCFARWYRHAIEGRAAAAGRDDPSPSNRQQQGGADAEAPPVLTPLLGAPGGVRASTLASRCFAVVFMVFVPLVIVVFERSQADVVAYALCLANIIVMVVWLSPDAGPAAAAAKSLLRLSDDEDDGSTGSAGADDKCCVCLAGMREDQELRELPRCGHRFHDKCIGKWLKAHPTCPVCRATAVPPPQEGGDPLDDDISPV

SEQ ID NO: 7607 - DNA, 940 bp, Panicum virgatum
  misc_feature: Ceres CLONE 1917377
  misc_feature: Encodes the peptide sequence at SEQ ID NO. 7608
gagcaccagccatggaacccgcggtgggaggtgcgggtcggcagcgccagaacaaagcctcggcgggcaagaaagcaaagaagggaggcggcgaaggcggcagatggccggcggtcaagcccaagaaggatctccagatcaatcgcctcaagggctcccacctcctcaccattccagacttcttcacttccgccgaggcgaaggctttcattgatgtcgccgagtctatgggcttcactcaccagggcagtttgggaccactaaagggggaggcttacagagacaatgatcgtatatctgtgacagatccattgctttctcaagccatttgggaatcaggaataaacagaatatttacagacatcaatatctctggcaaagcagctacaggattgaatccaaatatcaggttctacaggtacactgaaggtcagcgttttggtaggcatatcgatgagagtgttgacctcggggatggttctaaaacgtattatacgctgttgatatacctttccggcaaaggcagtgcaaaggattcatcaggacaagctcttgttggaggggagactgtattttatgatcagagaggtggaattgtcgccgaggttgctccagtgcaaggaatggctctcctccacttacatggcgccaaatgtatggtgcatgaagcccgggttgtgaaaaagaacgccaagtatgtactccgttcagatgttgtattttcttagctaaagaagtgcctcaagcttttgtttcagatcagctacccgtctatggcacaatggatctgggaagtacttctagttagtttcccattttatacattgatacatgattcatgtaaccattgcagtgttggaagaaatcttttgacatcagaatcatgttttcttttctgttgctgaatttgctattgcttgaaaaaaaaaaaaaaaaaaaa

SEQ ID NO: 7608 - protein, 238 aa, Panicum virgatum
  misc_feature: Ceres CLONE 1917377
  misc_feature (1)..(102): Pfam Name: 2OG-FeII_Oxy Pfam Description: 2OG-Fe(II) oxygenase superfamily
MEPAVGGAGRQRQNKASAGKKAKKGGGEGGRWPAVKPKKDLQINRLKGSHLLTIPDFFTSAEAKAFIDVAESMGFTHQGSLGPLKGEAYRDNDRISVTDPLLSQAIWESGINRIFTDINISGKAATGLNPNIRFYRYTEGQRFGRHIDESVDLGDGSKTYYTLLIYLSGKGSAKDSSGQALVGGETVFYDQRGGIVAEVAPVQGMALLHLHGAKCMVHEARVVKKNAKYVLRSDVVFS

SEQ ID NO: 7609 - DNA, 1243 bp, Panicum virgatum
  misc_feature: Ceres CLONE 1917412
  misc_feature: Encodes the peptide sequence at SEQ ID NO. 7610
ataccggctgtttccctccctctctctcaccaaatgtcgtcaccgccgccgccgccgccgccgcctccggccgaggcccgcctggccatgatggagctggccaacatgatctccgtcccgatggcgctcaccgccatcatccgcctgggcgttccctccgccgtctgggccggcggcgccaacgcccctctctccgccgccgagctcctcccggagggccacccggacccgtccgtcctggagcgcctcctccgcctgctagcctcccgcggcgtcttctcggagcacggcggctccccgcggcggttcgcgctcacggcggtggggcggaccctggtgccgggccccacgggcgcgtcctacgccgactacgtgctgcagcaccaccaggacgcgctggtggcggcctggccgcgcctccacgaggccgtgctcgaccccgccggccccgagcccttcgcgcgcgccaacgccggcgtgcccgcctacgcctactacggcaaggacagggaggccaatcaggtgatgctccgggccatgaccggcgtctccgagcccttcatggacgcgctgctcgacggctacgcccaaggcttccacggcgtggccacgctggtggacgtcgggggcagctccggggcctgcctccagatgatcatgcgcagggtcgccaccatcaccgagggcatcaacttcgacctgcccgacgtcgtcgccgcagcgccgcccatcgccggagtgcggcatgtgggtggagacatgttcaagtccatcccctccggcgacgccatattcatgaagtgggttctgacgacgtggaccaacgacgagtgcacggccatcctgaggaactgccacagcgcgctgccggccggcggcaaggtcatcgcctgcgagccggtggtgccggaagagacggacaccagcaccaggaccagggccctgctcgagaacgacatcttcgtcatgaccacctaccggacgcaggggagggagcgctccgaggacgagttccgccgcctcggcctcaccgccggcttcaccggattccgcgccatctacctcgacccattctatgccatcctcgagtacaacaagtgactcaacttgatccatcccttgtgttttcctttctttccactttaaattccttgtgacagttgagtcgaacagcatacttgtaataagaaataaggaatcatgctctttgaaccagagaaagtaaaaaaaaaaaaaaaaaaaa

SEQ ID NO: 7610 - protein, 355 aa, Panicum virgatum
  misc_feature: Ceres CLONE 1917412
  misc_feature (3)..(254): Pfam Name: Methyltransf_2 Pfam Description: O-methyltransferase
MSSPPPPPPPPPAEARLAMMELANMISVPMALTAIIRLGVPSAVWAGGANAPLSAAELLPEGHPDPSVLERLLRLLASRGVFSEHGGSPRRFALTAVGRTLVPGPTGASYADYVLQHHQDALVAAWPRLHEAVLDPAGPEPFARANAGVPAYAYYGKDREANQVMLRAMTGVSEPFMDALLDGYAQGFHGVATLVDVGGSSGACLQMIMRRVATITEGINFDLPDVVAAAPPIAGVRHVGGDMFKSIPSGDAIFMKWVLTTWTNDECTAILRNCHSALPAGGKVIACEPVVPEETDTSTRTRALLENDIFVMTTYRTQGRERSEDEFRRLGLTAGFTGFRAIYLDPFYAILEYNK

SEQ ID NO: 7611 - DNA, 1392 bp, Panicum virgatum
  misc_feature: Ceres CLONE 1917449
  misc_feature: Encodes the peptide sequence at SEQ ID NO. 7612
ggagcgtttacttgtgctgcgtgcgtacttgccccgttgcccgtagcatgtttgcattggggtttgaagcgttcgcttcatgtcctcggcttgccgcttgcgcaccgcccctgcccctgccgatgccgtggcagcagccttggttgacgcgcgcgctccatctccgccagccgcagcgcccctgccgtgtgccccgcgctataaatcccccacgccgcgccggccctcggctcatctcccaaaccccgaccagacaaaaagtaacaacagcaaccagcgcgcatgggtcgccgtccatccctcggcctcgcccccgccgccgcggcggccgcggctgtcctgctgctcatcgcggccgcggcgccggccgccagggcgcaggaggagacggaggacgagcacgagttcagctacgacccccgcgacgcgcacgggccggcgcgctggggcgcgatcaaggcggagtgggccaactgcagcgcggggcggatgcagtcgcccatcgacctctcccacgagcgcgtcacgctggcgcgcgccctcggctacctcgaccacgcctaccgcgccgccgcggcctccatcgtcaaccgcggccacgacatcatggtgcggttccggggcgacgccgggagcctcgtgatcaacggcacggcgtaccgcctgcggcagctgcactggcacacgcccacggagcacaccgtcggcggccgacgctacgacatggagctgcacctcgtgcacgagagcgccgcgggtaaggcggcggtggtcggcgtcctgtacgaggtcggcgccgcccccgacccgttcctgcgcgcgatggagcccgccgtccgccggatcgccgaccgccgggacagggaggaggacgtcggcgtcgtcgacccgcgccgcgcgcgcggccgcgccagcgtctactaccgctacatgggctccctcaccacgccgccctgcaccgagggggtcatctggaccgtcgtcaagagggttcgcaccgtgtccaagtaccagctggagctgctcagggaagccgtgcacgacgacatggagaagaacgcgaggccgctgcaggaggtgcacgaccgggacatcagcatcttccgtccaaagccccacaagcactactagctagctaggtccagcagcttactgtcagtgatgcatgagctgacgtggacaccccggttgtttcagaattcagagctagagaataatatacatacatacgtacgggtggcattcgattcgttggagatggttcggtctggtcctccggaagagatgtagatgacgggtatctttttttttttgtttttagtaattctttgtacctctgttatgtgactaaataaagcatcacttcatgcccaaaaaaaaaaaaaaaaaaaa

SEQ ID NO: 7612 - protein, 282 aa, Panicum virgatum
  misc_feature: Ceres CLONE 1917449
  misc_feature (3)..(228): Pfam Name: Carb_anhydrase Pfam Description: Eukaryotic-type carbonic anhydrase
MGRRPSLGLAPAAAAAAAVLLLIAAAAPAARAQEETEDEHEFSYDPRDAHGPARWGAIKAEWANCSAGRMQSPIDLSHERVTLARALGYLDHAYRAAAASIVNRGHDIMVRFRGDAGSLVINGTAYRLRQLHWHTPTEHTVGGRRYDMELHLVHESAAGKAAVVGVLYEVGAAPDPFLRAMEPAVRRIADRRDREEDVGVVDPRRARGRASVYYRYMGSLTTPPCTEGVIWTVVKRVRTVSKYQLELLREAVHDDMEKNARPLQEVHDRDISIFRPKPHKHY

SEQ ID NO: 7613 - DNA, 1086 bp, Panicum virgatum
  misc_feature: Ceres CLONE 1917451
  misc_feature: Encodes the peptide sequence at SEQ ID NO. 7614
agcaatcgctctcccccactcacacacttttaagcaatcgctctcccctcccgtctcgcgcctcaccaccggcgacctcaccgccggcggcgcggcgcggcaaaccgggcccttcttccaccgcaatcgtttttcgcctggcggcgtctgcaacctcctctacccgcgcgggtggagatccgtcatcccgtttctactttcgccgcgcgcagcaccaatccccttgggccttgggtttgaagaaggatcaggatcttcgttcatccgtggagacatttcctctccctacgtttgatgcatctttttgtgatggaccactcctctcagttcagtggttatggagcctcccatgaagcataagcccagtgctgtgccaatcaacacttcagaggaggaagtggggttacaagatagaaatactgagttagtcaagcgcaggaagactggattttcagggtccattgtccaaccacaacaggaaattgaagtctctgccatggagaacaatgttcccgatggtcttccagttgaagtttctactggcaacgatcccatggatgtactcactgattgtgcagtgcaaagctctggtgaagcgaatagtcgcagcgaggggcgcgttcgtagtatctcatttacagttaatgggccagcaaggttgaggttgccaaaaatatgcgctgcatttggctggaaagaaccatcatttgacttcgaaaagcaaggacctcctcacaacatattgttcacttgcaaggtgactgtccgcttagagggacttgtcaacactgtcatagagtgcttcggtgaccccaagcctcaaaagaaagccgcacaagaccatgctgctcaaggggccttgtggtgccttgagcgatttggacatatcaagcaatcttcggatgcgtaggcactgtcacaccccgaaattttcaaatttctggatgtgactaaaataaataataaaaccacaattttctcaggtttttaaaattttcacaacattttcttttgttcgcagggaatttagtaaaaataagtaaagtttgtgtgattttcaaaaattaaaaaaaaaaaaaaaaaaaa

SEQ ID NO: 7614 - protein, 190 aa, Panicum virgatum
  misc_feature: Ceres CLONE 1917451
  misc_feature: Great-hit functional homolog of the protein sequence given in SEQ ID NO 9609
  misc_feature: Useful for making plants with altered alkaloid content
MEPPMKHKPSAVPINTSEEEVGLQDRNTELVKRRKTGFSGSIVQPQQEIEVSAMENNVPDGLPVEVSTGNDPMDVLTDCAVQSSGEANSRSEGRVRSISFTVNGPARLRLPKICAAFGWKEPSFDFEKQGPPHNILFTCKVTVRLEGLVNTVIECFGDPKPQKKAAQDHAAQGALWCLERFGHIKQSSDA

SEQ ID NO: 7615 - DNA, 1951 bp, Panicum virgatum
  misc_feature: Ceres CLONE 1917515
  misc_feature: Encodes the peptide sequence at SEQ ID NO. 7616
aaaccgccgaaacctccccctccgtctcgtcggcgcatctcgcacggtcgcccctcctccgatattccctgacctgatggatcccaaggcggcggcgaagtcgaagcgctcgcacacggtgcacggccgccgcgcccaccagactcccgccgcggcggcagcgcacaggcagaagcgcgccgccgccgccacctcttctggcccccgcagtcgaaacctcccctcgaactgggaccgctacgacgacgagggcgaggcggaggaacctgcttctgccgcggaatggacaggcgaagtggctccgcgcagcaagggcgccgacttcggattcctgctagagcaggcgcgagcgcagccccgcgaggcccggggcctcagggcgccgtggctcccctcccaggatttgccatttgattttatgcaggcctccacatctatgttcgaagctaaaggtgaagggatcttgtcctggtgtgctgatgataacttcatattagaggatgatttagccccagacttcgaggtgccttttctctcaatggatttgcatgcattggccaaccagctttcgaagcttaagctttcacagagactttttttagaagaagatctactaccagaggatctggctgctgtatcagaagacaatgaaatactgattgaatgtggcacctctgtggaaagtgatcccaaaggaagttcggttggggataacttgaactttgagccaaggaaagacgcaagtcattatgagtatgctggcaacacctattctgatgatcaaatgaaatcagaacatcagtcccaatgttttgaacatgaagctacaacatcacccaagattagtactcatttagtgaattcagacagtgaagacgataaggcatatacaagaaccatggatactgatcctagtacaaggcatagcgataggttagagttcgaggtgggttctgcagaagaacttgacatgctcctcaattcgtttagtggaactcacctttctagctccaacttggatgaattggttggacatgattcaacttcccaaggtacaaagatcagttggtcagacaagaaaggtacacttagcaagtcttccaaatcacctgcgcttgcacctgtggacgatgctctagatgacttgctttcagagacttccctacctgtacagaatgaaggttttgctacacaaagttcaacttcccaaccaactgttaaatctggccagaactttgacttcagatatgctaagaaggttgatgtgatagcatccattgatgattcactggataatttgcttgaagacactccatcgtgcttaagtgagccaaaggaaactacaactgcacaaggaccaaacagcacgtcacatgacagtggcccccctcagtctggccccccaaatgcatcagatgattttgattcatggttcgattccctataggggagaaaagggttggtgctgtgaggaagtgatggctgacttctggattcctctctgcgatgcagaagtcttctatacctttcttccctccattcttgaatctaactggtaaacatattcaggagctgtattccgaagttctcgtttctatatggaggtccactagagaactatcttaatattaagttttaatgggaaacgatgaggtggatagggcatggtataaaagctaaagaagtaaagatcatctgtggctggctgctgtgaaatttgaagcatcggatatgtaacactgaacttagcatgtttttgctattgtaccattgtctgtaacctgtctcagaagcaggctgatgcaaacatttcacagaagtatacttaaagcttgctccgttattcagtcggtttactgatgtgcaataatttatgataagtacatgtatataatctttagaaccagtgcgactaacagttggtgcttctcaaaaaaaaaaaaaaaaaaaa

SEQ ID NO: 7616 - protein, 456 aa, Panicum virgatum
  misc_feature: Ceres CLONE 1917515
  misc_feature: Great-hit functional homolog of the protein sequence given in SEQ ID NO 9482
  misc_feature: Useful for making plants with modulated nitrogen use efficiency
MDPKAAAKSKRSHTVHGRRAHQTPAAAAAHRQKRAAAATSSGPRSRNLPSNWDRYDDEGEAEEPASAAEWTGEVAPRSKGADFGFLLEQARAQPREARGLRAPWLPSQDLPFDFMQASTSMFEAKGEGILSWCADDNFILEDDLAPDFEVPFLSMDLHALANQLSKLKLSQRLFLEEDLLPEDLAAVSEDNEILIECGTSVESDPKGSSVGDNLNFEPRKDASHYEYAGNTYSDDQMKSEHQSQCFEHEATTSPKISTHLVNSDSEDDKAYTRTMDTDPSTRHSDRLEFEVGSAEELDMLLNSFSGTHLSSSNLDELVGHDSTSQGTKISWSDKKGTLSKSSKSPALAPVDDALDDLLSETSLPVQNEGFATQSSTSQPTVKSGQNFDFRYAKKVDVIASIDDSLDNLLEDTPSCLSEPKETTTAQGPNSTSHDSGPPQSGPPNASDDFDSWFDSL

SEQ ID NO: 7617 - DNA, 1290 bp, Panicum virgatum
  misc_feature: Ceres CLONE 1949437
  misc_feature: Encodes the peptide sequence at SEQ ID NO. 7618
aatttcccctccctgcccgtgcgcgaatccgaagatggaacggagcgaaatgcccagggtgaagcttggcacgcagggcctcgaggtgtccaagcttgggttcgggtgcatgggcctcactggagtctacaacgccccggtccctgaggaaaccggaatcgctattatcaagcacgcgtttgaggccggtatcaccttcttcgacactgcagatgcctacgggccacacaccaacgagatcctgcttggaaaggcacttaagcattttccccgtgagaaggtacaagttgccaccaaatttggcattgctggattcgatgtcagtggcatgcgtgtgaagggcactccagattatgttcgagcatgttgtgaagcaagtcttcagcgccttgctgttgattacattgatctctactaccagcatcgcattgatcagtcagtgcctatagaggaaactatgggggaactcaaaaagttggtcgaagaagggaaagtgaaatatgttgggttgtcagaggctagtgccgataccattcgtcgcgcacatgcagttcatccagttactgcagtgcagttggagtggtcgctatggaccagagatatagaggaagatataataccagtctgcagggagcttggtatcggaatagttccatacagcccacttgcccgtggcttctttgctggcagggcagctgtagagagtgtaccgtcagaaagtttgttgtctaaacatcctaggtatactggggagaacttggagaagaataaagttctgtatacacgacttgaaatgttgtccaagaagtatgggtgcagccctgctcaacttgctctctcctgggttcttcatcaaggagaagatgtcgtcgcaatccctggaacaacaaaagtgaagaaccttgatgataacattggtgctgtaaaggtaaagctaagcaaagaaaacctcgaagaaatctcagctgctgtccctgctggtgtggtggccgggtccagacttctgggagtcctggagccttattcttggaggcttgcaaataccccacttccaaaatagccacttcacatcttcaagtgcaatttcatggtggtccgatcatttatactgtgttgtatttattcatatctacatgaaagaaacagcattattcatttgcttgtgaaatgagtgtacctctcttgcttgcgaaaaaatgattgtacctgaaggaagagatattatcactggcattctgtaccatattgctatactagatcaatgaaacaagtcggatataagttgaagtc

SEQ ID NO: 7618 - protein, 341 aa, Panicum virgatum
  misc_feature: Ceres CLONE 1949437
  misc_feature (1)..(303): Pfam Name: Aldo_ket_red Pfam Description: Aldo/keto reductase family
MERSEMPRVKLGTQGLEVSKLGFGCMGLTGVYNAPVPEETGIAIIKHAFEAGITFFDTADAYGPHTNEILLGKALKHFPREKVQVATKFGIAGFDVSGMRVKGTPDYVRACCEASLQRLAVDYIDLYYQHRIDQSVPIEETMGELKKLVEEGKVKYVGLSEASADTIRRAHAVHPVTAVQLEWSLWTRDIEEDIIPVCRELGIGIVPYSPLARGFFAGRAAVESVPSESLLSKHPRYTGENLEKNKVLYTRLEMLSKKYGCSPAQLALSWVLHQGEDVVAIPGTTKVKNLDDNIGAVKVKLSKENLEEISAAVPAGVVAGSRLLGVLEPYSWRLANTPLPK

SEQ ID NO: 7619 - DNA, 1174 bp, Panicum virgatum
  misc_feature: Ceres CLONE 1949456
  misc_feature: Encodes the peptide sequence at SEQ ID NO. 7620
aacaaagcccatccaacaaacaaaccttgagtcgcttggctgacagagaagagacacaaaccgagcgtctgtagctttgcctgtggccggccaagcatggccaccgtggggcagcctggcgccctgagaaggatcaccgtgcactacgccaactcgcccacgcgcagcacgggagatgcggaccttgacgagctagaagaagacctgctccagtctgtgttcgctgatcttcttccttgtcaggagggtttgcaccaatccatcttggaagaagcatccagcaaccaaaaccacatgagaggtgccccatctgataattcacagtcacagcactaccatggggagagcagcactgccgcagcagcatcagcgactgcctccggaacttcaggaacggaagaacagatcgcctcggactttgagtacgccaagctactgcaggagatggaggacctgagcatcgaagatgacgatatcagttgcgtaccctctccatcagactctgacgatgaccatgaccatgaccataacgacgaagaggctgacaggcaggatggtaatgatgatgatccagacaacatgacttacgagcaaaggcaagcactcgtggaagctgtggggactgaggacagaggtttacctgatgagctcatctcctatctgcacacatggaagtacaaggcttcagggtttttctccaggaagacaaccaatgaagactgtcctatctgcctgtctactttcagacaccgagaaagtatgattacattgccgtgcgagcattactaccacgcagcttgtgtcaccaaatggctcaaggtcaataagacctgccctgtctgcaaatatgaaccgtttggaccttgctagcatgtggccacgaagcagatacacgatgacgtcacacccagcttgttgcaacagctattcagctacctttttagtgccagtaaactgaaaatgaaaaaaaaagttaatccaaaaggaaaaaacaaaaaatagcaaatatagatgcttgatcactcgaggaaaagaccccaaaaaaaattgatcccgatttctgacagtatttttcttttacatttggatttttggcttgtggaaatgtacttaagaatcacaatcttatatatgtgagaagactgtttttctctaaaaaaaaaaaaaaaaaaaa

SEQ ID NO: 7620 - protein, 257 aa, Panicum virgatum
  misc_feature: Ceres CLONE 1949456
  misc_feature (1)..(41): Pfam Name: zf-C3HC4 Pfam Description: Zinc finger, C3HC4 type (RING finger)
MATVGQPGALRRITVHYANSPTRSTGDADLDELEEDLLQSVFADLLPCQEGLHQSILEEASSNQNHMRGAPSDNSQSQHYHGESSTAAAASATASGTSGTEEQIASDFEYAKLLQEMEDLSIEDDDISCVPSPSDSDDDHDHDHNDEEADRQDGNDDDPDNMTYEQRQALVEAVGTEDRGLPDELISYLHTWKYKASGFFSRKTTNEDCPICLSTFRHRESMITLPCEHYYHAACVTKWLKVNKTCPVCKYEPFGPC

SEQ ID NO: 7621 - DNA, 1109 bp, Panicum virgatum
  misc_feature: Ceres CLONE 1949480
  misc_feature: Encodes the peptide sequence at SEQ ID NO. 7622
acacctcgtccgtgtccgtccagccgctgtggatgacgctcgcagcgagcgcacgctcgtgccgtctcccactcccctccaaaggttggagatggcaaagcacggttgctacatggaaacataagcgttctggccaacataatgcggtcataacatttgcgacaaagagtactaaaagggaaaggataaattttcagaagaagtcaaaagattcactgttgacaagtgatgaagcttcttcaggcggtggaggaagcgccagcacaagcctcaaggtcaatagcgaggaagttgctgctactgatgatcaaatttcaggtgccccaaggactgctgttcttcaggcatgcactatcacatcaggcttgctgcttgctggaggacttctgcttcgccaggcatcacaccttgcatctttaaatggatggccaatttctgatcctacagatgtttcattcaattttgaaacgtggcatctcgagttggtagcagggcttgtaatagtaatctcctctagcagatacattctgctacaaacatggtcagatttcagagattccagtgaagctgcaaatacacaaatccttagttcgctagagcctttggactacattgttgttgcttgtctccctgggataagtgaggagttgctctttcgaggggcactgatgcctatcttgggattgaactggattagtgcccttataatcggaaccatttttggtgttcttcacttgggcaatggcaggaaatattcatttgcgatctgggcaacatttgttggctttgcctatggtataggagccatagcttcctcgagcattatagttccaatggcttctcactccgtaaacaatattattggaggtttactttggtgctttaccaagaactcacaaaaataaatatataataccctcagtagtcatccctggaagatcttgcactagtttagcctcaccttactagttctgttgttacttataactactggcgttccactgttgcttcattcatgtattttcagtagcttgtagtaattttccatgttctcgtttgcctacgaccataaggaaaatgaagttaaacaaaaaaaaaaaaaaaaaaaa

SEQ ID NO: 7622 - protein, 290 aa, Panicum virgatum
  misc_feature: Ceres CLONE 1949480
  misc_feature (1)..(92): Pfam Name: Abi Pfam Description: CAAX amino terminal protease family
MTLAASARSCRLPLPSKGWRWQSTVATWKHKRSGQHNAVITFATKSTKRERINFQKKSKDSLLTSDEASSGGGGSASTSLKVNSEEVAATDDQISGAPRTAVLQACTITSGLLLAGGLLLRQASHLASLNGWPISDPTDVSFNFETWHLELVAGLVIVISSSRYILLQTWSDFRDSSEAANTQILSSLEPLDYIVVACLPGISEELLFRGALMPILGLNWISALIIGTIFGVLHLGNGRKYSFAIWATFVGFAYGIGAIASSSIIVPMASHSVNNIIGGLLWCFTKNSQK

SEQ ID NO: 7623 - DNA, 1063 bp, Panicum virgatum
  misc_feature: Ceres CLONE 1949762
  misc_feature: Encodes the peptide sequence at SEQ ID NO. 7624
gacccgccctcccatttcgtctcttgtgtctcttcctccgttttcctctgcgcacacctgatttcctggtggccccacgcccccacctgccaaacactcggacttggcaaactaggacctttcttccctgctgcattcggctctgctctatccactctgctcacaaagggggctaggagtagactggagatttggggcttcacctactactgtatctcatcgtcatctgttagttcaattaccctgctactgctgattgaagaagacgaggaagcagcgtccatggagacagcgaggcccatcctgtacaacgcctggatcagctcctgctcccaccgtgtccgcatcgctctcaacctcaaaggtgtggactatgagtacaagtcagtaaatcccaggacagatccagattttgaaaaaatcaacccaataaaatatattcctgcactagtagatggggacatagtcgtttccgactctcttgccatctcattgtatttggaagtcaaatatcctgcacatcctctcctgcctaaagatccgaagaggaaagctcttaatcttcagattgctagcatagtttgttcaagcattcaacctcttcaaggctatgccgttattggtttgcatgagggaagcatgagccctgatgagagccttcaaattgttcagcgttatactgacaagggattcagagcgattgaaaagcttttggatggatgcgagagtaaatatgctactggagatgatgtccaattgggtgatgtgtttctagagccgcagatccatgccggcataaatcacttccaaattgatatgtcaaagtacccgattttggcaagacttcatgatgcatacatggaaatccccgcatttcaagctgcgcttcctaaaaatcagccagatgcaccatcgtcgtaaagaatcaagattaccatgctacatcgaaatgcatgcttttcattttcgataataagttggaagagtttgtttaaacaataataatttggaaggatggtaactgcttcagcactgggttggatgttagcttacccattcatgc

SEQ ID NO: 7624 - protein, 212 aa, Panicum virgatum
  misc_feature: Ceres CLONE 1949762
  misc_feature (1)..(93): Pfam Name: GST_C Pfam Description: Glutathione S-transferase, C-terminal domain
  misc_feature (2)..(71): Pfam Name: GST_N Pfam Description: Glutathione S-transferase, N-terminal domain
  misc_feature (1)..(212): SWISSPROT Homolog: EC 2.5.1.18 Glutathione S-transferase
  misc_feature (8)..(211): SWISSPROT Homolog: EC 2.5.1.18 Glutathione S-transferase zeta class
METARPILYNAWISSCSHRVRIALNLKGVDYEYKSVNPRTDPDFEKINPIKYIPALVDGDIVVSDSLAISLYLEVKYPAHPLLPKDPKRKALNLQIASIVCSSIQPLQGYAVIGLHEGSMSPDESLQIVQRYTDKGFRAIEKLLDGCESKYATGDDVQLGDVFLEPQIHAGINHFQIDMSKYPILARLHDAYMEIPAFQAALPKNQPDAPSS

SEQ ID NO: 7625 - DNA, 1052 bp, Panicum virgatum
  misc_feature: Ceres CLONE 1949811
  misc_feature: Encodes the peptide sequence at SEQ ID NO. 7626
ggatgaaaattgagagagagagaagactgcgatagcgtccgtcgagccggtggcggcgaagatgcggaagaagctcggcacccggttccccgcggctcggataaaaaagataatgcaagcagatgaggacgttggcaagattgcactagccgtgcctgttttagtttcaagggctcttgaattgtttttgcaagatttgattgatcggacctatgaaattactcttcagagcggtgcaaagactttgaattccttccacctgaagcaatgtgtgaaaaggtacagttcttttgatttcctaactgaagttgtcaacaaggtaccagaccttggtggtgcagactcttgtggggatgaaagagggttacctagaagaagaaagtcaaatggcagtgacccagagaatgatgaatcaagatccagcaaaatggtcataagaagtgcgaacatcagccctagaggacgtgggagaggtcgaggccgggggcgaggcaggccaccaaccaagagaaaggaagttggttatgtacaatttgaggatgagagcggcatgtttgctgaacaaggtgaacctttaccaggagacgagacagttccagagagcaaccatagcaatgaaaacataacccaaagtgcagaacctccagtagaggctcccgcaccagcagctgcgccaggtgcatctaaggtggaagaagcgtatactgaccatcagtcagattggccaatgccagatgctgccattggaaacattggtgtcggtccatctggttttgggcatctgacggtgcaggttgatgaggatgaggactacgacaacgaggattagtcatggtcgtcctcattgtatgcactaacaggactgttctggtgttgtaaaatgtaaatatagtctgaagtagttgccacagcttagctgtgatgggctgctgatgtgatgcagttatgtagctgtcctgtttgacttttgttcccaataattgcttggtagttgcctcttattttacatgattgactacaagtgttttgtcaaaaaaaaaaaaaaaaaaaaa

SEQ ID NO: 7626 - protein, 255 aa, Panicum virgatum
  misc_feature: Ceres CLONE 1949811
  misc_feature (1)..(65): Pfam Name: CBFD_NFYB_HMF Pfam Description: Histone-like transcription factor (CBF/ NF-Y) and archaeal histone
MRKKLGTRFPAARIKKIMQADEDVGKIALAVPVLVSRALELFLQDLIDRTYEITLQSGAKTLNSFHLKQCVKRYSSFDFLTEVVNKVPDLGGADSCGDERGLPRRRKSNGSDPENDESRSSKMVIRSANISPRGRGRGRGRGRGRPPTKRKEVGYVQFEDESGMFAEQGEPLPGDETVPESNHSNENITQSAEPPVEAPAPAAAPGASKVEEAYTDHQSDWPMPDAAIGNIGVGPSGFGHLTVQVDEDEDYDNED

SEQ ID NO: 7627 - DNA, 978 bp, Panicum virgatum
  misc_feature: Ceres CLONE 1949903
  misc_feature: Encodes the peptide sequence at SEQ ID NO. 7628
gttctctgctctgcctacctctgctcatttctttcttccaccttgggccttggctatggcatccagcgtgtcccggttcattaagtgtgtcacggagggggacggcgccgtggggaagacctgcatgctcatctgctacaccagcaacaagttccccactgattacatacccactgtcttcgataacttcagcgcaaacgttgtggtcgacggcaccacggtgaacttgggcctttgggacactgcaggacaggaagattacaacaggttgaggcccctgagctaccgcggagccgatgtgttcgtgctcgccttctcgctcrtcagccgarctagctacgakaatgttgttaagaagtggctacccgagcttcsgcattatgcaccgggtgtccccatagttttggctggaactaaattggatcttcgtgaagacaagcactacttactcgaccatcctggtgcagtacctgttactacggcacagggggaggaacttcgcaagcacatcggagcaacatgttacatggagtgcagctcaaaaactcagcagaatgtcaaagctgtgtttgatgctgccatcaaggtagtaataaggcctccgacaaaacagagggaaaggaagaaaaagaaagcacggcggggatgttcaatattccgaatcatgcacaaaaggagactaggatgcttcaagtgatcgaaggccttattcgacgatcacataggtttccaaggcgaatcgagatcacgtgtaattgcatccaagtttcaaagtgcttgttgcgcttgcgcacttgcgccagtaatgtgtatatttacggctttagcaattgacttctaggagatatgtgaagtattttgtttgtttatgtaccaatccaatggctcataatgagttaggaagttcaatacatcctgagatgtaacgatatattcttccagtgagcctgactgttcatattaatttattcaaaaacg

SEQ ID NO: 7628 - protein, 213 aa, Panicum virgatum
  misc_feature: Ceres CLONE 1949903
  misc_feature: Great-hit functional homolog of the protein sequence given in SEQ ID NO 9499
  misc_feature: Useful for making plants with modulated nitrogen use efficiency
  misc_feature (90)..(90): Xaa is any aa, unknown, or other
  misc_feature (93)..(93): Xaa is any aa, unknown, or other
  misc_feature (96)..(96): Xaa is any aa, unknown, or other
  misc_feature (107)..(107): Xaa is any aa, unknown, or other
MASSVSRFIKCVTEGDGAVGKTCMLICYTSNKFPTDYIPTVFDNFSANVVVDGTTVNLGLWDTAGQEDYNRLRPLSYRGADVFVLAFSLXSRXSYXNVVKKWLPELXHYAPGVPIVLAGTKLDLREDKHYLLDHPGAVPVTTAQGEELRKHIGATCYMECSSKTQQNVKAVFDAAIKVVIRPPTKQRERKKKKARRGCSIFRIMHKRRLGCFK

SEQ ID NO: 7629 - DNA, 1026 bp, Panicum virgatum
  misc_feature: Ceres CLONE 1950034
  misc_feature: Encodes the peptide sequence at SEQ ID NO. 7630
aaaaaaaaaaaaaaaaaaaaaaaaaaaagcgacactagcctcttccttgctccttccctccctccccagcaaccgatcctcccctccgcctgctgctgcagcagcagccatggcggcctccacggcgctctccaccgccgccaaccccacccagctctgccgcccccgcgcctctcccaacaagccggcgaagggcctgggcctcgggacaggccgcgaccgcttctcccagcgcagcagcggcggcggcgtcacgtgccaggcggcgagcagcatccccgccgaccgcgtccccgacatggagaagcgcaagctgatgaacctcctcctcctgggcgccatctcgctgcccaccgccggcatgctcgtcccctacggctccttcttcatccccgccgggtccggcggcgccggcggcggcacctacgccaaggacaagctgggcaacgacatcaaggtggaggagtggctgcagacgcacggccccaacgaccgcaccctcgcgcaggggctcaagggcgacccgacctacctggtggtggagcaggacaagacgctggccacctacggcatcaacgccgtctgcacccacctcggctgcgtcgtgccctggaacagcgccgagaacaagttcatctgcccctgccacggctcccagtacaacaaccagggcaaggtcgtccgtggcccggcgcccctgtcgctggccctggtgcacgccgacgtcgacgacggcaaggtgctcttcgtcccgtgggtggagaccgacttcaggaccggcgaggacccctggtggaaggcgtaagcgggggcgctccggcggcggcggcgatcgcagtcacccagtgatgagctcatagcctttgcgttcctgtgttgctgcttctcagagggcgttatcgctataaattcacttgcttcttgcttgctgcctccagattatatgttgtacacagcacactgtatgaaacaagaacacttgcttctcatctgatctgcatatacataacctttctcgagactttg

SEQ ID NO: 7630 - protein, 231 aa, Panicum virgatum
  misc_feature: Ceres CLONE 1950034
  misc_feature (3)..(229): SWISSPROT Homolog: EC 1.10.99.1 Cytochrome b6-f complex iron-sulfur subunit, chloroplast precursor
MAASTALSTAANPTQLCRPRASPNKPAKGLGLGTGRDRFSQRSSGGGVTCQAASSIPADRVPDMEKRKLMNLLLLGAISLPTAGMLVPYGSFFIPAGSGGAGGGTYAKDKLGNDIKVEEWLQTHGPNDRTLAQGLKGDPTYLVVEQDKTLATYGINAVCTHLGCVVPWNSAENKFICPCHGSQYNNQGKVVRGPAPLSLALVHADVDDGKVLFVPWVETDFRTGEDPWWKA

SEQ ID NO: 7631 - DNA, 1595 bp, Panicum virgatum
  misc_feature: Ceres CLONE 1950046
  misc_feature: Encodes the peptide sequence at SEQ ID NO. 7632
acacgccctgcgtttctcccactcgcagtcgcagtcttgccttgcgcttgcgcccacacacccgtctctgggtcgatcgccagggagaggcagtgaccgcaagtgaatcgcgcacactaagatcgggcgttcctcctgtccatgggaggttttaggcggtggctgccgttcggcggcggcggcggcgggtgctgctgctgcggaggcggaggcggaggcggaggcaggggcgtggcggacgggctggtgtgggacgtgcccctcaaggcgcacgcgtcgggggactactccatcgccgtggcgcaggccaacgaggcgctcgaggaccaggcgcaggtgctctcggcgccgggcgccacgctcgtcggcgtctacgacggccacggcgggcccgaggccgcgcgcttcgtcaacaggcgcctcttctccctcatccaagattacgcggccgagaacggcggtctgtcggcggaggtgatccagaaggccttcggcgcgacggaagacgagttcgtgggcatggtgcagaagtcgtggccggcgcacccgcggatcatgtccgtgggctcctgctgcctggtgggcgccatcgagaacgggaccctctacgtggccaacctcggcgactcccgcgccgtgctcggccgccgcgacgccgccgcccccggccgggggaacaagcgggtggcggcggagcggctgtcccgggaccacaacgtcgccgacgaggacgtgcggcgggaggtggcggagatgcaccccgacgactcgcacatcgtgctcaacagccacggcgtgtggcggatcaagggcatcatccaggtgtcccggtccatcggcgacgtgtacctcaagaggcccgacatgtgccggggcaacccgatgctgcagcagtcgctgtgcccgttcccgctgcgccgccccgtgatgagcgccgtgccgtcgatcacgacccgggagctgcgcccgggcgaccggttcgtcatcttcgcgtccgacgggctgtgggagcagctcggcaacgacgacgcggtgggcatcgtggcgggcagcccaaggaagggcgtggccatgcgcctggtgcgcgccgcgcagctggaggcggcgcggaagaaggaggtcaagtacgacaagatccggaccatcgagaagggacaccgccggcacttccacgacgacatcaccgtcgtggtgctcttcctggacagctgccggggcgcggcgcggtccggcgccggggacatcggcggcacctacgcgcccgttgacgtgttctcctgcagccccgccggcgaccatcaccacgaggacccgaccaggcccgtcctgcggcgttgagttgagactgatcctggttggtgtgctgttctttcgttcggttcatgcgatttatttcgctcttgaaacgagaggtacgtgaatcgagttgcttcccgtaatcccgtttcaaggagaatttgcctgtaaagaaagaagtgtcatcgaacagacgaacatactacagtgtggtggtgatcatgtgtagcaaactgtaaacctccatctattccttccttcttttgttttaagagaatgtgaatgttctactgcactcc

SEQ ID NO: 7632 - protein, 398 aa, Panicum virgatum
  misc_feature: Ceres CLONE 1950046
  misc_feature (1)..(291): Pfam Name: PP2C Pfam Description: Protein phosphatase 2C
MGGFRRWLPFGGGGGGCCCCGGGGGGGGRGVADGLVWDVPLKAHASGDYSIAVAQANEALEDQAQVLSAPGATLVGVYDGHGGPEAARFVNRRLFSLIQDYAAENGGLSAEVIQKAFGATEDEFVGMVQKSWPAHPRIMSVGSCCLVGAIENGTLYVANLGDSRAVLGRRDAAAPGRGNKRVAAERLSRDHNVADEDVRREVAEMHPDDSHIVLNSHGVWRIKGIIQVSRSIGDVYLKRPDMCRGNPMLQQSLCPFPLRRPVMSAVPSITTRELRPGDRFVIFASDGLWEQLGNDDAVGIVAGSPRKGVAMRLVRAAQLEAARKKEVKYDKIRTIEKGHRRHFHDDITVVVLFLDSCRGAARSGAGDIGGTYAPVDVFSCSPAGDHHHEDPTRPVLRR

SEQ ID NO: 7633 - DNA, 875 bp, Panicum virgatum
  misc_feature: Ceres CLONE 1950077
  misc_feature: Encodes the peptide sequence at SEQ ID NO. 7634
actgcaactcttcaatggcggccggccggtcgatggttgggcggctctacctctccgtgtacaactgggttgccttctatggatgggcccaggttctgtactacgcaacgttagcattgttggccagtggacatgagactgtctatgatgctgttgagcagccactgctgttcgcacagaccgctgccttactggagattcttcatcctattttagggtttgtgagatcccccgtctctgcaactattccacaactttccgggaggttgtttgttacatggggcatcttgtggagctttgctgagacacattcccacgttctcgttacttccttggtcctaagctggtctataactgaggtcataagatactctttctttggtttgaaggaagcatttggaattataccttactggcacctatggcttaggtacagtacatttcttgtgttatatcctatcggtcttgtcagtgagcttggcttaatctatgctgcccttcctttcatgaaggcatctggaaaatactgtctcaagatgcctaacaagtggaatttccccttcagctactactatttttgtattattttatccatcctctacattccagggtttccgtacttgttccattatatgctcacccaaaggaagaaggccttatcaaaggcaaaagctgcataatacttcaaaagagcttcctagttctggagtatccagtaacctgagaatggtggctcttgtttgcaacttaatcttcagtggaagtctgcagactggggacttgttagaatactactcttatattattatctgttgccaacagtgtttgattgcgaacagtgtttcggtgtaacaaggaaaaaagttaaattttct

SEQ ID NO: 7634 - protein, 221 aa, Panicum virgatum
  misc_feature: Ceres CLONE 1950077
  misc_feature (1)..(165): Pfam Name: PTPLA Pfam Description: Protein tyrosine phosphatase-like protein, PTPLA
MAAGRSMVGRLYLSVYNWVAFYGWAQVLYYATLALLASGHETVYDAVEQPLLFAQTAALLEILHPILGFVRSPVSATIPQLSGRLFVTWGILWSFAETHSHVLVTSLVLSWSITEVIRYSFFGLKEAFGIIPYWHLWLRYSTFLVLYPIGLVSELGLIYAALPFMKASGKYCLKMPNKWNFPFSYYYFCIILSILYIPGFPYLFHYMLTQRKKALSKAKAA

SEQ ID NO: 7635 - DNA, 1364 bp, Panicum virgatum
  misc_feature: Ceres CLONE 1950096
  misc_feature: Encodes the peptide sequence at SEQ ID NO. 7636
aaaaaaaaatgtcctcatcagtcctcgccttgtcgcccagctcaccagggttttcagtcctcgcctcatccgacctcgtctccctcgcgagcatcgccctcgcgccgttccggccggttccgccatggcttccgacaggagcaaaacttcgaaaccagagaagctgtccgcagcagcgggtgccagcctccccaatccttttgatttttcttctattagtggcttgctcaatgatccagcaataagagagatggcagagcaaattgcaagtgaccctgtgttcaaccagatgcctgaacagcttcagaaaagtgctcagggtgctggtgaacagggcatccctgcactggatcctcaacagtacatggaaacaatgcaacaagtcatgcaaaatcctcagtttatgtcaatggcagagcgtcttgggaatgctcttatgcaggatcctgctatgtccagtatgcttgagaacttgagtagtccagctcataaggagcagtttgaagagcgaatggctcgtatcaaggaagatccatccttgaagccaatccttgatgagatagagaatggtggtccatctgcaatgatgaagtactggaatgaccctgagtttcttaaaaagattggccaggcaatgggagttaaccttccaggagattctagtgcttccactgaactctctggacctgaagaaactgaggaagaaggtggttatgatgatgagtccattgttcatcacactgccagtgttggtgatgcagagggtctgaagaaagctttagatggtggagcagacaaagatgaagaggatgctgagggaagaagggccttgcactttgcatgtggctatggcgagttgaagtgtgcagaaatccttctggaggctggtgctgcagttgacgccctggataagaacaaaaacactccgttgcattacgcagctgggtatggtcggaaggaatgcgtggatcttctgttaaagcatggtgctgctgtcacgctccagaatctggatggtaagacccccatcgaggttgccaggctcaacaatcaggatgaggttctcaagttgctggagaaggacgcattcctataagaacccctgggctaaagcgcatcaacttgtcaaactattggcttcaacattggttcattttggttcggagtggtcgtgcataacttgtgaattcgatggtttttttcatggcgatgccccgcatttcaactggtccatgtgttgcagtgtaagaagtgcccgggctttgttcgtgttcctccatatggagtttcacagttgctacaggaattgattgcaaagtcaatttgaaggctatttcttcttttaaaaaaaaaaaaaaaaaaaa

SEQ ID NO: 7636 - protein, 323 aa, Panicum virgatum
  misc_feature: Ceres CLONE 1950096
  misc_feature: The sequence is a functional homolog of  SEQ ID NO 1839 in the  10/374,780 US patent application
  misc_feature: Useful for making plants with modulated growth and phenotype characteristics
MASDRSKTSKPEKLSAAAGASLPNPFDFSSISGLLNDPAIREMAEQIASDPVFNQMPEQLQKSAQGAGEQGIPALDPQQYMETMQQVMQNPQFMSMAERLGNALMQDPAMSSMLENLSSPAHKEQFEERMARIKEDPSLKPILDEIENGGPSAMMKYWNDPEFLKKIGQAMGVNLPGDSSASTELSGPEETEEEGGYDDESIVHHTASVGDAEGLKKALDGGADKDEEDAEGRRALHFACGYGELKCAEILLEAGAAVDALDKNKNTPLHYAAGYGRKECVDLLLKHGAAVTLQNLDGKTPIEVARLNNQDEVLKLLEKDAFL

SEQ ID NO: 7637 - DNA, 1280 bp, Panicum virgatum
  misc_feature: Ceres CLONE 1950162
  misc_feature: Encodes the peptide sequence at SEQ ID NO. 7638
agtgggtagtgcctttttccttctttttcatttcaagagctgtggtaggctggtgggtgttgttccaaactcagagaaagcaagcaggaagggatggagctcaccaacatcccctatcttgcatcatcttcctcctccagcatcttctactccagctacagccgctgtacctgcaggggcaaaaaggctgggaacctggtgataacagcttctgcagctggtggtaggtgtgctgctgatttggcatgttcacagcttgttgagcgggaaaataaagacgccctttcaggtcctagatcttcctggcattatagaaagagagaatttgcttctgccattttgctcccttttctgcttcctcatgttgatgtctcaagcgcggctgagacatacaatgaatcaatcattcgaagtggcgtgaggactgtcttaaccaaggccaaggctgctggcgtgcttcgtttggttttccatgatgcagggacttttgatgttagtgacaaatcaggtggcatgaatggctctataatatatgaagttgacaggcctgaaaatactgggctaaatagatccataaagatattaggaaaagcaaaatcaggaatcgatgatattcagaaagtgtcatgggcggacttgattgctgtggctggtgctgaggcagttgcgctctgtggtgggcctgaaattccagtaaggctaggacgattagattccagtactgctgatccagctggtaagctccctgaagagacattggatgcagctgctctaaaaacattattcagcacaaagggtttttcaccgcaggagatggttgttttatctggtgcacacacaattggaggcaaaggattcgggagtccaatcgtttttgacaacacctacttcaaagtgctccttgagaagaagcctcaaacatcttcatctggcatggaagcaatggtggggctgcgcacggattgggcactcactgaagatgacgagtgcttaagatggattaggatatatgcagaggaccaagctagatttttcgacgacttcagggatacatacatcaagctggtagatagtggagccacgtggagaacagcttaattagaattttccatggctgtaaaatgcaatgaatttttcctatataggcagcggctcgttcgaaacatacgagtttcatagagtttttttttaccaaaaacagagcagttttttccaggcaaaatgccaattgaacacaaaagacgcagtctcttgtaaactaagtagcattttggaacacc

SEQ ID NO: 7638 - protein, 334 aa, Panicum virgatum
  misc_feature: Ceres CLONE 1950162
  misc_feature (1)..(188): Pfam Name: peroxidase Pfam Description: Peroxidase
MELTNIPYLASSSSSSIFYSSYSRCTCRGKKAGNLVITASAAGGRCAADLACSQLVERENKDALSGPRSSWHYRKREFASAILLPFLLPHVDVSSAAETYNESIIRSGVRTVLTKAKAAGVLRLVFHDAGTFDVSDKSGGMNGSIIYEVDRPENTGLNRSIKILGKAKSGIDDIQKVSWADLIAVAGAEAVALCGGPEIPVRLGRLDSSTADPAGKLPEETLDAAALKTLFSTKGFSPQEMVVLSGAHTIGGKGFGSPIVFDNTYFKVLLEKKPQTSSSGMEAMVGLRTDWALTEDDECLRWIRIYAEDQARFFDDFRDTYIKLVDSGATWRTA

SEQ ID NO: 7639 - DNA, 1119 bp, Panicum virgatum
  misc_feature: Ceres CLONE 1950174
  misc_feature: Encodes the peptide sequence at SEQ ID NO. 7640
agcaaaaggaaagggaaaggcgacgtttctttctcctcgttccggcgccctaccagtaccgggagtgtgagctgctgcctgctctgctcaactcgaacgccgcttgtcgcgcgcaccgcggcctcgatccgacgagctacatgtccggggagcaggatcatgttagtaaaagctctagctcaagcatcagcagcagtactcaggagagcgaggaggaagtaagtgtaaccatcggtagcctccttgcccaagcaaagaatagcagtggacatagtcttgggaagcgcctgtcccatttgggatcaataccgtacactcctcgaattaacgggaaaattcccaatgttgataatgcaacactggatcacgaaaggttgctggaaaggttgggcacttatggtttggctgaatttcaaatagagggggatggaaattgtcagttccgagctttggcagaccagatatttcgcaatcctgactatcacaaacatgtgaggaaggctgtcatgaaacagctaaaggaattcagaaaacagtatgaaagctatgtaccaatggaatataaggtgtatttgaagagaatgaaaagatctggggaatggggagatcatctgactctacaagcagctgcagatcggtttggtgccaaaatttgtttgctgacatcatttagagacacctgtttgattgaaatagtccccagggatctgactcccaccaaagtgctttggctaagcttctggtgtgaggtccactacaattccttatatggaattgacgatctcttgactcgcaagaccaagaagaagcactggctgttctagggttgattctgaagcttctctgagtagccatgttctttccagccagtgtagactcttttgtagttactagccagccaatattgtagcatatcctgagcctacataggctttgccctcttatgtacagttaatttcactccttttgctccaaaaatcttgtaaaatttctttaaggaacaaacctggaactgcacaacttttagatgcatgagtctcatgctccatttacatggcggtgtagtttttgccttcgcaatgtacattacagtttttcgtaaaaaaaaaaaaaaaaaaa

SEQ ID NO: 7640 - protein, 227 aa, Panicum virgatum
  misc_feature: Ceres CLONE 1950174
  misc_feature (1)..(113): Pfam Name: OTU Pfam Description: OTU-like cysteine protease
MSGEQDHVSKSSSSSISSSTQESEEEVSVTIGSLLAQAKNSSGHSLGKRLSHLGSIPYTPRINGKIPNVDNATLDHERLLERLGTYGLAEFQIEGDGNCQFRALADQIFRNPDYHKHVRKAVMKQLKEFRKQYESYVPMEYKVYLKRMKRSGEWGDHLTLQAAADRFGAKICLLTSFRDTCLIEIVPRDLTPTKVLWLSFWCEVHYNSLYGIDDLLTRKTKKKHWLF

SEQ ID NO: 7641 - DNA, 977 bp, Panicum virgatum
  misc_feature: Ceres CLONE 1950178
  misc_feature: Encodes the peptide sequence at SEQ ID NO. 7642
agaaggttccagaacccaccggctgcttcctctgccttcctccaccaatcccttcgtcgcctgcacgccacctcctccctcctcccccgcccgtatttatacgcgccgatcccctctcgcttcctccttcctgcttctcgatcggattggggcttcgtttggggggtcttggtaggtgtggtgtgcacgggagttggggcttcgttgctttgcttcgctcgtgcgcaagggagagagagaagagggaggagtaagcgaggaggcagatggcgtcgaagcggatcctcaaggagctcaaggacctgcagaaggatcctcccacctcctgcagcgcaggcccagtcgcggaagatatgttccactggcaagcaacgattatgggtccatcggatagcccatacgctggcggcgtctttttggtcacaattcacttccctccagactacccattcaaaccgcccaaggttgcattcaagacaaaggtcttccatccgaatatcaacagcaatgggagcatctgtcttgatatcttgaaggaacaatggagcccagcattgacagtttctaaggtactactctcaatttgctcccttttgacggacccgaaccctgatgatccattggttccggagattgctcacatgtacaagactgatcgggcgaagtatgagtccactgctaggagctggacccagaaatacgcaatgggctgacattgccggctactgggaagatgatgacctagcaatatgctcgtgttatgtgcctttgttccagttctaatgttactgccttctgtcggtgaaaccagaggtctaacttaaacttgttcgtgcattgaacaattgagtataatggaaggagaaacattcattgtattgtccctgagtgtgatccaagttgttggcaacttttttcatggtttatatgtcactgatgattcacgcgactcgatgcattaggatctttgactgccg

SEQ ID NO: 7642 - protein, 148 aa, Panicum virgatum
  misc_feature: Ceres CLONE 1950178
  misc_feature: Great-hit functional homolog of the protein sequence given in SEQ ID NO 9309
  misc_feature (1)..(148): SWISSPROT Homolog: EC 6.3.2.19 Ubiquitin-conjugating enzyme E2-17 kDa
  misc_feature (1)..(148): SWISSPROT Homolog: EC 6.3.2.19 Ubiquitin-conjugating enzyme E2-17 kDa 10/12
  misc_feature: Useful for biocontainment applications
  misc_feature: The plant produces a reduced number of seeds.
MASKRILKELKDLQKDPPTSCSAGPVAEDMFHWQATIMGPSDSPYAGGVFLVTIHFPPDYPFKPPKVAFKTKVFHPNINSNGSICLDILKEQWSPALTVSKVLLSICSLLTDPNPDDPLVPEIAHMYKTDRAKYESTARSWTQKYAMG

SEQ ID NO: 7643 - DNA, 838 bp, Panicum virgatum
  misc_feature: Ceres CLONE 1950185
  misc_feature: Encodes the peptide sequence at SEQ ID NO. 7644
aaaaaaccctccggccattcttccccaaccggtgtcggcgatatccacctcctgcgccgccgatggatctctccgccgtccaggccgccctctccgacaagtcctactccactctagcccccctctgcgacgaactcctcctccaggccgcgtccaggggaaccaccaccgacgaatggccccacgccgtccatctcctcgcccatctgtacctcaacgacttgaacagcgcgaggttcttctggaagtcgctgccacaggaggtgaaggacgcgtctccggagctcgccgccgtctggaggatcggccagtgcctctggaatcgcgactacgctggtgtctacacggccgcacagggatttgagtggggccctgaccttgctgacttcaccactgccttcctagaaagctacagacagaggatattccagcttttgacttctgcatattcaacaatcagcgttgctgatgttgctcacttcatgggaatgagtgaggaggattctacaaactatgctgtgcaaaagggttggagtttggatgtggggaccaagatgcttactgtcaagaaaccaaaggctcagaccaaccagaagcttgacgcaagcaaactgcagcgtttgacagagtgtgttttccacttggagcactgatgcccactggcaatggcattgcatcccgggtgcttttctacaccgaaccttaaggatcatgtttactatgtgatagctagatgcctgggcgactagctcggttttggctggaaagggcagaactctcactactgaatttttggcatacgtatgtggtttctgatggaaaaagtccattttttgct

SEQ ID NO: 7644 - protein, 196 aa, Panicum virgatum
  misc_feature: Ceres CLONE 1950185
  misc_feature: Great-hit functional homolog of the protein sequence given in SEQ ID NO 9460
  misc_feature: Useful for making plants with modulated low light sensitivity
MDLSAVQAALSDKSYSTLAPLCDELLLQAASRGTTTDEWPHAVHLLAHLYLNDLNSARFFWKSLPQEVKDASPELAAVWRIGQCLWNRDYAGVYTAAQGFEWGPDLADFTTAFLESYRQRIFQLLTSAYSTISVADVAHFMGMSEEDSTNYAVQKGWSLDVGTKMLTVKKPKAQTNQKLDASKLQRLTECVFHLEH

SEQ ID NO: 7645 - DNA, 1006 bp, Panicum virgatum
  misc_feature: Ceres CLONE 1950203
  misc_feature: Encodes the peptide sequence at SEQ ID NO. 7646
gcatcgccgcgcggaaaccctcccgaatcgtcgccatggcagccgccgcaccggcaagctccgtcaaggaagtgctcccgtctcccctgaccgccgcctccgagcccccgcccctcttcgacggcacaaccaggttgtatgttgcctaccattgcccgtacgcgcagcgcgcttggattgccaggaactacaagggtttacatgacaagatcaagatagttgcaatcgatcttgctgacaggccagcatggtacaaggagaaggtttatcccgagaacaaggtgccttccctagagcacaacaaccaggttaaaggagagagcttggatttggtcaagtacattgatagcaatttcgaaggcccatcattgcttcctgatgatcctgcaaagaagcagttcgctgaggagctgcttgcttttaccgatgcttttaacaaagcactgtactcatctataatctctaaggaagatgtgtccgaggaaactgttgctgctctggataaaatagaagaggccctggggaaatttaacgatggaccattcttcctcggtcagttcagtctggtggacatagcatatgtgccatttatcgaaaggtttcagatattttttgaaaacatcaagaactatgacatcacaaagggcagatccaaccttcagaagttcattgaggaagtgaacaagattgatgcgtacacacagactaagcaggacccacagtttttgcttgagcacacaaagaagcggcttgggattgcatgaagcttgtgaccaaggatgaaaatctcgccagtgggctgcttgcatagactgcattgtttgcaagaatggccttgtatgcactatgctggtcgtgcttttgaaataaactagttgtcctggattatagcttttgtagtgcatcgacgtcattatgttacttgacaggaagaggatgttataatgatgttcagggtgctctgttaaatgttgccgtgttcgataaatcagtgttcctctgctct

SEQ ID NO: 7646 - protein, 242 aa, Panicum virgatum
  misc_feature: Ceres CLONE 1950203
  misc_feature (1)..(74): Pfam Name: GST_C Pfam Description: Glutathione S-transferase, C-terminal domain
  misc_feature (1)..(76): Pfam Name: GST_N Pfam Description: Glutathione S-transferase, N-terminal domain
MAAAAPASSVKEVLPSPLTAASEPPPLFDGTTRLYVAYHCPYAQRAWIARNYKGLHDKIKIVAIDLADRPAWYKEKVYPENKVPSLEHNNQVKGESLDLVKYIDSNFEGPSLLPDDPAKKQFAEELLAFTDAFNKALYSSIISKEDVSEETVAALDKIEEALGKFNDGPFFLGQFSLVDIAYVPFIERFQIFFENIKNYDITKGRSNLQKFIEEVNKIDAYTQTKQDPQFLLEHTKKRLGIA

SEQ ID NO: 7647 - DNA, 1283 bp, Panicum virgatum
  misc_feature: Ceres CLONE 1950217
  misc_feature: Encodes the peptide sequence at SEQ ID NO. 7648
agtagttaatagctgttaagatgtaagcccagtagctcacgcacccttccaccaacaaaatacttgtagctgccactttccgcatctgactgcagggaattgggaagaagagggatagtctcctttccagttactctgttgccagtctccctacacattgtcactagacctgttggtgttcagaattcccaggcctcgactgccatggtccagatgtctctgcagaggagcatagccatatctcctcgtggctccttatctgaatcgctgcatcgtgtgggtggtgcaagaagaagattggcgtcttgtagatcccagtcttcaagctttgcttatagtgcgagattgtctccgatccttctcaagaccgacagtgaaattgatccctccgaaccaaagaatttggatctgagctcctcagcttcaagaagtggaccttacagtgcagcttgtcatccatcaggcactgttggagtaattggagcatcttctacttcctctctcagatttttagaaaaatttgtgtgttggagtaccagagatggagaagaggcacctccattcgtcatctgtaatgatccactcgtcaagaaagagctattgtcttctggaaaccatcccaattctgactctagtattgctcttgggaagttaaggcagaagaggctcttcttggagcaatctggagcatgttgcattgttatgccatgccagttcttacatgcctggcgcgatgagatttcacagggttgctcggttcctttcctccatgttggtgattgtgttgcaaatgaactcaaagcagcaaacttgaaacctgttgagtatggaggtaatgtctgtgtaggtgttctggctaccaatgatacactggctagaaagtgctacttagacaagcttgagagacagggttttgacgtgctatgtctagataaagcttccatgcagcacacggtgttaccatcagtcgatgcatttaggaagggggacagggaaggtgcaagaaatctactgcgagtgtcactccaagttcttcttgtgcgagctgtcaatacggtaatccttgcgtctgatgaccttgtaggcatcctgcctgatgacgaccctctgctcaagaaatgtatagacccaatggatgccttggtccgagaggccattgtatgcacaagaatacctcgaccatgatatgcctcagattactctggttcttgtgtaggtcccaagccccaatagtagctgtttgcacattgacttcctgtgagcacatttgtagattttaagat

SEQ ID NO: 7648 - protein, 326 aa, Panicum virgatum
  misc_feature: Ceres CLONE 1950217
  misc_feature (1)..(239): Pfam Name: Asp_Glu_race Pfam Description: Asp/Glu/Hydantoin racemase
MVQMSLQRSIAISPRGSLSESLHRVGGARRRLASCRSQSSSFAYSARLSPILLKTDSEIDPSEPKNLDLSSSASRSGPYSAACHPSGTVGVIGASSTSSLRFLEKFVCWSTRDGEEAPPFVICNDPLVKKELLSSGNHPNSDSSIALGKLRQKRLFLEQSGACCIVMPCQFLHAWRDEISQGCSVPFLHVGDCVANELKAANLKPVEYGGNVCVGVLATNDTLARKCYLDKLERQGFDVLCLDKASMQHTVLPSVDAFRKGDREGARNLLRVSLQVLLVRAVNTVILASDDLVGILPDDDPLLKKCIDPMDALVREAIVCTRIPRP

SEQ ID NO: 7649 - DNA, 893 bp, Panicum virgatum
  misc_feature: Ceres CLONE 1950291
  misc_feature: Encodes the peptide sequence at SEQ ID NO. 7650
cgcgctcttcctttttattttatttttctctcgccggcgtaaatcaccgaactcgccgcgctctcccttctcgccgccgccgccgcggaacccatcgccgccagccatgtcgatcttcgagtacaacgggagcgccgtggtggcgatggtggggaagaactgcttcgcgatcgccagcgaccgccggctcggcgtgcagctgcagacgatcgccaccgacttccagagggtgttcaaggtccacgacaagctctacatcggcctctcggggctcgccaccgacgcccagacgctgtatcagcggctggtgttcaggcacaagctctaccagctgagagaggagagggacatgaagcctgaaacctttgcgagccttgtttcggccatcctctacgagaaaaggtttgggccgtacttctgtcaaccagttattgctggcctaggagataacaatgagccatttatatgtaccatggactgccttggtgccaaggaacttgcaaaagattttgtggtatctggtacttcttcagagtcactttatggtgcttgtgagtccatgtataagccaaacatggaacctgaagaactgtttgagacagtctcacaagcattgatggcttctgttgatcgcgattgcctcgctggctggggaggttatgttctcattgtcacacccactgaagtgcaggagagggtggtgaagggaaggatggactgagtcctctgccgtgtagccgcgtaggagattgtttcttcattcgcttcgccctgtactacggcgtacagacagaaaacccgcgcggatgtttccttctcagagaacatatcatgaaagattcaggcagttgcttgttcacctctctatgcctcagacgtcagcttctgttttc

SEQ ID NO: 7650 - protein, 204 aa, Panicum virgatum
  misc_feature: Ceres CLONE 1950291
  misc_feature (1)..(204): SWISSPROT Homolog: EC 3.4.25.1 Proteasome subunit beta type 3
  misc_feature (1)..(204): SWISSPROT Homolog: EC 3.4.25.1 Proteasome subunit beta type 3-A
MSIFEYNGSAVVAMVGKNCFAIASDRRLGVQLQTIATDFQRVFKVHDKLYIGLSGLATDAQTLYQRLVFRHKLYQLREERDMKPETFASLVSAILYEKRFGPYFCQPVIAGLGDNNEPFICTMDCLGAKELAKDFVVSGTSSESLYGACESMYKPNMEPEELFETVSQALMASVDRDCLAGWGGYVLIVTPTEVQERVVKGRMD

SEQ ID NO: 7651 - DNA, 1642 bp, Panicum virgatum
  misc_feature: Ceres CLONE 1950300
  misc_feature: Encodes the peptide sequence at SEQ ID NO. 7652
aagcgaatcaatcgagcatttttattacaacgaaaacacacgccaatttggctcgtctcggtgcgccgccctccgctgctgaccacccactcgccggtgatctgatggcggcgccgccgcgcgcagcgccgctcacgttctccgcggaggcgaggacgtccgcgctcggggccgcgtccttctccgcgccgcgacggggtgctagggttcgcgcggcgcggccacgggaggagaatttcaataaccatcgcttgctgatgtcatctaatacgaattcaaggtcattggtgtgctctccgtgcaattgtgctcaaatggctttggccgacagaagaattgtgaatcaacctgatgttgacaagcatgctggagttctggcctatgaactggtccaaggaaaccttgtgcagtggaattcatttatggacaaatcaatacctgatccaccaacagctgttctccttcatggcatccttgggagcaggaaaaactggggatcttttgcgaagaggttggctcaagaattcccaatgtggcagtttctcttggttgatttgcgacaccatggcaactcagcatcaactaagaagcgcgggccacacactgttgcctcaactgctcttgatgttctaaagctgttagtgcagctcaggctaacccctcgggttttggttggtcacagctttggcggaaaagtggccctaagtatggtagaacaagctgcaaaaccacttgctcgtcctgttagagtatgggtccttgatgctactcctggcaaagttcgtgctggaggagatggtgaagatcaccctgcagaactaattgaattcctcaggagaatgcccacgcaggtttcttcaaagcaggaggttgtcgatgctcttgttaaagaacaattttctatggatgttgcacggtgggtggccacgaatctacatcggagcagtccattaggtcagcgatcatctacaagcttttcatgggcttttgatctaaatggcatctcggagatgtacaagtcttatgaagatactaacttgtggaggattgtagagactgttccaaggggggttcatattaattttctaaaagctgaacggagtttacatagatgggctcttgaagacctccaaagaattcatactgcagaagaattagctgcagacgagggaggaggagttgaaatgcacgtgcttgaagatgctggacactgggttcacgctgacaacccagatggtctgtttcggattctttcatcaaccttccggatcgagactactataagaggaatgcaagactaagtaccaaaccgtaattgatccagcattgatatgagctgaggcaatggcatgaatagaagaagtgtatattacaatgaggggaaaaccgtgtatattacaatgaggggaaaaccgtcagcgatgatgctaactgctaccattggcgcgtctgttcatttgttcattcttttcatgtatggcgtctgtaacatgatagtcatctacacttgtgctgtttcttgtaatttactaattttatctgttactaggtttgtgcccgtgcgttgcaacgggtggcaaaaattaaaacctcatataccaatattcccatgatatagaatacaatcgtttcaagctttcac

SEQ ID NO: 7652 - protein, 398 aa, Panicum virgatum
  misc_feature: Ceres CLONE 1950300
  misc_feature (1)..(127): Pfam Name: Abhydrolase_1 Pfam Description: alpha/beta hydrolase fold
MAAPPRAAPLTFSAEARTSALGAASFSAPRRGARVRAARPREENFNNHRLLMSSNTNSRSLVCSPCNCAQMALADRRIVNQPDVDKHAGVLAYELVQGNLVQWNSFMDKSIPDPPTAVLLHGILGSRKNWGSFAKRLAQEFPMWQFLLVDLRHHGNSASTKKRGPHTVASTALDVLKLLVQLRLTPRVLVGHSFGGKVALSMVEQAAKPLARPVRVWVLDATPGKVRAGGDGEDHPAELIEFLRRMPTQVSSKQEVVDALVKEQFSMDVARWVATNLHRSSPLGQRSSTSFSWAFDLNGISEMYKSYEDTNLWRIVETVPRGVHINFLKAERSLHRWALEDLQRIHTAEELAADEGGGVEMHVLEDAGHWVHADNPDGLFRILSSTFRIETTIRGMQD

SEQ ID NO: 7653 - DNA, 1021 bp, Panicum virgatum
  misc_feature: Ceres CLONE 1950450
  misc_feature: Encodes the peptide sequence at SEQ ID NO. 7654
aaccacagcaaacagcagaagaacaagctcctcgcctcacctctcgttcgctgcctagctctgcttatttctttcttccaccttgggccttggatatggcatccagcgtgtcccggttcatcaagtgcgtcacggtgggggacggcgctgtggggaagacctgcatgctcatctgctacaccagcaacaagttccccactgattacatacccactgtcttcgataacttcagcgcaaacgttgtggtcgacggcaccacggtgaatttgggcctttgggacactgcaggacaggaagattacaacagattgaggcccctgagctaccgtggagccgatgtgtttgtgctcgccttctcgctcgtcagccgagctagctacgagaatgttatgaagaagtggctaccagagcttcggcattatgcaccgggtgtccccatagtttcggctggaactaaattggatcttcgtgaagacaaacactacttacttgatcatcctggtgcagtaccggttactacggcacagggggaggaacttcgcaagcacatcggagcaacatgttacatcgagtgcagctcaaaaactcagcagaatgtcaaagctgtgtttgatgctgccatcaaggtagtaataaggcctccgacaaaacagagagaaaggaagaaaaagaaagcacgacggggatgttcaatattccgaatcatgcacaaaaggagactaggatgcttcaagtgatcgaaggccatatttgacgatcacataggtttccaagatgaatcgagattacgtgtagtttgtataattgcatccaagtttcaaagggcttgttgcgcttgcgcatttgtaccggtaatgtgtatatttacgtcttcagcaattgacttctaggagatatgtgagatatttttgtatgtttatgtaccaatggctaataatgagttaggaagttcaatacattctgagatgtaacgatatgatatattcttccagtgagcctgactgttcatattaatttattc

SEQ ID NO: 7654 - protein, 213 aa, Panicum virgatum
  misc_feature: Ceres CLONE 1950450
  misc_feature: Great-hit functional homolog of the protein sequence given in SEQ ID NO 9499
  misc_feature: Useful for making plants with modulated nitrogen use efficiency
MASSVSRFIKCVTVGDGAVGKTCMLICYTSNKFPTDYIPTVFDNFSANVVVDGTTVNLGLWDTAGQEDYNRLRPLSYRGADVFVLAFSLVSRASYENVMKKWLPELRHYAPGVPIVSAGTKLDLREDKHYLLDHPGAVPVTTAQGEELRKHIGATCYIECSSKTQQNVKAVFDAAIKVVIRPPTKQRERKKKKARRGCSIFRIMHKRRLGCFK

SEQ ID NO: 7655 - DNA, 1696 bp, Panicum virgatum
  misc_feature: Ceres CLONE 1950459
  misc_feature: Encodes the peptide sequence at SEQ ID NO. 7656
agctcgacagatggacgcaacccaaatttaatcccccgggaacagaaggataaagccacatctgcagtggagtggagacttcgcagacccagaagaaaagggcggaggagatggaataaaaaaagagtgagcaggaggagcgcgcacacaccaagcaaaggaagagaagtgcagaggagaattcattcagatcaaaccaagcaattcttctgtacgcaatacgttgagggacaggaggaggcggggtaggacgagtgaatgcaccgttccgaactccagcttcttgtccaaaactccatattcttcttgctgaatccctgctgctgaaacaaaaaaatgaagttattaggagaaagtgagaaaccttcatgctgccctggtcgagaaatgccctggtcgaccgactaatcgcgattagtggacgactaatcggacgaccaggtttctggtcgctctggtcgggtcggtggtgctggtcggacttggagaaccgacctgggcgattaatcgcgattaatcggacgacttgaaaacatggggggcaatcactcatgggatattgggctgggtaagcataggaatattttggtgcaacaacttgatatagagttcaagaccaaagaagcaatggaaagggaatcagctaccacatatgagccaaaaaggaacagtgaaataagggtttttgagagtttagatgagatttcaacagatctggctgagtatatcgcgcaaatttcagaaatttctgtcaaggaaaggggatacttttctattgccttatctggaggtcccctagtcagttttttggggaaactttgtgaggccccatacaacaagaccctggattggtccaaatggtacatcttctggtctgatgaacgtgctgttgcaaagaaccacgcagagagtaactataagctaacaaaagaaggattcctcgccaaggtacctattcttaatggccatgtctactccatcaatgacaatgccacagtggaggatgcagcaaaagactacaagttcgtcatcaggcagctggtcaaggtccgcacaatcggcgtatcagagagcaacgactgccccaagtttgatctcatcctccttgacatgggctctgatggccatgtggcctccctgttccctaaccaccctgcccttgagctgaaagatgattgggtcacctacatcactgactccccgcagcctccacctgaaaggatcaccttcactctcccagtaatcaactcggcgtccaacatagcaatagtggctactggtgacgacaaggcgaaggccatccacttagcagttttcgatggcactgaaggtcctgaggctcccgcattgctgcctgcaagaatggtcaagccaacagacgggaagctggtgtggttcctggacaaggctgcagcatcatcccttaaggctgacaaaggaagcgacgcctcctatgagcatcacgagtacttaccctgaagatccaaaggttatttcgccgttaatgagtggaggtatgtaacgtaagtaggcggtgggatgtgatggaagatgcttggttgcccattttagctcgatatacttgtagtcttggcattaattttgtctgaggatctaagttccgggaaatgaaaaactgccccttggtccttttgcaatgaggttatttagagcagaaaaaaaaaaaaaaaaaaaa

SEQ ID NO: 7656 - protein, 314 aa, Panicum virgatum
  misc_feature: Ceres CLONE 1950459
  misc_feature (1)..(240): Pfam Name: Glucosamine_iso Pfam Description: Glucosamine-6-phosphate isomerases/ 6-phosphogluconolactonase
MGGNHSWDIGLGKHRNILVQQLDIEFKTKEAMERESATTYEPKRNSEIRVFESLDEISTDLAEYIAQISEISVKERGYFSIALSGGPLVSFLGKLCEAPYNKTLDWSKWYIFWSDERAVAKNHAESNYKLTKEGFLAKVPILNGHVYSINDNATVEDAAKDYKFVIRQLVKVRTIGVSESNDCPKFDLILLDMGSDGHVASLFPNHPALELKDDWVTYITDSPQPPPERITFTLPVINSASNIAIVATGDDKAKAIHLAVFDGTEGPEAPALLPARMVKPTDGKLVWFLDKAAASSLKADKGSDASYEHHEYLP

SEQ ID NO: 7657 - DNA, 1564 bp, Panicum virgatum
  misc_feature: Ceres CLONE 1950579
  misc_feature: Encodes the peptide sequence at SEQ ID NO. 7658
gggcccaacacggccgcaaaattgctagcccgtccaagacccagtttctgagttcctcgtcttcatccgttcatcgtcaatctctgtgctgtgagcgagccgacgaatccggccggagccccctcgtctgaagaggcgaacacggccgacgaacaccgaacagaagaggcggtctgggcgaagcagcgcccgactcccgaccgacagtgtcatgtgcaagaatcgaaagccgcttccgcctgcacaagcctcaaatcttctccgccgctccagcaccaagaggcagattccagtactggctctcgttgcagcttcaatttttccttaaaaaaaatctccgttcgatttgccgaatcggaagaccagagttacacttggaactaaccgaagggaatgcttctcaacgcacctactatttcctggcgatgctgtacttcatggaacatgtgtactgagtctagccagttaccaggaaagttggctcaaagagttgatttgtggaattcttcgtgctcacaaacattgaggcatcacgccaggactggttcagttaagaagaacataaattcatctaatccagcatgttctgtcagtttaggtcgacagtttcatggcagactatcagcaagaagccaaatcctaagtgtaaagtctgatatactataccatcacaagttttctagtataggttggcgtttgggaagtatgccacgaaaaataggaggtatagcatctggaaaaggttttacagtgtctgggatgtcaagtgccgagggtcctgtggataacaacattgatagcacccagcctgctgaatcatcagcaaatttatctcatgggaagaaagtttacacagattattctgtcactgggaaacccatacctaatgaggatcttcagagaaagctagccgatgagttgagaacaatggttgctgatgagtttatcaagagacgagcagagactgaatggttcgttgaaggagaattcgatacatatgtctctcagattagaaagccacatgtttggggaggtgaaccagagttatttatggcttcgcatgttcttcagatgccaatcacagtttacatgcatgataaagaagctggcggtttaatagcaatagctgaatatggccaagagtatgggacagaagctcccatccaagttctttatcatggttacggccattatgaagctctgcagataccgggaaagggtggtccaaggtcaagattgtaacatttgcagctcaactttcaaatggagcgacgcgcgggctgcaagttgagatccacactgctgtgtttatgtggcgaagaacagatggccagaacttctaaacaggcttggagctgccaaaggacagtgatctgcacccgcattcctatacattccaactattgagccctgtgcgctgccccccttgttcgagatttcatgttattaacatcgttgcaaggtcagatgcagcaggttacatataccgttgatgcaatgcagagttcttgtcaaatattgctggcaacatcgcttgatgggtcgtgtattcttgagcttatcc

SEQ ID NO: 7658 - protein, 282 aa, Panicum virgatum
  misc_feature: Ceres CLONE 1950579
  misc_feature (20)..(127): Pfam Name: OTU Pfam Description: OTU-like cysteine protease
MLLNAPTISWRCCTSWNMCTESSQLPGKLAQRVDLWNSSCSQTLRHHARTGSVKKNINSSNPACSVSLGRQFHGRLSARSQILSVKSDILYHHKFSSIGWRLGSMPRKIGGIASGKGFTVSGMSSAEGPVDNNIDSTQPAESSANLSHGKKVYTDYSVTGKPIPNEDLQRKLADELRTMVADEFIKRRAETEWFVEGEFDTYVSQIRKPHVWGGEPELFMASHVLQMPITVYMHDKEAGGLIAIAEYGQEYGTEAPIQVLYHGYGHYEALQIPGKGGPRSRL

SEQ ID NO: 7659 - DNA, 860 bp, Panicum virgatum
  misc_feature: Ceres CLONE 1950721
  misc_feature: Encodes the peptide sequence at SEQ ID NO. 7660
agtcctcctctcacgagtcacgactcacgagccgatctctcacacagtcacacgttgcggggctcctcccacctcgtcttcttgtcgtcgcccccgtcctcccctctcctcaaccaaggggcgcatgagctagtgtggactggagatccatccatctgctggacctggattgacttcttctttcctagggacatccgaggatgtcgactcctgcgagaaagcggttgatgagggatttcaagcggttgatgcaggaccctccggccggcataagtggcgccccgcaggataacaacatactgctatggaacgctgtgatctttggccctgacgatactccatgggatggtggtacgttcaagctaactctccagtttactgaagaatatccaaacaagccaccaactgtgcgatttgtttctcggatgtttcatcctaacatttatgctgatgggagcatatgcttagatatcctgcagaatcagtggagcccgatatatgatgtagctgctatacttacatccatccagtcgttactgtgtgatccaaacccgaattcgcctgctaactccgaagctgcccgcatgttcagcgagaacaagcgagagtacaaccgcaaagtgcgggaggttgtggatcagagctggacggcagactgatgtattgcatcgggcagcttgtcacagcgcccctctggtccttcccataccaaaatgcatgtgcttgtgtaactgaatagatgaattcagctgtgactgctgttctcctgtatgagctgccgtgcttcctatcttggttggaccggtgaagactgttccaatttcgattttcacctatgctggatctggaatacaagctcc

SEQ ID NO: 7660 - protein, 152 aa, Panicum virgatum
  misc_feature: Ceres CLONE 1950721
  misc_feature (1)..(152): SWISSPROT Homolog: EC 6.3.2.19 Ubiquitin-conjugating enzyme E2-17 kDa
  misc_feature (1)..(152): SWISSPROT Homolog: EC 6.3.2.19 Ubiquitin-conjugating enzyme E2-17 kDa 2
MSTPARKRLMRDFKRLMQDPPAGISGAPQDNNILLWNAVIFGPDDTPWDGGTFKLTLQFTEEYPNKPPTVRFVSRMFHPNIYADGSICLDILQNQWSPIYDVAAILTSIQSLLCDPNPNSPANSEAARMFSENKREYNRKVREVVDQSWTAD

SEQ ID NO: 7661 - DNA, 1081 bp, Panicum virgatum
  misc_feature: Ceres CLONE 1950755
  misc_feature: Encodes the peptide sequence at SEQ ID NO. 7662
acaggagagcagctctatctcaggaccgacctgccggccggcttgcctccgcccgccccagggagacgtgtggcctgaggcctccctctcggacaagaatcaaagaggagaagagcagatctacatctgctccaccgatgagcgcttctcggttcatcaagtgcgtcaccgtgggggacggcgccgtcggcaagacctgcatgcttatctcctatacctccaacactttccccaccgattatgttccaactgtgttcgacaacttcagtgccaatgttgtggtcgacggaagcaccatcaacttgggtctgtgggatacagcaggacaagaggactacaatagactgcgcccgttgagctatcgtggtgctgatgtttttctgctcgccttttctcttatcagcaaagcaagctacgagaatgtatcaaagaagtggattcctgaattaaggcactatgctcctggtgtgcctataattcttgttgggaccaagcttgatctgcgggatgataaacagtttttcgttgatcaccctggtgctgctcctatttccactgcccagggtgaagagctgaggaagctaattggtgcagctgcctacatcgaatgcagttcaaaaacccaacaaaacatcaaagcagtgtttgacgcggccattaaggtggttctccagcctccgaagcaaaagaggaagaagaaaaaggcgcagaaaggatgcgtcattttataactagtaaatggcagactcagcagatgtcccgcaacatcttttgctgcatctggctgcgcttcaaaggaccagcacaaggcatatcttgtggtgttggtcttgaaagatcctgcctgatacactgggtttctagtgtcctactacgagtcatgcctgctgacccatcactgcgtgtgttttgtatgggcgaaacagaattcatcggtggatttgcaatatagcaggttgccgaaactagacagccacttgactagctagttgagtctgtgtatatgttgagtgaaattagtttggtgtgttgtgcttgtttggaaaagctgccgtcccgtcaaaaaaaaaaaaaaaaaaaa

SEQ ID NO: 7662 - protein, 197 aa, Panicum virgatum
  misc_feature: Ceres CLONE 1950755
  misc_feature: Great-hit functional homolog of the protein sequence given in SEQ ID NO 9499
  misc_feature: Useful for making plants with modulated nitrogen use efficiency
MSASRFIKCVTVGDGAVGKTCMLISYTSNTFPTDYVPTVFDNFSANVVVDGSTINLGLWDTAGQEDYNRLRPLSYRGADVFLLAFSLISKASYENVSKKWIPELRHYAPGVPIILVGTKLDLRDDKQFFVDHPGAAPISTAQGEELRKLIGAAAYIECSSKTQQNIKAVFDAAIKVVLQPPKQKRKKKKAQKGCVIL

SEQ ID NO: 7663 - DNA, 1316 bp, Panicum virgatum
  misc_feature: Ceres CLONE 1950828
  misc_feature: Encodes the peptide sequence at SEQ ID NO. 7664
agttcttgcctgctcccctttccttttcagtcgtgctgatgaaaagatggggtggtaaaactgaaatcttcgccgctccattatactcttcttccccagcaatccacagctcggagccccggttctctgcacagcttcctgcccgtgtccgtccagccgctgtggatgacgctcgcagtcgcagcgaccgcactcccactcccctccaaaggttggaaatggcaaagcccggtttccacatggaaacataagtgttctggccgacataatgcggtcataacatttgcgacaaagagtactaagagggaaaggagaaagtttcagaagaagtcaaaagattcactgttgacaagtgaggaagcttcttcaggcggtggtggaagcgccagcacaagcctcgaggtcaatagcgaggatgttgctgctactgatgatcaaatttctggtgccccaaggagtgctgttcttcaggcatgcactctcacatcaggcttgctgcttgctggaggacttctgcttcgccaggcatcacaccttgcatctttaaatggatggccaatttctgatcctacagatgtttcattcaagtttgaaacatggcatctcgagttggtagcaggacttgtaattgtaatctcctctagcagatacattctgctacaaacatggtcagatttcagagattccagtgaagccgcaaatacacaaatccttactttgctagagcctttggactacattgttgttgcttgtctccctgggataagtgaggagttgctctttcgaggggcactgatgcctatcttgggattgaactggattagtgcccttataatcggaaccatttttggtgttcttcacttgggcaatggcaggaaatattcatttgcaatctgggcaacatttgttggcttcgcctatggtataggaaccatagcttcgtcgagcattatagttccaatggcttctcactccataaacaatattatcggaggtttactttggcgctttaccaagaactcacaaaaataaataaatatataatacccttaatagtcatccctgtaagattacttacatgtgaaaagctgttgtgtgctcgtttgtgtaatgaaggagatgacgagaaagcaagatatgaagaatgcttatatgtatatataggcctggtaggattagtttattgcattgcattacagcacggtgctagctaactgtgtgagctgtcttgaaacaacactgtagcttatggccagtgtatgatccaattttcaactatccaagcacccagcttataaaaaaaaaaaaaaaaaaaa

SEQ ID NO: 7664 - protein, 288 aa, Panicum virgatum
  misc_feature: Ceres CLONE 1950828
  misc_feature (1)..(92): Pfam Name: Abi Pfam Description: CAAX amino terminal protease family
MTLAVAATALPLPSKGWKWQSPVSTWKHKCSGRHNAVITFATKSTKRERRKFQKKSKDSLLTSEEASSGGGGSASTSLEVNSEDVAATDDQISGAPRSAVLQACTLTSGLLLAGGLLLRQASHLASLNGWPISDPTDVSFKFETWHLELVAGLVIVISSSRYILLQTWSDFRDSSEAANTQILTLLEPLDYIVVACLPGISEELLFRGALMPILGLNWISALIIGTIFGVLHLGNGRKYSFAIWATFVGFAYGIGTIASSSIIVPMASHSINNIIGGLLWRFTKNSQK

SEQ ID NO: 7665 - DNA, 1258 bp, Panicum virgatum
  misc_feature: Ceres CLONE 1952559
  misc_feature: Encodes the peptide sequence at SEQ ID NO. 7666
gaacaccaccaacgcgtagtcgagcacaaaccaccgcagccatgctcctcaccaaaccccaacactccaacccgctgctcccgtccgcgccgccctccaaccccgctcccagctccagccatgccaggcccctctccgcccccgccgcccgtcgcggccgcctccgcgtctccgccgggccgagccgagtggacgtgctctcggaggcgctccccttcatccagcgcttcaagggcaagacggtggtggtcaagtacggcggcgccgcgatgaagtcgccggggctccaggagagcgtgatccgcgacctcgtcctcctctccggcgtcggcatccgcctcgtgctcgtccacggcgggggccccgagatcaactcctggctgctccgcgtcggcgtcgagccgcagttccgcgacggcctccgcgtcacggacgcgctcaccatggaggtcgtcgagatggtgctcgtcggcaaggtcaacaagaacctcgtctccctcatcaacctcgccaagggcaccgccgtcggcctctgcggcaaggacgcgcgcctcatcaccgcgcgaccgtcccccaacgccgcggcgctcgggttcgtcggsgaggtcgcgagcgtcgacgcgaccgtcctccaccccatcattgcttcaggccatattccggtcatcgccaccgtggccgccgacgagactggtcaggcctataatatcaatgctgatacggcggcaggggagatcgccgctgctgtgggcgccgagaagctgctgctgctcacggatgtgtctgggatactggcggaccgtaatgatcctgggagcctggtgaaggagattgacattgccggggtgcgacggatggtagctgacggcaaggtggcaggtggaatgaaacccaaggtggagtgctgcgtgcgcgccctggcacaaggtgtgcgcactgcgagtatcattgatgggcgcgtcgaacactcgctgctgcttgagattctcacagatcagggtaccggcaccatgatcactggctgaggtagttatgacttatggtatttttcttgcgtctctctgctcttagacatgtattttatggtaatgtagacttgactcaagattgcaataagaatgcattactaacattgtgagaaaattagtttggttgaggttgttttgcgcccatttatttgtgactttgctggcttctagttgagaagtgtagagatagttgagaagtaaatttgatcaattcaggttaaaatctattc

SEQ ID NO: 7666 - protein, 327 aa, Panicum virgatum
  misc_feature: Ceres CLONE 1952559
  misc_feature (1)..(239): Pfam Name: AA_kinase Pfam Description: Amino acid kinase family
  misc_feature (45)..(327): SWISSPROT Homolog: EC 2.7.2.8 Acetylglutamate kinase
MLLTKPQHSNPLLPSAPPSNPAPSSSHARPLSAPAARRGRLRVSAGPSRVDVLSEALPFIQRFKGKTVVVKYGGAAMKSPGLQESVIRDLVLLSGVGIRLVLVHGGGPEINSWLLRVGVEPQFRDGLRVTDALTMEVVEMVLVGKVNKNLVSLINLAKGTAVGLCGKDARLITARPSPNAAALGFVGEVASVDATVLHPIIASGHIPVIATVAADETGQAYNINADTAAGEIAAAVGAEKLLLLTDVSGILADRNDPGSLVKEIDIAGVRRMVADGKVAGGMKPKVECCVRALAQGVRTASIIDGRVEHSLLLEILTDQGTGTMITG

SEQ ID NO: 7667 - DNA, 994 bp, Panicum virgatum
  misc_feature: Ceres CLONE 1952652
  misc_feature: Encodes the peptide sequence at SEQ ID NO. 7668
gccgccactgcagcaaaggatgccgaaatctaagcgcaaccgcccagtgaccttatcaaagaccaagaagaagccaggttcagagcgcaagggcaaagtagtagatgacataaaaaaggccgtcgaccaatacagcagcgcctatgtttttacctacgataacatgaggaatcagaagctcaaggacctcagggagcagctcaaatcatctagcaggatatttcttgctggaaagaaggttatgcagatagcgttggggcgttcacctgccgatgaagctaaaacaggcctccacaaactttccaagttccttcaaggtgactctggtctcttctttaccaatcttccaagggatgaagttgagaggctgtttcgagaatttgaggagcatgattttgcaaggacaggaagcactgccacagaaacggtggagcttaaggaaggccctctggaacagtttacacatgaaatggaaccttttctacgcaagcaaggactgccagttcgcctgaacagaggtgttgtagagttagttgcagatcatgtagtgtgtgaggaaggaaaacccctttcaccagaagcagcacagactctgcgcttgcttgggatacagatggcaacattccggctataccttgtgtgccgctggtcttgtgatgactttgaagtgtacaaagaaggcttggctcatctaggagctgatgatgattcctgttaagatccttatgttcccctatgtaagggcgcacttgctgtcttgtgttgggatagtttttggtattgtgtgcggccatgtcccccggagtgttggaaacttgaaagagtgttggaaatttgaaagatgcggtgaaaattttcttgtgtgtttctttcagtcccatctactgcagtgttggagggtgtaagctgattggtatatcatatgaacaagatggttgaggggtggatcagatctgcagtcatttttgagaatcaacgagtctttcaatttctg

SEQ ID NO: 7668 - protein, 232 aa, Panicum virgatum
  misc_feature: Ceres CLONE 1952652
  misc_feature: Great-hit functional homolog of the protein sequence given in SEQ ID NO 9674
  misc_feature: Useful for making plants with modulated nitrogen use efficiency
MPKSKRNRPVTLSKTKKKPGSERKGKVVDDIKKAVDQYSSAYVFTYDNMRNQKLKDLREQLKSSSRIFLAGKKVMQIALGRSPADEAKTGLHKLSKFLQGDSGLFFTNLPRDEVERLFREFEEHDFARTGSTATETVELKEGPLEQFTHEMEPFLRKQGLPVRLNRGVVELVADHVVCEEGKPLSPEAAQTLRLLGIQMATFRLYLVCRWSCDDFEVYKEGLAHLGADDDSC

SEQ ID NO: 7669 - DNA, 1226 bp, Panicum virgatum
  misc_feature: Ceres CLONE 1952693
  misc_feature: Encodes the peptide sequence at SEQ ID NO. 7670
acaaactcatttcaaaccctcttcttagtttgcctcccaaaaaaaaaacacttagcgcccctcctcgcggcaacacgatgctcaccacagcacacagccggcagcatcatcacgccttcgagaagagccctagcagccacatgaagaacctcgacaggaagctgcagcaggccatgagcaatgcgaccagcaagtacatgcagaggatctaccctctgggcatccagaggagcagctccaacctcacattgtcgtcgctctccctgtcgcagaactccaacgactcctcgctcagcagctccaactccagctgggagcccaaggtgccgcttctgtatggcggcaccttcagcccctggggcgatgtgctggtgtctctggagatgaggagggaggaggacgacaaggccagtgaccacgacgttgaagggggtgaggacttcgattgcagcgagccggggagcttgcataggtgcagctggatcaccaagaacagtgatgacgcgtacgttcagttccacgacgagtgctggggcgtccccgtgtacagcgacaaccgcctcttcgagcttctgtcgctgtccgggatgctcatagaccacaactggaccgagatactcaagaggcgagacatgtacagggaggtgttcgccgacttcgaccccagcacggtggccaagatggacgaggacgccgtcgccgagatcagcggcaacaaggagctcaggctggccgagtccagggtccggtgcatcgtcgagaacgccaagtgcatccagaaggtggccaaggaattcgggtcgttcagcgggtacatgtgggggcacgtgaaccaccggccggtggtgggcaagtacaggcaccacaagtacatcccgttccggacgcccaagtcggaggcggtgagcaaggacctcgtccgccggggcttccgcctcgtcggccccgtcattgtctactccttcatgcaggcagccggcatggccatcgaccacctcgtcgactgcttccgcttcccggagtgcgtccgcctcgccgagcgatcctggggcatcaccaacatcgccgcgtagccgccggccggccggtcgtcggaggcgtgctcggtcgctcggcgctccaatttttttttttttttacaccttctggtgtgacttccttcaagtgtgtgtgaactgtaaagtagtacagtaaatgctaagttatgatgtgataattttattctc

SEQ ID NO: 7670 - protein, 331 aa, Panicum virgatum
  misc_feature: Ceres CLONE 1952693
  misc_feature (1)..(181): Pfam Name: Adenine_glyco Pfam Description: Methyladenine glycosylase
MLTTAHSRQHHHAFEKSPSSHMKNLDRKLQQAMSNATSKYMQRIYPLGIQRSSSNLTLSSLSLSQNSNDSSLSSSNSSWEPKVPLLYGGTFSPWGDVLVSLEMRREEDDKASDHDVEGGEDFDCSEPGSLHRCSWITKNSDDAYVQFHDECWGVPVYSDNRLFELLSLSGMLIDHNWTEILKRRDMYREVFADFDPSTVAKMDEDAVAEISGNKELRLAESRVRCIVENAKCIQKVAKEFGSFSGYMWGHVNHRPVVGKYRHHKYIPFRTPKSEAVSKDLVRRGFRLVGPVIVYSFMQAAGMAIDHLVDCFRFPECVRLAERSWGITNIAA

SEQ ID NO: 7671 - DNA, 1126 bp, Panicum virgatum
  misc_feature: Ceres CLONE 1952726
  misc_feature: Encodes the peptide sequence at SEQ ID NO. 7672
agtccccctttcccttgtctctccctctctcctcccttggtcttcctttcctggcggcgacgactgggcgaggggcggtgccattcgtcacgacttcgcactgccctttgccggcgacgagcatccatcagttcctaggcaagggagagcttcctagatagagctattgccctgcacgagtagcagatggcaaggataaagcccaggcaattgctcattcaaagcaaaacgaagaaggctccttctcgaatcagttactcaactatcatcacatggaacctgattgtcgtcttggttgtgctatccctctatgccacttacaggcattggcatcaaaggtcggcccaagatattgaaatggaccttcatcaagctgagcttgctgtgagaccagatgattcaaaaatgacaagtagaccaggatatgcagtaatgaacacgggcaaaggtccaattactatagaaatatacaaagatgcttctgctgatgttgttgatagatttagcaacttgtgtaagagtaatcacttcaaaggaatgccattccgccatatcataaaaaattttgtgattcaaggtggtgattttgattttgatggagctgcccaagaatggataacaaaagctaaagccagtgggaagaatgatctcagtccaaagcacgaggcatttatgattgggactgctaagaatcctaataacaaaggatttgatttgtttatcacgactgccccaattcgtgatttgaatgacaagcttgtagtatttgggcgagtcatcaagggagaagatattgttcaggagattgaagaagttgacaccgatgagcattatcagccaaagactcccataggcatcatgaatatcatactaaaacaggagccatgagctgataactttttgacaggctcgtatacatgaaaaccttaactacctgtctccctactttctgtagtatacttagtatgaaaaagtccatacgtctcattgagtttttgttgtattgatgacgtgcatgcggatgggatccttcctttggactccatgaattgcagattgtgacagcctgttccatgagttcgtgcagtatgtgtataaatatcacccattgcggttttttgctatc

SEQ ID NO: 7672 - protein, 233 aa, Panicum virgatum
  misc_feature: Ceres CLONE 1952726
  misc_feature (1)..(151): Pfam Name: Pro_isomerase Pfam Description: Cyclophilin type peptidyl- prolyl cis-trans isomerase/CLD
MARIKPRQLLIQSKTKKAPSRISYSTIITWNLIVVLVVLSLYATYRHWHQRSAQDIEMDLHQAELAVRPDDSKMTSRPGYAVMNTGKGPITIEIYKDASADVVDRFSNLCKSNHFKGMPFRHIIKNFVIQGGDFDFDGAAQEWITKAKASGKNDLSPKHEAFMIGTAKNPNNKGFDLFITTAPIRDLNDKLVVFGRVIKGEDIVQEIEEVDTDEHYQPKTPIGIMNIILKQEP

SEQ ID NO: 7673 - DNA, 1260 bp, Panicum virgatum
  misc_feature: Ceres CLONE 1952773
  misc_feature: Encodes the peptide sequence at SEQ ID NO. 7674
atccgtatcagtccgtgtccgtcagtccccgctcgccactgctctcttgcctctggtctgatcagatcagatcacccgccaccccatggccgccgaccgccgcttcaagatcttcgcggccgccgacggctttggccagccgctcaaggacgccgtcgtcgcgcacctccgcgcgcacccggccgtcgccgaggtcgtcgacctcggcgtcgacaagtactacgccgccgccgcagccgtcgcccgccaagtctcctcctccgattcggccggcgcccccgaggtccgcggcgtcgtcgtctgcggcacgggcgccggcgtctgcatcttcgccaacaagtacccgcgcgtgtacgccacgcactgcgccgcccccgccgacgccgtcaacacccgctccatcaacgcctgcaacgtcctcacgctctcggggatggccacgccgcccgatgccgccgccgccatcgcggacgcctggctcgccacgcccttccgcgccccctgcccggcctccggggacacgccctggccggaggacatccagcggttcttcgacaccgcgccggacgagatggccgccatccccgaggccgagggcgcccccgactccgcctgcgccatctgctgcctcaggaacgggatggagttcgagccggtggggataatgcccgggggcgagatgcggatcgtgcgggagagccccacctcggcgtacgtacggttcaaggccggcagcgtggagccagcgcaccaccacacctttggccacgacctggtggtcatcaagggcaagaagaaggtctggaacctcaccaaggaggagagctacgacctggtggacggagatttcctcttcactccggccggggacgtgcacagggtgaagtacttcgaggacacggaattcttcatccgatgggatgggcactgggacatcttcttagatgaggatctcgacaccgcacgtagtgcgattgatgcagagcttggagcaggcagcaacggcaagtgaggtgactgcatcttgtgcggtaatggcaatgcttctgaagttacatgccctcattatcttggtcttgcaaagttgcgatgttggttgctatatatagttgttttgtcatctcgggttgcgatgttgtgcattatgatgatagcaaactgtacaatacaatgactgaataaaactgcatatgcaaggttgctagtcgtggttgttcttggaactggtttcatgtttatggaagctatatgttttatgtc

SEQ ID NO: 7674 - protein, 308 aa, Panicum virgatum
  misc_feature: Ceres CLONE 1952773
  misc_feature (1)..(149): Pfam Name: LacAB_rpiB Pfam Description: Ribose/Galactose Isomerase
MAADRRFKIFAAADGFGQPLKDAVVAHLRAHPAVAEVVDLGVDKYYAAAAAVARQVSSSDSAGAPEVRGVVVCGTGAGVCIFANKYPRVYATHCAAPADAVNTRSINACNVLTLSGMATPPDAAAAIADAWLATPFRAPCPASGDTPWPEDIQRFFDTAPDEMAAIPEAEGAPDSACAICCLRNGMEFEPVGIMPGGEMRIVRESPTSAYVRFKAGSVEPAHHHTFGHDLVVIKGKKKVWNLTKEESYDLVDGDFLFTPAGDVHRVKYFEDTEFFIRWDGHWDIFLDEDLDTARSAIDAELGAGSNGK

SEQ ID NO: 7675 - DNA, 1244 bp, Panicum virgatum
  misc_feature: Ceres CLONE 1952776
  misc_feature: Encodes the peptide sequence at SEQ ID NO. 7676
aatcatcaggcagcttggaacacgcggcaccgggatcgacggctgcgagctgttgaagtgcgctccgcgctactagaatggcgtccggctggaggggcatcctgggctttgactacggcatcgtgcaggcgccgctcggcccggacatctcgggccccgagctcgccgccgccgtcgccaacgccggggccatcggcctcctccgcctccccgactggccggcgccggatcgcgtcagagagctgattcggaagacgaggagcctgacgtcgaggccgttcggggcggccattgtgctggcgttcccgcacgaggagaacctgagggtcgtcctggaggagaagctcgccgtgctgcaggtgtactggggggagttcccgagagagcgggtcgaagaggcacaccgcgccggcgtcaaggtcttgcatcaggttggcagccttgaggaggcagcaaaagctaaagaagcctgtgtagatggaatcattgttcagggccgtgaagcaggaggtcatgtaattggtcaggaaggactgtttccactgttgccaagagtagtggatcttgtttcggactctggcattccagttatcgctgctgggggaatcgtaaatgggcgtggctatgttgccgcattagcacttggcgctcaaggcatttgtttaggaacaaggttcgtggctaccgtggaaagctttgcacatcctatttataagcaaaagctaattgagatgagtcacacagactacacaaatgtgttcggacgtgctagatggcctgatgctccacagcgtgtcctggaaacacccttctatgctgggtggaagaataatctgtcagatcaggaaacagaggaaagccagcccatcataggccactgcatcatccatggcatgcacaaggatattcgtcggtttgctggtactgttccaaacgccacagctacaggtgatgtcgagagcatggccatgtatgcgggtcagggtgttgggctaatcacagagatcctaccagctggcgaagttgtcaaaaggctggtcgctgaagcaaaggatgtcatcagagaaaagctttctaatttgaagtgaaatcttcaagaactgcaaactctatctacaatgcatcaagcatttgtaagtagtcacgcatcagaacaattggtatcgccatatttgcttctgtatgctatttgtaaataataactgttgaaaataaatgagattaccaaaggtattctgtctgcc

SEQ ID NO: 7676 - protein, 336 aa, Panicum virgatum
  misc_feature: Ceres CLONE 1952776
  misc_feature (2)..(318): Pfam Name: NPD Pfam Description: 2-nitropropane dioxygenase
MASGWRGILGFDYGIVQAPLGPDISGPELAAAVANAGAIGLLRLPDWPAPDRVRELIRKTRSLTSRPFGAAIVLAFPHEENLRVVLEEKLAVLQVYWGEFPRERVEEAHRAGVKVLHQVGSLEEAAKAKEACVDGIIVQGREAGGHVIGQEGLFPLLPRVVDLVSDSGIPVIAAGGIVNGRGYVAALALGAQGICLGTRFVATVESFAHPIYKQKLIEMSHTDYTNVFGRARWPDAPQRVLETPFYAGWKNNLSDQETEESQPIIGHCIIHGMHKDIRRFAGTVPNATATGDVESMAMYAGQGVGLITEILPAGEVVKRLVAEAKDVIREKLSNLK

SEQ ID NO: 7677 - DNA, 1411 bp, Panicum virgatum
  misc_feature: Ceres CLONE 1952784
  misc_feature: Encodes the peptide sequence at SEQ ID NO. 7678
agcaattttgcattcccacccgccccttccctcaaaattcgcagagtgtcctccctcccttcgctcgtgctcccccgcggcccctcccctcctagctttcctcctcgtccccgcgcgcaaatcctaaccctaccctcgcctcgcccgtcccgcggcgtcatgccaatggcgcgccccgtgtgagagaagggagagagacatagaggccgcggcgtggggaggagagagaggaggaggaggaaccggagagatgtataagcaggggggagcggggctggaccggaagcggatcagcgacgcgctcgacaagcacctcgagaaggctgtcgcgtcaccgtccacgtcgagggggtcggcgggaggcggcggcgggcgggaccaccaccgcctcgtcgtgccatcctccgcgtcgtccatccccaagggccgctgctctgaaggggagtctgattctgatagcgaagcgtcagatgttagtggctctgatggagaagacacctcatggatttcatggtattgcaaccttagagggaacgagttcttctgtgaggtcgacgacgactacatacaagatgacttcaacctttgtggcctcagcagccaagttccttattatgattatgctctcgatctcattttagatatcgagtcatctcatggtgatatgttcactgaggaacagaatgagctggtagaatcagctgcagagatgttgtatgggctgattcatgcacgctacattctgaccagtaaaggactggctgcaatgctggagaaatataagaactacgactttgggcggtgcccacgagtttactgctgtggtcagccatgcctaccagttggacaatcagatatccatcggtctagtactgtgaagatatactgccccaagtgtgaagacatctactacccacggtccaagtaccaaggcaacatcgatggtgcatactttgggacgacattcccccatctgttcctgatgacatatgagcacctcaagccccagaaaccctcacagcgctatgttcctcgtgtctttggcttcaagctccacaagccatgaaaacctcttgtatgtggctattaagctcgacaaagatgcagcatgacactgtggggagacgggagtttcacaaggtctagagacccttgaagacatatataagagcaccattggcaagatcatcagatcggtaaaattctatcatgctgcctcactcgtgtacctaggctgggcacacctatccaacatttgaatgtagctccaaggacatcaatgttgttgtaacctaactgcagttatttgattattaaaccaggacctcctacgatgtagaatatgggcattatttgtggccttgcgctgaaaatcgtttgcacttctatccaaaaaaaaaaaaaaaaaaaa

SEQ ID NO: 7678 - protein, 271 aa, Panicum virgatum
  misc_feature: Ceres CLONE 1952784
  misc_feature: Great-hit functional homolog of the protein sequence given in SEQ ID NO 9253
  misc_feature (1)..(175): Pfam Name: CK_II_beta Pfam Description: Casein kinase II regulatory subunit
  misc_feature: Useful for making plants with modulated flowering time
MYKQGGAGLDRKRISDALDKHLEKAVASPSTSRGSAGGGGGRDHHRLVVPSSASSIPKGRCSEGESDSDSEASDVSGSDGEDTSWISWYCNLRGNEFFCEVDDDYIQDDFNLCGLSSQVPYYDYALDLILDIESSHGDMFTEEQNELVESAAEMLYGLIHARYILTSKGLAAMLEKYKNYDFGRCPRVYCCGQPCLPVGQSDIHRSSTVKIYCPKCEDIYYPRSKYQGNIDGAYFGTTFPHLFLMTYEHLKPQKPSQRYVPRVFGFKLHKP

SEQ ID NO: 7679 - DNA, 1236 bp, Panicum virgatum
  misc_feature: Ceres CLONE 1952796
  misc_feature: Encodes the peptide sequence at SEQ ID NO. 7680
atcccggccgagtctgtgggcgtcgcctcgaacggagcaacgagctcaaaaaccccaatttcccgtcgaaccgatccaaatccaaaccccaaccccacgagaaatctatctcggatcaccttccccgctctgcctgttcctccgactccaatcacccgcgcgatccctccgcctgcgatctccctcggggatcgagcagcgccgcggcggcgggaaggaggaaggaaggaaggggacggagatgaggaagcgggagcgggagaacccgtgcgggatctgcgggcactaccacaagttcgaggagggggaggtctgcggggtgtgcggccaccgctggaagccgtcggacggggagggcaccccggcgaggcacgagtccgccttccccaccgaggtgctcaaggacttcctcttcctcgggagctacgacaacgccgcccgctccgaggtcctcaagacgctcggcatctcccacatcctcaacactgtgcctgattgccacaatctataccagaattcattcacgtatcacagtcttccgcgtgacaggcctttggattttgatggggcaatccggtttctagaacaatgtgaaagagataaagtacgtgttcttgttcattgcatgactggaaaaaacaggtcagcagctattgttgcagccttcttgatgaactctagagcatggagacttgctcagtctttacagtgggtgaaaggctgtcggccgcaggttcaactgacagatgcttctcaggacgagcttctggaatacgaacagaagctttttggactcggtgctcaacctgtgattcccactgaatcatttgcttctcttggatttggctacacaaaaccaacaggtgacaccgaagcacctacgttcaaccaaatgaccgtgccatccatattcaagcgagtcagcccaaatgacattcccgccaacttcacctttggagcccggaggatggtggaagtcaaccctcaagatagcgataacaatggtgggaccaacccagcttcaactgataacgtgatggacagctcttaagatgatatcaggctgttggatctccatgctgccgaagtaaccaaccactaggttactcaccggggagttcagtttcataggggtatttgatttttgtgcacttgagaaatggttctggcaactgccccgtgctgtagagtactggagtgactgaccctagtcgaattaaatgatgtttgacatgc

SEQ ID NO: 7680 - protein, 269 aa, Panicum virgatum
  misc_feature: Ceres CLONE 1952796
  misc_feature (1)..(134): Pfam Name: DSPc Pfam Description: Dual specificity phosphatase, catalytic domain
MRKRERENPCGICGHYHKFEEGEVCGVCGHRWKPSDGEGTPARHESAFPTEVLKDFLFLGSYDNAARSEVLKTLGISHILNTVPDCHNLYQNSFTYHSLPRDRPLDFDGAIRFLEQCERDKVRVLVHCMTGKNRSAAIVAAFLMNSRAWRLAQSLQWVKGCRPQVQLTDASQDELLEYEQKLFGLGAQPVIPTESFASLGFGYTKPTGDTEAPTFNQMTVPSIFKRVSPNDIPANFTFGARRMVEVNPQDSDNNGGTNPASTDNVMDSS

SEQ ID NO: 7681 - DNA, 1376 bp, Panicum virgatum
  misc_feature: Ceres CLONE 1952804
  misc_feature: Encodes the peptide sequence at SEQ ID NO. 7682
atctgtctccaccacccacgaggccgaaaccctagctagggttttactcgccgccgccttcgtcgatccagcgcccgagcgtctccgccgagattgccgcaatggacccaggccgcaagcggactgcgccagagggtgccaacggctccggcggcgccaagcgcccgagagaactggagacatctcaaatgggtgtaggaagcaaatcgaagccgtgcaccaaatttttcagtactgctggctgtccatttggttccagttgccattttctccacaacttccctggtggttaccaggctgttgcaaagatgaccaacttgggcggacaacatgttccatctcctatggggagatttcctatgggacctggtgttcctaatggaccacctacaccgtctgtgaagacccgcatgtgcaacaaatacaacaccgcagaaggatgtaaatggggtagcaaatgtcactttgctcatggagagagggagcttggaaagcccatggcattggacaactcaatgggaggacctccaatggggccaggacccaacggtcacttcatgcctccgccaatgcctttcccagacatggttcctccctcaacattcggagcttcagccacagccaagatcagtgttgatgcatcccttgctggcggcatcattgggaagggtggtaccaacattaagcatatatcccatgtgactggggccaagttagccatccgtgacaatgaagctgatcccaacctgaaaaacattgaactcgagggaacatttgaccagatcaggcatgctagtgctatggtcacagagctgatcgcccgcattggtggtaaagcccctcagcaagccaagaacccgggccgggggtctcatgctgggggccctgcaagcaacttcaagactaagctgtgtgataacttcaacaaaggctcctgcacatttggagagaggtgccacttcgcccatggtgaaggtgagctgcggaaacctgctgctgcttgatggatacttgtggcctattagcctgtggtggttactccgcctatatggctgaataacaccagaaccgaagatactcgtctgagctgaaatgagttgcgcaaatctgatgcttccaggaggaactttttgtggcctgtattgatcatgttgctgtaacattgaaatagagatccgacaatggctgtgcttttagagatttatttataggcctatggtttcttccttcgttctgcttttatttctgtagcttttttaggtaacttttgttggcagattattgtgattctgagtagatttgctctatttgtactatcaattcgtgaattcttgatacttattagaagtgcatgcaagttaaaaaaaaaaaaaaaa

SEQ ID NO: 7682 - protein, 300 aa, Panicum virgatum
  misc_feature: Ceres CLONE 1952804
  misc_feature (1)..(27): Pfam Name: zf-CCCH Pfam Description: Zinc finger C-x8-C-x5-C-x3-H type (and similar)
MDPGRKRTAPEGANGSGGAKRPRELETSQMGVGSKSKPCTKFFSTAGCPFGSSCHFLHNFPGGYQAVAKMTNLGGQHVPSPMGRFPMGPGVPNGPPTPSVKTRMCNKYNTAEGCKWGSKCHFAHGERELGKPMALDNSMGGPPMGPGPNGHFMPPPMPFPDMVPPSTFGASATAKISVDASLAGGIIGKGGTNIKHISHVTGAKLAIRDNEADPNLKNIELEGTFDQIRHASAMVTELIARIGGKAPQQAKNPGRGSHAGGPASNFKTKLCDNFNKGSCTFGERCHFAHGEGELRKPAAA

SEQ ID NO: 7683 - DNA, 1113 bp, Panicum virgatum
  misc_feature: Ceres CLONE 1952828
  misc_feature: Encodes the peptide sequence at SEQ ID NO. 7684
agattcccaaaccgctgctctccctcttctacctcattccctctccaccaccaccacattccaattccattccggccaccagagaagagaaacccaacaaagagccaccaccactcttcatcacttctcctccaccaaagcaccaaccagtccgggagccatgagcaaggactgcggcaaccacggcgaccacgacctccgccgctcgtgccggcgcctgctcggcctcctcctgggcctggccctcatcgtcgccatcatcgcgctcatcgtctacctcgtcctccgccccacgcacccgcgcttcttcctgcaggacgcctcgctccgccagctagacctcgccaacggctcctccaagctcctctccaccacgctccaggtcaccgtcgcctcccgcaaccccaacgaccgcgtcggcgtctactacgaccgcctcgacgtctacgcctcctacaagtaccagcagatcaccgtcgccgcctcgctcccgccggtctaccagggccacggcgacgwcgacgtctggtcgcccgtcctcgccggccccaacgtccccttcgccccctacctcgccgacgcgctccagcaggactgccaggccggctacctcatcctccaggtcaagatcgacggccgcgtcaggtggaaggtcggcagctggatctccggccactaccacctcttcgtcacctgcccggccttccttgtcaccaacggcggcaacggcgcgccaggggcaagcggattcaagttccagaccaccacctcctgccgcgtcgaggtctagctagctaccgaggctttgctgctgccgccggcgacggcgaggtaggtgcccgtacgtcgtcttgtgtctgtctgcctgtccagggttatagcagaaggggaaaaaacagaggccacagaagcagagagatcttgatgctcagggtcatggcgataggcgaggcggaaataatcgatcaattcatcaataccagtgaactgaatcaatcagtgattctgctgctgcgtataaaaatgtaaaggatgatgtttctttttttctttctttcgtagggttgattaataataatataatagtaggacgatcgagcgagggtcacacac

SEQ ID NO: 7684 - protein, 209 aa, Panicum virgatum
  misc_feature: Ceres CLONE 1952828
  misc_feature: Great-hit functional homolog of the protein sequence given in SEQ ID NO 9244
  misc_feature: Useful for making plants with altered protein content
  misc_feature (120)..(120): Xaa is any aa, unknown, or other
MSKDCGNHGDHDLRRSCRRLLGLLLGLALIVAIIALIVYLVLRPTHPRFFLQDASLRQLDLANGSSKLLSTTLQVTVASRNPNDRVGVYYDRLDVYASYKYQQITVAASLPPVYQGHGDXDVWSPVLAGPNVPFAPYLADALQQDCQAGYLILQVKIDGRVRWKVGSWISGHYHLFVTCPAFLVTNGGNGAPGASGFKFQTTTSCRVEV

SEQ ID NO: 7685 - DNA, 1199 bp, Panicum virgatum
  misc_feature: Ceres CLONE 1952843
  misc_feature: Encodes the peptide sequence at SEQ ID NO. 7686
agcggtgactccacagtccacaccccgctcctcctcctccgtcgctgccgtgccgttacccccagagagatggcgcgagtctccaatgccaggaagcggcagggcgccaagcccgcggccgccgcggatcccgccgccgccgccaagcaggccgggagcagcgtcggcggccgccccgtgcgcgtctacgccgacggcatcttcgatctcttccacttcggccacgcccgcgccctcgagcaggccaagaagctgttccccaacacgtatctgctcgtcgggtgctgcaacgacgagctcaccaaccgctacaagggcaagaccgtcatgacccaggaagagcgatacgagtccctgcgccattgcaagtgggttgatgaggtcattcctgatgctccgtgggttctcacacaggagttcattgataagcatcagattgactatgttgctcatgatgcgctaccttatgctgatactagcggggctgcaaatgatgtctatgactttgttaaaaagatcgggaaattcaaggaaacaagaaggacagatggggtttcaacttcggacctcattatgaggatcttaaaggactataatcagtatgtcatgagaaatttagcacggggctactctaggaaggatctgggcgtgagctatgtcaaggagaaacaactgcaagttaatatgaagattaataaattacgagagactgtgaaggcacatcaggaaaagttgcaaacagtggcaaagaccgctgggttgaatcatgaagaatggcttgccaacgcggatcgctgggttgccggtttcctggagaagtttgagcaacactgccacaatatggaaacagccatcaaggacaggatacaagagaggctggggagacagctgggcaaaggaatgaacgctggtcttgtgcagcagccggtggtggcctaaatgtgttgctgctgcagtgtagatgaaccctcgtggaccggtctagagtgaagtggaccgatgctcatcctcaggtgatgtgtggtttgtcgacatggaacgtggatgcttgtaagagtgcaacacagttgctgaggtgtttctagttttgtaacgcaaatggaagccatatacaaatgtctataggagaggcgtttgttgttttgagcatcgttacggccgtgttttctttgtacgtaagggttagattaacttttttc

SEQ ID NO: 7686 - protein, 289 aa, Panicum virgatum
  misc_feature: Ceres CLONE 1952843
  misc_feature (1)..(131): Pfam Name: CTP_transf_2 Pfam Description: Cytidylyltransferase
  misc_feature (24)..(274): SWISSPROT Homolog: EC 2.7.7.15 Choline-phosphate cytidylyltransferase B
MARVSNARKRQGAKPAAAADPAAAAKQAGSSVGGRPVRVYADGIFDLFHFGHARALEQAKKLFPNTYLLVGCCNDELTNRYKGKTVMTQEERYESLRHCKWVDEVIPDAPWVLTQEFIDKHQIDYVAHDALPYADTSGAANDVYDFVKKIGKFKETRRTDGVSTSDLIMRILKDYNQYVMRNLARGYSRKDLGVSYVKEKQLQVNMKINKLRETVKAHQEKLQTVAKTAGLNHEEWLANADRWVAGFLEKFEQHCHNMETAIKDRIQERLGRQLGKGMNAGLVQQPVVA

SEQ ID NO: 7687 - DNA, 608 bp, Panicum virgatum
  misc_feature: Ceres CLONE 1952877
  misc_feature: Encodes the peptide sequence at SEQ ID NO. 7688
actacagcttgtagctaagcaccaagactgctctctgaacttttagccacaacagcaggagaagcaacaaccatggtcagtgccaagagacttgttcaaatggcgaagaagtggcaaagaatggcggccctcgcgaggaagcggatcacgtcaccggcgaaagaaacccaagggtcaccgtgcagcacgtcgtcggtggccagcaagggccactgcgtggtgtactcggccgacagcaagcggttcgaggtcccgctggcgtacctcggcacagcgatcttcggcgagctcctgagcctttcccaggaggagttcgggttcgccggcgatgacggcaggatcacgcttccctgcgacgctgccgtgatggagtacgtggtgtgtttgctcagaagagacgcatcagaagaggtcctgagggcgttcctgagctccatggcgaggccttgccactgtggaaatggattgggtcaatctgtgggagttagccagcaagttgctgtttctagcttctgaagattagggctcagattggtttcttttcctgccatgatacatgtaaatagttagatgtgagatattggatgtgagaaccgcccaatttgccc

SEQ ID NO: 7688 - protein, 147 aa, Panicum virgatum
  misc_feature: Ceres CLONE 1952877
  misc_feature (1)..(103): Pfam Name: Auxin_inducible Pfam Description: Auxin responsive protein
MVSAKRLVQMAKKWQRMAALARKRITSPAKETQGSPCSTSSVASKGHCVVYSADSKRFEVPLAYLGTAIFGELLSLSQEEFGFAGDDGRITLPCDAAVMEYVVCLLRRDASEEVLRAFLSSMARPCHCGNGLGQSVGVSQQVAVSSF

SEQ ID NO: 7689 - DNA, 1223 bp, Panicum virgatum
  misc_feature: Ceres CLONE 1953051
  misc_feature: Encodes the peptide sequence at SEQ ID NO. 7690
gcttgagctgaaagcacttgcgacgcgggcacaagcagctcgcattgacgccgcggtcgggccggggctccgcatccagcccgggcgatctctttctttcctccccgcctcgctcgctccccgagtccccagcaccagcgccgctataagaagcagggctccgctctgcctgcccaaccaaccagcagcatccggccggcgaccaccgtccgcccgtgagtgagcgagcggcggcgcactaccgtacaatggcccgggcttcctctccccaccagttccttggagcggcggtcacggtggcgcttgtagtccttgccgccgcgccgtccgcgcttgccggcgacccggactacctccaggatctctgcgtcgccgacctcaactccgagctgaaggtgaacgggttcccgtgcaaggcgaacgccaccgcagacgacttcttctcgagcgtgctggccaagccgggcaacaccaccaacgccgtgggctccgtggtcacgggcgccaacgtcgagaaggtcccggggctcaacaccctgggcgtctcgctctcgcgcatcgactacgcccccggcgggctcaacccgccgcacacgcacccgcgcgccaccgagctcgtcttcgtcctctacggcaccctcgacgtgggcttcgtcaccaccgccaacaagctcgtcgccaggaccatctcccagggcgacgtcttcgcgttcccgcgggggctcgtgcacttccagaagaacgccggcgacgagcccgccgccgtcatctcggccttcaacagccagctccccggcacgcagtccatcgccatgacgctcttcggggcctcgcccgaggtgcccgacgaggtgctcgccaaagcgttccagatcggcgccgaggaggtggacaagatcaaggccaagttcgcgcccaagaagagctgaggacccaggtggaactgattttggtctgaccatcagtcgctgatgatgatattggtatgcattggttggttcgaagttcgattattctgctgttgcttcgtttgcttcattgcttgtgattgagcgtgcaatgcaatcgtacgcgtcgttgggtttgtgttgtgtgtgatgattgtcggttaagtgtgagtgtgtgacctgcagaatgagttggtaggtgcctctctctgtcttgtaataagctgcaggcctgatggagaacattctgttcatcttatattattcagaagctcg

SEQ ID NO: 7690 - protein, 226 aa, Panicum virgatum
  misc_feature: Ceres CLONE 1953051
  misc_feature (19)..(225): SWISSPROT Homolog: EC 1.15.1.1 Nectarin-1 precursor
MARASSPHQFLGAAVTVALVVLAAAPSALAGDPDYLQDLCVADLNSELKVNGFPCKANATADDFFSSVLAKPGNTTNAVGSVVTGANVEKVPGLNTLGVSLSRIDYAPGGLNPPHTHPRATELVFVLYGTLDVGFVTTANKLVARTISQGDVFAFPRGLVHFQKNAGDEPAAVISAFNSQLPGTQSIAMTLFGASPEVPDEVLAKAFQIGAEEVDKIKAKFAPKKS

SEQ ID NO: 7691 - DNA, 1496 bp, Panicum virgatum
  misc_feature: Ceres CLONE 1953185
  misc_feature: Encodes the peptide sequence at SEQ ID NO. 7692
actcagcactcaccttcgcccatggcgaccatctctgcagccctcgccatctccttcctcccgtccccgactcgcttacccgtccccactacggcctccccgtcctcgcgcataaagagaacggcgcgcttcaggtgctgtgcggagccttcttcccaggagcaggataccgcggccgctcctcctaccctgccgcccgcaaaagagtccacttcgtctctgctgggcatttccacgagcacctggtctgcgggtgtcgctgggctggggttcctggagactgggtacctcacgtacctcaagctcacgggatccgaggcgttctgccccatcagcggcggaggctgcggcgacgtcctcgacagcgactactccgccgtctttgggataccccttcccttagttggtctggtggcatatggtttggttacagcactttctctgcaagaaaatggaacggacttgctccctggattggatgacctggatattcagttaacattgcttctgattgctacttctatggcgactgcaagtgcttattttctttatattctaagcactaaattcgtcggggtatcctgttcttactgcttgttgtcagcagttctctcgttcactctacttttcatcagagtaaaggacttcggttttgagcgtatccagaagttcgctggtattcagttagctgtagttgtcattatagctctagctttgacaaactcatacggttcagctactactcagttgaagggcacagatgattttgtattagaaccatatgaaacagagataacaaccgaatcatccccattcgctatatcattggctagacatttgcactctataggtgctaagatgtatggagcattctggtgttctcattgcaatgaacaaaaacagatgtttggtcgtgaagctacaaaaattctagactatgtggagtgtttcccaaatggtgctggtaagggaaagaaaatgagttcggaatgtcaagctgctggtcttgaaggttttccaacatggttcatcaatggaaaggtcctgagcggtgatcaggagcttgaagttctggcagaagcatcaggcttcgttgctgagggtacagaacaatccaaggaaatagcaccgaattgatattataacttttgaacttataaactgagagctttctgaaaaatctcggtggagtcttcagacatcaatataacaaaatatgcactcgagcagttgcatccgaaggtcgtatagtctacttgacaactaaccattataatttgtagcaactctgcttgctctccgagaagaggaaacaaaccccaaggcagcttgttgtacaaccattttgtagtcctagtttgtactgtaaaatgtgtaatcctttgaaaacacgcactttctcatttgacgtatatatatacagtactatgtaatgccattcccgcttatatgaaatttaagttgacactggagtaaacaaaaaaaaaaaaaaaaaa

SEQ ID NO: 7692 - protein, 371 aa, Panicum virgatum
  misc_feature: Ceres CLONE 1953185
  misc_feature (1)..(137): Pfam Name: VKOR Pfam Description: Vitamin K epoxide reductase family
MATISAALAISFLPSPTRLPVPTTASPSSRIKRTARFRCCAEPSSQEQDTAAAPPTLPPAKESTSSLLGISTSTWSAGVAGLGFLETGYLTYLKLTGSEAFCPISGGGCGDVLDSDYSAVFGIPLPLVGLVAYGLVTALSLQENGTDLLPGLDDLDIQLTLLLIATSMATASAYFLYILSTKFVGVSCSYCLLSAVLSFTLLFIRVKDFGFERIQKFAGIQLAVVVIIALALTNSYGSATTQLKGTDDFVLEPYETEITTESSPFAISLARHLHSIGAKMYGAFWCSHCNEQKQMFGREATKILDYVECFPNGAGKGKKMSSECQAAGLEGFPTWFINGKVLSGDQELEVLAEASGFVAEGTEQSKEIAPN

SEQ ID NO: 7693 - DNA, 1093 bp, Panicum virgatum
  misc_feature: Ceres CLONE 1953215
  misc_feature: Encodes the peptide sequence at SEQ ID NO. 7694
aaaagcctcacagctgcgcagttccagcctccatagctcggccagcaaactcttccgcctcatcgtatccgtcgcctccgattccttgcgttcccttcctccctgggaggtctcagcgaggagcgaggagcgaggagctgaggagacgccgaatcgatctcggtcgggatgaagagccggaggcagagcagcgggggcagctcggccggcgcgaccgccgcgggggaggggaacacgcacagcagcggcggcgggtgcaagctggagaggaaggacgtggagaagaaccggcggctgcacatgaagggcctctgcctcaagctctcctccctcatcccgcccgccgcccgccgcgcgtccctgctctcggaggcggcggcgtccgcgtccaaccccaacaaggacgcggcgacgcagctggatcagctggacaccgcggcggcgtacatcaagcagctcaaggagcggatcgatgcgctgaagcggaggaaggagggcggcggcggcggccgtgccgccaccgcagggtccggcgccggcgccgtgcgcatgccggtggtcgaggtgcggtgccaggacggggcgacgctggacgtggtgctcatcagcgaggccgggcggccgttcaagctgcacgaggtgatcacggcgctggaggaggaaggcgccgtggtcgtcagcgccagcttctccgtcgtcggcgacaagatcttctacaccatccactcgcaggcgctcagcccccgcatcgggctcgacgccgccagggtctccgagaggctgcacgacctgctgctcctcgcctgactctgacggacgaaccacctgaacgaacatcaccagcgacggtgctgacgaggaagatctactgtattgttagcgtagctagctagtcgaggtcaggacgcacggaccataactccataagcatagccggctgatccagggaagggaagctttggtttctttgcagttgtgcatacgtaggagcaagcgagcagactgctttttttttttcagctcgatcttagaacgaaatggccggtgctgtaacacactggagtgagtacatgcatcctgtctctgttctatt

SEQ ID NO: 7694 - protein, 212 aa, Panicum virgatum
  misc_feature: Ceres CLONE 1953215
  misc_feature: Great-hit functional homolog of the protein sequence given in SEQ ID NO 9607
  misc_feature (2)..(72): Pfam Name: HLH Pfam Description: Helix-loop-helix DNA-binding domain
  misc_feature: Useful for making plants with altered Lignin content
MKSRRQSSGGSSAGATAAGEGNTHSSGGGCKLERKDVEKNRRLHMKGLCLKLSSLIPPAARRASLLSEAAASASNPNKDAATQLDQLDTAAAYIKQLKERIDALKRRKEGGGGGRAATAGSGAGAVRMPVVEVRCQDGATLDVVLISEAGRPFKLHEVITALEEEGAVVVSASFSVVGDKIFYTIHSQALSPRIGLDAARVSERLHDLLLLA

SEQ ID NO: 7695 - DNA, 1100 bp, Panicum virgatum
  misc_feature: Ceres CLONE 1953368
  misc_feature: Encodes the peptide sequence at SEQ ID NO. 7696
agcaggaaccggcactcattgaggaaccacacgcggagaaaggggggagaccaagaagaagcaagccatggagctcaatcaagcagacgaggttctatcttctccgcttgctccaaatgcaaaggacaatctcagcatgatgcactcaaagtttatcggctgcaagctctacatttctgaaagccgcaatcccacggctattgccgcaattggtcttgcagcgaagactgatcctcaggttgcggtgctaagcaagttcgaagatagtctctacaaccgcgtacgctacacacttgtctcctatatcattgatggcagctcaactggtgaagagatatatagtccaatcaggaaggtattgttggcgatgatggaggctgcattttcagccataaacctcgaatcgcactccggtgctcatcctagaatgggtgtcaatgatgacctatccttccaccccttgggtcaagccacaatggaggatgcagcttacttggctaagcaggtggcttcagacattggcaatgattttcaagtgccggtgttcctctatgcagcagcccatcccacaggcaagcctgtaggtgcaataaggcgtgagctcggctactaccggcccaatcacatgggcaaccagtggtcaggtaccatgctccctgatgttctgccaattaagcctgatgagggtccaaccagtgtttcttctgaaagaggggccacaacagttggcgcgacaccttttgttgaggcatacaatgtgccagtgctctcaaaggatgttgcaactgtgaggcggattactcgaagactaagcggacgcggtggagggcttccgactgtgcaagctcttgcgcttccccatggtgatgattgcacagagatcgcatgcttgttggatccagatcatgtcagtgcctatcaagttcagaccgtggttgagcagattgcagcagaagaagggctcgaagttgagaaggggtacttcactgacttaactaaggacaggatgcttgacaagtacttgaagataactgctgattgatatgaatgtaatagaactttgtgcgactgactaacccagatgaatcatgcatgtttat

SEQ ID NO: 7696 - protein, 324 aa, Panicum virgatum
  misc_feature: Ceres CLONE 1953368
  misc_feature (1)..(197): Pfam Name: FTCD_N Pfam Description: Formiminotransferase domain, N-terminal subdomain
MELNQADEVLSSPLAPNAKDNLSMMHSKFIGCKLYISESRNPTAIAAIGLAAKTDPQVAVLSKFEDSLYNRVRYTLVSYIIDGSSTGEEIYSPIRKVLLAMMEAAFSAINLESHSGAHPRMGVNDDLSFHPLGQATMEDAAYLAKQVASDIGNDFQVPVFLYAAAHPTGKPVGAIRRELGYYRPNHMGNQWSGTMLPDVLPIKPDEGPTSVSSERGATTVGATPFVEAYNVPVLSKDVATVRRITRRLSGRGGGLPTVQALALPHGDDCTEIACLLDPDHVSAYQVQTVVEQIAAEEGLEVEKGYFTDLTKDRMLDKYLKITAD

SEQ ID NO: 7697 - DNA, 1191 bp, Panicum virgatum
  misc_feature: Ceres CLONE 1953372
  misc_feature: Encodes the peptide sequence at SEQ ID NO. 7698
taactgaagaagattactttgatccttgttcttgatgatagactagcaaagaagccgcgcagcatctgattagatgttgttgctcgtcctgtccgagcaccccctttctggttttatggtcggctccaccatcacccgcctcgtgcagtccttctccgtcgtcttcctctactggttctatgtcttctcagtagcatccctgtagttagttgtaattttgcaactaactaagttttctctataggatataattaagatagtaacaaaggggtacgtatacgtgacacataagagctgaaatagttgagagtacacaagaggtggtgagacgtgaccatgtcaagtgggaccttgtctgggtcgagtttagggacccggagctccaagtcggaggatgacctggacctccaggcccagatggagaggaggaggaagcgcaggaaggagtccaaccgggagtcggctcggaggtctaggctgcgaaagcagcagcatcttgacgacctcacctcacaggtaaaacacctgaaggaccagaacaaacagctcagcttggcactaagcataaccagccaaaaccttgtggcagtgcaagcacaaaactctgttctgcagacccagaagatggagctggacagcaggctgagtgccctgactgagatcctctgttacatgaacaccatcacttgcaccaatgcaagtgctcctgcaaatccagccatggtgaacaacatcacatccagcagctcctatgatcttcttggtgccagctgcacatggaaccagcagccaatagacatgtaccagtgcttctagctctacaagagagaagtggttgttacatgacatagtggtagggccagaaggaaaggaggcagacaggcatcaagctcttttcaatcatgtagggtctttgtgtcactattgatgtatgcttgatgcctctctcttaattgtgtattttggaggagatagagatgttttggttttcttgttgctggtggtagagcctaaaggatggggaaatagcgaagttgtgcttggcattgtgtgaggtggagggtgttgtactctggtagttgagggtagaggggaaataatattgggccagactgtgaaagagaaaggcaggggattttgtactggctcaaactaatgcataaatgcgtaatgatgatgatgatgtttatc

SEQ ID NO: 7698 - protein, 159 aa, Panicum virgatum
  misc_feature: Ceres CLONE 1953372
  misc_feature (1)..(65): Pfam Name: bZIP_1 Pfam Description: bZIP transcription factor
  misc_feature (2)..(55): Pfam Name: bZIP_2 Pfam Description: Basic region leucine zipper
  misc_feature: The sequence is a functional homolog of  SEQ ID NO 248 in the  10/225,066 US patent application
  misc_feature: The sequence is a functional homolog of  SEQ ID NO 2508 in the  10/374,780 US patent application
  misc_feature: The sequence is a functional homolog of  SEQ ID NO 74 in the  10/286,264 US patent application
  misc_feature: Useful for making plants with modulated growth and phenotype characteristics
MSSGTLSGSSLGTRSSKSEDDLDLQAQMERRRKRRKESNRESARRSRLRKQQHLDDLTSQVKHLKDQNKQLSLALSITSQNLVAVQAQNSVLQTQKMELDSRLSALTEILCYMNTITCTNASAPANPAMVNNITSSSSYDLLGASCTWNQQPIDMYQCF

SEQ ID NO: 7699 - DNA, 1645 bp, Panicum virgatum
  misc_feature: Ceres CLONE 1953416
  misc_feature: Encodes the peptide sequence at SEQ ID NO. 7700
gcaatcgaacgccaccccgaaaaatccccaaaaaagaagggggaaattacgcagcatgaactgcttgaagaactcgcgctccgtcctctcgcggctcctccgccacaggccccacgtagccgcgccgccggcgccgcagtcgccggcatcccggtactactctttctacgcctcccgcatcctccgcaacaagcccgccgtctccccaccgccgctgccgcagttgcccggccctaggcactactgcacctcccggccgagggaggaggtcatccacttcacccgccgccgcggcgggtcccggtggtaccacgaccatcggaagctcaccgcaggggtcttgatcaccgggggcggggcggtcgccgtctacttcggccacctcgaggccgtgccctacaccaaccgctcccatttcatcatcctctcgcccaagctcgagcgccagctcggcgagacccagttcgcggaactcaagaagcagttcgggcccaagatcttgcccccgctccaccccgacagcatccgcgtccgcctcatcgcctcggagatcgtccgcgccgtgcaccgtgggcttgccggtcaccagcgatacgacgcctcgtacggagaggacgcctcttatgggtatggcggcatctccgacgaccacaccatcaggaaccgcgacgccgacgctactgccgcgatgcttggtgggtcccctcgcaagaacgcgacggcggctgatgcagtccagcgagacgacgaggttctggatgacaggtgggtcactgagagccggagccgtggtaaggcgaagggggcgcagcagcagacgggtcatcttgacgggctcaattgggaggtgattgttgtcagagatgacatcgtcaatgcaatgtgcctgcctggtggcaagattttagtcttcactgggttgctggacaaattcagggcggatgctgaggttgccactgtgcttggacatgaggttgggcacgctattgcaaggcactctgcagagcaaatcacaaagaacatgtgggtggcaatcctgcagattatcgtcctgcagtttatctacatgccagacctgataaatacaatgtcaacattacttcttaggctgcccttctcacggaggatggagatagaggctgaccacattggactcctgctacttggtgctgctggttatgatccacgagtagccccatcagtctatgagaaactaggaaagataggaggagattcagcactgaacaattatctctcaactcatccttcgagtaagaagagagcggagcttctctctcgagctcatgtcatgaacgaggcactggaattatacagggaagttagtgccggccaaggcactgaaggtttcctctagattctgggatttactcctctacttgtttcaaatgctttacaaaaaaggttggtcatcctagcaccactagtggacagtggtgggctgtgcctggaagatgaaagaatgtttcgtgtcccttgttaccttcagatgttgtctgggtgaatggtcctctgtttcaccccaaactggagcttagctgcttcaattgtgatcagggaaaaggaaaccaatttgtccatagtgtcaataattgtttgttgacagcaaaaaaaaaaaaaaaaaaaa

SEQ ID NO: 7700 - protein, 439 aa, Panicum virgatum
  misc_feature: Ceres CLONE 1953416
  misc_feature (1)..(159): Pfam Name: Peptidase_M48 Pfam Description: Peptidase family M48
MNCLKNSRSVLSRLLRHRPHVAAPPAPQSPASRYYSFYASRILRNKPAVSPPPLPQLPGPRHYCTSRPREEVIHFTRRRGGSRWYHDHRKLTAGVLITGGGAVAVYFGHLEAVPYTNRSHFIILSPKLERQLGETQFAELKKQFGPKILPPLHPDSIRVRLIASEIVRAVHRGLAGHQRYDASYGEDASYGYGGISDDHTIRNRDADATAAMLGGSPRKNATAADAVQRDDEVLDDRWVTESRSRGKAKGAQQQTGHLDGLNWEVIVVRDDIVNAMCLPGGKILVFTGLLDKFRADAEVATVLGHEVGHAIARHSAEQITKNMWVAILQIIVLQFIYMPDLINTMSTLLLRLPFSRRMEIEADHIGLLLLGAAGYDPRVAPSVYEKLGKIGGDSALNNYLSTHPSSKKRAELLSRAHVMNEALELYREVSAGQGTEGFL

SEQ ID NO: 7701 - DNA, 1692 bp, Panicum virgatum
  misc_feature: Ceres CLONE 1953442
  misc_feature: Encodes the peptide sequence at SEQ ID NO. 7702
aggccaagccattctccgttccccctcggctccgctacttcccatctcagcctgcgttcccgcctccaagccgtctagattcaagccaccgcgagcagctcgtggccatgctggccgcggggagaagcggcagcggcatggcgctggcgctcatcgtcctcgccgcctccgcggtgtccctgttccctgcggcggcgtccctctccgtcacctcgccctacgtgcgcccgccgccgcggccggacgcgctgtcgctgctgctccaggacgacgacgacggcgacggccagacgccgcagcaggtacacatatcaatggtcgggcctgacaagatgagggtgacatggatcaccgacgacgaagcgccggcgatcgttgagtatggcacgacgtcaggcaactacccgctgtctgcaaccggaagcacgacgacctactcctacgtcctctacaaatccggcaacatccacgacgccgtcatcggcccactgcagcctagcacaacttactactaccggtgcagctccaacccaaagcgcgagttctccttccggacgccgccggccaccctccccttcaagttcgtcatcgtcggcgactttgggcaaaccggatggacggagtcgacgctgaagcacatcgcggccgccgactacgacatgctcctcctccccggcgacctctcgtacgccgacttcatccagtcgaggtgggactcgtacggccgcctcgtggagccgctggcgagcgcgcggccgtggatgatgaccgagggcaaccacgagatcgagaagctccccgtcgtcgagcccgagcccttcaaggcctacaacgcgcggtggcgcatgccgtacgacgcgggcgccacgccgtcgggcgacaacctctactactccttcgacgtcgccggcggcgccgtgcacgtcgtcatgctgggctcctacaccgactacgacacgggcagcgcgcagcacgggtggctccagcgcgacctggcggctgtcgaccgcggcaggacggcgttcgtgctggcgctggtgcacgcgccgtggtacaacagcaacagggcgcaccagggggagggcgacgccatgcgcgacgccatggaggcgctgctctacggcgcgcgcgtggacgccgtgttcgcggggcacgtgcacgcgtacgagaggttcgcgcgcgtgtacgccgggaaggaggacccctgcgcgccgctgtacgtcaccgtcggcgacggcggcaaccgggaggggctggcggacaagtacatcgacccgcagccggcgatctcggtgttccgggaggcgagcttcgggcacgggcgcctggaggtggtgaacgccacccacgcgctgtggacgtggcaccggaacgacgacgaccagcaggtggtcgcggaccaggtgtggatcaccagccttgcgaccaccccggcttgccgcggaagcaagggcaagaagtgaccagaagaaaactgtgtcttcaccggcgtgagttcaaattaaatttatagatatatgttgttccccaaagcaatatttataaattggtgtcattctctttaaattagtggggcagtgtcatgtaaatatccgtacttttactgattgttggaccttgtacaattattattatgcttcctgaatttaaaaatgggcgaggagtccaacttaaaaaaaaaaaaaaaaaaaa

SEQ ID NO: 7702 - protein, 451 aa, Panicum virgatum
  misc_feature: Ceres CLONE 1953442
  misc_feature (1)..(197): Pfam Name: Metallophos Pfam Description: Calcineurin-like phosphoesterase
MLAAGRSGSGMALALIVLAASAVSLFPAAASLSVTSPYVRPPPRPDALSLLLQDDDDGDGQTPQQVHISMVGPDKMRVTWITDDEAPAIVEYGTTSGNYPLSATGSTTTYSYVLYKSGNIHDAVIGPLQPSTTYYYRCSSNPKREFSFRTPPATLPFKFVIVGDFGQTGWTESTLKHIAAADYDMLLLPGDLSYADFIQSRWDSYGRLVEPLASARPWMMTEGNHEIEKLPVVEPEPFKAYNARWRMPYDAGATPSGDNLYYSFDVAGGAVHVVMLGSYTDYDTGSAQHGWLQRDLAAVDRGRTAFVLALVHAPWYNSNRAHQGEGDAMRDAMEALLYGARVDAVFAGHVHAYERFARVYAGKEDPCAPLYVTVGDGGNREGLADKYIDPQPAISVFREASFGHGRLEVVNATHALWTWHRNDDDQQVVADQVWITSLATTPACRGSKGKK

SEQ ID NO: 7703 - DNA, 600 bp, Panicum virgatum
  misc_feature: Ceres CLONE 1953644
  misc_feature: Encodes the peptide sequence at SEQ ID NO. 7704
cagtcattttcggtccttaatttaagcgcgcgagacaaggaggcactggtgtgtcttcctctttcttccatattctcattctcaccatcaccaaaccgaaaaccacaccatggttcatcatctccgtgccatctccctcaccggcttcaccatcctgctgtccctcgccctcctcttcacctcccagcaagctcaaggagccagcagcaacttgggtcgccgcagcggcaaggagaaacaacgacaggagtcgtcggaggagtactacgtccccgtgcggagcgtggtgtaccggtcgcggtcggtggcgcttccggcggcggcggcagcgacggaggcggtggggtacgagccgttcgaggtgtgcgaggggtgccggtgctgctcgacctccaacacgagcagctgcgtggacacgagctgctgctacgccatcgactgcaacctcccggggaagcccttcggcacctgcgccttcacgccccaaacctgcggctgcggcggcaccaccaactgcacccagccctcctgatccttgctttcctgattactcatttcgtgttcttctttgactgactctcaaatatcaatttgggtctg

SEQ ID NO: 7704 - protein, 140 aa, Panicum virgatum
  misc_feature: Ceres CLONE 1953644
  misc_feature: Great-hit functional homolog of the protein sequence given in SEQ ID NO 9322
  misc_feature: Useful for biocontainment applications
MVHHLRAISLTGFTILLSLALLFTSQQAQGASSNLGRRSGKEKQRQESSEEYYVPVRSVVYRSRSVALPAAAAATEAVGYEPFEVCEGCRCCSTSNTSSCVDTSCCYAIDCNLPGKPFGTCAFTPQTCGCGGTTNCTQPS

SEQ ID NO: 7705 - DNA, 1265 bp, Panicum virgatum
  misc_feature: Ceres CLONE 1953714
  misc_feature: Encodes the peptide sequence at SEQ ID NO. 7706
acagccaagcaactctcgatcccgtccctaatcagcagctcgagctcgctttagcttgagaagcagcgcgtgtgtttgcagcaatggcggccgccaatgtcctcctcgtcctgctctgctcaaccttctgcttcctcgcccgccgggccgccggcgactacggcgggtggcagagcgcccacgccacgttctacggcggcggcgacgcgtccggcacaatgggcggggcgtgcgggtacgggaacctgtacagcaccgggtacggcaccaacacggcggcgctgagcacggcgctgttcaacgacggcgcctcgtgcgggcagtgcttcgagctccgctgcgacaacgccggccagtcgtgcctgccgggcaccatcaccgtgacggccaccaacttctgcccgcccaactacggcctgcccaacgacgacggcggctggtgcaacccgccgcgcccgcacttcgacatggccgagccggcattcctccagatcgcgcagtaccgcgccggcatcgtgcccgtcgcctacaggagggtgccgtgcgtgaagaagggcgggatccggttcaccatcaacggccactcctacttcaacctggtgctggtgaccaacgtggccggcgccggcgacgtgcagtccgtgtccatcaagggctccgccaccgggtggcaggccatgtcccgcaactggggccagaactggcagagcaactcgctcctcgacggccaggccctctccttcaaggtcaccgccagcgacggccgctgcgtcaccagcaacaacgccgcgccggccggctggcagttcggccagaccttcgagggcggccagttctagcggcccagccccgcgccgccgccgttcgacgaggatccatcggtcggcgttcggagaaggaaaaccggccggcctcttcgccgtagtaaagaagagagcccgccggccattctgaggctgcttatcattagcacccgcttaggcctttccttctccgacgacgacgatgatgataggattaagttatttttctgtatcagtgattgtgtagccttggattatggggattaaaaaaaagaacctgcagggccaattattgtagggcaagctgcaggggagtgtgtggtgtcgtgttcgtgtaacttttgttgttacatgggttgggtgatctatcaccgatggcaccttgggaccgtgcccaatgcttatttatggccggtctgaacgtgcagtatatatggtatgctttgtgctttgttgatcttc

SEQ ID NO: 7706 - protein, 251 aa, Panicum virgatum
  misc_feature: Ceres CLONE 1953714
  misc_feature: Great-hit functional homolog of the protein sequence encoded by LOCUS At1g69530
  misc_feature: Great-hit functional homolog of the protein sequence encoded by LOCUS At2g03090
  misc_feature: Useful for making plants with altered cell wall content and/or composition
MAAANVLLVLLCSTFCFLARRAAGDYGGWQSAHATFYGGGDASGTMGGACGYGNLYSTGYGTNTAALSTALFNDGASCGQCFELRCDNAGQSCLPGTITVTATNFCPPNYGLPNDDGGWCNPPRPHFDMAEPAFLQIAQYRAGIVPVAYRRVPCVKKGGIRFTINGHSYFNLVLVTNVAGAGDVQSVSIKGSATGWQAMSRNWGQNWQSNSLLDGQALSFKVTASDGRCVTSNNAAPAGWQFGQTFEGGQF

SEQ ID NO: 7707 - DNA, 1040 bp, Panicum virgatum
  misc_feature: Ceres CLONE 1953746
  misc_feature: Encodes the peptide sequence at SEQ ID NO. 7708
acacacctccctcgacctcaacgacccccaagcgcacgcgactcgacctcttcccgttccggcggcggcggcggcgatggcggcgaatctggaggacgtgccgtcgctggatctgatgcacgagctgctccgccgcatgaagtgcagctccaagcccgacaagcgcctcatcctcatcggtccacctggctctggaaaggggactcagtcaccccttattaaggatgaatattgcctgtgccatttagccactggtgatatgttgagggctgctgtggctgccaagactcccctgggaatcaaagcaaaagaagctatggataagggtgaacttgtttctgatgacttagttgtggggattattgatgaagccatgaagaagccttcatgccagaaaggtttcattcttgatggcttccctagaactgttacacaagcacagaagcttgatgagatgctggcaaagcaaggtgctaatgttgacaaggtgttgaactttgcaattgatgatgctatattggaagagcggattactggtcgttggatccatgcagctagtggtaggacataccatacaaagtttgcacctccaaaaaccccaggagtagatgatgttactggagagccactgatgcagaggagagatgatacggctgaggtcttgaaatcaaggcttgaggccttccaccggcaaactgaacctgtgattgactactactccaagaagggcttagtggcgaatctgcatgctgagaaaccacctaaggaagtgactgctgaagtgcagaaagttctctcatcatgaaacttcacctttcagcttaagcatggcatgtaccaaaagtccattgtcagagttttcccaaaatgcacactgacgcctacatcctgagatttcattttccaaatttcatttgtgcgagggcaccattttatcacagctttgacaagctccggaattgtctaaataatttctgttttggacgaggaaagttgtttttgtactaacactgattattacagcaatttgtcctcggcag

SEQ ID NO: 7708 - protein, 242 aa, Panicum virgatum
  misc_feature: Ceres CLONE 1953746
  misc_feature (1)..(187): Pfam Name: ADK Pfam Description: Adenylate kinase
  misc_feature (1)..(241): SWISSPROT Homolog: EC 2.7.4.3 Adenylate kinase A
  misc_feature (2)..(241): SWISSPROT Homolog: EC 2.7.4.3 Adenylate kinase B
MAANLEDVPSLDLMHELLRRMKCSSKPDKRLILIGPPGSGKGTQSPLIKDEYCLCHLATGDMLRAAVAAKTPLGIKAKEAMDKGELVSDDLVVGIIDEAMKKPSCQKGFILDGFPRTVTQAQKLDEMLAKQGANVDKVLNFAIDDAILEERITGRWIHAASGRTYHTKFAPPKTPGVDDVTGEPLMQRRDDTAEVLKSRLEAFHRQTEPVIDYYSKKGLVANLHAEKPPKEVTAEVQKVLSS

SEQ ID NO: 7709 - DNA, 912 bp, Panicum virgatum
  misc_feature: Ceres CLONE 1953842
  misc_feature: Encodes the peptide sequence at SEQ ID NO. 7710
aagcattccttcctccgtctccctcatagtagccttcttccacctgcttctagcctatctacttccagcttgcacctcagacctcacctcgccatgggtggagcttctgaccttcctccagggttccacttcttcccatcggatgaagagctcatcgtccacttcctccgccgcaaagcctccctgcttccatgccagccagacatcgtcccaacaatacttctgaaccactacgatccatgggaactgaatgacaaagcacttcaagcaggtaaccagtggtacttcttcagtcatgcaacacaaagtagggtcacaccaaatggttactggagctctatttgtgccgatgagacggtaaaaagtggtggctgtaacattggcctgaagaagacgcttgtcttttccattggagagtcctctgaggggattgaaaccaactggatcatgcatgagtaccacttactagacggggggaaggtgtgtagcagtagcacttcaactagttcaagcaggaagttgcacagggagaaaggtcactcaaacacagagtccgataactgggtgatatgccgagtgtttgattcgacctgcggatcgcaagcgaacttccatgaggagggcatggagctttcatgtttagatgaggtgttcctatccctcgacgactatgacgaagtcagtttgtcaaataattagaacccttgtcagcagaactggtagtaggccatgtacctatacggtaccattatgttgattctagcaggaaaagttactccaaaagatcaaatgattccataggtgtcgaacctagacatgtgtctagaccacacatgtaattattctccccaaagaacgagccacacatgtaacaaacttgagttagcttgatgtaactatggcattaatgtg

SEQ ID NO: 7710 - protein, 201 aa, Panicum virgatum
  misc_feature: Ceres CLONE 1953842
  misc_feature: The sequence is a functional homolog of  SEQ ID NO 2694 in the  10/374,780 US patent application
  misc_feature: The sequence is a functional homolog of  SEQ ID NO 662 in the  10/225,066 US patent application
  misc_feature: Useful for making plants with modulated growth and phenotype characteristics
MGGASDLPPGFHFFPSDEELIVHFLRRKASLLPCQPDIVPTILLNHYDPWELNDKALQAGNQWYFFSHATQSRVTPNGYWSSICADETVKSGGCNIGLKKTLVFSIGESSEGIETNWIMHEYHLLDGGKVCSSSTSTSSSRKLHREKGHSNTESDNWVICRVFDSTCGSQANFHEEGMELSCLDEVFLSLDDYDEVSLSNN

SEQ ID NO: 7711 - DNA, 742 bp, Panicum virgatum
  misc_feature: Ceres CLONE 1953954
  misc_feature: Encodes the peptide sequence at SEQ ID NO. 7712
actcccacagaagaaggaatttcgattcccttccaagcaagcaaactctcatccactcccaagaccaacaaccacccgatggcgcccaaggcggagaagaagccggcggccaagaagcccgcggaggaggagcccgcggcggggaagaagcccaaggcggagaagcgtctcccggcgggcaagtcggccggcaaggagggcggcggcgacaagaaggggaagaagagggccaagaagagcgtggagacgtacaagatctacatcttcaaggtgctcaagcaggtgcaccccgacatcggcatctcctccaaggccatgtccatcatgaactccttcatcaacgacatcttcgagaagctcgccggagaggccgccaagctcgcgcgatacaacaagaagcccaccatcacctcgcgcgagatccagacctccgtacgcctcgtcctccccggcgagctcgccaagcacgccgtctcggagggaaccaaggccgtcaccaagttcacctcggcttaggcggctctcttcttcttctggctttattaattatcctactagactagactcgtagttgtagtgctagtgactggaagatctctctatctctctctggtatggtgtagtcaagtgttgtggtggatctgactcttgtcccgttcatgtaagaatgaattaccatcatgttttatattggaacgctattatcagctgtatcttaatagtaatcgctcctttcgctgtg

SEQ ID NO: 7712 - protein, 145 aa, Panicum virgatum
  misc_feature: Ceres CLONE 1953954
  misc_feature: Great-hit functional homolog of the protein sequence given in SEQ ID NO 9491
  misc_feature: Useful for biocontainment applications
  misc_feature: Useful for making plants with modulated flowering time
  misc_feature: No seed is being produced by the plant
  misc_feature: The plant flowers significantly late compared to wild-type.
MAPKAEKKPAAKKPAEEEPAAGKKPKAEKRLPAGKSAGKEGGGDKKGKKRAKKSVETYKIYIFKVLKQVHPDIGISSKAMSIMNSFINDIFEKLAGEAAKLARYNKKPTITSREIQTSVRLVLPGELAKHAVSEGTKAVTKFTSA

SEQ ID NO: 7713 - DNA, 682 bp, Panicum virgatum
  misc_feature: Ceres CLONE 1954046
  misc_feature: Encodes the peptide sequence at SEQ ID NO. 7714
actcactgccaccaccaactcagctttgctccatcgtctccatctcaaaagagaatagaccaaattaactaagagatggctcgtgcccatcagcttgcggtgctcgccctggtgctactgctgctcccggctgccccgcacgccgacgccgccatcacctgcagccaggtggactcggacgtcagcccctgcgtcgcctacgcccagggcaccagctccgccccctcggccgcctgctgcagcggcgtcaggagcctcaacgccgccgccagcaccaccgccgacaggcgcgccgcgtgcaactgcctcaagtccggcgccgccagcgtcagcggcctcaaggccggcaacgccgccagcattgccagcaagtgcggcgtcaatctcccctacaccttcagcacctccattgactgctccaaggtcagctgaacggcccaccgttccatcgcatcgatcagaactggcagcatcctactctacgtatcatcagctaatgagtcgtcagaataaaagctctcccttatcgtacacactactactttactactcctctacgctcaattagtagagtacgtgggcatgcgagagagtgttgctccatcggtatttccatgcatgttactccattcgtttgtttgtgtttattatgtccagtaatacagctctccttttgaagggc

SEQ ID NO: 7714 - protein, 118 aa, Panicum virgatum
  misc_feature: Ceres CLONE 1954046
  misc_feature (1)..(86): Pfam Name: Tryp_alpha_amyl Pfam Description: Protease inhibitor/seed storage/LTP family
MARAHQLAVLALVLLLLPAAPHADAAITCSQVDSDVSPCVAYAQGTSSAPSAACCSGVRSLNAAASTTADRRAACNCLKSGAASVSGLKAGNAASIASKCGVNLPYTFSTSIDCSKVS

SEQ ID NO: 7715 - DNA, 789 bp, Panicum virgatum
  misc_feature: Ceres CLONE 1954052
  misc_feature: Encodes the peptide sequence at SEQ ID NO. 7716
aagcacaagctaaccagcgatcttatagctgcagtagtaatagttgtagcccttagccttgttcttcaacattttctttagagaaatctaaccatgagttcatcatggacgacaaggcagaataaggtgtttgaggaggctctggcaacgtatgataaagacacgcctgaccgctggcagaaagtggcacaggcagtgggcgggggaaagacggtcgatgatgtgaagaagcaatacaaggagctgactaaagacgtgagggaaatggacaccgcaggcctccagaattttcagtatggcggcagcagcagcagcaacacatccaagggtggcagcagcagcaacagggagcagggaggctgaagtaccccaaacccccagtgataataatgcaagtatgcactttccagcttgcaacaagctaccctgtatgcactatgatatgatgattattgcattgtgaaggtggtcctcttgccccagctaaactaaagcttgctcctactcatctgaagtcagagatgcaatcgagttgcgcttcagaattgtacctttcgtattttgtatccatgtttacgtgcgtgcctgaatgtgtttgtttacgagtgtgtcctaccacgagcactgtccatctagctctatgtagcagctgcggcagtggtactgccgggagatatcggattggacgtgtgcttgtttggtgtgggtgtgtcccgtgtaaccttatctgtccccgtttcgccagattgtgttattgaagttcaagtctatggaccactcattaccagc

SEQ ID NO: 7716 - protein, 89 aa, Panicum virgatum
  misc_feature: Ceres CLONE 1954052
  misc_feature (1)..(50): Pfam Name: Myb_DNA-binding Pfam Description: Myb-like DNA-binding domain
MSSSWTTRQNKVFEEALATYDKDTPDRWQKVAQAVGGGKTVDDVKKQYKELTKDVREMDTAGLQNFQYGGSSSSNTSKGGSSSNREQGG

SEQ ID NO: 7717 - DNA, 748 bp, Panicum virgatum
  misc_feature: Ceres CLONE 1954207
  misc_feature: Encodes the peptide sequence at SEQ ID NO. 7718
actataaaacagtctctctaaagctcaaaaaaaaaaaaaaaaaaaactcgccgcgccgcgccgcagccatcccccaccagcaccccgagtcctggagagaagcagatcggcggcgcgtcactccaactgccggtaagcttaaatggcgacggttcctgattctctgatctgggagatcgtgaggaagaataactccttcctggtcaagcagtttggcaatggcaatgccaaggttcagttcagcaaggagcctaacaacctctacaatgtccactcctacaagcactctggccttgccaacaagaagaccgtgactgtgcaaccagccagtggcaaggagatagcggtggtcctctcgacaaccaagacaaagaagcagaacaagcctgccagcctcaaccacaagtctgtcatgcgcaaggaattccgcaagatggccaaggctgtcaagaaccaggtcggtgacaattactacaggcctgatcttaccaagccagctcttgcaaggctgagcgcagtgtaccgcagcctccaggttgccaagtctggtgtcaagaagaagaacaggcaggcgaactaagtcacaaggagttgttttgatgggtggtgtttatgtttcatggtttctagatctggagtatgatggatgatgtgcgtacctaagactgccacaaaatttcattgtaggttccacctttgtacccaactacccatgacatgattaagcatatgaatatccttttagtag

SEQ ID NO: 7718 - protein, 145 aa, Panicum virgatum
  misc_feature: Ceres CLONE 1954207
  misc_feature: Great-hit functional homolog of the protein sequence given in SEQ ID NO 9265
  misc_feature: Useful for making plants with altered oil content
  misc_feature: Useful for making plants with modulated cold sensitivity
MATVPDSLIWEIVRKNNSFLVKQFGNGNAKVQFSKEPNNLYNVHSYKHSGLANKKTVTVQPASGKEIAVVLSTTKTKKQNKPASLNHKSVMRKEFRKMAKAVKNQVGDNYYRPDLTKPALARLSAVYRSLQVAKSGVKKKNRQAN

SEQ ID NO: 7719 - DNA, 945 bp, Panicum virgatum
  misc_feature: Ceres CLONE 1954234
  misc_feature: Encodes the peptide sequence at SEQ ID NO. 7720
cccgcctccgcctcctcccgccgtcagccgcagcagcgtcggcgccgccttttcctccgcgcgggccagcctccgccaccggatcgagcgcgcgcctcaccggcgggcgtaggcggcgcgggccggcggtggccatggcgtccggcgacgcgcgcgtggcggggatcgcgtcctccatccgcgtcatccccgacttccccaagccagggatcatgtttcaggacatcacgacgttgctcctagatccgaaggcgttccgcgacacgattgacctctttgtcgagcggtacaaggaccaagggatcacggtagttgctggtgttgaagctaggggttttatctttggccctcctattgctttagccataggtgcaaaatttgtacctttgagaaagccaaaaaagttgccaggtgaggtgatctccgaagaatattctttggaatatggcactgacaaaatagaaatgcatgtcggagctgtggaggctaatgatcgagcacttgttgttgatgatctcattgccaccggtggaacactgtgtgcagctgtcaaacttcttgagcgtgttggagcaaaggtggttgagtgtgcttgtgtcattgaattgccggaattgaagggccgggacaagctaggggacaggcctgtttttgtccttgtgaaagcggacggagcatgatgaaacacaagcacacaacttaggacatctcagagttggcccagttgatgttctctctctagaatcattctggaaatgacacagtatcccatgctacattggctagttcctagctgatgtttaataaagttttatctttaaatttgaggccatgaattatttgtcaatgtggacgtgattgctggtccttgtaaggcttatgtatgtgaaaacagtgccagttattcacatcaattgaggataatccttgttggagtttgttgtc

SEQ ID NO: 7720 - protein, 181 aa, Panicum virgatum
  misc_feature: Ceres CLONE 1954234
  misc_feature (1)..(179): SWISSPROT Homolog: EC 2.4.2.7 Adenine phosphoribosyltransferase 1
MASGDARVAGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVEANDRALVVDDLIATGGTLCAAVKLLERVGAKVVECACVIELPELKGRDKLGDRPVFVLVKADGA

SEQ ID NO: 7721 - DNA, 1038 bp, Panicum virgatum
  misc_feature: Ceres CLONE 1954264
  misc_feature: Encodes the peptide sequence at SEQ ID NO. 7722
atcagctctccacagcacaccagtcaggcagtcaccaccagctagctgctttctcactagagccgccctagttcactttcactagcgatggagcacttcagcaaagccctaacggcactgtccgtcacactgccgctgctgctgctggctcctctcctggtcatggccgccgaccccgaccctctccaggacttctgcgtcgccgacctcaacggctcgccgtcggtgaacggccacccgtgcctgccgccctcggcggcaggcgacgagttcctcttctcgaccaggatcgccacggggggcgacccgctggcgaacccgaacggctccaacgtgacggagctcgacgtgtccgagtggcccggcgtgaacacgctcggcgtgtccatgaaccgcgtcgacttcgcgccgggcggcaccaacccgccgcacatccacccgcgcgccaccgaggtcgggatggtgacccgcggcgagctcctcgtgggcatcatcggcggcctcgactccgggaaccggtactactccaaggtggtccgcgccggcgagaccttcgtcatcccgcgcgggctcatgcacttccagttcaacgtcggcaaggaggcggccaccatggtggtgtcgttcaacagccagaaccccggcatcatcttcgtgccgctgacgctgttcgggtcctcgccgccgatcccgacgccggtgctcgtcaaggcgctccgggtggacgccggggtcgtcgagctcctcaagtccaagttcaccggtgggtactgatgagagccggctgctggtcccatcatgcatccgcgtaattggggtggggcccatcggatcaacaacgtacaatttgatatcacgggcagctataaataatgtcgatgtcagaaattatgcttctgttaagaagtcgtgatcgataataaggaataagttagcaaatggcctcgaggttcactacctaagtcagggaatcaaaatgtatttgctcatttttcatgtgtaatgtaacaaatggaactacatatatgtgtgattttt

SEQ ID NO: 7722 - protein, 228 aa, Panicum virgatum
  misc_feature: Ceres CLONE 1954264
  misc_feature (4)..(228): SWISSPROT Homolog: EC 1.2.3.4 Oxalate oxidase 2 precursor
  misc_feature (4)..(228): SWISSPROT Homolog: EC 1.2.3.4 Oxalate oxidase GF-2.8 precursor
MEHFSKALTALSVTLPLLLLAPLLVMAADPDPLQDFCVADLNGSPSVNGHPCLPPSAAGDEFLFSTRIATGGDPLANPNGSNVTELDVSEWPGVNTLGVSMNRVDFAPGGTNPPHIHPRATEVGMVTRGELLVGIIGGLDSGNRYYSKVVRAGETFVIPRGLMHFQFNVGKEAATMVVSFNSQNPGIIFVPLTLFGSSPPIPTPVLVKALRVDAGVVELLKSKFTGGY

SEQ ID NO: 7723 - DNA, 1030 bp, Panicum virgatum
  misc_feature: Ceres CLONE 1954288
  misc_feature: Encodes the peptide sequence at SEQ ID NO. 7724
acacggcaagcaagcggaggcgaaggcgaaggctcgtgctcgccccgcgccttgctcgcaaagatctgcccggtgcgcgggccgcgatgagctgcggggggcaggccggcgggtggctgctggactacgggctggtggaggaggagatccagggctccgagttcatctacatggtcgacgacccggccgtatccagcgtcatactggggttcgatgctcccaggaaggaggacggcgtccaggacaacaccgccgccaagaagagatcccggccggagtccagcgccccgcctggcaccaaggcttgccgtgaaaagctccggcgagacaggctcaacgaaaggttcaacgaactctgtgccatcttggagcccgggaagccgcccaaggccgacaaagtcgccattctaagtgacactgcccgcctcctgagccagctgcgtgctgaggcccagaagctcaagcagtcaaacgaatcgctccaggactccgtcaagagcctcaaggctgagaagtctgagctgcgcgatgagaagacaaggctgaaggccgagaaggagaggctggagcagatgctcaagggcgtcagcgccgcggccgccccggcgcccttcgtcccgcaccctgccgccgccgccgcgccgtcgttccacccggcggcgtttgtccaggccggcaagttcgtcccgtaccccacctacccgccaccggccgcgttctggcaatggataccgccgacgtccctggacacgtccaaggaccccgcgcactggccgccggtcgcgtagtcggccagcttgtcgtggccatcattgatcggtgatgcatcgccgcgtgtactgggcttgctcctggtgtagaatttgaccaaagcttcgggggttgctgattgtatagcggtgtttgtgctgtgtcgtggataaagatcagtgagtgacgggatatactaaaattcagctgatcattgccgattggagaagtctacgtaacagtcctaattttaaagcaatgaaggtgatatgattaaacc

SEQ ID NO: 7724 - protein, 233 aa, Panicum virgatum
  misc_feature: Ceres CLONE 1954288
  misc_feature (2)..(52): Pfam Name: HLH Pfam Description: Helix-loop-helix DNA-binding domain
  misc_feature (3)..(52): Pfam Name: HLH Pfam Description: Helix-loop-helix DNA-binding domain
MSCGGQAGGWLLDYGLVEEEIQGSEFIYMVDDPAVSSVILGFDAPRKEDGVQDNTAAKKRSRPESSAPPGTKACREKLRRDRLNERFNELCAILEPGKPPKADKVAILSDTARLLSQLRAEAQKLKQSNESLQDSVKSLKAEKSELRDEKTRLKAEKERLEQMLKGVSAAAAPAPFVPHPAAAAAPSFHPAAFVQAGKFVPYPTYPPPAAFWQWIPPTSLDTSKDPAHWPPVA

SEQ ID NO: 7725 - DNA, 820 bp, Panicum virgatum
  misc_feature: Ceres CLONE 1954395
  misc_feature: Encodes the peptide sequence at SEQ ID NO. 7726
gccctcgccctcgccttcgccttcgcctacctctcgacgcccaaccccaaaaagaaaaattctcctcgcggagaaaggtcgcgtgccgtctcgcccacagcccatctgtaacaatggcacaggagagctggaaacaggaatctgaggagactggagtccatgcacctgaggccccaattctgtgcataaacaactgtggtttcttcggcagcagcatgacgaacaatatgtgctcgaagtgctacagggacttcatcaaattgatggaaggccctgtggttgagaagaaggtgatcacggtggcatcttcttctgcggcaccaatggagacagcaaagcaagatgatgtgcctgcagctgctgccactgaagctgtgacggagaagcaagcagagcaggagccgccaaagccgcccagcaaccggtgccttacctgccgcaagaaggttgggctgactggcttcctctgccgctgcgggggcaccttctgctccatgcaccgctacactgactcccaccagtgcaccttcgactacaagaaggtggcacgggagcagattgccaagcaaaatccagttgtgatggcagagaagattaacaagatatgatgcatggtcatgtgaagggatcactaaattcatgcctgggtagtgggttcactccaaatgataggttccttcaggcggtggtctgggtctgggttagagtggtagctggtctcaattgtgtctatcctcctcctttatcatggtttcattctctcgattgtgtaataatgtaaatatattcaaactgtaatttaatcctattgcttcctact

SEQ ID NO: 7726 - protein, 164 aa, Panicum virgatum
  misc_feature: Ceres CLONE 1954395
  misc_feature: Great-hit functional homolog of the protein sequence given in SEQ ID NO 9336
  misc_feature (1)..(40): Pfam Name: zf-AN1 Pfam Description: AN1-like Zinc finger
  misc_feature: Useful for making plants with modulated nitrogen use efficiency
MAQESWKQESEETGVHAPEAPILCINNCGFFGSSMTNNMCSKCYRDFIKLMEGPVVEKKVITVASSSAAPMETAKQDDVPAAAATEAVTEKQAEQEPPKPPSNRCLTCRKKVGLTGFLCRCGGTFCSMHRYTDSHQCTFDYKKVAREQIAKQNPVVMAEKINKI

SEQ ID NO: 7727 - DNA, 584 bp, Panicum virgatum
  misc_feature: Ceres CLONE 1954415
  misc_feature: Encodes the peptide sequence at SEQ ID NO. 7728
ctccccaccagcctcccaaagcctccgcctccccctgcctcctccgccgccgcgcgcgcagacgacccgcgacccacaggcatgggcgtgtacaccttcgtgtgccgcaacaccggcggcgagtggacggccaagcagcactccggcgagatcgaggcctccgccgccaccccctacgagctgcagcgccgcctcgtcgccgccgcctccgcggccgactccgcggccggcgtccagtcctccttctccatggtctctcccagctccgccgtcttccaggtgattgttggtgctgtcggtggcggtgcgatgatcagtggaggtgctgcagttggtggcgctgctgcctcaggtggtggtgcggctgaggcccccaaggaggagaagaaggaagaggagaaggaagagagtgacgatgacatgggtttctccctgttcgactagattatttagctcccataagtggtggtttggtcctattatggtacttaattttgctgtcctgtctacacaagccagtggcttgtgaacctgaaaactctgttaaattgttacaagtgatcccggagttcccagttcttgtg

SEQ ID NO: 7728 - protein, 120 aa, Panicum virgatum
  misc_feature: Ceres CLONE 1954415
  misc_feature (82)..(120): SWISSPROT Homolog: DNA-(apurinic or apyrimidinic site 60S acidic ribosomal protein P0
MGVYTFVCRNTGGEWTAKQHSGEIEASAATPYELQRRLVAAASAADSAAGVQSSFSMVSPSSAVFQVIVGAVGGGAMISGGAAVGGAAASGGGAAEAPKEEKKEEEKEESDDDMGFSLFD

SEQ ID NO: 7729 - DNA, 597 bp, Panicum virgatum
  misc_feature: Ceres CLONE 1954469
  misc_feature: Encodes the peptide sequence at SEQ ID NO. 7730
gttcctcggccctccgctctcctccccacgtttccaccggagacgcccaccgcgatctcctctcctcgcctccgaatccgccgcctgccgcccgccgcccgccgccgagcccagcctcctccacgacccgctgcgtctccgactaacatggattcagagccgtcatcacagaacccagcagatatgactgcatttgtgcaaaatctccttggacaaatgcaaacaaggtttgagtccatgtcgcagaacattgtgtcaaagatagatgaaatgggaaccaagatcgacgagctggagcagagcatcaatgatctgaaagctgagatgggcacggagatgcctgccaagaagcctgatgaggcgaagcctgctgattctgcttaacttggctgtgatccagatactggcgagtgaaaacttgaatactttgtgacagatttttagagttatgagtaattcattgtcttccatggaccatatccactgcatgagtgtactgtcagctatgtagactggagccatcttatgaaatactgtatccatagtttgggcactcagctctctatatttgtgcaaattccatggtgttttcccccc

SEQ ID NO: 7730 - protein, 78 aa, Panicum virgatum
  misc_feature: Ceres CLONE 1954469
  misc_feature (1)..(54): Pfam Name: HSBP1 Pfam Description: Heat shock factor binding protein 1
MDSEPSSQNPADMTAFVQNLLGQMQTRFESMSQNIVSKIDEMGTKIDELEQSINDLKAEMGTEMPAKKPDEAKPADSA

SEQ ID NO: 7731 - DNA, 334 bp, Panicum virgatum
  misc_feature: Ceres CLONE 1954559
  misc_feature: Encodes the peptide sequence at SEQ ID NO. 7732
ctcgattccagtcgaaccctcgcacaaaccctagttcctcaaacaccaggcggtggcggcggtggagaagaagaaaggagaagcaagatgatctacgacgtgaactcacccctcttccgctccttcctcagccagaagggtggcgcctccgacaagaggaaaatggaagagcaaaagcctaaggagcagaagcccaaggccaacgagaacaagcctgtcatgaacgaataattgtagcagcataatcatgtggttactgttgtctgcatactaaatcgagttgtatgaaccttttgttgtgcatttgagaacttgatattgaagtacctttgtg

SEQ ID NO: 7732 - protein, 47 aa, Panicum virgatum
  misc_feature: Ceres CLONE 1954559
  misc_feature: Great-hit functional homolog of the protein sequence given in SEQ ID NO 9509
  misc_feature: Useful for making plants with modulated biomass
  misc_feature: The plant is abnormally small.
MIYDVNSPLFRSFLSQKGGASDKRKMEEQKPKEQKPKANENKPVMNE

SEQ ID NO: 7733 - DNA, 664 bp, Panicum virgatum
  misc_feature: Ceres CLONE 1954668
  misc_feature: Encodes the peptide sequence at SEQ ID NO. 7734
accccagctcgcgccgccgacttcggaccactccgcgaatcctagccttcctttccccagcggcggcttcgagggcccccagtcatgacgttcaagcggaggaatggcggtcgcaacaagcacgggcgaggtcacgtcaagtacatccgttgctcaaactgcgccaagtgctgccccaaggacaaggctatcaagcggttcttggtgaggaacattgttgagcaggctgctgtgagagatgtgcaagaggcttgtgtgcatgatggatatgtgctccccaagctgtatgccaaggtgcatcattgtgtttcatgtgccatccatgctcacattgtccgtgttcgctctcgggagaacaggaggaaccgtgagcctccacagcgtttcaggcgcagggatgatggcccaaggccaggccaaagtggcccaccacgtgttggtggtggtgctcctcccgctgcggcagctgctgctcctcgcacctaagttcaggaatgagttttctggacttacttttttttgtcaccaatgggataataccatttttaggaaacagtttctgtacccggttgacattattttcatgttgttccagttcaccgtcatccttgttagtgtttttgccagaatactatatatgacgtttcttggaagctatcggacg

SEQ ID NO: 7734 - protein, 133 aa, Panicum virgatum
  misc_feature: Ceres CLONE 1954668
  misc_feature: Great-hit functional homolog of the protein sequence given in SEQ ID NO 9225
  misc_feature: Useful for making plants with modulated nitrogen use efficiency
MTFKRRNGGRNKHGRGHVKYIRCSNCAKCCPKDKAIKRFLVRNIVEQAAVRDVQEACVHDGYVLPKLYAKVHHCVSCAIHAHIVRVRSRENRRNREPPQRFRRRDDGPRPGQSGPPRVGGGAPPAAAAAAPRT

SEQ ID NO: 7735 - DNA, 1215 bp, Panicum virgatum
  misc_feature: Ceres CLONE 1954967
  misc_feature: Encodes the peptide sequence at SEQ ID NO. 7736
ccttctctcggactcgctcgtcccttgctcttccttccccggcggcgacgaccgggcgagcggcggcgccatttgtcacgtatccgcccagccctttgccggcgacgagcatccgccaggacgatcattgattttggacaaacaagatcttccatggaaccatcctcacagccgcagcctgtgatgggtgttgctactggtggatcacaagtttatcctgctgctgcttcctatgcgcctccaacaatggtacctggagctcctgctgttgttcctcctggctcacagccagcagcaccatttgccaatccagctcaactcagcgctcagcaccagatggtctaccaacaagctcagcaatttcaccaacaactgcagcaacagcaacagcagcagctcagagagttctggactacccagatggatgagatcgagcagacaactgacttcaagaaccacaccctgccacttgcaaggataaagaagataatgaaggctgatgaggatgtgcggatgatttctgcagaagctcctgttgtctttgcgaaggcatgtgaggtattcatattggagctgacattgagatcatggatgcacacagaagagaacaagcgccggaccttacagaagaacgacattgcagctgccatcactaggactgacatatatgacttcctggtggacataattcctagggatgaaatgaaagaagagggacttggacttccaagggttggcttgccgcctgctgtgggggcaccgggtgatagctatccaccatattactatatgacagcacagcagatgccaccaggaggtggaatggtatatggtggccagcagggtcacccggttacgtatatgtggcagcagcctcaggggcacgaggaagagcctcctgaagagcagcagcagcagcaacgatccacctgaaactgaaagtagctaagagatgatacagctaagccattgcatgatgatcctgaacctaggcctctaaacaaacgatttggttatgttattgtgcccatgattgttgattgctggccaagacggttatttatcgttaattaggtcatagtttcctaatggtagtttcgactcccgacgctgccatgacagcattagaaaaagattgtgatttggtaggtgatttgcatctaatgtagtaagattaccattttctgtctaatcgaatattcgaacttgtgggcc

SEQ ID NO: 7736 - protein, 259 aa, Panicum virgatum
  misc_feature: Ceres CLONE 1954967
  misc_feature (1)..(65): Pfam Name: CBFD_NFYB_HMF Pfam Description: Histone-like transcription factor (CBF/ NF-Y) and archaeal histone
  misc_feature: The sequence is a functional homolog of  SEQ ID NO 1188 in the  10/412,699 US patent application
  misc_feature: The sequence is a functional homolog of  SEQ ID NO 1189 in the  10/412,699 US patent application
  misc_feature: The sequence is a functional homolog of  SEQ ID NO 1190 in the  10/412,699 US patent application
  misc_feature: The sequence is a functional homolog of  SEQ ID NO 835 in the  10/374,780 US patent application
  misc_feature: The sequence is a functional homolog of  SEQ ID NO 836 in the  10/374,780 US patent application
  misc_feature: The sequence is a functional homolog of  SEQ ID NO 837 in the  10/374,780 US patent application
  misc_feature: Useful for making plants with modulated growth and phenotype characteristics
MEPSSQPQPVMGVATGGSQVYPAAASYAPPTMVPGAPAVVPPGSQPAAPFANPAQLSAQHQMVYQQAQQFHQQLQQQQQQQLREFWTTQMDEIEQTTDFKNHTLPLARIKKIMKADEDVRMISAEAPVVFAKACEVFILELTLRSWMHTEENKRRTLQKNDIAAAITRTDIYDFLVDIIPRDEMKEEGLGLPRVGLPPAVGAPGDSYPPYYYMTAQQMPPGGGMVYGGQQGHPVTYMWQQPQGHEEEPPEEQQQQQRST

SEQ ID NO: 7737 - DNA, 1211 bp, Panicum virgatum
  misc_feature: Ceres CLONE 1955009
  misc_feature: Encodes the peptide sequence at SEQ ID NO. 7738
gaagaaagaggagggggcaagaacgaggaaaccctagcccagcacaacacccttctctctccgccgccgccgccgaagcagcctccaccgccgactcgctcgctttccgtcgaggccatggcgtcctcctcccccgctctactcttcccttcgacctcctcatcctcctcgccgtcttcggcgcgggtggaggcggtggtgctcttcaacatctgcgacagctacgtgcgccgcccggaccaggcggaccgcgtcatcggcaccctcctgggctccctcctccccgacggcaccgtccacgtccgcaactcctatgtcgtcccccacaacgagtccgccgaccaggtcgccatcgacatcgagtaccaccataacatgtacgcctcgcaccagaaggtcgaccccaaggaagttatcgtcggatggttctcgactggctttggcgtttcaggggggagtacacttatccatgacttctattcaagggaagtgcagaaccccatccatcttacagtcgacactggctttactaggggggaggcctccatcaaagcgtacatctcatccaacctgtccctcggagataggcaccttgctgcacaatttcaggaaatccccctggatctaaggatgattgaggcagaaaaagctggatttgagatcctgaaatctacaatggtggagaagcttcccaatgacctggaaggaatggagtcttcaatggaaaagctttacattcttattgatgagatctacaaatatgtcgatgatgttgtggaaggacgtgtggcacctgaccacaaaattgggaggttcatctctgaatctgtcgcttcgatgccgaagttgtctgcagctgcttttgataagcttttcaatgacaagattcaggataaccttgcactggtatacctgtcaagcatcacaaggacacaaatcagcatagctgagaagttgaacactgctgctcaagtcctgtaacttcggtggtgtggcatcttagtgaatgactttatgcaatttacgatgttttgcatatgtgttcagtgggggcagaagtgtgattttgttttttgttaaatgagatcagaaggaacgaatcagtaattgatgagatcccatagtgctagtagaggggaagaggctgagatattccgatttggacagtattctgcttctagttgaagatttgtaatgcttattgattttgc

SEQ ID NO: 7738 - protein, 287 aa, Panicum virgatum
  misc_feature: Ceres CLONE 1955009
  misc_feature: Great-hit functional homolog of the protein sequence given in SEQ ID NO 9605
  misc_feature: Useful for making plants with altered alkaloid content
  misc_feature: Useful for making plants with altered terpenoid content
MASSSPALLFPSTSSSSSPSSARVEAVVLFNICDSYVRRPDQADRVIGTLLGSLLPDGTVHVRNSYVVPHNESADQVAIDIEYHHNMYASHQKVDPKEVIVGWFSTGFGVSGGSTLIHDFYSREVQNPIHLTVDTGFTRGEASIKAYISSNLSLGDRHLAAQFQEIPLDLRMIEAEKAGFEILKSTMVEKLPNDLEGMESSMEKLYILIDEIYKYVDDVVEGRVAPDHKIGRFISESVASMPKLSAAAFDKLFNDKIQDNLALVYLSSITRTQISIAEKLNTAAQVL

SEQ ID NO: 7739 - DNA, 1210 bp, Panicum virgatum
  misc_feature: Ceres CLONE 1955051
  misc_feature: Encodes the peptide sequence at SEQ ID NO. 7740
ttcgagaagaaaagaaaagaaatatcgccgacccttcgcacgccggattctccaattccccgtctcccccagtcctcgccgagaccccaattccgctgcgactgcgaggttgaggtttcctggttccagagccgcagagcatgctccgcgacgccggcggcggcttccccgccaccacctctgccccccttcttgcgcacccgccgtttcagtccgagccctcgcctgcgaccgttggctcaccggagataacggacgaggagatcgacgccgccaccgcggcctgctgccgcatctgcctggagtccgagtccgagcttggtgatgagctaatatctccatgtatgtgcaaggggacgcagcaatttgtgcaccgctcctgccttgaccattggagatctgttaaggaaggaactgccttttcacactgcacaacgtgcaaggcacgattccatctacgggtggaatgtctggaggatgacatatgtcatagaatgaagttccggttgtttgttgccagagatgccatacttgtattccttgttatgcaagccgccatcgcggcgataggtggtatggcatatttgttggataaaaatgggaacttcagaaacagattttctgacgattgggaacggtttctgtcaaagcatccggttcccttttactacagtgttggtgtggtggtgttctttgtactggttggattttttgggataatagtgcacctatcatctttcaacaacaatgatccatgcttggctggatgccataatggctgctatgggtggggtatagtggagttaccagcttcaattgaagcctgttttgcttttgctgtcatctttgttattatattcgtcatccttggagtggcatatagtttccttgctgcaactctggccatccagaggatctggcagcggcactatcacatacttaccaagaaggagctgacaaaggaatatgttgtggaggaccttccaggtggttacacaccgccaaagatggatccggagcatgagcagcgtctgaagatgttgcagctcatgtagcttccacttgtgcaaatgacggacagaagtatcacatctttttggcgcatcaattacactagcataatgtatgtgtagctggataaaatctaagcatattcagtgatgtgcaattccatgtaatgactactgaggtataaatagaaccacggtag

SEQ ID NO: 7740 - protein, 304 aa, Panicum virgatum
  misc_feature: Ceres CLONE 1955051
  misc_feature (1)..(51): Pfam Name: zf-C3HC4 Pfam Description: Zinc finger, C3HC4 type (RING finger)
MLRDAGGGFPATTSAPLLAHPPFQSEPSPATVGSPEITDEEIDAATAACCRICLESESELGDELISPCMCKGTQQFVHRSCLDHWRSVKEGTAFSHCTTCKARFHLRVECLEDDICHRMKFRLFVARDAILVFLVMQAAIAAIGGMAYLLDKNGNFRNRFSDDWERFLSKHPVPFYYSVGVVVFFVLVGFFGIIVHLSSFNNNDPCLAGCHNGCYGWGIVELPASIEACFAFAVIFVIIFVILGVAYSFLAATLAIQRIWQRHYHILTKKELTKEYVVEDLPGGYTPPKMDPEHEQRLKMLQLM

SEQ ID NO: 7741 - DNA, 1281 bp, Panicum virgatum
  misc_feature: Ceres CLONE 1955063
  misc_feature: Encodes the peptide sequence at SEQ ID NO. 7742
aaccaaacacatcagagcacacaggctacgtacgacaagaaagatacagcgtgagggactgagtgaccgcgagagaccagaaaatggccgctgattctcggaccatcgtagctcccactgatgctgagctgctgcaggcacaagccgacctatggcgccacagcctctactacctcacatccatggcgctcaagtgcgccgtcgagcttcacatcccaactgctatccataaccttggaggcgccgcctcactgcccgacttggtaaccgcactgtcccttcctcagactaagcttccattcctccgccgcttgatgcggttgctagtcacgtcaggcatctttgcatctgaaagcggtgcagaggtggagacgtaccgcctgaacccactctcctggctcctggtagaaggtgtggaagcggaagatcacacctaccagaaatactttgtgctcggcacgatctcacgccattatgttgaggctggattgtctctagctgactggttcaggaaggatttgcctgcgccattaccatcgccattcgaagagttacatggtttgccacttttccatgagacaacaaagctccttgatgaagagctagacagaattgtcaataaaggtaaggctgcacatgaccatttggcaattggaactgttattcgggagtgcggtgaccttttcaagggtctgcaatcactgactgattgcggtggtggtgatggcacgactgtgaggggaatcatcaaggcgttccctcacatcaagtgtactgtgctggaccgtccagagattattgaggccgcaccagctcatgattcagttacctatgtctcgggtgacatgttccattccattccacctgctcaagctgtgatgctcaagcttgtactgcacttctgtaacgatgaggattgtgtgaagatcctggagcagtgcaggaaggcaattccctccaaacaagaggggggaaaggtgattattatagaaatactcctttccccttctacagggccgataatgtacgaagcccaactcctcatggacatgctcatgatggtgaataccaaaggcaagcagcgagatgaaaatgactggcgcgatatctttatcaaagcaggtttctccgactataagattgttaagaaaataggggctcgtggtatcattgaagtttatccgtaacacaaaacacccttaaattatgctcaatgtgtggtttactattgagcggaccatgtgctgtgaggatacaaataaacggagtgcctcatttcct

SEQ ID NO: 7742 - protein, 367 aa, Panicum virgatum
  misc_feature: Ceres CLONE 1955063
  misc_feature (1)..(260): Pfam Name: Methyltransf_2 Pfam Description: O-methyltransferase
MAADSRTIVAPTDAELLQAQADLWRHSLYYLTSMALKCAVELHIPTAIHNLGGAASLPDLVTALSLPQTKLPFLRRLMRLLVTSGIFASESGAEVETYRLNPLSWLLVEGVEAEDHTYQKYFVLGTISRHYVEAGLSLADWFRKDLPAPLPSPFEELHGLPLFHETTKLLDEELDRIVNKGKAAHDHLAIGTVIRECGDLFKGLQSLTDCGGGDGTTVRGIIKAFPHIKCTVLDRPEIIEAAPAHDSVTYVSGDMFHSIPPAQAVMLKLVLHFCNDEDCVKILEQCRKAIPSKQEGGKVIIIEILLSPSTGPIMYEAQLLMDMLMMVNTKGKQRDENDWRDIFIKAGFSDYKIVKKIGARGIIEVYP

SEQ ID NO: 7743 - DNA, 1072 bp, Panicum virgatum
  misc_feature: Ceres CLONE 1955077
  misc_feature: Encodes the peptide sequence at SEQ ID NO. 7744
agccaacccgaggtcggtcaatctcaatccacccacagctccccgctcctacccagatctcccggacccgttcagcgccaactgtagcgtcggcgatggccagcacggcggcggagcagccggcgcaggagcagcaggccaacggcaacggcgagcagaagacgcgccactccgaggtggggcacaagagcctgctcaagagcgacgacctctaccagtacatcctggacacgagcgtgtacccgcgggagcccgagagcatgaaggagctccgcgagatcaccgccaagcacccctggaacctgatgacaacgtcggcggacgaggggcagttcctcaacatgctcatcaagctcatcggcgccaagaagaccatggagatcggcgtctacaccggctactccctcctcgccaccgcgctcgccctccccgaggacggcacgatcttggccatggacatcaaccgcgagaactacgagctcggcctgccctgcatcgagaaggccggcgtcgcccacaagatcgacttccgcgagggccccgcgctccccgtcctcgacgacctcatcgccgacgagaagaaccacggcaccttcgacttcgtcttcgtggacgccgacaaggacaactacctcaactaccacgagcggctgctcaagctcgtcaagctcggcggccttatcggctacgacaacacgctgtggaacggctccgtcgtgctccccgacgacgcgcccatgcgcaagtacatccgctactaccgcgacttcgtgctcgtgctcaacaaggcgctcgccgccgacgagcgcgtcgagatctgccagctccccgtcggcgacggcgtcaccctctgccgccgcgtcaagtgagcgtggccaggcccggctgccaccccccaccggccaccgcaccgacggccgccgccgcccgactccaatcatagacaacgcgcagcattaattaattattcaccgtctttctttttttggctctttcttggccctgtaatcttggaaactgtcatcattttcatgcgtaaatgtcgagactataatataaatttcatagtacc

SEQ ID NO: 7744 - protein, 257 aa, Panicum virgatum
  misc_feature: Ceres CLONE 1955077
  misc_feature: Great-hit functional homolog of the protein sequence given in SEQ ID NO 9679
  misc_feature (1)..(213): Pfam Name: Methyltransf_3 Pfam Description: O-methyltransferase
  misc_feature (1)..(257): SWISSPROT Homolog: EC 2.1.1.104 Caffeoyl-CoA O-methyltransferase 1
  misc_feature (1)..(257): SWISSPROT Homolog: EC 2.1.1.104 Caffeoyl-CoA O-methyltransferase 2
  misc_feature: Useful for making plants with altered Lignin content
  misc_feature: Useful for making plants with altered cell wall content and/or composition
MASTAAEQPAQEQQANGNGEQKTRHSEVGHKSLLKSDDLYQYILDTSVYPREPESMKELREITAKHPWNLMTTSADEGQFLNMLIKLIGAKKTMEIGVYTGYSLLATALALPEDGTILAMDINRENYELGLPCIEKAGVAHKIDFREGPALPVLDDLIADEKNHGTFDFVFVDADKDNYLNYHERLLKLVKLGGLIGYDNTLWNGSVVLPDDAPMRKYIRYYRDFVLVLNKALAADERVEICQLPVGDGVTLCRRVK

SEQ ID NO: 7745 - DNA, 1898 bp, Panicum virgatum
  misc_feature: Ceres CLONE 1955192
  misc_feature: Encodes the peptide sequence at SEQ ID NO. 7746
aaaacaagctcgccaccctcctccggtcctcccccatccatcagccatcttctctctcatcatatcatatgaggaaggattctttccaacctacaatcttctttccttgatagctagccagctctttcttggactgtcgtctcttctctccctagccaccaccacacctaaccttctcgagcttgacccacagcaagagaggagaggctgctgaagacatcaaatccattccgctctcttccaaaccactaaccactccatttacccgcccaaacaatagacacgccaagatatatacttctatctgtgtatatataccatggcctaattcaccatggacgtcgccggtgacggcggaggcggccgccgccccaacttccctctgcagctcctcgagaagaaggaggagcagccgtgctccagctcggctgccgtgggcagttcggcgggcggcaacgccaggaatggatcgggggccgccggaggcgaggtgcaggtgcggaaggcggcgcccaagcgcagctcgaccaaggaccggcacaccaaggtggaaggcagagggcgtcgcatccggatgccggcgctgtgcgcggcgcgggtgttccagctgacgcgggagctgggccacaagacggacggcgagaccattgagtggctgctgcagcaggccgagccggcggtgatcgcggccaccggcacaggcaccatcccggccaacttcacatccctcaacatctccctccgctcctcgggctcgtccttctccgccccggctcacctccgcacggccttgcctagccccgccaccgccgctcggttcggccgcgctgacgcgtgggaccgggttgtcggcctgggcttcccttcggaaggcccggcctcgtcgtcatcgtcgccgtccccgttgttgctcaacttccactcgggcagcgtcggccttgacgtgcaaccgtcgccgtctgccgccgccgcagccgccgacatctcaaggaagaggcggtgggaacaagaaatgcagcaggcgcagcagcagcagcagcagcagcaggcgcagcaatatcagcagcagatcgcgggctacacgcagagccaaatgccgggaaccgtgtggatggtgccgagcagcaacagcacgcagggtggggcgccttccggtggcggcggcggcggcagcggtggaggaggcagtggcgagtccatctggacgttcccgcagatgagcagcgccgcggccgcggccgccgtgtaccgagggggcgtgccgagcgggctacatttcatgaacttccctgcaccggtggcgctgcttcccgggcagcagctggggctcggcaccgtggggagcggcggcggcggcggaggcggtggcgagggccacatggggatcctggccgccctcaatgcgtaccggacacaggccgcgacggatcccgcggcaggccagggcggcggaggaagtaccggaggaggagggtccggccagcagcaacacggtggcggccgcggcgagcggcatgagagcatgagcaccagcgactcgtagccgacgggggtctccgaggatcgcatgcatcgcacggctggtgtggctttgatctgttctttgtcttggtttcatttttttcctttcttttttgtggtttccttcctcctcctcctcctcctagctagacaccccttgcgtgcgaggattacgctcagctccattccatggcatgcgataggatcgtccaccatcctaacgcgggctgtgcctgtgacctgtgtgagtgagagagcgaggtgtgccatgggagaggaagaggagggaaacgcagcagcagcagagagattgttcattttgtcctttagttttagggtttgcattgatcaagtgcgagcagaagagatttttatcg

SEQ ID NO: 7746 - protein, 402 aa, Panicum virgatum
  misc_feature: Ceres CLONE 1955192
  misc_feature: The sequence is a functional homolog of  SEQ ID NO 166 in the  10/225,068 US patent application
  misc_feature: The sequence is a functional homolog of  SEQ ID NO 220 in the  10/374,780 US patent application
  misc_feature: Useful for making plants with modulated growth and phenotype characteristics
MDVAGDGGGGRRPNFPLQLLEKKEEQPCSSSAAVGSSAGGNARNGSGAAGGEVQVRKAAPKRSSTKDRHTKVEGRGRRIRMPALCAARVFQLTRELGHKTDGETIEWLLQQAEPAVIAATGTGTIPANFTSLNISLRSSGSSFSAPAHLRTALPSPATAARFGRADAWDRVVGLGFPSEGPASSSSSPSPLLLNFHSGSVGLDVQPSPSAAAAAADISRKRRWEQEMQQAQQQQQQQQAQQYQQQIAGYTQSQMPGTVWMVPSSNSTQGGAPSGGGGGGSGGGGSGESIWTFPQMSSAAAAAAVYRGGVPSGLHFMNFPAPVALLPGQQLGLGTVGSGGGGGGGGEGHMGILAALNAYRTQAATDPAAGQGGGGSTGGGGSGQQQHGGGRGERHESMSTSDS

SEQ ID NO: 7747 - DNA, 1499 bp, Panicum virgatum
  misc_feature: Ceres CLONE 1955206
  misc_feature: Encodes the peptide sequence at SEQ ID NO. 7748
accacctcggaaagtacactcaatagcatagtcacttcgccacgagctagtagtcaacagtcctccaaaatccagtcacccatggctctgcaggctgctctcctcccttccaccctctccgtccccaagaaggccagcttgagcgccgctgcggtagtcaaggacacggcggcattcctcaacgttccccaccaaaagaagggaatgccgtcgctctcggtgcgaacccaggtggcgacgacgccgtcggcgcccgtggccaccccgggtgcgaccacgtcgaccatggacaagaagaagactctgcgccagggcgtcgtggtgatcacgggcgcgtcgtcgggtctcggcctggccggggctaaggcgctcgccgagacgggcaagtggcacgtggtgatggcgtgccgcgactttctgaaggcagccaaggcggccaaggccgctggcatggccgacggcagctacaccatcttgcacctggacctggcctccctcgacagcgtgcgccagttcgtcgacaacttccgccgcctgggcatgccgctggacgcgctggtctgcaacgccgccatctaccgccccacggcgcggaccccgacgttcacagccgacgggtacgagatgagcgtgggcgtcaaccacctgggccacttcctcctcgcgcgcctcctcctcgacgacctcaacaagtccgactacccctcgcgccgcctcgtcatcctcggctccatcacggggaacaccaacacgctcgccggcaacgtcccgcccaaggccaacctcggcgacctccgcgggctcgccggaggcctggccgggaagaacaagaacgggtcggccatgatcgacggtgacgaggacttcgacggcgccaaggcgtacaaggatagcaagatctgcaacatgctcaccatgcaggagctgcacaggcgcttccacgaggacacgggcatcaccttcgcttccctctacccgggctgcatcgccaccacggggctgttccgcgagcacatcccgctcttcaggctgctcttcccgcccttccagaagttcatcaccaagggattcgtgtcggaggaggagtccggcaagaggctggcgcaggtggtcagtgaccccagcctcaccaagtcgggagtgtactggagctggaacaaggactcggcgtccttcgagaaccagctctcgcaggaggccagcgaccccgagaaggcaaggaagctctatgagctcagcgagaagctcgtcggcctcgcctgaacttagtttaactagctgcttcatgggacctcctcctactgcacaaactccatcgagcagagtagagcagggaccagcagggaacttttgcagttcgttgttgatgtgtattgtaccattatgaaccatttcgttttggagctggtgacgagagaacagaagacagtctgtctagattttctcttgtcttgttcttcacatttttttttggataataaaacaacagcctgaagctc

SEQ ID NO: 7748 - protein, 393 aa, Panicum virgatum
  misc_feature: Ceres CLONE 1955206
  misc_feature (1)..(129): Pfam Name: adh_short Pfam Description: short chain dehydrogenase
  misc_feature (1)..(393): SWISSPROT Homolog: EC 1.3.1.33 Protochlorophyllide reductase A, chloroplast precursor
MALQAALLPSTLSVPKKASLSAAAVVKDTAAFLNVPHQKKGMPSLSVRTQVATTPSAPVATPGATTSTMDKKKTLRQGVVVITGASSGLGLAGAKALAETGKWHVVMACRDFLKAAKAAKAAGMADGSYTILHLDLASLDSVRQFVDNFRRLGMPLDALVCNAAIYRPTARTPTFTADGYEMSVGVNHLGHFLLARLLLDDLNKSDYPSRRLVILGSITGNTNTLAGNVPPKANLGDLRGLAGGLAGKNKNGSAMIDGDEDFDGAKAYKDSKICNMLTMQELHRRFHEDTGITFASLYPGCIATTGLFREHIPLFRLLFPPFQKFITKGFVSEEESGKRLAQVVSDPSLTKSGVYWSWNKDSASFENQLSQEASDPEKARKLYELSEKLVGLA

SEQ ID NO: 7749 - DNA, 1237 bp, Panicum virgatum
  misc_feature: Ceres CLONE 1955348
  misc_feature: Encodes the peptide sequence at SEQ ID NO. 7750
aacgcgcacacacacaagctctcctcgcgcagcacagcttcgactcgttaatctcgagctagctagagatagtagttttcgtcaccaactcgtcttcttggatcggaggagggccggccggcgagagattaatttacggtcgaggaggatcggaggaggagatggaggtcgccgccgcagcgagctacgtgggcgacgacgttgaccgctgcctcaaggcgaccgagctgaggctcggcctgccgggcaccgagctagagacggcgccggccgccgcagcgctgccgacgccgccgtccacgccccggggcaagaagcgcgacgggaacaccgccggcgctgaggaggcagccaagaccgcgccgccggccgccaaggctcaggtggtggggtggccgccggtgaggtcctacaggaagaactgcttccagcagtccagcagcagcgccgccaagagcaagccagcggcggcgccggaggagaaggccccggccccggcccctgtcgccgccggtggcaacgccaacgcggcgctgttcgtcaaggtgagcatggacggggccccctacctgaggaaggtcgacctcaagatgtacaagggctaccgcgagctcagggaggccctggaggccatgttcctctgcttctccggcggcgctgatgcgccggcggccgtgaacccctccgacttcgccgtcacctacgaggacaaggacggcgacctcatgctcgtcggcgacgtccccttcgacatgttcatcagcacctgcaagaggttgaggatcatgaaggggtctgaagccagaggcctgggctcagtgaagaacaactgaggttgcaggatttgcatgtcttgtgcacgagcagattcttttgttcttttgggctgcttggagtctccaaggcatggacatgttttcaccatctctccttgtctgactcgactcgatcttcgacacaacatggagacaagacaaaggcaaagcatgcaattgcaaggtcgagggaagaggagtgagtcaagcttgcaaggagagacagctttgtgcatcaaagtgcatgcatgcgtggatgtgtggtcactttgtttccatttttctctctctcttttttactgctactgctaggtgttagcaacacaaaaggagtggagattcgagttgacatctccatgtgtgtttgtacaaagccaaagatcactttcaagttttatctatcagtgcttggtttcttctgt

SEQ ID NO: 7750 - protein, 223 aa, Panicum virgatum
  misc_feature: Ceres CLONE 1955348
  misc_feature (2)..(194): Pfam Name: AUX_IAA Pfam Description: AUX/IAA family
  misc_feature: The sequence is a functional homolog of  SEQ ID NO 636 in the  11/479,226 US patent application
  misc_feature: Useful for making plants with modulated growth and phenotype characteristics
MEVAAAASYVGDDVDRCLKATELRLGLPGTELETAPAAAALPTPPSTPRGKKRDGNTAGAEEAAKTAPPAAKAQVVGWPPVRSYRKNCFQQSSSSAAKSKPAAAPEEKAPAPAPVAAGGNANAALFVKVSMDGAPYLRKVDLKMYKGYRELREALEAMFLCFSGGADAPAAVNPSDFAVTYEDKDGDLMLVGDVPFDMFISTCKRLRIMKGSEARGLGSVKNN

SEQ ID NO: 7751 - DNA, 1377 bp, Panicum virgatum
  misc_feature: Ceres CLONE 1955386
  misc_feature: Encodes the peptide sequence at SEQ ID NO. 7752
aacaacacaatcttcctttcatacacataggcctctccagagaggccagagacaagctagctagctgctagctttgcagcaccagccaggcagccactactctttctccaccagctccccgatccccttgacgaccgacctctctctgcacactgttcaagatcagctagcttcgttcccatccagtcgagctcttgatcgcggccctggatggacttcgacatgctgaattcccacccggaggcgcagctggagctgatgaacgcaatgctccagctggagcagctcacggcgttccctgaccaccacggcgccatgatgatggtgccctcgacgccgcccccgtcgccgccgtgcatgcagcagcaagttcatcaccacttctcctcctcggtgcctcatcacatgtccgcgggcggcgccgccaacggccgcgccacctaccacgaccaccaccagtcctatagctcctccgctgtcacgtcccacgcgtcgagcaacggcagcgcccgctcggagtacgcggcgcatcaggactaccctgccgccgccgccggcggaggaggaggcgggggcaacggcggcatggacgacggcgccaccgccgtggggtcgtcggcgatgcgggagatgatcttccgcgtggcggcgctgcagccggtgaacatcgacccggagatggtgcgccccccgaagcgccgcaacgtgcgcatctccaccgacccgcagagcgtggcggcgcggatgcggcgggagcgcatcagcgagcgcatccgcatcctgcagcagctagtcccgggcggcaccaagatggacaccgcgtccatgctggacgaggccatccactacgtcaagttcctcaagacgcaggtgcagtccctcgagcgcgccgccgccgccagcggccgccgcccggcgccaccggcggcggacgacgacggcgccggcgcgccctaccccggccgcttcagcggccagtggtagatcgaaccgatcgttcgctcgcgcgcggccaccctccggcaggcatgcatatggccaaggttgtggtcgtcgatcatgcactaatcgccgactcgccgtctcgccgtcggacctggagctttgcacgtacgcacgtgctgcgacgagcccccgcgcgtcggcagcacgtgtacgatcatatgttgtgtaaattaagagtttaagatgcacttggctagacgccttacatttttactactagtacttagagatgtttttttactgccctttccatgcttgcgattatactactctcacagcacatgatgcatgcacacatataatagcttgtacattgcacgcatctcatgttgtgaacgtgttaatttccattaaaaaaaaaaaaaaaaaaaa

SEQ ID NO: 7752 - protein, 257 aa, Panicum virgatum
  misc_feature: Ceres CLONE 1955386
  misc_feature (1)..(48): Pfam Name: HLH Pfam Description: Helix-loop-helix DNA-binding domain
  misc_feature: The sequence is a functional homolog of  SEQ ID NO 130 in the  10/225,066 US patent application
  misc_feature: The sequence is a functional homolog of  SEQ ID NO 414 in the  10/374,780 US patent application
  misc_feature: The sequence is a functional homolog of  SEQ ID NO 488 in the  10/666,642 US patent application
  misc_feature: Useful for making plants with modulated growth and phenotype characteristics
MDFDMLNSHPEAQLELMNAMLQLEQLTAFPDHHGAMMMVPSTPPPSPPCMQQQVHHHFSSSVPHHMSAGGAANGRATYHDHHQSYSSSAVTSHASSNGSARSEYAAHQDYPAAAAGGGGGGGNGGMDDGATAVGSSAMREMIFRVAALQPVNIDPEMVRPPKRRNVRISTDPQSVAARMRRERISERIRILQQLVPGGTKMDTASMLDEAIHYVKFLKTQVQSLERAAAASGRRPAPPAADDDGAGAPYPGRFSGQW

SEQ ID NO: 7753 - DNA, 1142 bp, Panicum virgatum
  misc_feature: Ceres CLONE 1955388
  misc_feature: Encodes the peptide sequence at SEQ ID NO. 7754
ctctccttgccggatctcaccacccccacccccacccccccatccgccccgcccatgggagcccccacccctcgccgctgacccgtgggctccacgtccccctcctccgtcctccccctcccgcccccgcctccgctcccgctcccgctccaccacgcgaaccctagctgttgttgccgaaagagctctggcggccgaagaggagaggagaataaagctcgaatcttggatgcgcccgagccgatggcgacgcccgctgcagagaagcccgacgatgtggagatccgcgaggtctgggcggacaaccttgaagccgagttcgccgtgatccgcgacatcgtcgacgactacccctacgtcgccatggacacggagttccccggcgtggtgtgccgcccgctcggcacctacaaatccgctgccgagttcaactacgccaccctcaaggccaacgtcgacatgcttaagcttattcagctcgggctcacattctccgacgagcatggagggctgccggcgcttggcccaggcggccgaccctgcgtctggcagttcaacttccgagggttcgacccccggaccgacgtcgccgccgcggactccatcgatctgctccgccgcagtgggatcgacttcgcccgccacggtgcggatggagccgacgctcgacgcttcgcggagctgcttatgtcctccggcgtcgtgatgaattccgatgtgcgttgggtaacctttcacagcggctacaacttcggctacttgctcaagctgctcaccggcacaaacctgcctgacaccatgtcgggattcttccatctcgtcaagatttacttccctgtgatctacgacatcaaacacctcatgagattctgcaatagcctccatggcgggctgaacaagcttgctgagctgctcgacgtcgccagggttggaatctgccaccaggcagggtccgactcgcttctgactgcgctttccttcaagaagctcaaggaggcatacttcaacgggttaaccgagaaatatgccggtgtgttgtatgggcttggctttgagggtggggagaccacctcagctcactgagtaatggatagttaaataaaagatgaactatttatgggaatggagaaatctgtttggtt

SEQ ID NO: 7754 - protein, 279 aa, Panicum virgatum
  misc_feature: Ceres CLONE 1955388
  misc_feature (1)..(234): Pfam Name: CAF1 Pfam Description: CAF1 family ribonuclease
MATPAAEKPDDVEIREVWADNLEAEFAVIRDIVDDYPYVAMDTEFPGVVCRPLGTYKSAAEFNYATLKANVDMLKLIQLGLTFSDEHGGLPALGPGGRPCVWQFNFRGFDPRTDVAAADSIDLLRRSGIDFARHGADGADARRFAELLMSSGVVMNSDVRWVTFHSGYNFGYLLKLLTGTNLPDTMSGFFHLVKIYFPVIYDIKHLMRFCNSLHGGLNKLAELLDVARVGICHQAGSDSLLTALSFKKLKEAYFNGLTEKYAGVLYGLGFEGGETTSAH

SEQ ID NO: 7755 - DNA, 1287 bp, Panicum virgatum
  misc_feature: Ceres CLONE 1955427
  misc_feature: Encodes the peptide sequence at SEQ ID NO. 7756
atcagcccatcgccattcaggaattcaggaggccagccatggcggaagaggggaagcgcggcagcggagtgcgggtgtgcgtcaccggaggcgccgggttcatcggctcgtggctcgtcaagaagctcctcgagagaggctacaccgtccacgccaccctgcgggacaccggggacgaggagaaggccgggctgctgcgccggctggtccccgccgcggcggagcggctgcggttgttcgaggccgacctcttcgacgccgccaccttcgcgccggccatcgctggctgccggttcgtcttcctcgtcgccacgccgtacgggttcgaagccgccagctccaagtataagagcacggcggaagccgccgtggccgcggtgcgcgtgatcctgcggcagtgcgaggagtcccagacggtgaagcgcgtgatccacaccgcctccatatcgtccgcctcgccgctgaaggaggccggcgccggcgccggctacaaagatttcatcagcgagtcttgctggacaccgctcgacgttgactaccctctgcgcagcgcgcacttcgataagtacattctgtcgaagctgcagtcggagtgggagctcctgagctacaacggcggcgagcgcccggcgttcgaggtggtgacgctgcccctgggcctcgtcgcgggggacacggttctcggccgcgccccggagacgctggagcacgccgtggcgccggcgtcccggagcgaggccggcttcgcgttcctgcgcctgctgcagaggctgctcggctcgctgccgctggtgcacgtggacgacgcctgcgacgcgctcgtcctctgcgcggagcgcccctccgtcgccggccggttcatctgcgccgccgcgtacccgaccatccacgacgtcgcctcccacttcgccggcaggttcccccacctcgacgtcctcagagagacggaggcggtggcgagggtgcggcccgccgaggacaagctgggcgagctgggcttcaggtacaagtacggcatggaggagatcctcgacggcagcgttgcctgcgcggcgaggttgggttgtcttgacgcagccaagctcagcgcgcagcaaggatgaaaacagcaaggcgtagtccgtaagtaaggcgtagtcgtgcgttttccacgttcccaaactgccaccgaatgcagcaaacttgaacgtaacctggccgtactttcatgcatgttaaattcggtattttgtttttttaataaaagcaggagcactgcaatgcatttaaaaaaaaaaaaaaaaaaaa

SEQ ID NO: 7756 - protein, 354 aa, Panicum virgatum
  misc_feature: Ceres CLONE 1955427
  misc_feature (6)..(242): Pfam Name: Epimerase Pfam Description: NAD dependent epimerase/dehydratase family
MAEEGKRGSGVRVCVTGGAGFIGSWLVKKLLERGYTVHATLRDTGDEEKAGLLRRLVPAAAERLRLFEADLFDAATFAPAIAGCRFVFLVATPYGFEAASSKYKSTAEAAVAAVRVILRQCEESQTVKRVIHTASISSASPLKEAGAGAGYKDFISESCWTPLDVDYPLRSAHFDKYILSKLQSEWELLSYNGGERPAFEVVTLPLGLVAGDTVLGRAPETLEHAVAPASRSEAGFAFLRLLQRLLGSLPLVHVDDACDALVLCAERPSVAGRFICAAAYPTIHDVASHFAGRFPHLDVLRETEAVARVRPAEDKLGELGFRYKYGMEEILDGSVACAARLGCLDAAKLSAQQG

SEQ ID NO: 7757 - DNA, 1186 bp, Panicum virgatum
  misc_feature: Ceres CLONE 1955429
  misc_feature: Encodes the peptide sequence at SEQ ID NO. 7758
caaccaaacccgcccactgatttccgccgcgcggtagcgtagggggcgaggcagcgcgcagccatggacttcctgcaggggcagagcaccgagaccatggtggccgtcgccgtcgccgtcgtcgcggtcgccgcgggcgccgccttcctcctcctccgatccgggaagagcaagggttgcctgaatcctgagaacttcaagaagttcaaacttgttgaaaagaagcagataagtcataatgtcgccaaattcaaattcgctcttccaactccaacttctgtattgggccttccaattggtcaacatataagttgcagaggacaagatgctacaggtgaagaagtaatgaagccttatacccctactaccttggattctgatcttggatattttgagcttgtcataaagatgtatcctcaagggagaatgtcccatcatttccgtgagatgaaagttggtgattatttgtctgtgaagggacctaagggtcgtttcaagtaccaagttggccaagtgagagcatttggaatgctggctggtggatcaggcattactccaatgttccaagttgccagagcaattcttgagaaccctaatgacaacaccaaggttcatttaatctatgctaatgtcacatacgaagacattcttctgaaggaagagctggacaacatggccaaaacctatcctgatcgctttaagatctactatgttttgaatcagcctcctgaaaattggaatggtggtgttgggtttgtgtccaaggaaatgatccaatcccattgcccagcgcctgctgatgacattcagatcctgagatgtggtcctccaccgatgaacaaggcaatggctgcacaccttgacgagctcaactacacaaaggagatgcagttccagttttaagcaacgctgagctcgaataataattggcgaccggcatggttcttccggaatggtttctgaccgtttgttgacattaggaattcaggattgcatgatcaattagtattgagccagcaacttgtgcaatcgccattttttagggcaaaggttacctccctcgagggagcccaccttggcagagactccattattactattattgatttgaaatgtgtaacattggatgctataaggaacatcacattaccacagatgagctatgcatgggaccttgtacttttgg

SEQ ID NO: 7758 - protein, 279 aa, Panicum virgatum
  misc_feature: Ceres CLONE 1955429
  misc_feature (1)..(100): Pfam Name: FAD_binding_6 Pfam Description: Oxidoreductase FAD-binding domain
  misc_feature (1)..(110): Pfam Name: NAD_binding_1 Pfam Description: Oxidoreductase NAD-binding domain
MDFLQGQSTETMVAVAVAVVAVAAGAAFLLLRSGKSKGCLNPENFKKFKLVEKKQISHNVAKFKFALPTPTSVLGLPIGQHISCRGQDATGEEVMKPYTPTTLDSDLGYFELVIKMYPQGRMSHHFREMKVGDYLSVKGPKGRFKYQVGQVRAFGMLAGGSGITPMFQVARAILENPNDNTKVHLIYANVTYEDILLKEELDNMAKTYPDRFKIYYVLNQPPENWNGGVGFVSKEMIQSHCPAPADDIQILRCGPPPMNKAMAAHLDELNYTKEMQFQF

SEQ ID NO: 7759 - DNA, 1081 bp, Panicum virgatum
  misc_feature: Ceres CLONE 1955447
  misc_feature: Encodes the peptide sequence at SEQ ID NO. 7760
agcgctgctctcgcatcgagacgacccgcgtccaccgcgcccgtgcgccgcacccccgcacccacggaagtaacttaatttcttgaccaacatgtctcgggaggagaatgtttacatggccaagcttgctgagcaggcagaacggtacgaggagatggttgagtacatggagaaggtggctaagactgtggatgtagaagagctcaccattgaggagcgtaaccttctctctgttgcctacaagaatgtcattggggctcgccgtgcctcatggcgcattgtctcctccattgagcagaaggaggagtcccgtaagaatgaggaacatgttgctcagatcaaggaataccgtggcaagattgaggccgaattgagcaatatctgtgatggtatcctgaagctgcttgactcgcaccttgtgccttcctccactgctgcagagtcaaaggtgttttacctcaagatgaagggtgattatcacaggtacctggctgagtttaagactggcgttgagaggaaggaatctgcggacagcacaatggtggcttataaggcagctcaggatattgcactggctgaattggcacctactcatccaatcaggcttggacttgcacttaacttcccagtgttctattatgagattctgaactctccagacagagcttgcaaccttgcaaagcaggcttttgatgaggctatctcagagttggacacccttggagaggagtcgtacaaagatagcaccttgatcatgcagctcctgagagacaacttgaccctctggacctccgacctcacggaggatggtgccgaggagggcaaagaagcctcgaagggtgatgcaggtgagggtcagtagcctggtaaacattgatgaatggttcggcatgtttttcaagcccattgtgttggacgccccatgctcctccatggattccccgattccgagtgtcgagccttgttcccctcacccctgctccatttcatgtactaggctggtagtggtcggattagtcccattgcatttgttgtcactgggtccatttggactgatggtattgaagtcgtcttctctggc

SEQ ID NO: 7760 - protein, 256 aa, Panicum virgatum
  misc_feature: Ceres CLONE 1955447
  misc_feature: Great-hit functional homolog of the protein sequence given in SEQ ID NO 9428
  misc_feature: The sequence is a functional homolog of  SEQ ID NO 2350 in the  10/374,780 US patent application
  misc_feature: The sequence is a functional homolog of  SEQ ID NO 344 in the  10/412,699 US patent application
  misc_feature: The sequence is a functional homolog of  SEQ ID NO 790 in the  10/225,066 US patent application
  misc_feature: The sequence is a functional homolog of  SEQ ID NO 805 in the  11/479,226 US patent application
  misc_feature: Useful for making plants with modulated drought sensitivity
  misc_feature: Useful for making plants with modulated growth and phenotype characteristics
MSREENVYMAKLAEQAERYEEMVEYMEKVAKTVDVEELTIEERNLLSVAYKNVIGARRASWRIVSSIEQKEESRKNEEHVAQIKEYRGKIEAELSNICDGILKLLDSHLVPSSTAAESKVFYLKMKGDYHRYLAEFKTGVERKESADSTMVAYKAAQDIALAELAPTHPIRLGLALNFPVFYYEILNSPDRACNLAKQAFDEAISELDTLGEESYKDSTLIMQLLRDNLTLWTSDLTEDGAEEGKEASKGDAGEGQ

SEQ ID NO: 7761 - DNA, 1363 bp, Panicum virgatum
  misc_feature: Ceres CLONE 1955474
  misc_feature: Encodes the peptide sequence at SEQ ID NO. 7762
ctttttccgtttccttctttttcctcgacacctcccagcccataaaagcctgcgcgatccagctctcgaatccccccgtcgttctcgattccaccccgaaactccgacgcctcccgcaaaatccccccaaacccccgcgccgccgcaggcaacaaccggcgaggatcccatgaagccggcgcacacctcccgcaagcgcggcccgccggttccacctccacccgcggccggccccgccccgcccgtccagctcccgccgccgggcttcgtcgccgaccgcgcggaggccgcggcgcgcgtggagcgcctgctgtgctaccagttccgcgaccgcgccctcctcgaggaggcgctcacgcaccagtccttctccgacaccgtgacctcctaccagcggctcgagttcgtcggggacgccgcgctcggcctcgccttcaccaacttcctctacctcaccaaccccaccctcggccccggcgcgctatccacgctccgcgccgctaacgtctccaccgagaaacttgcgcgcgtcgccgtccgccacgatctctacccgctgctccgccgcaagtgcgcccgcctcgactttctcgtaggccagtttattgaatcagtgaagatagaactaaaagatgaccttgccactacaccttatggtgggagtttggttaaagctcccaaggtgcttgcggatattgttgagtccatcgctgctgctgtctacgttgattgcaaatttgaccttgagaagctttggaaggttacaaggtggctctttgagccaattatcacggcagaaaccgtagatgaacaaccagtgactacattgcatgagttatgccagaaacatggcaaagttgcccagttcaagacatggcagaggggtgggataacagtggtaaatgtatttgttggtggggagatggttgggcttggctcctcggagcagaaggtaattgctaagctcaatgcagcacgaaatgcgttagcgaagcttggtggtgcaaaacagcaagtgatcactgggcttggcaatggatcggcggatgagattggggagctcaaggagtgtaaacatcaacttgctgatcagtgcattggaaagaattggccagaacccatttttaagttggaaaaagaaggtggccctgcacatgataggaagtttgtgttctctgttcaggtagaaactcaagatggcacttttgttacaataggtgatcctatgtcaagggtaaaagatgcagagaattccgctgcggagaagttgttggaattattgttgcggttgtgagatcttttctgtacatggctagatcatcggtaaccttattttattcaagcattcctattatggcagacc

SEQ ID NO: 7762 - protein, 374 aa, Panicum virgatum
  misc_feature: Ceres CLONE 1955474
  misc_feature (1)..(115): Pfam Name: Ribonuclease_3 Pfam Description: RNase3 domain
MKPAHTSRKRGPPVPPPPAAGPAPPVQLPPPGFVADRAEAAARVERLLCYQFRDRALLEEALTHQSFSDTVTSYQRLEFVGDAALGLAFTNFLYLTNPTLGPGALSTLRAANVSTEKLARVAVRHDLYPLLRRKCARLDFLVGQFIESVKIELKDDLATTPYGGSLVKAPKVLADIVESIAAAVYVDCKFDLEKLWKVTRWLFEPIITAETVDEQPVTTLHELCQKHGKVAQFKTWQRGGITVVNVFVGGEMVGLGSSEQKVIAKLNAARNALAKLGGAKQQVITGLGNGSADEIGELKECKHQLADQCIGKNWPEPIFKLEKEGGPAHDRKFVFSVQVETQDGTFVTIGDPMSRVKDAENSAAEKLLELLLRL

SEQ ID NO: 7763 - DNA, 1138 bp, Panicum virgatum
  misc_feature: Ceres CLONE 1955481
  misc_feature: Encodes the peptide sequence at SEQ ID NO. 7764
atccaaacaccgaatcttgtgtctgctcggtacgcagtagccgccttccttcttaggcttggagtagtaggattgtgcttgctgcactgagctaagagatggcctcctctttctcttccaaggcagctgcccttgcagcactcctcttctccctccttgtcacgtatggctcgtgcgctcggcctgtgaacttcaacgcctccgccttcaccgccgatcccaactgggaggccgccagggccacctggtacggcgcgcccaccggcgccggtcctgacgacgacggtggcgcctgcgggttcaagaacgtgaacctgccgccgttctcggccatgacgtcgtgcggcaacgagccgctgttcaaggacggcaagggctgcggctcctgctaccagataagatgtaccaaccacgctgcgtgctccggcaacccggagacggtgatcatcaccgacatgaactactaccccgtcgccaagtaccacttcgacctcagcggcacggcgttcggcgccatggccaagcccggcagcagcgacgagctccgccatgccggcatcatcgacatccagttcaagagggtgccctgcaactaccccgggcagaaggtgaccttccacgtcgaggagggctcgaacgccgtctacctcgcggtgctcgtcgagttcgaggacggcgacggcgacgtggtgcaggtggacatgatggaggccaactccggctcgtgggcgcccatgcgcgagtcctggggatccatctggaggatggactccaaccaccggctgcaggcgcccttctcgctgcgcatcaccaacgagtccggcaagcagctggtggccagcaacgtcatcccggccaactgggtgcccaacacctactaccgctccatcatccagtactagccactgtagcccatgcccatcatctggtgcttgcatgcccacaataatccggtcattgatttttggttattcgtctggtgctatttcgttgttgcattggattgaggtgccttaattaactagagatagtagtaggtaagatatcagcaggtgtccggctatgctggcactggcagtagtaggagttgtgtctgtaagagagattggcgagtgggaaacagaggaggcaagtttgc

SEQ ID NO: 7764 - protein, 267 aa, Panicum virgatum
  misc_feature: Ceres CLONE 1955481
  misc_feature: Great-hit functional homolog of the protein sequence encoded by LOCUS At1g65680
  misc_feature: Useful for making plants with altered cell wall content and/or composition
MASSFSSKAAALAALLFSLLVTYGSCARPVNFNASAFTADPNWEAARATWYGAPTGAGPDDDGGACGFKNVNLPPFSAMTSCGNEPLFKDGKGCGSCYQIRCTNHAACSGNPETVIITDMNYYPVAKYHFDLSGTAFGAMAKPGSSDELRHAGIIDIQFKRVPCNYPGQKVTFHVEEGSNAVYLAVLVEFEDGDGDVVQVDMMEANSGSWAPMRESWGSIWRMDSNHRLQAPFSLRITNESGKQLVASNVIPANWVPNTYYRSIIQY

SEQ ID NO: 7765 - DNA, 1198 bp, Panicum virgatum
  misc_feature: Ceres CLONE 1955484
  misc_feature: Encodes the peptide sequence at SEQ ID NO. 7766
accgcaaccgcaagtcagtcacactcccctctccccatcccatccctgtccaccctccgccaatcccagcaagcaggatggccgcgcgctgcccctacttcgccgccgaggagtccgcccgcggcatccgcccgggggagtccccggccgcggcgctccgccggatcctcgccacgcccggcgcgcaccaggcgccctgctgcttcgacgcgctcggcgcgcgcctcgtcgagcgcgcggggttccccatcggcttcatgggcggtttctgtgtttctgcagcacggcttggcttgcctgatgttggcctcatctcctatggagaaatggtagaccaagggcgtctaatcaatgaagctgtgtcgatcccagtgattggtgacggagacaatggctatggaaactctatgaacatcaagagaaccatcaaagcatatattaatgctggttttgctggaatcatgcttgaagaccaggtggcacctaaagcatgcggacatactgaaggaaggaaagtcatctcaagggaggaggccatcatgcacataaaagctgctgttgatgctaggaaggagagtggctctgacattgttattgtggcaagatcagattcccgtcaagccatttctcttgatgaagcattatggagagtaaaagcttttgctgatgccggcgctgatgttctgtttattgatgcccttgcttcagtggaagagatgaaggcattttgcgcagttgcaccagaagttccaaagatgtcctttcttccagtgagtttgacaaggggtgttgaaaggatacacccaaaagacaaatatgttccataaagtaaaattgaggccacactttgatctgaagttgtcttgtagtttatatgcattgtcatacccattcatgctggttcaggtttggagttccgcagcagattctggatattttagtattccatagaacttcatgctatgttctcgatgcataatctaatgttcgtgtaggtgtgttgtgtcattcagatctgtacatgatatagtgatgaaatggggctgatcggtgcctccatttggacccagctttattgtaggtattagatacatatgatgaactgattcacctacaccatcaccattttctcatatttccagtctgaatcgaaaagaatacctgtacaagttacttttactgctcatgttttgttgtc

SEQ ID NO: 7766 - protein, 249 aa, Panicum virgatum
  misc_feature: Ceres CLONE 1955484
  misc_feature (1)..(83): Pfam Name: ICL Pfam Description: Isocitrate lyase family
MAARCPYFAAEESARGIRPGESPAAALRRILATPGAHQAPCCFDALGARLVERAGFPIGFMGGFCVSAARLGLPDVGLISYGEMVDQGRLINEAVSIPVIGDGDNGYGNSMNIKRTIKAYINAGFAGIMLEDQVAPKACGHTEGRKVISREEAIMHIKAAVDARKESGSDIVIVARSDSRQAISLDEALWRVKAFADAGADVLFIDALASVEEMKAFCAVAPEVPKMSFLPVSLTRGVERIHPKDKYVP

SEQ ID NO: 7767 - DNA, 1202 bp, Panicum virgatum
  misc_feature: Ceres CLONE 1955493
  misc_feature: Encodes the peptide sequence at SEQ ID NO. 7768
ataaagccactctctcgctcactctatttccgctctcaccctctccctccgctcgccactaaccacccgcgccacactcgtttctctcccccctcccagctcggctccctctgctcctttcccctgcgccgggacgcaggagcgacgccatcttccttcccgtcacctccgatggggaacccgcccgagctgtaccacaagatcctcaacatccccaaggacacctcgccgcaggagatccgcaccgcgtacaagaacctcgtcaagaaatggcaccccgacaagcacccgccgtcgtccaagcccgaggccgaggcgcgcttcaaggccatcagtgaggcctacgaggcgctcctggaccagcaggagaacagggcggtgttcgggctgtgcaacgacggccgggccggcgagagggccggcggcggcggcctcggcgccggcgtcgggccgcgcatggagaggacgcgcagcgacgacttctgcacgaggagcgcgcccggcacgccggcgagggagttcaagaaggtgtacagctccggcaactccggcgggcggcgcgccttcgccgagttctccagctccatcatgcgcaaggcgccgccgctggagcgcaagctcgagtgcaccctcgaggagctctgccgcggctgcaagaaggaggtcaagttcacccgcgacgtcgtcaccaagaacgggtcaattgttaagaaggaggtgacccagacggtggtggtgaagccggggtggaggaaagggaagcaggtcgtgttcgaaggcatgggggacgagcggccgggctgcctgcccgccgacgcgatcttcaccgtgtcggagaagaagcactcgacgttcaagcgcgtgggcaacgacctggtgctcaaggccgaggtgccgctggtgagcgcgctcacgggctggtccttgtcgttccggctgctgagcggcaagaaggtgagcctggcgttccaggacgaggtcatctgcccggggctcgagaaggtgatcaggggcgaaggcatgcccatccccgagcacaagggcgcgcggggcgacctcagggtgaagctcgaggtcgtcttccccaaggacaaggatgtaatacccgtagccttggatcaaatccagacgtgagaaatcacagaagaacacagagattcgccgggacgaggacagcttcctcttccgatttgtttcatagc

SEQ ID NO: 7768 - protein, 320 aa, Panicum virgatum
  misc_feature: Ceres CLONE 1955493
  misc_feature (1)..(66): Pfam Name: DnaJ Pfam Description: DnaJ domain
  misc_feature (2)..(110): Pfam Name: DnaJ_C Pfam Description: DnaJ C terminal region
MGNPPELYHKILNIPKDTSPQEIRTAYKNLVKKWHPDKHPPSSKPEAEARFKAISEAYEALLDQQENRAVFGLCNDGRAGERAGGGGLGAGVGPRMERTRSDDFCTRSAPGTPAREFKKVYSSGNSGGRRAFAEFSSSIMRKAPPLERKLECTLEELCRGCKKEVKFTRDVVTKNGSIVKKEVTQTVVVKPGWRKGKQVVFEGMGDERPGCLPADAIFTVSEKKHSTFKRVGNDLVLKAEVPLVSALTGWSLSFRLLSGKKVSLAFQDEVICPGLEKVIRGEGMPIPEHKGARGDLRVKLEVVFPKDKDVIPVALDQIQT

SEQ ID NO: 7769 - DNA, 1177 bp, Panicum virgatum
  misc_feature: Ceres CLONE 1955535
  misc_feature: Encodes the peptide sequence at SEQ ID NO. 7770
atcccagcgcacaacttcttctcctgcctgccctcccaagcttgcgagcttgtccggcttagcttgtagcagcgctacctagctagtaagatggcatccgccatgatcgccacgaaggtggcctcacttgctgccgcactgatcttctccctccttgtcacgtacggctcgtgcgctagcccgccgccggtgaaccttaacgcctccgccttcaccgccgaccccaactgggaggccgccagggccacctggtacggcgcgcccaccggcgccggaccatacgacgacggtggcgcctgtggattcaagaacgtgaacctgccgccgttctcgtccatgacgtcctgcggcaaccagcccctgttcaaggacggcaagggctgcggctcctgctaccagatacgatgcaccaaacacgctgcctgttccggcaacccggagacggtgatcatcaccgacatgaactactacccggtggccaagtaccacttcgaccttagtggcactgccttcggcgccatggccaagcccggccgcaacgaagagctccgccacgccggcatcatcgacatccagttcaagagggtgccctgcaactaccccgggcagaaggtgacgttccacgtcgaggagggctcgaacgccgtctacctggcggtgctcgtsgagttcgaggacggcgacggcgacgtggtgcaggtggacctgatggaggccaactccgggtcgtgggcgccgatgcgcgagtcctggggatccatctggaggatggactccaaccaccggctgcaggcgcccttctcgctgcgcgtcaccaacgagtccggcaggaagctggtggccagccgggtcatcccggctaactgggcgcccaataactactaccgctccatcatccagtattagccctgctactgcgtgcatgcgctctgtaattccggcgtcattggccggcttaattgtatatcatcgctgcgtttactaggtagcactccagtaattaagtgaggcgccggaagcccggcaatgccgcccgtaggtgttgtgtttcagcaagtgttggcagagtaggagatgaggaggccagtttggatgtgctttctcgcccagtgccaatgtatttttcaatgtgatcaagactataattggaaactggttctgtgtggcattcagaacg

SEQ ID NO: 7770 - protein, 271 aa, Panicum virgatum
  misc_feature: Ceres CLONE 1955535
  misc_feature: Great-hit functional homolog of the protein sequence encoded by LOCUS At1g65680
  misc_feature: Useful for making plants with altered cell wall content and/or composition
MASAMIATKVASLAAALIFSLLVTYGSCASPPPVNLNASAFTADPNWEAARATWYGAPTGAGPYDDGGACGFKNVNLPPFSSMTSCGNQPLFKDGKGCGSCYQIRCTKHAACSGNPETVIITDMNYYPVAKYHFDLSGTAFGAMAKPGRNEELRHAGIIDIQFKRVPCNYPGQKVTFHVEEGSNAVYLAVLVEFEDGDGDVVQVDLMEANSGSWAPMRESWGSIWRMDSNHRLQAPFSLRVTNESGRKLVASRVIPANWAPNNYYRSIIQY

SEQ ID NO: 7771 - DNA, 682 bp, Panicum virgatum
  misc_feature: Ceres CLONE 1955597
  misc_feature: Encodes the peptide sequence at SEQ ID NO. 7772
acaccactttaccaccacaacacccagccccagcaaactcacacagaagcagcagcagcagcagcagtgtagtgcctgcagcagctgaggccaagcaggatgaagaagcttcaggccacggccgccctggcgctcctcctcttcctcctcctggcgccccccgcgctccgtgtctccatggccggatcagggttctgcgacggcaagtgcacgacgaggtgctccaaggcgagccggcacgacgactgcctcaagtactgcgggatctgctgcgccgcctgcggctgcgtgccgtccgggacgttcggccacaaggacgagtgcccctgctaccgcgacatgaccaccggccacggcaaccgcaccaggcccaagtgcccatgatcatgaccactcaccataggctaagcacccatatacatggctacattctcgcacacaccctaaccatgactccatgagcatggatgcatgtgcatatatgtttgtgcccttgagagatctgtgccctgcgggtgctctgcttcccacctgaaccttctggtttcactcgctgctagcctgctctgctatgtacattgggcaagaaacggagctgatgtggtgatggtattagtgttgtatactggccagctggtaataatgatgtgtattgtgataataaagtcttgacttaagagcg

SEQ ID NO: 7772 - protein, 94 aa, Panicum virgatum
  misc_feature: Ceres CLONE 1955597
  misc_feature (1)..(91): Pfam Name: GASA Pfam Description: Gibberellin regulated protein
MKKLQATAALALLLFLLLAPPALRVSMAGSGFCDGKCTTRCSKASRHDDCLKYCGICCAACGCVPSGTFGHKDECPCYRDMTTGHGNRTRPKCP

SEQ ID NO: 7773 - DNA, 761 bp, Panicum virgatum
  misc_feature: Ceres CLONE 1955628
  misc_feature: Encodes the peptide sequence at SEQ ID NO. 7774
gacttcgcatcacgcaacgccccccggcactcgtcacgcacatccaaacccacttcccgatccgacccggaagttccgagcgaacatgaagtcgagggcgaggtccagcggagcccactccaggctctccgtgaggaggtccaaggccgacaacgaccccaacaagcccaaaaggcctccgagcgccttcttcttcttcatggaggagttcaggaaggactacaaggagaagcaccccaatgtcragcaagtctccgtgattggcaaggctggtggcgacmagtggaagtccctgtccgatgctgagaaagctcccttcgtgtccraggctgagaagstcaaagctgagtacaccaagaagatggatgcctacaataacaagacggctggaggccctacagcttctggtgactctgacaagtccaagtccgaggtgaacgacgaggatgaggagggtgacgagtgatgcatccatgtctccagccaagtcgtcgcagtcagtagtagggaagtcttcgtcgtckgcctaaccgggcaktgctgctccttagcctctggatgctgtcrgtctctctagatgtagcagtagtagcttggtagttgcaagtgtsgtcycwgaagtgaagcagtttagtggtagtgtgtttgcttcttcggcacttaactcgttgttggaatttatgtcgccctgcagtctgtacttaccccaagcatcagttcctgttttaatctccgatatgaatagatgagttattttgccg

SEQ ID NO: 7774 - protein, 126 aa, Panicum virgatum
  misc_feature: Ceres CLONE 1955628
  misc_feature: Great-hit functional homolog of the protein sequence given in SEQ ID NO 9488
  misc_feature: Useful for making plants with altered Lignin content
  misc_feature: Useful for making plants with altered terpenoid content
  misc_feature (54)..(54): Xaa is any aa, unknown, or other
  misc_feature (66)..(66): Xaa is any aa, unknown, or other
  misc_feature (81)..(81): Xaa is any aa, unknown, or other
  misc_feature (85)..(85): Xaa is any aa, unknown, or other
MKSRARSSGAHSRLSVRRSKADNDPNKPKRPPSAFFFFMEEFRKDYKEKHPNVXQVSVIGKAGGDXWKSLSDAEKAPFVSXAEKXKAEYTKKMDAYNNKTAGGPTASGDSDKSKSEVNDEDEEGDE

SEQ ID NO: 7775 - DNA, 937 bp, Panicum virgatum
  misc_feature: Ceres CLONE 1955668
  misc_feature: Encodes the peptide sequence at SEQ ID NO. 7776
acgacgacgcccccatttcgaggctcctccttgcgattccaatccccgcacgcatcttccgcctcgcgcaggctatagtagtcatggaacacaaggaggcgggctgccagcaaccggaggggccaatactatgcatcaacaactgtggcttctttggcagtgcggccaccatgaacatgtgctccaagtgccacaaggagatgataatgaagcaggagcaggcccagctggctgcctcctccattgatagcattgtcaatggcggtgacggtgggaaaggccttattatagctgcaaccgcagaggtggcggttgctcaagttgaggagaagactattgttgtgcagcctccatttgtagctgaaaccagcgaggctgctgtcgttatacccaaggccaaagaaggtccgaaccggtgtgcaagctgtaggaagcgggttggcctgacgggtttcaactgccgatgcggtaacatgtactgcgcgatgcaccgctactccgacaaacatgactgccagtttgactaccagactgcagctagggatgcgattgccaaggccaatcctgtggtgaaggcggagaagctcgacaagatctgaagggggcaatggggaacgaaatgggttgcgatctgcaagattcaatcatgcatctttgctgctttatcattgaacatcccattcttgtttgctgccacatccctgagttgttcaacactatgatgctcacgcatcctggcagctgcaagaactcatcctcagtcgagttcaaaatggtttgcgtgttggctatgttgtgtaagcttattcagttattcatggtggtttcagtggtttcagtcggtattgtggcattcccatttaggtagctctgtaatgtactattgtctcatgcgtgctacattccaatcagtaatagtaatcagcaatggtctgcc

SEQ ID NO: 7776 - protein, 171 aa, Panicum virgatum
  misc_feature: Ceres CLONE 1955668
  misc_feature (1)..(41): Pfam Name: zf-AN1 Pfam Description: AN1-like Zinc finger
MEHKEAGCQQPEGPILCINNCGFFGSAATMNMCSKCHKEMIMKQEQAQLAASSIDSIVNGGDGGKGLIIAATAEVAVAQVEEKTIVVQPPFVAETSEAAVVIPKAKEGPNRCASCRKRVGLTGFNCRCGNMYCAMHRYSDKHDCQFDYQTAARDAIAKANPVVKAEKLDKI

SEQ ID NO: 7777 - DNA, 767 bp, Panicum virgatum
  misc_feature: Ceres CLONE 1955679
  misc_feature: Encodes the peptide sequence at SEQ ID NO. 7778
aaggaccacccagaaacagagaaggcgcggctcccgaggtcaagtcgtctcattacctttcccctcctccgctcccgtcgctcgcctcgcttcccgttcgccggcgcgccgccaaccaagctcatacatccagaccgactagtgaaactgatcagtttggggactaatcaaactcaacaagcaagtttcatgtctgatctcgacgtccagcttccatctgcttttgatccgtttgcggaggcaaatgctgaggactccagcgctggtgctggatcaaaggagtatgtgcacgtgcgcattcagcagcgcaacggaagaaagagcttgacaactgttcagggcttgaagaaagactacagctataacaaaatcctgaaggatctcaaaaaggagttctgctgcaatggcagtttagtccaggatccagagctaggccaggtcattcagctgcaaggtgatcagcgcaaaaatgttgctactttcctagtccaggctggaatcgcaaagaaagagagcatcaagattcacggattttaagcagcaacatataaatgcttctgtggtatcatataccaagcattgaaggtttctgaagcttggaagtcttaatatcagtagtcattttcataatctgaacctttgtgtcactattggattgagaattctatcattgatgcaagtcgtgcttgcagtatggtttgtaagcgttacctgcatgaaagtatcgtgcgtcgaataacaagagagattgctgtttgggttcgttt

SEQ ID NO: 7778 - protein, 115 aa, Panicum virgatum
  misc_feature: Ceres CLONE 1955679
  misc_feature: Great-hit functional homolog of the protein sequence given in SEQ ID NO 9555
  misc_feature: Useful for making plants with modulated biomass
  misc_feature: Useful for making plants with modulated flowering time
  misc_feature: The plant flowers significantly earllier than wild-type.
  misc_feature: The plant is abnormally small.
MSDLDVQLPSAFDPFAEANAEDSSAGAGSKEYVHVRIQQRNGRKSLTTVQGLKKDYSYNKILKDLKKEFCCNGSLVQDPELGQVIQLQGDQRKNVATFLVQAGIAKKESIKIHGF

SEQ ID NO: 7779 - DNA, 971 bp, Panicum virgatum
  misc_feature: Ceres CLONE 1955713
  misc_feature: Encodes the peptide sequence at SEQ ID NO. 7780
atcacagcatcacaacaagaactagctcacatcctctcactagtacactgcgatcgcagctgagaaagcacgagccatccgacatggtttccaagaaaaccatgtcctccctcgccttcctcgtggcgctgctgctcgcatgcagctccatgagcagcgcggctcggtacctggaggagacgaagcccgagtacccgccgcaccccgccgtgccggagatccccaagccggagctgcctccgcaccccaccgtgccagagctcccaaagcctgagctgccaccccaccccaccgagccagagcacccgaagcctgagctgccgccacacccaaccctgccagagctacccaagcctgagctgccaccgcaccccgccgtgccggagcacccaataccggagctgcctcaccctgtgcaagaggttcccaagccagagctgccacaccccgccgtgccggaggtgccgcaccccgtgcctgaagtacccaaacccgagctgccacaccctgccgtgccggaggtgccgaagcctgagctcccgcctcaccccgaggtaccggagctgccgaagccggaaacgcctcacgtgccggaggtgccgaagcccgagctcccgcctcaccccgaggtaccggagctgccgaagccggaagctcctcacgtgccggaggtgccgaagcatgagctcccgcccctgccggaacccgagctgccgaagccggagagccactacccggtgccagagcccaagccatgatcgaatgaatgaactgcgcccgtgttgctcctccagctagtaataatgcgttctgtttctgtacttggtgtggatacgatggagtagtatgtaggagcgtgacgttcagtgttgtacgttgtgcttgctgctttgatttgtccgttgatgatgttacctatgtatatgtattgcctttggcgtatatcatatatatacacgaataatttcatt

SEQ ID NO: 7780 - protein, 224 aa, Panicum virgatum
  misc_feature: Ceres CLONE 1955713
  misc_feature (60)..(116): Pfam Name: Trypan_PARP Pfam Description: Procyclic acidic repetitive protein (PARP)
MVSKKTMSSLAFLVALLLACSSMSSAARYLEETKPEYPPHPAVPEIPKPELPPHPTVPELPKPELPPHPTEPEHPKPELPPHPTLPELPKPELPPHPAVPEHPIPELPHPVQEVPKPELPHPAVPEVPHPVPEVPKPELPHPAVPEVPKPELPPHPEVPELPKPETPHVPEVPKPELPPHPEVPELPKPEAPHVPEVPKHELPPLPEPELPKPESHYPVPEPKP

SEQ ID NO: 7781 - DNA, 1076 bp, Panicum virgatum
  misc_feature: Ceres CLONE 1955733
  misc_feature: Encodes the peptide sequence at SEQ ID NO. 7782
acgacctccccgcctcgaccattcccgtggactcccggctgccccgcctccctgctgtgctgccgccccgctccagcattcccaacccccaccccgcgcggccgtcgccggagcgagcagagcagccggagggcacgtcggatccgccgccgccaagatgaacgacgccgatgtctccaagcagatccagcagatggtgcggttcatctgccaggaggccgaggagaaggccagcgagatctccgtctccgccgaggaggaattcaacattgagaagttgcagcttgttgaagctgagaaaaagaagatcaggcaagagtatgaacgaaaagagaagcaggttgaagtacggaagaaaattgagtactctatgcagttgaatgcttctcgcatcaaagttcttcaagctcaggatgatctagttaacaaaatgaaagaggatgccatgaaggaactccttcgtgtcagcgacaaccaccacgaatacaagaaccttttgaaagatctaatcgttcagggcttgctcaggttgaaagagccagctgtactgctccgttgccgtaaagaggaccaccatcatgtggaatctgtactgcattcagcaaagcatgagtatgcatcaaaagcagatgtccatcaaccagagatatttgttgaccatgatgtgtacctgccacctgccccaagccatcatgatgctcatggccagttttgctctggaggtgttgtcctggcttctcgagatggaaagattgtgtttgagagtacacttgatgcaagactggaagttgttttccgcaagaaattgccagagatccggaagcttctttttggccagaaggcagtctaatagacttatccgatgacggcgacgatggtacagctgcttctatgtaatggctgctgccctgcagccgtaagcgactccaccagtttttgccaaattgattgtttaaagtattcatcccctatgtacaaactacctatttgttcattattatcgccgagcaccgactatttgcactctgtttgctccgaggaataagaataaagcaccgccagactcttcactgcag

SEQ ID NO: 7782 - protein, 230 aa, Panicum virgatum
  misc_feature: Ceres CLONE 1955733
  misc_feature (1)..(210): Pfam Name: vATP-synt_E Pfam Description: ATP synthase (E/31 kDa) subunit
  misc_feature (1)..(229): SWISSPROT Homolog: EC 3.6.3.14 Vacuolar ATP synthase subunit E
MNDADVSKQIQQMVRFICQEAEEKASEISVSAEEEFNIEKLQLVEAEKKKIRQEYERKEKQVEVRKKIEYSMQLNASRIKVLQAQDDLVNKMKEDAMKELLRVSDNHHEYKNLLKDLIVQGLLRLKEPAVLLRCRKEDHHHVESVLHSAKHEYASKADVHQPEIFVDHDVYLPPAPSHHDAHGQFCSGGVVLASRDGKIVFESTLDARLEVVFRKKLPEIRKLLFGQKAV

SEQ ID NO: 7783 - DNA, 860 bp, Panicum virgatum
  misc_feature: Ceres CLONE 1955754
  misc_feature: Encodes the peptide sequence at SEQ ID NO. 7784
actctgaccgctagctttctttcttccccaacaatcttcgggaggcttcttccctccgccgccatggccgccgcccgcctgctcccgctgctcagacgccgcctcgccaccacgatctccgacgcgcgcgctccctcctcccgaggattttcgtttcctccaaccacatctgcggggctaagatccctcctgacagttaccgaagcaagcaccaatgcatccgacaacaatcctttggaccaagagcaagacagctccaaaactgacacccctccagcttcagcccctgcaccggagcccagcttcaaggtcagagatacctccaacctgaagatctcgcccaggcatgaccttgccatggtcttcacatgtaaggtctgcgagaccaggtctatgaagatggccagccgggactcgtacgagaatggagttgtggttgcacgctgtggtggctgcaacaacctccaccttatagcagataggctaggctggtttggggagccagggagcattgaggacttcctagcagcgaaaggagaggaggtgaagaaaggttcaacggatactctcaacttctctctcgacgacttggttgggtctcaggtcagttcataggggccttctgaacaaaattagacttcttcctgatatggtggtaggcttttcgaccagcaagtacctgtagaagcaacattaatattagggaagtcccacaaatattgttcaacttcatggcttgtcatgtgtatctctcaagctcatcgagtacatgtcattgtgatctattgcagtgtagctgttttactgaaaactcatccatgggttttaagcccacataaatgactggtgaatttcttgtg

SEQ ID NO: 7784 - protein, 183 aa, Panicum virgatum
  misc_feature: Ceres CLONE 1955754
  misc_feature (1)..(65): Pfam Name: zf-DNL Pfam Description: DNL zinc finger
MAAARLLPLLRRRLATTISDARAPSSRGFSFPPTTSAGLRSLLTVTEASTNASDNNPLDQEQDSSKTDTPPASAPAPEPSFKVRDTSNLKISPRHDLAMVFTCKVCETRSMKMASRDSYENGVVVARCGGCNNLHLIADRLGWFGEPGSIEDFLAAKGEEVKKGSTDTLNFSLDDLVGSQVSS

SEQ ID NO: 7785 - DNA, 1089 bp, Panicum virgatum
  misc_feature: Ceres CLONE 1955768
  misc_feature: Encodes the peptide sequence at SEQ ID NO. 7786
gatcgagggagcaagcaagcagccaggcgaaggtgaggccgtgagggggaagccgggaagggctgctagtactagccggtggcgatcttcttgcaccggggtgtcctgccgtgcgagggggatgggggagcaggagaacaacaagaccggcggcggcaacaacgccatggcggtggtggacgaggctccggcggcggccaaggagaagggccgcgccgccgcggacccgcgcctccagggcatttccgacgccatccgcgtcgtcccccacttccccaagccagggatcatgttcaacgacatcacgcagctgctgctccggccggccgtgttcaaggacgccgttgacatgttcgtcgagcgctaccgcggcatgggcatcgcggccgtcgcaggtatcgaagccagaggcttcatctttggaccagccattgctttagccattggagcaaagttcataccgctgcgtaaacctaagaaacttccaggtgatgtattttctgaaagttatgtacttgagtatgggacggattgtttggagatgcatgttggagctattgaaccgggggagcgtgcagtggttgttgatgatctggttgccactggtggaaccctttctgctgcaatcagacttcttgaacgcgccggagctgacgtggttgagtgtgcatgcctcattgggcttcccaagtttaaggatttctacaagctcaacggaaaaccagtttacattctggtggagtcccgcaaataggacgtggtaaaagatcaggcagaaaagctttcctcagaaaaacaagctcaaagcttcattgtttgcaagcgcgaggtggaagaatggacgccgagtactctccggtaaactgtgttgaggccaggggccagagccagctgctatgtatcttcatggagagggtgagatggatcgggtgaaacgttagtctctgtaccacgtcccgtctagtgttcttttagtagccgtgactgaggagagtttgtagctattcccgccgggaactgaagtgttggccagagaatcgaaggggaacggtttttcttcgagaattgtacgttttctgtgtcttgttc

SEQ ID NO: 7786 - protein, 210 aa, Panicum virgatum
  misc_feature: Ceres CLONE 1955768
  misc_feature (26)..(207): SWISSPROT Homolog: EC 2.4.2.7 Adenine phosphoribosyltransferase 2
  misc_feature (35)..(208): SWISSPROT Homolog: EC 2.4.2.7 Adenine phosphoribosyltransferase 1
MGEQENNKTGGGNNAMAVVDEAPAAAKEKGRAAADPRLQGISDAIRVVPHFPKPGIMFNDITQLLLRPAVFKDAVDMFVERYRGMGIAAVAGIEARGFIFGPAIALAIGAKFIPLRKPKKLPGDVFSESYVLEYGTDCLEMHVGAIEPGERAVVVDDLVATGGTLSAAIRLLERAGADVVECACLIGLPKFKDFYKLNGKPVYILVESRK

SEQ ID NO: 7787 - DNA, 721 bp, Panicum virgatum
  misc_feature: Ceres CLONE 1955770
  misc_feature: Encodes the peptide sequence at SEQ ID NO. 7788
gctagcttcccccagctgctgcccagcgacctccgggcctccggccggtcacgccatggaccccggcgccacggccacgccgcggcagccagcagccccggcggcggcgaaggaatccggggccaagatgatggccgagctggactcgccgctgcacgccctcgggttcgagatggaggagctctccccgtcggggctcgccgggcgcctcctcgtgacccccacctgctgccagccgttcaaggtgctgcacggcggcgtgtcggcgctggtggcggaggcgctggcgagcatgggcgcgcacatggcgtccgggttccgccgcgtggtcgggatgcagctcagcatcagccacttccgcagcgccgccctcggcgacaccgtcctcgcgcgggccgcccccgttcacgtcggccgctccacccaggtttgggaagtaaagctctggaagatggatccatccacgggagagaagggtcctcagattgccgaatccagagtcacgctgctgagtaacctgcccttgccggaggagcacaagaacgccggagatgccctcaggaaatacgcatcaaaactgtagagatgggacgcttcaaacggataaccttcttgcaggtttcacggatctgaatatctgatgtttttttatgaaactgaatatctgatgttgtagaaaacatattggctatcctaaagacctgcaagtttcttctgctct

SEQ ID NO: 7788 - protein, 175 aa, Panicum virgatum
  misc_feature: Ceres CLONE 1955770
  misc_feature (1)..(78): Pfam Name: 4HBT Pfam Description: Thioesterase superfamily
MDPGATATPRQPAAPAAAKESGAKMMAELDSPLHALGFEMEELSPSGLAGRLLVTPTCCQPFKVLHGGVSALVAEALASMGAHMASGFRRVVGMQLSISHFRSAALGDTVLARAAPVHVGRSTQVWEVKLWKMDPSTGEKGPQIAESRVTLLSNLPLPEEHKNAGDALRKYASKL

SEQ ID NO: 7789 - DNA, 1067 bp, Panicum virgatum
  misc_feature: Ceres CLONE 1955772
  misc_feature: Encodes the peptide sequence at SEQ ID NO. 7790
actctcgacgctcgacccggaaaaaaaaattattctccgcgggggggaaggggaaaggtcgcgtggcgtctcggtctcgcccacagtccatcggtagcaatggcacaagagagctggaaacaagagaccgaggcgactggagtccacgcgcctgagacccctattctctgcataaacaactgtggtttctttggcagcagcatgaagaacaatatgtgttcgaagtgctacagggacttcatcaagttgatggaagcccctgtggtggagaagaaggtgatcacgtcagcatcttcttccgcggcaccactggagacaatgcgagatgatgcgcctacagctgctgccactgaagctgtgactgagaagcaagcagagcaagagcccccaaagccgcccagcaaccggtgcctgacctgccgcaagaaggtcggactgaccggcttcctttgccgctgtgggggcacattctgctccacgcaccgctacaccgactcccaccagtgcacctttgactacaagaaggtggcacgggagcagatagccaagcagaatccagttgtgatggccgagaagataaacaagatctgatgcatgcccgtgaagggattgctgagttcatgcctgggtttcgagtcctcaagttcactacaatcgataggttccttcgggtggtggtctgggttagcgtggtagtaggggatctcaattgtgtctatccttctccgttatcatggttctattctctgccggaatgatgcagtggttttgcgtcgtcacttcctcaggaagtagtttaagtcgagaagataagattgcacatcaggtattgcttattctggtcctggacggctaagtgttgtatcgacatgtcattggttttgtatcgctgtatgttatcacttgtgctggaagtcgcagcaggtatgaagcttatctgatcctgctaccatcatgtttatgtgatcagatgaagttatagataagcatatacatatcaaatctgtttatttgtgatgttggtcgtaaggtttgcaaataataagatgcagagcttttgatgaatc

SEQ ID NO: 7790 - protein, 163 aa, Panicum virgatum
  misc_feature: Ceres CLONE 1955772
  misc_feature: Great-hit functional homolog of the protein sequence given in SEQ ID NO 9336
  misc_feature (1)..(39): Pfam Name: zf-AN1 Pfam Description: AN1-like Zinc finger
  misc_feature: Useful for making plants with modulated nitrogen use efficiency
MAQESWKQETEATGVHAPETPILCINNCGFFGSSMKNNMCSKCYRDFIKLMEAPVVEKKVITSASSSAAPLETMRDDAPTAAATEAVTEKQAEQEPPKPPSNRCLTCRKKVGLTGFLCRCGGTFCSTHRYTDSHQCTFDYKKVAREQIAKQNPVVMAEKINKI

SEQ ID NO: 7791 - DNA, 1138 bp, Panicum virgatum
  misc_feature: Ceres CLONE 1955774
  misc_feature: Encodes the peptide sequence at SEQ ID NO. 7792
ttacccccccagcccgcgctcttttagccccctctcaacgcgattcctctccgtctccccgcttccaccgcaaccccacaagctcttctcgccgccgcaccagctcgtggcaccctaaccctaaaacccttacccctcgcctccaatcccacgctcccatggaggggcgcggaggctaagcgtagccaacccatcgcatatccccatggattgagtcgtcgattccaaggcatgggtccaaaccctagcctgcaacagctggtcgctgtggcggcggtgaaggcgtctgagccgccgcctccgccacgggcgcgtgtggtgcggatcctcgtccacgatgctgacgctaccgattcgtcctccagcgaggatgaggcgccgcctcctccgcgcagggcgaggggtggcagcagcagcgtgggcgcgaagcgccgcgtcatggaagcggccggggctaattcgcccgtccacttccgtggcgtccgccggaggccgtgggggcgctgggctgcggagatacgcgacccgcacagccgccgccgcctgtggctgggcaccttcaacaccgcggaggaggctgctgcagcctatgacgctgcaaacatccgcctccgcggtgcaagcgcccctaccaatttcccgtccgctcgctactcactgccaccagagccagccaagcctatcatctcgctgactcctgagccgggaaaggtgatcaccttgccaccagtacctgtgaaaccgaccgtccctctgcaggtgaagaaggagggtgggagctattacggccaggtggagggaggtagctcggagctcaatgcttttgcaccaaagccgttgtgggagatgatccctgggaagcgcaagaagcgtccgggatgtggcaatggcagttgcctgcgcatcgccatccatgctgcttctgtctgcgtggaggaggttggcggggcctgagggcccaagtacccgtaattactattgctagaagctttattgtctatttctatatcatcatcagaacctggtattgtataattttggttagtgttaaactgtcgatgcgaaaacatatggcgcaggatgcgatatgattgggtgatgctactctaatgtatatatggcgttctgttacattcgg

SEQ ID NO: 7792 - protein, 240 aa, Panicum virgatum
  misc_feature: Ceres CLONE 1955774
  misc_feature (4)..(63): Pfam Name: AP2 Pfam Description: AP2 domain
MGPNPSLQQLVAVAAVKASEPPPPPRARVVRILVHDADATDSSSSEDEAPPPPRRARGGSSSVGAKRRVMEAAGANSPVHFRGVRRRPWGRWAAEIRDPHSRRRLWLGTFNTAEEAAAAYDAANIRLRGASAPTNFPSARYSLPPEPAKPIISLTPEPGKVITLPPVPVKPTVPLQVKKEGGSYYGQVEGGSSELNAFAPKPLWEMIPGKRKKRPGCGNGSCLRIAIHAASVCVEEVGGA

SEQ ID NO: 7793 - DNA, 934 bp, Panicum virgatum
  misc_feature: Ceres CLONE 1955826
  misc_feature: Encodes the peptide sequence at SEQ ID NO. 7794
gatccacagccaccccacgcacagagacgcagcagcagcagcagggcactacgactctagctactcgtagcagctgctagctgcaggtaaccatggcgaagaagaaagccgccgtggtcgccacgctcctggccctgaacctcctcttcttcgccttcgccaacgcctgcggctgcaagtgcggcgcctgccctagtccaggcggcggcggaaggggaggaggaggcagtgggggtggtggatctggcagcggcggtggtggcagcggcagcggaggcgggggaggcagcggcagtggcggcggagggagcagcggcggaggaggaggcacaggcggcggcggcggaaggggaggaggaggaggaggcagtgggggtggtggatctggcggcgggggaggcagcggtggaggcggcagcggcagcggaggcgggggaggtagcggtggaggcacaggcggcggtggaggaggaagtagtcggtgtcccatcgacgccctcaagctgggcgtgtgcgccaacgtgctgagcgggctgatcaacgtgaccctggggacgccgccgcggacaccgtgctgcacgctgatccaggggctggcggacctggaggcggcggtgtgcctgtgcacggcgctgcgagccaacgtgctgggcatcaccctcaacctgcccatcaacctcagcctcctcgtcaactactgcgggaggcgcgtccccccgggcttccagtgcgcctgatgcatgcctgcccggccgcctgcagctgcagatccatcgacgttcaagcctagctagctcatgatactcctaatatatacatacatgcatgcatatatgtgcatgtgtgttcaataattcaccaagctatctcatctctcatatatctatagtagctaatgtaatttgtgcgttaatgaaagtgtactttattatcg

SEQ ID NO: 7794 - protein, 214 aa, Panicum virgatum
  misc_feature: Ceres CLONE 1955826
  misc_feature (1)..(83): Pfam Name: Tryp_alpha_amyl Pfam Description: Protease inhibitor/seed storage/LTP family
  misc_feature (37)..(108): SWISSPROT Homolog: EC 5.99.1.2 DNA topoisomerase 3-alpha
MAKKKAAVVATLLALNLLFFAFANACGCKCGACPSPGGGGRGGGGSGGGGSGSGGGGSGSGGGGGSGSGGGGSSGGGGGTGGGGGRGGGGGGSGGGGSGGGGGSGGGGSGSGGGGGSGGGTGGGGGGSSRCPIDALKLGVCANVLSGLINVTLGTPPRTPCCTLIQGLADLEAAVCLCTALRANVLGITLNLPINLSLLVNYCGRRVPPGFQCA

SEQ ID NO: 7795 - DNA, 772 bp, Panicum virgatum
  misc_feature: Ceres CLONE 1955834
  misc_feature: Encodes the peptide sequence at SEQ ID NO. 7796
aaccatcccaaacacaagctcagcctactcacaagctatagctgtagcaagcagctcatagaacgcttgaagctatagctagctaatagaaatggcaccatcaaagcttgccctgttcctcgccctgactgtcctcgccttcgcggcggctgtgcacggctgcacgccgtcctgtcctaccccaccagtggttcccagcccaccgccgccggttgtgccgacgccgtccggcggtggtggctcctgtccaatcaacgcactgaagctggaggtgtgcgccaatgtgttgaatctcctgaagctcaacatccctgtcacggggagcgaccagtgctgcccgctgctgcaggggctcgtcgaccttgacgccgcagtctgtctctgcactgctatcaaggccaacgtcctcggcatcaacatcaatgtgcccatcgacctgagcctcctcctcaaccactgtggcaagatctgccctgcagatttcacctgccccaattagctagcgaatgaaacattccacacgccatcttaatcttcagcttctatccactgccttgcctgcgttcttgtgcgcctatgccgtcggtctatgtgttggtttgcatcagcatgcacccatatatgtgttgatctcttctgttcgggttcgagtgagggctcaggacaggtgatggcatgcaaattgttgttctcgttcattcgaacaatatgttttgttttttgtctgtaacttcatcatacacgtgaaataaaagtttatacaagttgtgtc

SEQ ID NO: 7796 - protein, 135 aa, Panicum virgatum
  misc_feature: Ceres CLONE 1955834
  misc_feature (1)..(82): Pfam Name: Tryp_alpha_amyl Pfam Description: Protease inhibitor/seed storage/LTP family
MAPSKLALFLALTVLAFAAAVHGCTPSCPTPPVVPSPPPPVVPTPSGGGGSCPINALKLEVCANVLNLLKLNIPVTGSDQCCPLLQGLVDLDAAVCLCTAIKANVLGININVPIDLSLLLNHCGKICPADFTCPN

SEQ ID NO: 7797 - DNA, 719 bp, Panicum virgatum
  misc_feature: Ceres CLONE 1955845
  misc_feature: Encodes the peptide sequence at SEQ ID NO. 7798
ctcaatgactagtcaaacaaggcagaggcaggtagcctcgtcgtccggtgagagcccaccgccaacgaaccccaccatgcgggagcccccggcatggatggcggacggcgcccgcagatggctggaggacgccggcgccacggtggagggcggccccgaccgggccttcaacgcgctgccgctctccggcgtgcgcgtgtccctcgccgagcggggccgcgccgtctgctcgctccgcgtgccggcgcacctcaccgacgcggaggggaactggcacacgggcgccatcgccgcggcggcggacgacgtctgcgccgccgccatcatgtccgtcgagggcatcatcaaggtctccgtccactacgacatctcctacttcgcgccggccaagctccatgaggaagttgagttggatggcaaggtggtggagcataaagggaggatgacagcggtgacggtggagatccggaagaaggagtctggcgagctggtggcgatcgggaggcagtggatgacggcatccaggcccagagggagcaagatctgacgcctcatctatcatccctgcctggcccttaaacgggtgttgagttactaaactagcagttggtgagctcggctcaaggcaattgccgggtgagttaccgttacaaagattgattgctgttacacaggagatatgtctggtgactctctggcaattaagttggatttgtttc

SEQ ID NO: 7798 - protein, 180 aa, Panicum virgatum
  misc_feature: Ceres CLONE 1955845
  misc_feature (1)..(77): Pfam Name: 4HBT Pfam Description: Thioesterase superfamily
MTSQTRQRQVASSSGESPPPTNPTMREPPAWMADGARRWLEDAGATVEGGPDRAFNALPLSGVRVSLAERGRAVCSLRVPAHLTDAEGNWHTGAIAAAADDVCAAAIMSVEGIIKVSVHYDISYFAPAKLHEEVELDGKVVEHKGRMTAVTVEIRKKESGELVAIGRQWMTASRPRGSKI

SEQ ID NO: 7799 - DNA, 1114 bp, Panicum virgatum
  misc_feature: Ceres CLONE 1955854
  misc_feature: Encodes the peptide sequence at SEQ ID NO. 7800
agccacacacggcgccccgctttatgttgtccttgcccccccttgtcttcctccccaagaagcgaaatccaatctagaagctcccctcccctctcgctgccccccgacccgaacccgatctagctcgccgagatgggccgcaagttcttcgtcggtggcaactggaaatgcaacggaaccactgatcaggttgacaagattgtcaaaattctgaatgaaggacaggttccgccaacagatgttgttgaggtcgttgtcagccctccttatgtgttccttcctgtggtcaagagccagctgcgcccagagttccaagttgctgctcagaactgctgggtgaagaagggaggtgctttcactggtgaagtcagtgctgagatgctcgccaaccttggtgttccctgggtcatccttggacactcagaaaggagggctctgttgggagaatcaaatgagtttgttggagacaaagttgcctatgcactctctcagggactaaaggtcattgcttgtgttggtgagacccttgagcagagggaagctggatcaaccatggatgttgttgcggcacaaacaaaagccattgctgagaagatcaaggactggagcaacgtggttattgcctacgaaccagtctgggccattggaactggcaaagttgccaccccagatcaggctcaggaagtgcacgcatccctgagagattggctaaagatcaatgtcagccctgaggtcgccgattctaccaggatcatctacggaggctctgtgactggtgcaaactgcaaagagctggcggcaaagcccgatgttgatggtttcctggtcggtggtgcttctttgaagcctgagttcattgacatcatcaactcggccaccgtgaagtccgcctaagatgtcccaccccctcccaccccggacgtggagaatctgctagaggaacagacttgttacccatgctatgtacgctagtaattttgcgctggagcatatactgctttccctcatcctcagctctgaggctgcagcttgatcttgctaataatgttaactctgaacataccaataatgttttttggttagcccctttttttgtgatgaggcacattgcact

SEQ ID NO: 7800 - protein, 253 aa, Panicum virgatum
  misc_feature: Ceres CLONE 1955854
  misc_feature (1)..(241): Pfam Name: TIM Pfam Description: Triosephosphate isomerase
  misc_feature (1)..(253): SWISSPROT Homolog: EC 5.3.1.1 Triosephosphate isomerase, cytosolic
MGRKFFVGGNWKCNGTTDQVDKIVKILNEGQVPPTDVVEVVVSPPYVFLPVVKSQLRPEFQVAAQNCWVKKGGAFTGEVSAEMLANLGVPWVILGHSERRALLGESNEFVGDKVAYALSQGLKVIACVGETLEQREAGSTMDVVAAQTKAIAEKIKDWSNVVIAYEPVWAIGTGKVATPDQAQEVHASLRDWLKINVSPEVADSTRIIYGGSVTGANCKELAAKPDVDGFLVGGASLKPEFIDIINSATVKSA

SEQ ID NO: 7801 - DNA, 798 bp, Panicum virgatum
  misc_feature: Ceres CLONE 1955860
  misc_feature: Encodes the peptide sequence at SEQ ID NO. 7802
tctcgccgcatcagttcagctttcgatccaatcgacggccccactgccctcgtcttctcggcgttctcgcttccgtctccggcgtcgagccccctccggccacctgtcaaactcggcggctgtgcaaggaagagcagcaccgggaaggaattcttcaggattggaggtgccgccggtgtccgcacctctgctgggccggcgtcaagcggagatcgaatcgggaaccgaactgaccccgtctttcgtcgaacttgcatcaggagaagcaatgtcaggagtgatcacaaagttcgcggttacatccatggtgatgtggatggccccggtcgcgatcatgtatgggttctactaccaggtgtttccaggtgtgagtcagatgtcatcctcagcgcagacactcgccagtgggttccttgccgtcatatcagttaatctggtgatcggcttctacatatgcatggcgatgaaggagactccacaccaggagccgcagcctgatcccaccttcttggcagatgctaaagcgagtatcaaccagccaacatattctcaagtgaatgatgattccaagggaaaggggaaggttgagtaagctgtagcattttggcttgggtcttgtgtatgctatacgcatgtcactcaggaggaatagttgtgctatgccatcacacaatgccgtaaccttttaaatttcttaatttgctgtaaatcttgatggttatggttatggaaccatatgaagatgaatctcatgtatctgtttacgatggaaactatgttcgatgggttattttggtt

SEQ ID NO: 7802 - protein, 107 aa, Panicum virgatum
  misc_feature: Ceres CLONE 1955860
  misc_feature: Great-hit functional homolog of the protein sequence given in SEQ ID NO 9673
  misc_feature: Useful for biocontainment applications
  misc_feature: The plant produces a reduced number of seeds.
MSGVITKFAVTSMVMWMAPVAIMYGFYYQVFPGVSQMSSSAQTLASGFLAVISVNLVIGFYICMAMKETPHQEPQPDPTFLADAKASINQPTYSQVNDDSKGKGKVE

SEQ ID NO: 7803 - DNA, 1116 bp, Panicum virgatum
  misc_feature: Ceres CLONE 1955864
  misc_feature: Encodes the peptide sequence at SEQ ID NO. 7804
atccaaccacccacatccattcctccctcgtcctgctcggctgctggccttactcctctgctccggctctgctcagggaattgatacagtgaagtgaaggcaatcagattttatgatggagttaaaagctgggatttttaccgtggccatgctagccattgtgctctcctcaccaacaactgctcaaaagagtcctcctgctccagcgactccagtccttccaccggctccagcaccggcaccggcgccacaccatgtggacctcgctgatctcctcagtgtggccggcccattccacaccttcctggagtacctgcaaaagaccaatgtcattgagaccttccaaaaccaggcgaacaacaccaaggagggcatcaccatctttgttcccaaggactcagcgttcgccgcactgaagaagaccacatttgccaacctcacccaagaccagctcaagtccctgctcctgtaccatgcactccccaagtactactctctggctgagttcaacaagctgagcaccctcaacccggtggccaccttcgctggttcacaatacactctgaacctcacttacgacatgggcaccatccaagtgaagtcgatgtggtccaacccaaagatcagcagcagtgtctactcaacccgcccggttgcggtgtacgaggtcaacaaggttctcctgccaatgcagatcttcaagagcgaccccccgctcgctccagcccctgctcctgccccagatgccaaggcctctgatgtcgctcccaacccaacctcagggaaagcagcgagcggaaaggcgaaggcagacgagaagaattcatcataccaagtcggtgtcagcatcattacttacttggcccttgctgtctcgggtggcttgatgctcttctggtgagaattgaaaagttcctgaccatgttaaagcacagggttcagcttagcttccccgtgcttaatgtcatatggattttctggattcattcttttggacatattgtaggcattgtgttaggattgagttgttgagtgtttgcaccatatgcttctatgattactccccattgattctctggcttaatgcgtgtatggagaaagtatttcatacttgcc

SEQ ID NO: 7804 - protein, 262 aa, Panicum virgatum
  misc_feature: Ceres CLONE 1955864
  misc_feature: Great-hit functional homolog of the protein sequence given in SEQ ID NO 9209
  misc_feature: Useful for making plants with altered Lignin content
  misc_feature: Useful for making plants with altered cell wall content and/or composition
MMELKAGIFTVAMLAIVLSSPTTAQKSPPAPATPVLPPAPAPAPAPHHVDLADLLSVAGPFHTFLEYLQKTNVIETFQNQANNTKEGITIFVPKDSAFAALKKTTFANLTQDQLKSLLLYHALPKYYSLAEFNKLSTLNPVATFAGSQYTLNLTYDMGTIQVKSMWSNPKISSSVYSTRPVAVYEVNKVLLPMQIFKSDPPLAPAPAPAPDAKASDVAPNPTSGKAASGKAKADEKNSSYQVGVSIITYLALAVSGGLMLFW

SEQ ID NO: 7805 - DNA, 776 bp, Panicum virgatum
  misc_feature: Ceres CLONE 1955865
  misc_feature: Encodes the peptide sequence at SEQ ID NO. 7806
ggcctctgtgtcttccccctttcccttctctccgactcctccccttggtcttccttcctggcggcggcgactgggcgagcggcggcgctactcgtcacgtcttcgcccagccctttgccggcgacgagcatccaccaggggaaatggttgagtacctcttggacgataacttcagtgtgagcaggctcgatcctgatggcaagaagtttgacagagtcactcgcatcgaagctcataatgagcagatgcacatgcaactagatattgctactgagatttacccgatgcgtgtcggtgacaagttcaacatggtgttagctcctactctgaatctggatggaacaccagacactggctactacacacaggctggaaggaaaacacttgctgacaagtttgactatgtcatgcatggaaagctttacaagatctcagaagacagttccaccagctcatctactaaagtggagatctatgcctcttttggtggcctcctgatgctgcttaggtgtgatagttccagtgcagctagcttccagctggatcagaggctgtttcttcttatcagaaaggtgtaaacgtattggctactcgaaaggctggttaccttgttgactgtactcaacttccaccctatatgtactatcagtgggctttcaattggtagaaacaacttctaccatgtagtgatgtaatctcgctacaactgagcacgtgaagtgcttcattggcggataatactatggctgttctatcttctggtttattacactgcg

SEQ ID NO: 7806 - protein, 144 aa, Panicum virgatum
  misc_feature: Ceres CLONE 1955865
  misc_feature (1)..(139): Pfam Name: RNA_pol_Rpb8 Pfam Description: RNA polymerase Rpb8
MVEYLLDDNFSVSRLDPDGKKFDRVTRIEAHNEQMHMQLDIATEIYPMRVGDKFNMVLAPTLNLDGTPDTGYYTQAGRKTLADKFDYVMHGKLYKISEDSSTSSSTKVEIYASFGGLLMLLRCDSSSAASFQLDQRLFLLIRKV

SEQ ID NO: 7807 - DNA, 897 bp, Panicum virgatum
  misc_feature: Ceres CLONE 1955894
  misc_feature: Encodes the peptide sequence at SEQ ID NO. 7808
aaaacacacaatcccacaacaaagactctcatcagtgaccaggacgtcttcagttcttcactgatcagtgtcaactgacttgttgccacgatggttgtcggcaaagtcacactggagtacccggtggccgtgtcagtcgagctgctgtggaaggtggccttctccggtgacgtgtccatcttcaccaaggcctgcgttggcatgattgatgccatcgaggtcgacggtgatggcgggcccgggagcgtcaccaccatgaagctcaaccctgccgtgagcgacgcgaaggtgttcaagacccggctcctgtcgcgcgatgcggcggcgcgcgtggtgaagtcggagatggtggtggagggcgaactggccggaaagttcaagtcacaggtgtccgaggtgaaggtggtgccggccggcgacggtgccagcgtggcgcacatgacggtggtttacgagcgggtggacggcacgctgctgccgccggaggaggaggccaggatcgggcagggctacctcggcctcatcaagaaggtggaggagtacctcgtcgcgcaccctagcgagttcgcctaaagctaccatgagcatcgcccgtgttaaataaattaaatgatggttatcgtgctgtgtgttttttatttcaaaatcggaataatgagaggaagtgatcctctgcttggtccggtgattgtgcttgtggggaaacaacagtttcagtttttgtaccaacagtttatattctacagtacggtctttattattatttttttgcctcgtgtcacctgctccaaagtcgataccagtgtctgtcttcctccagttgcaatgattggtgagaactggccatggaaattgttgaagccaaccataataatgcaattagatatattagattgc

SEQ ID NO: 7808 - protein, 160 aa, Panicum virgatum
  misc_feature: Ceres CLONE 1955894
  misc_feature (1)..(161): Pfam Name: Bet_v_I Pfam Description: Pathogenesis-related protein Bet v I family
MVVGKVTLEYPVAVSVELLWKVAFSGDVSIFTKACVGMIDAIEVDGDGGPGSVTTMKLNPAVSDAKVFKTRLLSRDAAARVVKSEMVVEGELAGKFKSQVSEVKVVPAGDGASVAHMTVVYERVDGTLLPPEEEARIGQGYLGLIKKVEEYLVAHPSEFA

SEQ ID NO: 7809 - DNA, 992 bp, Panicum virgatum
  misc_feature: Ceres CLONE 1955907
  misc_feature: Encodes the peptide sequence at SEQ ID NO. 7810
atatctcattgttatccaagcccagagctgcggcctcctcctcctcctaaaacctctccatcaatggcggccgccacctccttcgcgaccctcgccatcgcgcgtccggcggggcagcgggcgctcctcgcctacaaggccccctcgccgctcatctacttcagcggcgcccgccttccctcccaggcgctctccttctccggggccttcgcgtcgtcgccctccgacacccgtactcgcttcgttacctccgccagcgcggagcccaaggaagcagaacttcagtccaaaatcacaaacaaggtgtactttgacataagcattggaaatcccgtggggaagaatgttgggagaatcgtcatcggcttatacggggaagatgttccccagacagccgagaacttccgtgctctctgcactggagagaaagggtttgggtacaagggatccagtttccatcgtgtcattaaggacttcatgatccagggaggagactttgacaagggcaatggtacaggtggaaaaagcatatatggccgcaccttcaaagatgaaaacttcaaattggttcatgttggacctggagtggtcagcatggccaatgctgggccaaacaccaacggtagccaatttttcatttgcactgtcaagacacaatggttggatggaagacatgttgtgtttggccaggttctggaaggcatggacgtcgtaaggatgattgagtcgcaggagactgacagaggggatcgtccgaagaagaaagtagtcatcagcgaatgtggggagcttccggtggtctaggtgttctaggattgccatctaatctcagacggatgtcgatatttctccctgctcatttcactgaggggagttgtacgatactgtgaacttatcggtgcttttctcctctagctagagattattctgagctaaagctacgatctgaggcatatcgctgttgcttgactggaataaatgttgttctttcc

SEQ ID NO: 7810 - protein, 246 aa, Panicum virgatum
  misc_feature: Ceres CLONE 1955907
  misc_feature (1)..(164): Pfam Name: Pro_isomerase Pfam Description: Cyclophilin type peptidyl- prolyl cis-trans isomerase/CLD
  misc_feature (45)..(245): SWISSPROT Homolog: EC 5.2.1.8 Peptidyl-prolyl cis-trans isomerase CYP20-3, chloroplast precursor
  misc_feature (60)..(245): SWISSPROT Homolog: EC 5.2.1.8 Peptidyl-prolyl cis-trans isomerase CYP20-2, chloroplast precursor
MAAATSFATLAIARPAGQRALLAYKAPSPLIYFSGARLPSQALSFSGAFASSPSDTRTRFVTSASAEPKEAELQSKITNKVYFDISIGNPVGKNVGRIVIGLYGEDVPQTAENFRALCTGEKGFGYKGSSFHRVIKDFMIQGGDFDKGNGTGGKSIYGRTFKDENFKLVHVGPGVVSMANAGPNTNGSQFFICTVKTQWLDGRHVVFGQVLEGMDVVRMIESQETDRGDRPKKKVVISECGELPVV

SEQ ID NO: 7811 - DNA, 1034 bp, Panicum virgatum
  misc_feature: Ceres CLONE 1955961
  misc_feature: Encodes the peptide sequence at SEQ ID NO. 7812
ctctccatctctagggtttgggattttagccgccgccgccgctcctcacctccttgagaagtcgcagccgacgtagtcctcgccggatccgatggccgtgactttctctgagcttcacaccgccgacggcctcaaggccctcgaggcgcacctcgccggcaagacctacgtctccggggatgccatcagcaaggacgacattaaggtgtttgcggcggtgccgtcgaagcctggtgccgagttccccaatgctgcccggtggtacgagaccgtcgccgcggctgttgcctccagattccctggcaagggtgttggtgtgaatctgcctggagccggatcggctcctgcagcagcagctcctgcggctgaggttgccaaggatgatgatgatgatgatgacgacttggatcttttcggtgatgaaactgaggaggacaagaaggctgcagatgagcgtgcggctgccaaggcctctgccaagaagaaagaaagtggcaagtcctctgtcctgatggacgtgaagccgtgggacgatgaaactgacatgaagaagcttgaggaggctgttcgcagtgtccagatggagggtctcacttggggagcttcaaagcttgtgcctgttggttatggtatcaagaagatgacaatcatgttgaccattgtggacgacctcgtgtcagttgacagtctgattgaggaccacctcacggaggcacccatcaacgagtatgtccagagctgtgacattgttgccttcaacaagatctagaatcccaattgttgggcactaaatctgctgctggggtcttggaactggattggttgtgatggaaagcgctcaagtttcctgtgggatgcgagctcttaccccttttagtaactctgctatagaaatggtcggtccgagtctattgttaagtgctgcctggtttttgaatgtctgtttatcttgaatagttgaactgctgggcagtgaaacatgtgctgtgtctaaagtacaccagttttctttgcaatgctagttttgaatgcgg

SEQ ID NO: 7812 - protein, 225 aa, Panicum virgatum
  misc_feature: Ceres CLONE 1955961
  misc_feature (1)..(50): Pfam Name: GST_C Pfam Description: Glutathione S-transferase, C-terminal domain
MAVTFSELHTADGLKALEAHLAGKTYVSGDAISKDDIKVFAAVPSKPGAEFPNAARWYETVAAAVASRFPGKGVGVNLPGAGSAPAAAAPAAEVAKDDDDDDDDLDLFGDETEEDKKAADERAAAKASAKKKESGKSSVLMDVKPWDDETDMKKLEEAVRSVQMEGLTWGASKLVPVGYGIKKMTIMLTIVDDLVSVDSLIEDHLTEAPINEYVQSCDIVAFNKI

SEQ ID NO: 7813 - DNA, 856 bp, Panicum virgatum
  misc_feature: Ceres CLONE 1956032
  misc_feature: Encodes the peptide sequence at SEQ ID NO. 7814
acgcagccatcggatttctttcttcttccccacccaaacaaaccctcgctcgattgcagccatggccaacccgcgcgtgttcttcgacatgaccatcggcggcgcccccgcggggcgcatcgtgatggagctgtacgcgaacgaggtgccccgcacggcggagaacttccgcgcgctgtgcacgggcgagaagggcgtgggcaagaaggggaagccgctccactacaagggctccgtcttccaccgcgtcatccccgacttcatgtgccagggcggcgacttcaccgacggcaacggcaccggcggcgagtccatctacggcgccaagttcgccgacgagaagttcgtgcgcaagcacacgggccccggggttctctccatggccaacgccgggcccaacaccaacggctcccagttcttcgtctgcaccgtgccctgcccctggctcgacggcaagcacgtcgtcttcggccaggtcgtcgaggggctcgacgtcgtcaaggccatcgagaaggtcggctcccgcagcggctccaccgccaaggtggtcaagatcgccgactgcggccagatcgcctagatggatctgctccctccctccatccgccgccgtccgtcgtccccttccgttctccgcttcccgccccccccctccgcgctgaataagatgacggtgatctgagaggtgcttcttctgaattgagtcgtgtcgtgtcgtcctttgtcgtgtgctgtgctggtggtgttctagggttttaggcggtggatctgcgaatccgatgggtgattgatggatggtgtctctgcttgttgtggtatggtgaattgatgatgatgatgctatgatgggaaactc

SEQ ID NO: 7814 - protein, 172 aa, Panicum virgatum
  misc_feature: Ceres CLONE 1956032
  misc_feature (1)..(167): Pfam Name: Pro_isomerase Pfam Description: Cyclophilin type peptidyl- prolyl cis-trans isomerase/CLD
  misc_feature (1)..(172): SWISSPROT Homolog: EC 5.2.1.8 Peptidyl-prolyl cis-trans isomerase
MANPRVFFDMTIGGAPAGRIVMELYANEVPRTAENFRALCTGEKGVGKKGKPLHYKGSVFHRVIPDFMCQGGDFTDGNGTGGESIYGAKFADEKFVRKHTGPGVLSMANAGPNTNGSQFFVCTVPCPWLDGKHVVFGQVVEGLDVVKAIEKVGSRSGSTAKVVKIADCGQIA

SEQ ID NO: 7815 - DNA, 747 bp, Panicum virgatum
  misc_feature: Ceres CLONE 1956073
  misc_feature: Encodes the peptide sequence at SEQ ID NO. 7816
agagcaagcgaccgcagcactgcagcagcagctgtagcttgtacgtgcacaagcagctcgcccggtcgcgatggcagctagagcggcgctcctcctggctgtgagcctggtcctggccgccgtggcgaacgcgaccaactgtccgcccccgccggccccgacgccgccgacgccgacgccaccgacgccgacgcccagcggcggccaccactgccccagggacgcgctgaagctgggcgtgtgcgccaacgtgctgggcctcgtcaaggccaaaatcggctcgccgccgtacctgccctgctgctcgctgctggacgggctcgtcgacctggaggccgccatctgcctctgcaccgccatcaaggccaacatcctcggcatcaacctcaacctccccatcgacctcagcctcatcctcaacaactgcggcaagagttgccccaacgacttccactgcgcatagatcgtccactgatcgatcgtcctcgctcctccatcgccggcggccgcggtcgtccattctgtcattgcgtggcgagatgatgatgctttgcttgctctgtggctgatcatcttgctgtcagttcgagcttgtttgtttttattcgttttgtgatacaaattgatgagtggttgcacgttacatgtgtttgcctgggtgagggtgatcagttaattactgatcatgttattcctgatctgtttctatggtttgtcccgtaaatgaagttgtaatttctttctgat

SEQ ID NO: 7816 - protein, 130 aa, Panicum virgatum
  misc_feature: Ceres CLONE 1956073
  misc_feature (1)..(83): Pfam Name: Tryp_alpha_amyl Pfam Description: Protease inhibitor/seed storage/LTP family
MAARAALLLAVSLVLAAVANATNCPPPPAPTPPTPTPPTPTPSGGHHCPRDALKLGVCANVLGLVKAKIGSPPYLPCCSLLDGLVDLEAAICLCTAIKANILGINLNLPIDLSLILNNCGKSCPNDFHCA

SEQ ID NO: 7817 - DNA, 948 bp, Panicum virgatum
  misc_feature: Ceres CLONE 1956100
  misc_feature: Encodes the peptide sequence at SEQ ID NO. 7818
acgcgctccgccgcaccggtattattaatcacggccccgatccctccccgatgccccctcgccccgccccactcctctcccgcctctgcgctgccgccgtcaccacccgtccctcctccgcggcgccgctgcgctgcggccgccacgctcgcctcgcgagccccttcgctctgcccccgccctgcccgcgcttcccccgctccgccgcggtctcgccgctcgtgctgcgcccgatcgccggcgggttcgcgttgttcagcatggccgccgccgcctcctccgccagctccgtgcacgacttcaccgtcaaggatgctagcgggaaagaggtggacctgagcacctacaaggggaaggtgctgctcatcgtaaatgttgcatcccagtgtggcttgaccaattccaactacacagagctgagccagctgtatgagaaatacaaggaccagggtttcgagatccttgctttcccatgcaaccagtttggtggccaggaacctgggactaatgaggagattgtccagtttgcttgtactcgcttcaaggctgagtatccaatttttgacaaggttgatgttaatggtgacaacactgcacccatctacaagttcctgaagtccagcaaaggcagcctctttggcgagaacatcaagtggaacttctccaagttccttgtcgacaaagaggggcgtgttgtggagcggtatgcaccaaccacatccccactcagcatcgagaaggacatcaagaagctacttgggagttcttcaaccttgtaactgggaccagtagctgcagtgctgcattgcatcgagcacctgatgcctcagggatgttgtaataaagctgtcctttgaactgagatgtttttactgtatttcctctgcacgccctgtcgtgtggtaaatgccatctaataaatttgatgcaatgcctgatttctcttgc

SEQ ID NO: 7818 - protein, 242 aa, Panicum virgatum
  misc_feature: Ceres CLONE 1956100
  misc_feature (1)..(109): Pfam Name: GSHPx Pfam Description: Glutathione peroxidase
  misc_feature (61)..(238): SWISSPROT Homolog: EC 1.11.1.12 Phospholipid hydroperoxide glutathione peroxidase 1, chloroplast precursor
  misc_feature (69)..(238): SWISSPROT Homolog: EC 1.11.1.12 Phospholipid hydroperoxide glutathione peroxidase, chloroplast precursor
MPPRPAPLLSRLCAAAVTTRPSSAAPLRCGRHARLASPFALPPPCPRFPRSAAVSPLVLRPIAGGFALFSMAAAASSASSVHDFTVKDASGKEVDLSTYKGKVLLIVNVASQCGLTNSNYTELSQLYEKYKDQGFEILAFPCNQFGGQEPGTNEEIVQFACTRFKAEYPIFDKVDVNGDNTAPIYKFLKSSKGSLFGENIKWNFSKFLVDKEGRVVERYAPTTSPLSIEKDIKKLLGSSSTL

SEQ ID NO: 7819 - DNA, 650 bp, Panicum virgatum
  misc_feature: Ceres CLONE 1956138
  misc_feature: Encodes the peptide sequence at SEQ ID NO. 7820
acgcagagcaagcgagcgcagcacaagcagtcaagcagtagcagcagcagctgtagcttgtacgtgcacaaggagctcgctcggtcgcgatggcagctagagcggcgctcctcctggccgtgagcgtggtcctggccgccgtggcgagcgcgaccaactgcccgccgccgccggccccgacgccgccgacgccgacgccgacgcccagcggcggcggccaccactgccccagggacgcgctgaagctgggcgtgtgcgccaacgtgctgggcctcgtcaaggccaagatcggctcgccgccgtacctgccctgctgctcgctgctggacgggctcgtggacctggaggccgccgtctgcctctgcaccgccatcaaggccaacatcctcggcatcaacctcaacctccccatcgacctcagcctcatcctcaacaactgcggcaagagctgccccaacgacttccactgcgcatagatcgcccactgatcgaccgtcctcgctcctccatcgccggcggccgcggtcgtccatcattccattctgtcattccgtggcggctctgtggttgatctcatcatcaactcgctgtcagttcgagcttgtttgtttttattcgtttcgttatacaaattaatgagtggttttttc

SEQ ID NO: 7820 - protein, 128 aa, Panicum virgatum
  misc_feature: Ceres CLONE 1956138
  misc_feature (1)..(83): Pfam Name: Tryp_alpha_amyl Pfam Description: Protease inhibitor/seed storage/LTP family
MAARAALLLAVSVVLAAVASATNCPPPPAPTPPTPTPTPSGGGHHCPRDALKLGVCANVLGLVKAKIGSPPYLPCCSLLDGLVDLEAAVCLCTAIKANILGINLNLPIDLSLILNNCGKSCPNDFHCA

SEQ ID NO: 7821 - DNA, 837 bp, Panicum virgatum
  misc_feature: Ceres CLONE 1956196
  misc_feature: Encodes the peptide sequence at SEQ ID NO. 7822
cttcttcgttcctcccactcgccgccgccgcctcccgagccccaggcgctccagctcccggagctcgcccgccccccctgcccaccatgatcatccccaagaagaaccgcaatgagatctgcaagtacctcttcaaagagggcgtgctgtacgccaagaaggactacaacctggcgaagcacccgcagattgacgtgcccaacctgcaggtgatcaagctcatgcagagcttcaagtccaaggagtacgtcagggagaccttctcctggcagtactactactggtacctcaccaacgatggcattgagcacctccgcaactacctcaacctgccatctgagatcgtgcctgccacgctcaagaagtctgccaggccgcctggccgcccgtttggctctggtcctcctggtgaccgcccaaggggcccacctcgctttgaaggggacaggccaaggtttggcgacagggaagggtaccgtggtggtcctcgtggtgctcctggtgactttggtggtgagaagggtggagctcctgctgagttccagccatctttcaggagttctggtagcagacctggcttcggccgtggtggtgccagcggctttggcgctggcccgacctcttcttccatggagtgaagttgcccctagtttggacatggtgttttccttcgcatgaggcgtttaattttgaaggacagttattatgtactagtattgttatccggatcggcagagtgctgacatatgcagaaaattgtgctatcttgataccgtggttccagtataatagtcttgtgcaaacgcttcggaatcatgtcgttacttgttcgaaagc

SEQ ID NO: 7822 - protein, 183 aa, Panicum virgatum
  misc_feature: Ceres CLONE 1956196
  misc_feature: Great-hit functional homolog of the protein sequence given in SEQ ID NO 9569
  misc_feature: Useful for making plants with modulated nitrogen use efficiency
MIIPKKNRNEICKYLFKEGVLYAKKDYNLAKHPQIDVPNLQVIKLMQSFKSKEYVRETFSWQYYYWYLTNDGIEHLRNYLNLPSEIVPATLKKSARPPGRPFGSGPPGDRPRGPPRFEGDRPRFGDREGYRGGPRGAPGDFGGEKGGAPAEFQPSFRSSGSRPGFGRGGASGFGAGPTSSSME

SEQ ID NO: 7823 - DNA, 1006 bp, Panicum virgatum
  misc_feature: Ceres CLONE 1956222
  misc_feature: Encodes the peptide sequence at SEQ ID NO. 7824
gagagagaggaataaaaaggagaggggcgagccggcgagagagcgctagaggccaaacagctcgagagcttctccgcgaaaccccacccctagcgccgccccttcccctccccgggcatcctccccgcgctccgatccaagatgtataagctggggagaggaaaccgcgacaaggtgcagcagttcatgaccataaccggcgccagtgagaaggttgcccttcaggcactgaaagctagtgattggcacttggaaggtgctttcgacttcttctatagccaacctcagatttctgcagtcaatgctcggcatcttgaagaaattttcaatagatacaaagaacctgatgctgatatgatcatggtggagggagtatctcaactttgcaatgatctgcaggtggatcctcaggatattgtcatgcttgtcatatcatggcacatgaaagccgccacaatgtgtgaatttactcgccaggaattcattggtggactgcagtctattggggtagattcaattgagaaatttcgtgcaaagttaccatcattacgagctgaactaaaagatgacaataagttccgtgagatatacaacttcgcgttcacttgggcaagagaaaagggtcaaaagtctctttcactggagactgctattgggatgtggcagttgctatttgctgacaggaactggcctcttctggatcattggtgccagtttttacaggtcaggcacaataaagccatatctagagacacgtgggcacaactgctggaatttgtaaagtcgattgatccacagctatccaactatgacgacgaaggtgcttggccctacctcatagatgaatttgtggaatacctgactgagaatgggttggttcagcgcaaaaagtgaactgcaacggggaggcctcgttcctcaccgaacaatggttgggctgtacaaacacaattcatctcggtgtatacgatgcccaggacccgacgttggcactcctgctcaatcc

SEQ ID NO: 7824 - protein, 250 aa, Panicum virgatum
  misc_feature: Ceres CLONE 1956222
  misc_feature: Great-hit functional homolog of the protein sequence given in SEQ ID NO 9585
  misc_feature: Useful for making plants with altered Lignin content
MYKLGRGNRDKVQQFMTITGASEKVALQALKASDWHLEGAFDFFYSQPQISAVNARHLEEIFNRYKEPDADMIMVEGVSQLCNDLQVDPQDIVMLVISWHMKAATMCEFTRQEFIGGLQSIGVDSIEKFRAKLPSLRAELKDDNKFREIYNFAFTWAREKGQKSLSLETAIGMWQLLFADRNWPLLDHWCQFLQVRHNKAISRDTWAQLLEFVKSIDPQLSNYDDEGAWPYLIDEFVEYLTENGLVQRKK

SEQ ID NO: 7825 - DNA, 854 bp, Panicum virgatum
  misc_feature: Ceres CLONE 1956268
  misc_feature: Encodes the peptide sequence at SEQ ID NO. 7826
aaccctagaacccgcccctcatcctccgccgccgccgcagccgcaggccgctcgccgctcgccgctcgcgccatgggtatcgacctcgccgccggcggccggaataagaagaccaagcgcaccgctcccaagtccgacgatgtctacctcaagctcctcgtcaagctgtaccgcttcctggttcgcaggaccaagagcaacttcaacgccgtgatcctgaagcgtctcttcatgagcaagaccaaccaaccgccgctctcgctccgccgcctcgtcaagttcatggagggcaaggagaaccagattgctgtgatcgtgggcaccgtgaccgacgacaagagggtctacgaggtgccggcgatgaaggtggctgcgctcaggttcactgagacggcgagggcccggatcgtgaatgctggcggcgagtgcctcacctttgaccacctggcgctccgtgcgcctctgggccagaacacggttctgctgaggggacctaagaatgctagggaagctgtgaaacactttggcccagcgcctggtgtgcctcacagccacaccaagccatatgtccgctctaagggaaggaagtttgagaaggcaagaggaaggaggaacagcagaggcttcaaggtttaagttgccgtgtcttatccatgtggtctcacctagtgggctaaataggtcttgcttgagcctgagttctatgttaatgttattacctcagttcaagtcttttgagggctatgttatttgtataccagttccaggatctgctcaattttgtcctgaatctgcgttttgtattggaatttgcaagtgtcttttggcagcattatgcactagttgctaagtac

SEQ ID NO: 7826 - protein, 187 aa, Panicum virgatum
  misc_feature: Ceres CLONE 1956268
  misc_feature: Great-hit functional homolog of the protein sequence given in SEQ ID NO 9458
  misc_feature: Useful for making plants with modulated nitrogen use efficiency
MGIDLAAGGRNKKTKRTAPKSDDVYLKLLVKLYRFLVRRTKSNFNAVILKRLFMSKTNQPPLSLRRLVKFMEGKENQIAVIVGTVTDDKRVYEVPAMKVAALRFTETARARIVNAGGECLTFDHLALRAPLGQNTVLLRGPKNAREAVKHFGPAPGVPHSHTKPYVRSKGRKFEKARGRRNSRGFKV

SEQ ID NO: 7827 - DNA, 654 bp, Panicum virgatum
  misc_feature: Ceres CLONE 1956288
  misc_feature: Encodes the peptide sequence at SEQ ID NO. 7828
acttgaagctctagctagctaatagaaatggcgccatcaaagcttgccatgttcctcgccctgactgtcctcgccttcgcggcggctgtgcacggctgcacgccgtcctgtcctaccccaccagtggttcccagcccaccgccgccggttgtgccgacgccgtctggcggtggtggctcctgcccaatcaacgcactgaagctggaggtgtgcgccaatgtgttgaacctcctgaagctcaacatccctgtcacggggagcgaccagtgctgcccgctgctgcaggggctcgtcgaccttgacgccgcagtctgtctctgccttgctatcaaggccaacgtcctcggcatcaacatcaatgtgcccatcgacctgagcctcctcctcaacaactgtggcaagatctgccctgcagatttcacctgccccaattagcatccatcatctgaatcttcatccactgccttgcctgcgatcttgtgcacctatgccgtcggtctatgtgttggtttgcatcagcatgcacccatatatgtgttgttctcttctgttcgggttccaatgatggcatgcaaattgttgttctcgttcgttcgaacaatatgttatgtttgtctgtaacttcattatatacgtgaaataaaagtttatacg

SEQ ID NO: 7828 - protein, 135 aa, Panicum virgatum
  misc_feature: Ceres CLONE 1956288
  misc_feature (1)..(82): Pfam Name: Tryp_alpha_amyl Pfam Description: Protease inhibitor/seed storage/LTP family
MAPSKLAMFLALTVLAFAAAVHGCTPSCPTPPVVPSPPPPVVPTPSGGGGSCPINALKLEVCANVLNLLKLNIPVTGSDQCCPLLQGLVDLDAAVCLCLAIKANVLGININVPIDLSLLLNNCGKICPADFTCPN

SEQ ID NO: 7829 - DNA, 668 bp, Panicum virgatum
  misc_feature: Ceres CLONE 1956325
  misc_feature: Encodes the peptide sequence at SEQ ID NO. 7830
ctttttcgaggacacctcacagcgacgccgcctcccgccgccgaactcgcctacggctccgcccgcgccggcagcgccttcgcctcgtcccctctctgcttcagcaccaggcaagagcaaccatggagcacgggtcgctggaggattcgagtgcatcgacgttctccatcatggaggaggaccacaccctcgccaactccgtcagattcgttctcaaccaggaccaaagggtggcattttgtggatacagcatccctcatccttctgaaaacaaagttaacataaggcttcagactacaggagatccagccaaggatgttctgaaagattcgttgcaggacctgatggtaatgtgccagcatataagggggacgtttgatactgcagtggctgatttccgggggagcaaaccagcagacgccatggacattgatttgaacaaaaagtagaaggttcttgatgattgttagccaggtggcagaaatgcacagatgtttaatgtgcaactgaattataaactactctagttatatgggatgtagtccttaaacccaaagtgtgaaatgtcattggcattagggttcttgacagtgtgacttcagatttctttgccaatatatggcacccgatcttgtttggagaaaaaattaatcaaatgcaatgaccat

SEQ ID NO: 7830 - protein, 108 aa, Panicum virgatum
  misc_feature: Ceres CLONE 1956325
  misc_feature (1)..(74): Pfam Name: RNA_pol_L Pfam Description: RNA polymerase Rpb3/Rpb11 dimerisation domain
  misc_feature (7)..(85): SWISSPROT Homolog: EC 2.7.7.6 DNA-directed RNA polymerases I and III 16 kDa polypeptide
MEHGSLEDSSASTFSIMEEDHTLANSVRFVLNQDQRVAFCGYSIPHPSENKVNIRLQTTGDPAKDVLKDSLQDLMVMCQHIRGTFDTAVADFRGSKPADAMDIDLNKK

SEQ ID NO: 7831 - DNA, 1659 bp, Panicum virgatum
  misc_feature: Ceres CLONE 1956928
  misc_feature: Encodes the peptide sequence at SEQ ID NO. 7832
ctccagctgacctcctttccccttcctctctccgcaagtcccctccaccacacgcgttccccaaattctcaccccaaattcgccgcgtcggcttcgaattcgatcccatccccgcgtctacctgttctgatcgccggatcgggggtaccagccaccggccatgtgggcggcttcgtgcctggcgtcgtgctgcgccgcgtgcgcatgcgaggcgtgccggacggcggtgggcagcatcggccgccgctccgcgcgcatcgcctactgcggcctcttcgcgctctcgctcttcgcctcctgggcgctccgggaggtcgcggcgccgctcctccagtccatcccatggattaaccacttccacaagacgccggaccgcgagtggttcgagaccgatgccgtgctcagggtcagtctcggcaacttcctcttcttcaccattctcgccgtcatcatggccgggataaaggaccagaaggacccccgcgacaagatccaccacggaggatggatggccaagatcttctgctgggtcgtcatcgtcttcctcatgttcttcgtgcccaacggtgtcgtcagcttctacgaatcgatatccaagtttggatcagggctgttccttctcgtccaggttgttcttctgttggactttgtgcatggatggaacgagaactgggtcgccaaggatgaacagttctggtacatggcattgttggttgtctcagttgtttgttacattgccacattctctttctcgggccttttgttccactggttcaccccgtcaggacatgactgtggactcaacttgttcttcattgtcttcaccctgatgctcgtctttgtattcgctattgttgccctgcacccaaagatcaatggtagcttgttgcctgcatcggttattgctgtgtactgcacctatctgtgctacagtggactttcgagtgagccaagggattatgaatgcaatgggcttcacaaccactcgaaagctgtctcaactggtagcctttcgttgggactgcttaccaccgtcctttctgtggtctattctgctgtccgagctggctcttccgcaactgtgctctcaccgcctgattcaccacgtgctggtgcagacaaacctctgcttcccttcagcaaggcggatgaacaagaagataagaaggatgtgtcaaggccagtgacatactcctactctttctttcacctgatcttctccctggctagcatgtactcagcgatgctcctgactggctggtcaacctcagttggtgagagcgggaagctggtcgatgttgggtggccgtccgtttgggtcaggattgcaactcagtgggcaacggcaggtctgtacatatggtcccttgttgcacccatcctctttcccgacagggaattctagatcaaccgggtcaaattcctgtgtgtgtacatccttttggagcatgaatcatgtgtgccgtgttaactaatctgtcctacgaaaatatttggtctatgtatggtctgtaatgcgtgctgtgagcaaatgatggtaggaaatctgtgcttgttggttctcaactccgtgacctaaataacgtgtgacaacaggcattatgccagcatttgaatttgaatacgtgctgtgtattgcaaaaaaaaaaaaaaaaaaaa

SEQ ID NO: 7832 - protein, 414 aa, Panicum virgatum
  misc_feature: Ceres CLONE 1956928
  misc_feature (1)..(407): Pfam Name: Serinc Pfam Description: Serine incorporator (Serinc)
  misc_feature (1)..(405): Pfam Name: Serinc Pfam Description: Serine incorporator (Serinc)
  misc_feature (1)..(409): Pfam Name: Serinc Pfam Description: Serine incorporator (Serinc)
  misc_feature (1)..(403): Pfam Name: Serinc Pfam Description: Serine incorporator (Serinc)
MWAASCLASCCAACACEACRTAVGSIGRRSARIAYCGLFALSLFASWALREVAAPLLQSIPWINHFHKTPDREWFETDAVLRVSLGNFLFFTILAVIMAGIKDQKDPRDKIHHGGWMAKIFCWVVIVFLMFFVPNGVVSFYESISKFGSGLFLLVQVVLLLDFVHGWNENWVAKDEQFWYMALLVVSVVCYIATFSFSGLLFHWFTPSGHDCGLNLFFIVFTLMLVFVFAIVALHPKINGSLLPASVIAVYCTYLCYSGLSSEPRDYECNGLHNHSKAVSTGSLSLGLLTTVLSVVYSAVRAGSSATVLSPPDSPRAGADKPLLPFSKADEQEDKKDVSRPVTYSYSFFHLIFSLASMYSAMLLTGWSTSVGESGKLVDVGWPSVWVRIATQWATAGLYIWSLVAPILFPDREF

SEQ ID NO: 7833 - DNA, 1846 bp, Panicum virgatum
  misc_feature: Ceres CLONE 1957107
  misc_feature: Encodes the peptide sequence at SEQ ID NO. 7834
acgcaacgcaaccaaccaggcgtcggccagggccgccagccagctgatcgacgcctgcaggtctctctggtggtgacgtgccatctcgatcgatcgattccctcctccttggccggccggccgcccggcctttatttgccggcctcgacgaccttcctctaggaacttgtgctaccagctagcagcagcagtcagtagcggtagtgttcttgctgcggacgcggccggccggctcgacgtccacgatgaggctccgcgactccgccgcgatggtggctctggtgctcgcgctcacctgctccgttgcagtgggctacgatcccctggaccccaacggcaacatcaccatcaagtgggatgtcatctcctggacgcccgacgggtacgtggccatggtgacgatgagcaactaccagatgtaccgccacatcatggcgcccgggtggacggtggggtggtcgtgggccaagaaggaggtgatctggtccatggtcggcgcgcaggccacggagcagggcgactgctccaagttcaaggccggcatcccgcactgctgcaagcgcacccccgccgtcgtcgacctcctcccgggcgtcccctacaaccagcagatcgccaactgctgcaaggccggcgtcgtcgccgcctacggccaggaccctgccgccgccgtctccgccttccaggtctccgtcggcctcgccggcaccaccaacaagacggtcaagctgcccaggaacttcaccctccagggccccggccccggctacacctgcggccccgcccggatcatcccctccaccgtctacctcacccccgaccgccgccgccggacgcaggcgctcatgacctgggcgctcacctgcacctactcgcagcagctcgcctccaagtacccctcctgctgcgtctccttctcctccttctacaacagcaccatcgtgccctgcgcccgctgcgcctgcggctgcggccacggcggccacggcgccgccggctgcatcgccggcgactccaagcgggcgctctcccccggcgtcaacacgccgcgcaaggacggccagccgctgctccagtgcacgccgcacatgtgcccggtgcgcgtccactggcacgtcaagctcaactacaaggactactggcgcgccaagatcgccatcaccaacttcaactaccggatcaactacacgcagtggacgctggtggcgcagcaccccaacctggacaacgtcaccgaggtcttcagcttccagtacaagccgctgctcccctacggcgccatcaacgacaccggcatgttctacgggctcaagttctacaacgacctgctcatggaggccgggcccttcggcaacgtgcagtccgaggtgctcatgcgcaaggacgcaagaaccttcaccttcagccagggctgggcgttcccgcggaagatctacttcaacggcgacgagtgcaagatgccgccgccggactcgtacccctacctgcccaactccgccccgctcgcggctccggtcatcgccaccgcggcctcggcgttcctgctggtggcgctgctcctggtggcgtgatcggtcatgggaattgggatgggctgccagggagcagagtaggcatggcgctctggagactgaaacgcttggcaatgtcatgtgtgttgttgcctgtgcagctgcacatagagagactagcagaccaatcaggctggcagagatcctggcacttttgagtctccaattactttttagacagcctgatcgagaacaaatgatagtatacatagtagagcacaaccttttttctgtggtttcgtcatgtacacataatgcagattattaattgttcg

SEQ ID NO: 7834 - protein, 441 aa, Panicum virgatum
  misc_feature: Ceres CLONE 1957107
  misc_feature: Great-hit functional homolog of the protein sequence encoded by LOCUS At5g15630
  misc_feature (1)..(165): Pfam Name: Phytochel_synth Pfam Description: Phytochelatin synthetase-like conserved region
  misc_feature: Useful for making plants with altered cell wall content and/or composition
MRLRDSAAMVALVLALTCSVAVGYDPLDPNGNITIKWDVISWTPDGYVAMVTMSNYQMYRHIMAPGWTVGWSWAKKEVIWSMVGAQATEQGDCSKFKAGIPHCCKRTPAVVDLLPGVPYNQQIANCCKAGVVAAYGQDPAAAVSAFQVSVGLAGTTNKTVKLPRNFTLQGPGPGYTCGPARIIPSTVYLTPDRRRRTQALMTWALTCTYSQQLASKYPSCCVSFSSFYNSTIVPCARCACGCGHGGHGAAGCIAGDSKRALSPGVNTPRKDGQPLLQCTPHMCPVRVHWHVKLNYKDYWRAKIAITNFNYRINYTQWTLVAQHPNLDNVTEVFSFQYKPLLPYGAINDTGMFYGLKFYNDLLMEAGPFGNVQSEVLMRKDARTFTFSQGWAFPRKIYFNGDECKMPPPDSYPYLPNSAPLAAPVIATAASAFLLVALLLVA

SEQ ID NO: 7835 - DNA, 1596 bp, Panicum virgatum
  misc_feature: Ceres CLONE 1957151
  misc_feature: Encodes the peptide sequence at SEQ ID NO. 7836
accggggaaggcaaatcaaagttcggcgcgcagggagccaagccgttgaggggagtagagcacatttcgctcagaaatctccactcgaatccctctcgccaccaccaatccgccatgctgccgtcgcacctcaacggccactcccccctcgcgcggcgccgcccgcgcctctccgctgcttccccacccgccgccgccgccggggagtccccggccgcgggggctggggctacatccacggcggattcgctggaggagcacgaccgcatctacttccagtcttactcccacatcggcatccatgaggcaatgatcaaggaccgcgtcaggactgatgcttaccactcagccatcatgcaccatcagaaatttatcgaggggaaggttgtgctcgatgtggggtgtggaactggaatactctctgtgttctgtgctcgtgctggaaaaaaaagggtgtatgctgttgaagctagtgaaattgctacccaggcttgtgaaattgtaaaagcaaacaacctaagtgataaggttgtggtcatccatggacgtgttgaggatgttgaccttgaggagaaggttgatgtaataatatcagaatggatgggctatatgcttctgtatgagagtatgctgccaagtgtcttatttgcaagagataaatggcttaaacctgggggtcttattcttccttctcatgctacgctcttcatggctccgataacaaatcctgagagatatgaaggcagtgttgatttctggtgtgatgtctatggcatagacatgtctgctcttgtgccacttgccaaaaaatttacatctgaagaaccctccattgaaacaattggtggagagaatgttataagttggccatctgtagtcaaacacatcgattgctataattttacagttgaggaattcaaatgtatcaccgcaaaatacaaagtttcatcaatgatgttagctcccattcatggctttggtttctggtttgaggtggagttcaatgggccccaagagtcctcccataatattccttccaatttgaatccacttgaaattattcagaagaaaaggagacgatcatctgaagatacagttcttctgtccacagcccctgaggatgagccgacccattggcagcagactattctgtacctccctgatcctatagaggtgaagcaggatcaaactgtagaaggctctgtaacggtgtcccagagcaaggagaacccacgttttctgaatattcatctagagtgctccacaggaggacatacgttggtaaaagactgtgccatgcgatgaactggtcctttttactttttagttacggtactgggtccccccagcaaagatcctataacttgcaacttgcatgaggtcttctactcttcctttcagcttccgcgaactgaattctatcatctgcaacgaggagttcaagattctctactgatagtttatttcccctcattttctgaatttttactggaagcagagaatttgtattattaatgcattttctgttcactgttaatgatggcggggattgcatgatttcagtttgtcttatgctatagattggtaatttctttt

SEQ ID NO: 7836 - protein, 396 aa, Panicum virgatum
  misc_feature: Ceres CLONE 1957151
  misc_feature (1)..(98): Pfam Name: Methyltransf_12 Pfam Description: Methyltransferase domain
  misc_feature (1)..(100): Pfam Name: Methyltransf_11 Pfam Description: Methyltransferase domain
  misc_feature (1)..(76): Pfam Name: MTS Pfam Description: Methyltransferase small domain
MLPSHLNGHSPLARRRPRLSAASPPAAAAGESPAAGAGATSTADSLEEHDRIYFQSYSHIGIHEAMIKDRVRTDAYHSAIMHHQKFIEGKVVLDVGCGTGILSVFCARAGKKRVYAVEASEIATQACEIVKANNLSDKVVVIHGRVEDVDLEEKVDVIISEWMGYMLLYESMLPSVLFARDKWLKPGGLILPSHATLFMAPITNPERYEGSVDFWCDVYGIDMSALVPLAKKFTSEEPSIETIGGENVISWPSVVKHIDCYNFTVEEFKCITAKYKVSSMMLAPIHGFGFWFEVEFNGPQESSHNIPSNLNPLEIIQKKRRRSSEDTVLLSTAPEDEPTHWQQTILYLPDPIEVKQDQTVEGSVTVSQSKENPRFLNIHLECSTGGHTLVKDCAMR

SEQ ID NO: 7837 - DNA, 1748 bp, Panicum virgatum
  misc_feature: Ceres CLONE 1957212
  misc_feature: Encodes the peptide sequence at SEQ ID NO. 7838
ataccatacatcaatcatcatcggtccacatccgcaatgaggatcgcagcatcgacagtgctgttcggcgcggcttccgccgcgtcattccagcaacaagctcagcatgtgctttccggtggcttcggaaaggcccaggaggccatgaagcccatctcggatgccttcaccgatgctgccggccgccctttcgagagcttcgaggatgctttctcgggaatgaccgctgagacgaaggcgctctgggaggagatcaagctgcttgttcccgacagtgccttcaaggacctctcgtggctcagcaagcccaagcctcaccaccgccgtgatgactggaaccatgtcgtgaagggcgccgatgtccagggcatgtgggtacaggatgctaacggtgagagccaccgtcaagtggacggtcgcctcgaggagtacaacctccgcgtcaaggctgtcgacccatccaagctcaatgtcgattcggtcaagcagtacagtggctatcttgacgacgaggccaatgacaagcacctgttttactggttcttcgagtcgcgcaatgaccccaagaatgatcctgtgatcctgtggctcaacggcggccccggctgctcgtcgctcaccggtcttttcctcgagctcggcccttcgtcgatcgacaagacgcttaaggttgtcaacaacgacttcagctggaacaacaatgccagtgtcatcttcctcgaccaacccgtcaacgttggctactcatactctggctcttctgtgagcaacaccgttgccgccggcaaggacgtctacgctctcttgaccctcttcttccatcaattccccgaatacgcaaagcaggacttccacattgctggcgagtcgtacgctggtcactacattccggtctttgcctcggagattctggcccacaagaacaggaacatcaacctcaagtctgtcctgatcggaaacggtctgactgatggcctcactcagtacgagcactaccgccccatggcttgcggtgaagttggctatcccgccgtcctcggtgaggctgagtgccgcagcatggacaacgccctcccgcgctgccagtcgctgattaacaactgctatgagagcggtagcgtgtggagctgcgtcccggcctccatctactgcaacaacgccatgatcggtccttaccagcgcaccggccggaatgtctacgatatccgcggcccatgtgaggacagcagcaacctttgctacagcggcctcggctatatcagcgactacctgaaccagcaatccgtcatggacgccttgggcgttgaggtttcaagctatgacagctgcaactttgacatcaaccgtaacttcctcttccagggcgactggatgcagcctttccaccgtcttgtgcccaagattctggaggaaatccccgtcctcatctatgctggtgacgctgattacatttgcaactggcttggcaaccgggcttggaccgaggcgctcgagtggcccggcaagaaggacttcaatgcggccaaggtcaaggatctgaagctttctggcgctgagaaggagtacggcaaggtcaaggcctcgggcaacttcacgtttatgcaagtctaccaggccggccacatggtccccatggaccagcccgagaactcgctcgacttcctgaacaggtggctcaacggcgagtggtttgccaaatagagggagatcaaggcgtgattagtatttagtaagaattgttatctcac

SEQ ID NO: 7838 - protein, 554 aa, Panicum virgatum
  misc_feature: Ceres CLONE 1957212
  misc_feature (3)..(406): Pfam Name: Peptidase_S10 Pfam Description: Serine carboxypeptidase
  misc_feature (1)..(409): Pfam Name: Peptidase_S10 Pfam Description: Serine carboxypeptidase
  misc_feature (1)..(408): Pfam Name: Peptidase_S10 Pfam Description: Serine carboxypeptidase
  misc_feature (1)..(407): Pfam Name: Peptidase_S10 Pfam Description: Serine carboxypeptidase
  misc_feature (1)..(412): Pfam Name: Peptidase_S10 Pfam Description: Serine carboxypeptidase
  misc_feature (1)..(413): Pfam Name: Peptidase_S10 Pfam Description: Serine carboxypeptidase
  misc_feature (1)..(411): Pfam Name: Peptidase_S10 Pfam Description: Serine carboxypeptidase
  misc_feature (1)..(407): Pfam Name: Peptidase_S10 Pfam Description: Serine carboxypeptidase
  misc_feature (1)..(413): Pfam Name: Peptidase_S10 Pfam Description: Serine carboxypeptidase
  misc_feature (1)..(413): Pfam Name: Peptidase_S10 Pfam Description: Serine carboxypeptidase
  misc_feature (1)..(551): SWISSPROT Homolog: EC 3.4.16.5 Carboxypeptidase Y precursor
  misc_feature (70)..(549): SWISSPROT Homolog: EC 3.4.16.5 Carboxypeptidase Y precursor
MRIAASTVLFGAASAASFQQQAQHVLSGGFGKAQEAMKPISDAFTDAAGRPFESFEDAFSGMTAETKALWEEIKLLVPDSAFKDLSWLSKPKPHHRRDDWNHVVKGADVQGMWVQDANGESHRQVDGRLEEYNLRVKAVDPSKLNVDSVKQYSGYLDDEANDKHLFYWFFESRNDPKNDPVILWLNGGPGCSSLTGLFLELGPSSIDKTLKVVNNDFSWNNNASVIFLDQPVNVGYSYSGSSVSNTVAAGKDVYALLTLFFHQFPEYAKQDFHIAGESYAGHYIPVFASEILAHKNRNINLKSVLIGNGLTDGLTQYEHYRPMACGEVGYPAVLGEAECRSMDNALPRCQSLINNCYESGSVWSCVPASIYCNNAMIGPYQRTGRNVYDIRGPCEDSSNLCYSGLGYISDYLNQQSVMDALGVEVSSYDSCNFDINRNFLFQGDWMQPFHRLVPKILEEIPVLIYAGDADYICNWLGNRAWTEALEWPGKKDFNAAKVKDLKLSGAEKEYGKVKASGNFTFMQVYQAGHMVPMDQPENSLDFLNRWLNGEWFAK

SEQ ID NO: 7839 - DNA, 1500 bp, Panicum virgatum
  misc_feature: Ceres CLONE 1957406
  misc_feature: Encodes the peptide sequence at SEQ ID NO. 7840
aattaactctcgcttacagttctcggcaataccaaacagtctctggagatcgttccaaaggacgacatgaggccttcagagcttcaaaagccggcgttggacatgtccgtcgcttgccctcggctaacaccggcagcattagcctttccagcagcagtatccgactactatcaacttgatgaattgctgacgccagaggagaaaagtttacgaatcaagatccggaggtttatggagaatgaagttgccccaataatacccaagtattgggagagagcagaatttccattccaccttattccaaagctgggctctctcggtttccttggaggcatcatcaagggccatgaatgtcctgggttatcagcgaccgcttatggtatttgcatatcagaggttgctcgtgtggatgcaagcatagcctccttctgcctggttcaatcgtgtcttgccatgctttgcattgcacagttgggatctgaagcgcagaaggacaaatatttgccgtcattgagcaaactgcacaaggtttgcgcttatgccatgacagagccagagtatggtagtgatgcaagctctctgaacacagtagctcgaaaggttcctggagggtgggtgctaaatggcaggaaacggtggcctgggaacagcagttttgcagatgtgttggttgttcttgctcggaataccagcaccaatcaggtcaatgggttcattgtggatggaggaagccctggtctgaagatcagcaagatcgagaacaaggtttcaatgagaattgtccagaactgcgacatcgagctggagaatgtgttcgtgtctgatgatgatcggttacctggtgccaattcttttcaggatcttgttaattcgcttgctttcagtcgtgtcatggctgcctgggtcagcatcggcatcgcagtaggggtgtacgacgcatgccagaggtacctgggagagaggaaacagttcggcgtaccactagcggcgttccagctgaaccaagagaagctcgtcaggatgcttggcaacatccaggccatgtggctcctcggctggcgcctttccaagctgcacagctccagcaagatgaccatcggccaggccagcctgggcaaggcatggatcacgaagcaggctagggagacggtggcgctcggcagggagctccttggtggcaatggcattgtcaccgatttccacgttggcaaggcattctgcgacttggagactgtgtacacgtacgagggtagctacgaagttaacgccctaatagtcgcacgggagatcactggcatctccagcattaggccgacgacaagccggctctagtgttgcaaaactgtgaacatattatgggtaatctacaagggggctgtacaaggcaaaaaagattaatcaaatcagagatacttgctcttcaatccccacaagactatgcattgttgaataattaggcaattgtatgattaaattctgaaataaataaatcttgaacac

SEQ ID NO: 7840 - protein, 421 aa, Panicum virgatum
  misc_feature: Ceres CLONE 1957406
  misc_feature (2)..(141): Pfam Name: Acyl-CoA_dh_1 Pfam Description: Acyl-CoA dehydrogenase, C-terminal domain
  misc_feature (2)..(52): Pfam Name: Acyl-CoA_dh_M Pfam Description: Acyl-CoA dehydrogenase, middle domain
  misc_feature (1)..(421): SWISSPROT Homolog: EC 1.3.3.6 Acyl-coenzyme A oxidase 4, peroxisomal
MRPSELQKPALDMSVACPRLTPAALAFPAAVSDYYQLDELLTPEEKSLRIKIRRFMENEVAPIIPKYWERAEFPFHLIPKLGSLGFLGGIIKGHECPGLSATAYGICISEVARVDASIASFCLVQSCLAMLCIAQLGSEAQKDKYLPSLSKLHKVCAYAMTEPEYGSDASSLNTVARKVPGGWVLNGRKRWPGNSSFADVLVVLARNTSTNQVNGFIVDGGSPGLKISKIENKVSMRIVQNCDIELENVFVSDDDRLPGANSFQDLVNSLAFSRVMAAWVSIGIAVGVYDACQRYLGERKQFGVPLAAFQLNQEKLVRMLGNIQAMWLLGWRLSKLHSSSKMTIGQASLGKAWITKQARETVALGRELLGGNGIVTDFHVGKAFCDLETVYTYEGSYEVNALIVAREITGISSIRPTTSRL

SEQ ID NO: 7841 - DNA, 1696 bp, Panicum virgatum
  misc_feature: Ceres CLONE 1957518
  misc_feature: Encodes the peptide sequence at SEQ ID NO. 7842
gcttgcttgttcgctcgctgcctctcctccgtggaccgttgcgctcatgtgttggtgcttcgcctgcctcggcctgtcctgaatccttggacgcatacaagctcatcaggttgtttgctggattctttagtatcccatcaggccaagaatcctgcaagagctttggagccagagggttgctgcctccgtcttgggcgaggcttcaatttcctttgacgaggcaaggcggcgatgatgagcttcaagggccacgaggggcttgggcaggtggccgccgggagccaggcctcccatgttgcggccggagccccactgccgtggtgggcgggcccccagctgatttacggcgagccggcacccctgtcgccggaggagacgcgccgggacggccatttccaggtcgtgccgggggctcagggcggcacaccggatccggcgccgccggctgccaccaagagagggaaccctgaggtcctgaaattctctgtgttccaagggaatctggagtcaggtggtaaaggagataaaaacccagaacactctaccactattgcgctgcagtcaccatttccagaatacaatggccgtttcgagatcggtcttggtcaatccatggtcccttccaattattcttgtgatgaccagtgctatggtgtgcttaccacttatggaatgagatcaatgtctggtgggagaatgctcttgccactgaatgccccagccgatgcacccatctacgtgaatccaaagcagtacgaaggcatcctccgtcgccgccgcgcgcgcgccaaggccgagagggagaacaggctggcgaaaggcagaaagccgtatcttcacgagtctcgccacctccacgcaatgcgccgggcaagaggctccggcgggcgcttcctcaacacgaagaaagaagggggtgcgagtgcgaacggcgccagcaagacggtgtcagcggcgccggctgcacgcctcgccacgtctcccagcaccgagcctcgacgggtgccggggctcagcaagggcagtgacggcagcaacccgcgctgccagtcccggagcagcgtctccagcctgtccggctccgaggtgtcgagcatctacgacgaccatgcgagccgccaccagtatggcggcatggagccgcacctccgggcgccgtccttcttcaccccgctgccagccatcatggacggcgaccacggcggggctgccgccatcccctccttcaagtgggcagccagcgacggctgttgcgagctcctcaaggcgtgaaccgaggaggggatgactactcagacggccggccttctccccgttggctggctgtctgtaggcaaatcattcttggctgttctgcaatggggtgcgatcctcctcatcacctagctacctacccatgtccctgaaactcatacggtgctgggtttcaggggtcctgtgatgctggagccacccccttatgcctgtaacatagtgtacccaaaagcactgctgcttggtactgcttgttgatagcagtgtctcagtacggaattctgtgatgtcaggtcgatcagtgtctgaataattgaggtgtcagacttctgactccagttcttggaggtgtgtctgggtctgtttgaagctttgaggtctgaaactttgtgctcggtgaagatactgtgctaatatgtaagtctgggacctacgttctgtt

SEQ ID NO: 7842 - protein, 346 aa, Panicum virgatum
  misc_feature: Ceres CLONE 1957518
  misc_feature (1)..(57): Pfam Name: CBFB_NFYA Pfam Description: CCAAT-binding transcription factor (CBF-B/ NF-YA) subunit B
MMSFKGHEGLGQVAAGSQASHVAAGAPLPWWAGPQLIYGEPAPLSPEETRRDGHFQVVPGAQGGTPDPAPPAATKRGNPEVLKFSVFQGNLESGGKGDKNPEHSTTIALQSPFPEYNGRFEIGLGQSMVPSNYSCDDQCYGVLTTYGMRSMSGGRMLLPLNAPADAPIYVNPKQYEGILRRRRARAKAERENRLAKGRKPYLHESRHLHAMRRARGSGGRFLNTKKEGGASANGASKTVSAAPAARLATSPSTEPRRVPGLSKGSDGSNPRCQSRSSVSSLSGSEVSSIYDDHASRHQYGGMEPHLRAPSFFTPLPAIMDGDHGGAAAIPSFKWAASDGCCELLKA

SEQ ID NO: 7843 - DNA, 1588 bp, Panicum virgatum
  misc_feature: Ceres CLONE 1957538
  misc_feature: Encodes the peptide sequence at SEQ ID NO. 7844
gttttccctgcccacctctctccccggccccggccctctatagtgccagcttgtttacttgtagatccaggctctcctgcccctctctctctagctcaacaagtgcggtgctcttctgttctgcctctctcctgtagcaagatccatctctctgctgcttcatttctccctaaagaattgaacacacatgaagaggcctaccagcagaggatcctcaatggtcagccaagcaaccacagatcaacaagaagacagttgcaggtacatggagcggcacggagtggacggcgatggcaccgccgcagctgagcgcgatgacatggaggccggggcgtacgacgaggaggacgacgatgaggagctcgcaggttcccgcggcggcctcggggagaagaagaggcgtctggcggcggatcaggtgcgagcgctggagcggagcttcgaggtggacaacaagctggacccggagcgcaaggcccggatcgcgcgcgacctcagcctccacccgcgccaggtcgccgtctggttccagaaccgccgcgcgcgctggaagaccaagcagatcgagcgcgacttcgccgcgctccgcgcacgccacgatgcgctccgggccgaatgcgacgcgctccgccgcgacaaggacgccctcgccgccgagataagggagctgagggagaaggtggagaggcagatggatgtgaagctggagtccgcggaggagatgcttccggtcgcggcggggacagccgctgccgccgccgctgtgtacaaggacgggtctacggacagcgactcgagcgccgtgttcaacgaggaggcgtcgccgtactccggcacggccttcgaccaccagcaccagcaccaactccacccgagcttcacgggtttcacctcgttcctggcctcatcgagctccctgagctcctctcttcctacttccttgtaccatggggtttcacatttggatcaggaagcggacggcttcctcagcgctgccgccgccgacggtttcttcgcagaggcggagcagggcgccgctggcctcggcagctggtacggcggtgagggttggtagaggtgggctgttggctggggagaattgatgtccacaatttctgtaaaaatatggcgctgtacatgcatgcatggggggtaactaggtagggtcaatttctatattttttaccggctggggaatagaccacggaaggaggagataggttatttatactggtcttggttgacagttaccccgctctcctgggttaattctttagacatctctcagtctcactctctctctctctcatatactgttgacaagtatatatatgcttctgtcagatgcatgtcaaattgagagagagagacagacaaagagagagaggggattagtaaggagactaagagaggattaagggaatgcctgagggtgtaaatgtaaactggatgctttggggccttgggggtaggcggcagtacttggtctactagcttggttattacaagttaaagcctagctgttgtaaatcatttattactttatatatagtgcaaatactaaatatgaaaaaaaaaaaaaaaaaaa

SEQ ID NO: 7844 - protein, 295 aa, Panicum virgatum
  misc_feature: Ceres CLONE 1957538
  misc_feature (1)..(55): Pfam Name: Homeobox Pfam Description: Homeobox domain
MKRPTSRGSSMVSQATTDQQEDSCRYMERHGVDGDGTAAAERDDMEAGAYDEEDDDEELAGSRGGLGEKKRRLAADQVRALERSFEVDNKLDPERKARIARDLSLHPRQVAVWFQNRRARWKTKQIERDFAALRARHDALRAECDALRRDKDALAAEIRELREKVERQMDVKLESAEEMLPVAAGTAAAAAAVYKDGSTDSDSSAVFNEEASPYSGTAFDHQHQHQLHPSFTGFTSFLASSSSLSSSLPTSLYHGVSHLDQEADGFLSAAAADGFFAEAEQGAAGLGSWYGGEGW

SEQ ID NO: 7845 - DNA, 1478 bp, Panicum virgatum
  misc_feature: Ceres CLONE 1957750
  misc_feature: Encodes the peptide sequence at SEQ ID NO. 7846
aaggaaaagtagcagctagcaaatcatctatctacaaagaggaggaggggaggggccgaggcaacaactctcctttgatttcttggcgctctctctctctctctctctctctctctctaggtcggtcagctcttggattcaacaagctaagcacatggcgcagagcgcggcggggagcatgcaagagatcgattaagaacacgcacgggccagtacacagatatgtgagccggccggcagctagctgctctctatcaataatttctcctgccttagcttgcttcaagaatatatataatcgacgagccagcagggatatatcggagctcgaaggaagaatctatcgatccgtggaccgagtgccaagaattggagctagctagaaaccctagctagctaggtagaagagatcgagagagaagctggcgagcaggtggtgggacgaggggcggcggctcggcctgccggagccatcctcccagcttggcaagaaccaggacgaagacatgacgccttcttccaacaaggacggcggcggcgccactgagcagccgacgagcggcgacgaccgcgagaactacggcagcggcgagcccaaggaaggcgccgtggtgaccggcaaccggcgcccccgcgggcggccaccggggtccaagaacaagcccaagccgcccatcttcgtgacgcgggacagccccaacgcgctgcgcagccacgtgatggaggtggccggcggcgccgacgtggccgagtccatcgcccacttcgcgcgccgccggcagcgcggcgtgtgcgtgctgagcggcgcgggcacggtgaccgacgtggccctccgccagcccgcggcgcccggcgccgtggtggcgctccgcgggcgcttcgagatcctctccctgaccggcacgttcctgcccggcccggcgccgcccggctccacggggctgaccgtgtacctcgccggcgggcaggggcaggtcgtgggaggcagcgtggtcggcacgctcacggcggcggggccggtcatggtgatcgcgtccaccttcgccaacgccacctacgagaggttgccgctggacgaggccgaggaggactccgggcagcaggcgcagctgcctccgctcggggcccccggcggagggccgcctggggatccctcggcggcgatgccaatgttcgccggggtgccgccaaacctgatgccagctgggggcggcgccgccgcctccggagcgggcctgcggctcgggcacgaggggcttgctgcatgggctcatcatcatgtacggcccccgccctactagtagatctagttaggatcgatcagaggaaggagatgatccatatatatatggccatatgctcaatcgatcttggaagtagaattaatgtgatggaggattatcattatcgttcatgcatcccatacaaagctactataagtagtgatgaattaagcagaaaaaaaaaaaaaaaaaaaa

SEQ ID NO: 7846 - protein, 264 aa, Panicum virgatum
  misc_feature: Ceres CLONE 1957750
  misc_feature: The sequence is a functional homolog of  SEQ ID NO 1395 in the  10/374,780 US patent application
  misc_feature: The sequence is a functional homolog of  SEQ ID NO 1402 in the  10/374,780 US patent application
  misc_feature: The sequence is a functional homolog of  SEQ ID NO 1410 in the  10/374,780 US patent application
  misc_feature: The sequence is a functional homolog of  SEQ ID NO 1413 in the  10/374,780 US patent application
  misc_feature: The sequence is a functional homolog of  SEQ ID NO 1507 in the  10/412,699 US patent application
  misc_feature: The sequence is a functional homolog of  SEQ ID NO 22 in the  10/669,824 US patent application
  misc_feature: The sequence is a functional homolog of  SEQ ID NO 22 in the  10/870,198 US patent application
  misc_feature: The sequence is a functional homolog of  SEQ ID NO 222 in the  10/374,780 US patent application
  misc_feature: The sequence is a functional homolog of  SEQ ID NO 240 in the  10/714,887 US patent application
  misc_feature: The sequence is a functional homolog of  SEQ ID NO 240 in the  11/435,388 US patent application
  misc_feature: The sequence is a functional homolog of  SEQ ID NO 254 in the  10/225,066 US patent application
  misc_feature: The sequence is a functional homolog of  SEQ ID NO 344 in the  11/435,388 US patent application
  misc_feature: The sequence is a functional homolog of  SEQ ID NO 346 in the  10/714,887 US patent application
  misc_feature: The sequence is a functional homolog of  SEQ ID NO 346 in the  11/435,388 US patent application
  misc_feature: The sequence is a functional homolog of  SEQ ID NO 348 in the  10/714,887 US patent application
  misc_feature: The sequence is a functional homolog of  SEQ ID NO 38 in the  10/669,824 US patent application
  misc_feature: The sequence is a functional homolog of  SEQ ID NO 38 in the  10/870,198 US patent application
  misc_feature: The sequence is a functional homolog of  SEQ ID NO 42 in the  10/669,824 US patent application
  misc_feature: The sequence is a functional homolog of  SEQ ID NO 42 in the  10/870,198 US patent application
  misc_feature: The sequence is a functional homolog of  SEQ ID NO 64 in the  10/225,068 US patent application
  misc_feature: The sequence is a functional homolog of  SEQ ID NO 66 in the  10/669,824 US patent application
  misc_feature: The sequence is a functional homolog of  SEQ ID NO 66 in the  10/870,198 US patent application
  misc_feature: The sequence is a functional homolog of  SEQ ID NO 722 in the  10/412,699 US patent application
  misc_feature: The sequence is a functional homolog of  SEQ ID NO 92 in the  10/669,824 US patent application
  misc_feature: The sequence is a functional homolog of  SEQ ID NO 94 in the  11/375,241 US patent application
  misc_feature: Useful for making plants with modulated growth and phenotype characteristics
MTPSSNKDGGGATEQPTSGDDRENYGSGEPKEGAVVTGNRRPRGRPPGSKNKPKPPIFVTRDSPNALRSHVMEVAGGADVAESIAHFARRRQRGVCVLSGAGTVTDVALRQPAAPGAVVALRGRFEILSLTGTFLPGPAPPGSTGLTVYLAGGQGQVVGGSVVGTLTAAGPVMVIASTFANATYERLPLDEAEEDSGQQAQLPPLGAPGGGPPGDPSAAMPMFAGVPPNLMPAGGGAAASGAGLRLGHEGLAAWAHHHVRPPPY

SEQ ID NO: 7847 - DNA, 1562 bp, Panicum virgatum
  misc_feature: Ceres CLONE 1957819
  misc_feature: Encodes the peptide sequence at SEQ ID NO. 7848
gcacctcggcatctcgctgacacaccgccacgaccgcacctcctgcgtatcctgccggcggtgctcgttccggtagctggagaccgatcttcgctggtagcttaacctagctccaggagagaagagccgccggccgcggagatgatgatgatgagccgtcacgcgggcggcggggccggcgcggggcggtacccgttcacggcgtcgcagtggcaggagctggagcaccaggcgctcatctacaagtgcctggcgtccggcaagcccatcccgtcctacctcatgccgccgctccgccgcatcctcgactccgccctcgccacctccccctccctcgccttcccgccgcaaccctcgctggggtggggctgcttcgggatggggttcggcaggaagcccgacgaggacccggagcccgggcggtgccggcggacggacggcaagaagtggcgctgcgccaaggaagcctacccggactccaagtactgtgagaagcacatgcaccgcggcaagaaccgttcaagaaagcctgtggaaatgtcccttgccacgccggcgccgtcctccaacgccacctccgccaacagcgccaccgccaacgccaccacgacctcgtcccccgcgcccacctaccaccgccctgctcccgcccccgccgccgcgcacgacgcggcgccctaccacgcgctgtacggtggcagcccctacgtggcctccacccgccccggcggcgcgtaccacgcggcggcgcaggtgagccctttccacctccacctggacaccacccacccgcacccgccgccgtcgtactactccgtggaccagagggactacgcctacggccacgccgccgcgaaggaggtcggcgagcacgccttcttctccgacggcacggccgagagggaccgccaggccgcggggcagtggcagttcaggaatctcggagcggagccgaagccgagcgcaacgtcgctgttctcggtcggcgggtacgggaacggcgcggcgacggtgccgtacgccgttgatcggatcaaggaggacgaggaggaacggcggcgccagcagcagcactgcttcgtgctgggagccgacctgcggctggagaggccgtcgggccacgatgccgcccccgagcagaaaccgctccggcccttcttcgacgagtggccgcacgagaaatcaaacaagggcggctcctggatgggtctcgatggcgagacacagctttccatgtccatccccatggcgaccaacgacctccccatcacctcccgctaccgtaatgatgagtgagtccagcttgtctaattgctgctagacgagagagaggctgaggcgagatcaacctgaagcacaactacgggtgccttccaggcgtgttgatcctgagatgtacggttctgctcaaggccggtacagttcgatgaagttgaaagtcctgaacctcctaagaatgaattttccttttttttctctccatttttttctacgcgttgttgcttctagtgttacacttcactgtaatgcttcttatgtgtttagttgtgatgaattagcag

SEQ ID NO: 7848 - protein, 384 aa, Panicum virgatum
  misc_feature: Ceres CLONE 1957819
  misc_feature: Great-hit functional homolog of the protein sequence encoded by LOCUS At3g13960
  misc_feature: Useful for biocontainment applications
  misc_feature: Useful for making plants with modulated biomass
  misc_feature: Useful for making plants with modulated flowering time
  misc_feature: Useful for making plants with modulated nitrogen use efficiency
  misc_feature: The plant flowers significantly late compared to wild-type.
  misc_feature: The plant is abnormally large.
MMMMSRHAGGGAGAGRYPFTASQWQELEHQALIYKCLASGKPIPSYLMPPLRRILDSALATSPSLAFPPQPSLGWGCFGMGFGRKPDEDPEPGRCRRTDGKKWRCAKEAYPDSKYCEKHMHRGKNRSRKPVEMSLATPAPSSNATSANSATANATTTSSPAPTYHRPAPAPAAAHDAAPYHALYGGSPYVASTRPGGAYHAAAQVSPFHLHLDTTHPHPPPSYYSVDQRDYAYGHAAAKEVGEHAFFSDGTAERDRQAAGQWQFRNLGAEPKPSATSLFSVGGYGNGAATVPYAVDRIKEDEEERRRQQQHCFVLGADLRLERPSGHDAAPEQKPLRPFFDEWPHEKSNKGGSWMGLDGETQLSMSIPMATNDLPITSRYRNDE

SEQ ID NO: 7849 - DNA, 1603 bp, Panicum virgatum
  misc_feature: Ceres CLONE 1958010
  misc_feature: Encodes the peptide sequence at SEQ ID NO. 7850
aataaacacacatgcacccacaatcatcgatcatctgtcctttcgcatcaggcaacaacaggaatggcatgctcctcggcggcgcccaaattcacggtgcacaggcgaccggcggtgctggtggctccggcggctcctacgcctcgtgagctgaagcggctctcggatatcgatcaggaggacaggctttggtgccaattctccaacctccatttctaccggaggaacgaatccatgggcggcaaggaccccgtgggggttatacgggaggctctcgccaaagcccttgtaccctactacccgttcgctggacggctccgagagtacgatggatggaagctcgccgtcgactgcaccggtgagggggttttgtttgtcgaggccgacgctgatgttggccttgagcactttggtgataccctactacctcccttcccgtgcctcgaggagctcatctttgacgtccccggctcttccgccgtcctcgacactcccctcctactcttccaggtgtcgcggctcgcttgtggaggattcatccttgcggtccgagtgaaccacaccatggttgacgcacaggggctgacgcagttcttgggggccgtggcagagcttgcgcggggtatgcaggctccatctgtgctgccggtgtggaaacgggagctgctggagggccgcaaccagcaacagctggcgctggtagtgtacgacaagttggacgaggtgccgggcaaggacactgacaccaaggccagcagtgtcatgcttccattagataacgcggcgctccggctccgctccttcttctttgggccgcgagagatcgctgctattcgagcgcaactcccgccgcaccttcagaagcgtgccacaaagttcgacgccattgcaggctggatttggaagttccgcacggtggcgctggccccgaaccccgacgaggtgatggagctgctggtgaacgtcaacgcacgcggccgcaaggctggcatccccatcggctactacggaaacgcattcgcgttcccggccgccatatctacggccagggagctctgcacgaaccccctgagctacgccgttgagctggtgaagaaggcgaaaaaccaggtggacatagagtacatgaggtcaagggtcgacctcatcgcgctacgcagggggcgaagtccgcccatcactgcaggcatgtattgcctgtcagacttaacaagggccaggtttgacaatctcgacttcggatggggcaagccggtgtatgggggtccagcgccacaagccatcggcgccaccccatcgttaccctggctggttggtggaagagatgagcaagttgctgcgcctatcagccgatgtgaccctgctgcaccagcctcacatgttttctgtcaagaggtcagcgctatgaataattcaccatgtgttggtgctggctatggccaaaatgaaacttcattatctgtatagtagcatgagaattgagtcaagtggccggtatgctattgtatgttcgtctcaaggggttctatttatcctatgtactgcatgttatcaataaaataatgcaatactcatcagttattaaaaaaaaaaaaaaaaaaaa

SEQ ID NO: 7850 - protein, 467 aa, Panicum virgatum
  misc_feature: Ceres CLONE 1958010
  misc_feature (1)..(439): Pfam Name: Transferase Pfam Description: Transferase family
MACSSAAPKFTVHRRPAVLVAPAAPTPRELKRLSDIDQEDRLWCQFSNLHFYRRNESMGGKDPVGVIREALAKALVPYYPFAGRLREYDGWKLAVDCTGEGVLFVEADADVGLEHFGDTLLPPFPCLEELIFDVPGSSAVLDTPLLLFQVSRLACGGFILAVRVNHTMVDAQGLTQFLGAVAELARGMQAPSVLPVWKRELLEGRNQQQLALVVYDKLDEVPGKDTDTKASSVMLPLDNAALRLRSFFFGPREIAAIRAQLPPHLQKRATKFDAIAGWIWKFRTVALAPNPDEVMELLVNVNARGRKAGIPIGYYGNAFAFPAAISTARELCTNPLSYAVELVKKAKNQVDIEYMRSRVDLIALRRGRSPPITAGMYCLSDLTRARFDNLDFGWGKPVYGGPAPQAIGATPSLPWLVGGRDEQVAAPISRCDPAAPASHVFCQEVSAMNNSPCVGAGYGQNETSLSV

SEQ ID NO: 7851 - DNA, 651 bp, Panicum virgatum
  misc_feature: Ceres CLONE 1958255
  misc_feature: Encodes the peptide sequence at SEQ ID NO. 7852
gcgctatttgtttgggcatgaaagttggaaattaatcaatatacccatttgtttgaaaaaaaaaaaaaaaggcaagctagctgcaagcaagggcgcggcaccaagtagtcatagcaagtgtggtcatccttgatcaggcttgctagctaatcacaccttgtcagttcttcctcgtcgatcgatctccgaccgacggcagctagcaatccaagaagagtcgtgatggagatgaagaaggtcgcctgcgccgtccttgtggccgccgcctcggccaccgtggccctcgccgccgacgccccggcgccctcacccaccagcgcctcctcggccgccttcccggccgtcggcgcggtgatcggcgcctccgtgctttccttcttcgcctgctgcctccagtaactgctagaggaggagcagcagcaggaagcttggtgctggctgcggttgtattctatttatgttttgtatacaagttaccttaattcgggtttaatctggattatttggccatatcgattgatccattcatttgattttgctttgacgtttctccccctctatgttattttccacctgtaaagagggcaggagcggaggcgctatttgtttgggcatgaaagttggaaattaatcaatatacccatttgtttg

SEQ ID NO: 7852 - protein, 58 aa, Panicum virgatum
  misc_feature: Ceres CLONE 1958255
  misc_feature: Great-hit functional homolog of the protein sequence encoded by LOCUS At3g57690
  misc_feature: Useful for making plants with altered cell wall content and/or composition
MEMKKVACAVLVAAASATVALAADAPAPSPTSASSAAFPAVGAVIGASVLSFFACCLQ

SEQ ID NO: 7853 - DNA, 1643 bp, Panicum virgatum
  misc_feature: Ceres CLONE 1958306
  misc_feature: Encodes the peptide sequence at SEQ ID NO. 7854
gaagccagcggccttccagccatggaaggtaactaccccaagtacttcttctacgtgctcttcttgctcggctcatggctcctcacctgcctcctccacttccgccagccgctcttcttccacctctccggcggcggcactgcagtcttcctcccattctcgcgcaaggcgagcttcttctctacccctgctgcggccgttgacgttgctgatgatcggcgctcgacgccgccggcgtcgtgcgacgggaggtacgtgcacatggtggacctgccgccgcagttcgatgtctgcgccgagggctctccggcgttcgagagcgagcacagcatctgtcagttcatgtccaatgccgggctcggcccggtgctcctccccgccggcggcaaccgcagcgacggcgacgacgcggacatcgtccccaacaccggctggtacaacacgaaccagtacgcgctggaggtgatcttccaccaccggatgcggctgtacgactgcctcaccggcgacccggcggcggcggcggcggtgtacgtgccgtactacgcggcgatggagctgcagccgcacacgtgcgggctgttcaacgccacggtgagggacggcgcgacggggcggctgctgcgctggctgtcctcgcggccggcgtgggcggcgcacggcggccgcgaccacttcatggtggcctccaagacctcgtggatgttccggaggagggcgccgccggcggccggcggcggcggcgacgacggcacgggctgcggcaacagcttcatggagaagccggagtcccggaacatgacggtgctcacgtacgagaccgtcatctgggagcagccgcagcgggacttcgccgtgccgtacccgagctacttccacccctcgtcggccggcgaggtggccgagtggcaggcgcgcgtgcgcaccgcgccgcggccgtggctcttctccttcgccggcgcgcgccgccccgggacgctcgccatccgcgaccgcatcttcgacgcgtgcgacgccgccgccgccgccgcgaccccgcgccgccgctgcgggaagctcgactgcggcgggcccgacggcggcgtcgcctgccggtcgccgcggaagctcatggccctcttcacctcctcccgcttctgcctgcagccgctgggcgactccttcatgcgccgctcctccgtggacgccgtcatggccggctgcatcccggtcttcttccacgaggcctccaccttcgagaagcagtactactggcacgagagggacccggacggcggcggcggccggagcggcgacggccgccggtacttcgtgttcatcgaccaggacgacgtcctccaagggaaggtgggaattgaggaggctctgagcaggtacaccgatgacgaggtcgccgccctgagagaggaggtgatcaagatgatcccgaggttcctgtacaaggacccccgggtgaggttcgcgggggacatgagagacgccttcgacatcaccattgatgaggtgattgcgaggattaggaagatcgaggaaggagaggattcggaggggaaagattacagtggtcgacttgcggttgccaatggctcatgacattcgatgaaattttagtactttaataaaactctcaggtggtgtggttc

SEQ ID NO: 7854 - protein, 523 aa, Panicum virgatum
  misc_feature: Ceres CLONE 1958306
  misc_feature: Great-hit functional homolog of the protein sequence encoded by LOCUS At2g29040
  misc_feature: Useful for making plants with altered cell wall content and/or composition
MEGNYPKYFFYVLFLLGSWLLTCLLHFRQPLFFHLSGGGTAVFLPFSRKASFFSTPAAAVDVADDRRSTPPASCDGRYVHMVDLPPQFDVCAEGSPAFESEHSICQFMSNAGLGPVLLPAGGNRSDGDDADIVPNTGWYNTNQYALEVIFHHRMRLYDCLTGDPAAAAAVYVPYYAAMELQPHTCGLFNATVRDGATGRLLRWLSSRPAWAAHGGRDHFMVASKTSWMFRRRAPPAAGGGGDDGTGCGNSFMEKPESRNMTVLTYETVIWEQPQRDFAVPYPSYFHPSSAGEVAEWQARVRTAPRPWLFSFAGARRPGTLAIRDRIFDACDAAAAAATPRRRCGKLDCGGPDGGVACRSPRKLMALFTSSRFCLQPLGDSFMRRSSVDAVMAGCIPVFFHEASTFEKQYYWHERDPDGGGGRSGDGRRYFVFIDQDDVLQGKVGIEEALSRYTDDEVAALREEVIKMIPRFLYKDPRVRFAGDMRDAFDITIDEVIARIRKIEEGEDSEGKDYSGRLAVANGS

SEQ ID NO: 7855 - DNA, 1762 bp, Panicum virgatum
  misc_feature: Ceres CLONE 1958326
  misc_feature: Encodes the peptide sequence at SEQ ID NO. 7856
atggatagcccggcgatgtctgaaacgggaaaacgaggagagcagctccccctcctgcctcctctcccaccgcctccgtcgttccggccgctcctggggcagggccggcccatgcgggtgaggtgacgacgacgcacgcggcgcgcggcgatcaccggaccggccggcggcggagaccatgaaggggaggtcgctgttcaagagccctctcccccgcagctacctctccgacacctccagcgcctcgtcgtcgtcggccgccgtcgccacccaccgcgtctaccaagtctggagaggaaagaatagattcctctgcggcggccggctcatcttcggcccggacgccagctccatcgtgctcacggcggcgctcatcatgacgccgctcgcgctcttcgtcgccttcgtctcgttccgcgtcgctgacctcatcggcaagccgctcggcaccgccgtcccggcgaccgccatggccgtcggcgtattcgacgtggtggtgctggtgctgacctccgggcgggaccccggcatcatcccccggagcgcgcggccgccggagcccgacgacggcgacagcacggcctcccccgccggcggcggcgcgccgtcgtggtcgctcccgccgacgcgcgacgtgtacgtgaacggcatggtggtcaaggtcaagtactgccacacgtgcatgctctaccggccgccgcgctgctcccactgctccgtctgcaacaactgcgtcgaccgcttcgaccaccactgcccctgggtcggccagtgcatcggccgccggaactaccgcttcttcttcctcttcatctcctccaccacgttcctgtgcctctacgtgttcggcttctcctgggtgaacctgctgctcatctcgcggcggtacggcgtggggctcggcggcgccgtcgcggagtactcgccggtgtcgggcttcctcatcgcctacaccttcgtcaccgcgtggttcgtcggcgggctcacggcgttccactcgtacctcgtctgcaccaaccagaccacgtacgagaacttccggtaccggtacgaggggaaggccaaccccttcaaccgcggcgccgccgccaacgtcgccgagatcttcttctcgccgatcccgccgtcgaggaacgacttccgggccaaggtctccccggccgaccccgacgccgccgcgctctactacctcggcccgctctcgtccgagtcgcggatcagcttctacacccgggccagcctcagcttcgacatggccaaggccagcttcgacctcggctactccgccaagcgcaccagcgtcgcgtcgtcctccgacttcggcgacatctacggcggcggcgaaggcagccacgtctcgacggcggcgcaccagcagcagccgcggcactccatcttcggcggcccgggcagggagcccaagaaggtggaggaggaggccgacgcggtcacggcggagctcggggcgaccatgcagcagtacgccggcgccggccggccgcgcgggtgggagttcgaggcggtgtgatcgatcagctagcgctgcggacatggccgatcgagaagggaggggatcgatcgaaggagcaaacgccgccgttcttgcgaacgcgatttgcttgcgcttgttttttttcgtgtgatgtgtacgtccgtgtttgtatatgtagaattcttctacttgcttcctgctggtacaccgtagttggttcaaggcgtcatgtatgtatatatagttgtatacatgtatatatgtatatat

SEQ ID NO: 7856 - protein, 449 aa, Panicum virgatum
  misc_feature: Ceres CLONE 1958326
  misc_feature (1)..(65): Pfam Name: zf-DHHC Pfam Description: DHHC zinc finger domain
MKGRSLFKSPLPRSYLSDTSSASSSSAAVATHRVYQVWRGKNRFLCGGRLIFGPDASSIVLTAALIMTPLALFVAFVSFRVADLIGKPLGTAVPATAMAVGVFDVVVLVLTSGRDPGIIPRSARPPEPDDGDSTASPAGGGAPSWSLPPTRDVYVNGMVVKVKYCHTCMLYRPPRCSHCSVCNNCVDRFDHHCPWVGQCIGRRNYRFFFLFISSTTFLCLYVFGFSWVNLLLISRRYGVGLGGAVAEYSPVSGFLIAYTFVTAWFVGGLTAFHSYLVCTNQTTYENFRYRYEGKANPFNRGAAANVAEIFFSPIPPSRNDFRAKVSPADPDAAALYYLGPLSSESRISFYTRASLSFDMAKASFDLGYSAKRTSVASSSDFGDIYGGGEGSHVSTAAHQQQPRHSIFGGPGREPKKVEEEADAVTAELGATMQQYAGAGRPRGWEFEAV

SEQ ID NO: 7857 - DNA, 1756 bp, Panicum virgatum
  misc_feature: Ceres CLONE 1958430
  misc_feature: Encodes the peptide sequence at SEQ ID NO. 7858
gctcgcagtcggccatcattccctgacccgcttgctttgcactgctcgctcaccgttcactccaagaagccgatggcaactcgagctctgccgctgctacgggagtccccgccgtgggccgtggcttgcgcggcggcggcgctgttgtggctggtggcctggacgctggagtgggcgtggtggacgccacggtggctcgaccgggccctgcgtgaccaggggctcaagggcaccacgtaccgcctcttcaccggcgacctgagggagaacacccggctcaaccgcgaggcgcgggcgaagccgctgccgcttgggtgtcacgacatcatcccccgcgtgctgcccatgctccacaacgccgtaaaggagaacggggcagcgtcattcacttggtttgggccaaaccctagggtgatgattccagacccagaatcagtaagagaggttttgtctaacaagtttggccactttggcaagcaacgttttagccgtgttggcaagttactaggcaatggggtggcgaatcatgaaggtgagaaatgggcaaagcataggagaatcctcaatccagcattccaccatgagaaaataaagcggatgctgcctgtatttgctacctgttgcatcaatgtgattaacagatgggaaaaaataatgtcttccgagggatcttctgagatagacatctggcctgagtttcagaatcttactggagatgttatctcgagaactgcgtttggtagcagctatcaagaggggatgaaaattttcgagctgcaaggagagctagctgaacgccttgtacagtctttccaaccagtatttatcccaggatattggttcttgccgaccagaaataacagaaggatgagagaaatcagtcgagaaatccacaaaattctgtgtgatataattgggaaaagagaaaaggctatgaaaaatggcgaaacaaatagtaatgatttgctgggcttattactggagtcaaacatgaggcaatcaaatgggaatgcaaagctaggattgacaacagaagatgtcattgaggaatgcaagctattttactttgccggtatggagacaacatcagtcctgcttacttggactctcattgtgctaagcaggcacccagaatggcaagagaaggcaagagaagaagtattaaaccactttggaagagatagaccagattttgaaaacttgaaccgcctgaagactgtaaccatgattctgtacgaggtcctcagattgtacccacctatagtcttattcagcagaagcacgtacaaggaaatgcagctcggtggcatcaaatatcctgcaggcgtgaacctcatcctgcccgtcatcttcattcaccgcgatcccagcatctggggagaagacgcaggcaagttcaatccagagaggttcgccgatggcatttccaacgcgtccaagcatcaggccgccttcttcccatttggaggcggtcccaggatctgcatcggccagaacttcgcgttgctggaagcgaagatggcgctgtgcaccattctccaacgcttctccttcgacctctcgccgtcctacattcacgcgccgtacaccgtgataacgttgcatccccagcatggtgctcagatcaggctgaagaagctttaatttaactatggtgatcttgctggatggcaaaacctcaataccattatcatatagtgactgtgcatctacgttgtttaaaattcatgatcaaggccggaactttccatattcc

SEQ ID NO: 7858 - protein, 523 aa, Panicum virgatum
  misc_feature: Ceres CLONE 1958430
  misc_feature: Great-hit functional homolog of the protein sequence encoded by LOCUS At3g14690
  misc_feature (16)..(523): SWISSPROT Homolog: EC 1.3.3.9 Cytochrome P450 72A1
  misc_feature: Useful for making plants with modulated cold sensitivity
MATRALPLLRESPPWAVACAAAALLWLVAWTLEWAWWTPRWLDRALRDQGLKGTTYRLFTGDLRENTRLNREARAKPLPLGCHDIIPRVLPMLHNAVKENGAASFTWFGPNPRVMIPDPESVREVLSNKFGHFGKQRFSRVGKLLGNGVANHEGEKWAKHRRILNPAFHHEKIKRMLPVFATCCINVINRWEKIMSSEGSSEIDIWPEFQNLTGDVISRTAFGSSYQEGMKIFELQGELAERLVQSFQPVFIPGYWFLPTRNNRRMREISREIHKILCDIIGKREKAMKNGETNSNDLLGLLLESNMRQSNGNAKLGLTTEDVIEECKLFYFAGMETTSVLLTWTLIVLSRHPEWQEKAREEVLNHFGRDRPDFENLNRLKTVTMILYEVLRLYPPIVLFSRSTYKEMQLGGIKYPAGVNLILPVIFIHRDPSIWGEDAGKFNPERFADGISNASKHQAAFFPFGGGPRICIGQNFALLEAKMALCTILQRFSFDLSPSYIHAPYTVITLHPQHGAQIRLKKL

SEQ ID NO: 7859 - DNA, 1288 bp, Panicum virgatum
  misc_feature: Ceres CLONE 1958488
  misc_feature: Encodes the peptide sequence at SEQ ID NO. 7860
gagattcgttgatcattgcagagtccgtagtggaatgagggagacgttgctccgagggtgaactgctgaagaagatgtcgccctggaaagaagaatttaagttgaccgaatgatggatttcttctttcaaggaccagaaccaggggcaagcgaaatgccgtcactgaaggacctctttgatgcttcagggcctaagtatttgacatatgtgaattggaactgcccgcaccaccagcgttccgtcgtggcgagccttgtccagggcgtgtacgtcctcgagcgcgaccgccagtggaaccggcagggccccgacgcccgcgcgccggcgtggtggaggttcttccacttcgagctgcgccgggtgctcgtcgacgccgccgacggctccatcttcggtgccgtctacgcgttccagccgccgttccacctcctggatcccacggcggccgccagcgccccgcactacgtcgtcgccttccgcggcaccatcaccaagaagggctcggcgaagcgggacctggggctggacctccagctggtccgcaacgggctggaaggcaagtcccgcttccgcgtcgccatgcaggccatccacgacacggtggccgcggcggcccggcagcacgaccgcgtctggctggcggggcactcgctggggtcggcgatcgcgacgctggccgccaagaccctggccagggcgggcgccgccgtcctgcccacgttcctctttaacgcgccgttcctgtcggtgcccgtagagcggatcggggaccggcgggtgaggcagggcatccgcatcgccagcagcttcgtgaccgcgggggtggcggccgtcctgcagaggggcggcggcggcggcgtgcgcgacgcgtcgttcgcggcgctggcggcgtgggtgccgaacctgttcgtgaacccggcggaccccatcagcgcggagtacgtggggtacttcgaccaccgcaggaagatggaggccatcggggccggcgccgtggggaggctggcgacgaggaactcggtcaaggacctgctgctcggcatcggcaaggggggcggcgggtgcgagccgctgcacctgttcccgtcggccgtgctgacggtgaaccgcgggccctcgccggacttcaagacggcgcacgggatccatcagtggtggcggcccgacctggcgctcgagtgcaccgcgcattactacacttgattctgattggtcacgacgagcgttcgactgtttaattgaaacagaaactgaaagagttactggcaaaaaaaaaaaaaaaaaaaa

SEQ ID NO: 7860 - protein, 364 aa, Panicum virgatum
  misc_feature: Ceres CLONE 1958488
  misc_feature (1)..(118): Pfam Name: Lipase_3 Pfam Description: Lipase (class 3)
MMDFFFQGPEPGASEMPSLKDLFDASGPKYLTYVNWNCPHHQRSVVASLVQGVYVLERDRQWNRQGPDARAPAWWRFFHFELRRVLVDAADGSIFGAVYAFQPPFHLLDPTAAASAPHYVVAFRGTITKKGSAKRDLGLDLQLVRNGLEGKSRFRVAMQAIHDTVAAAARQHDRVWLAGHSLGSAIATLAAKTLARAGAAVLPTFLFNAPFLSVPVERIGDRRVRQGIRIASSFVTAGVAAVLQRGGGGGVRDASFAALAAWVPNLFVNPADPISAEYVGYFDHRRKMEAIGAGAVGRLATRNSVKDLLLGIGKGGGGCEPLHLFPSAVLTVNRGPSPDFKTAHGIHQWWRPDLALECTAHYYT

SEQ ID NO: 7861 - DNA, 1437 bp, Panicum virgatum
  misc_feature: Ceres CLONE 1958522
  misc_feature: Encodes the peptide sequence at SEQ ID NO. 7862
aattaaacaacttattaattaacactctacttcatcttttcacttaatacaagccactttttcgcaacaatgaacagccgaaaaccttttattatacacagaagctcatctggtatggaaatcgagcctgaaccagatcgaaataacaacaataacaataccaacaacagcggcttagatatcaatcctgtctttgctgaactccaaattaagagagataaccgtcgtacttctgaaagaatgcgcgctcacaacgtctctttgtcaagcaacggaggtcgtagtgaagactctattggtgtctttgatgattttgctcgtcaaaactctgatgaaaatggtggtgatcgccctgcctctcttcaaatcttaaactcaccagcagataactcaccaagaagagctcaaacttcaagtcgaaatatcggatctaatttgttgtcttatctccaaaatctcgctaatcctttcagaagaacaacaacaagttctcagcaacaacaaaatcctcaacaaatgccattatatgccaatccctttgtcaacagcagcagcaacctcggccctgcacaagttgaagttccaaaccaacaacaaaatgctggaactcaaacaggaaatccttttggaaacttccctcatggagcattaattgtcagaactgtttctccaggccccaatgacactgttattgtcagtatgagaatcatcccaattgacgatattcttggcggtggaaatgctcataaccatgaaggagaaggccaagaagctggttctttgggagtttttggagctttgcttagcatgctttctggcggtttgaatatcgaaagaggaatggaaaaggaagctttggacgatttaccagttgtggtatatgattcagaagcattcaagaatgtggatgctgaatcaaagaaatgtccaatctgctttgatgattatgaagatggccatgagttgagatatttgtggtgcctccatagattccacaagaactgtgtggatcagtggctcggaaatcatacaacttgtccagtctgcaaaaaagattattctgatgctcaaaaaacaacctttgaagaggaagaagttccttcagaataaatcatattgtagacctcacaggcaggttctctttacatctttcttgttctcagaacttcttttaaaacaaaatgagctcttcaaaacataacaaaatgttaaaggctcaacttcctatactcaataaatgaaattctatattcgataaaactgattttttcaaaggttttgatcgtattctacttgataatggcttgtatgtatgtcaaaataacagcagtacattatcatgatgtctatattctctatcttatatacttctatgttctattcttctctatctattctttatctcgtataattataatgatactttgtcaaaatatt

SEQ ID NO: 7862 - protein, 346 aa, Panicum virgatum
  misc_feature: Ceres CLONE 1958522
  misc_feature (1)..(41): Pfam Name: zf-C3HC4 Pfam Description: Zinc finger, C3HC4 type (RING finger)
MNSRKPFIIHRSSSGMEIEPEPDRNNNNNNTNNSGLDINPVFAELQIKRDNRRTSERMRAHNVSLSSNGGRSEDSIGVFDDFARQNSDENGGDRPASLQILNSPADNSPRRAQTSSRNIGSNLLSYLQNLANPFRRTTTSSQQQQNPQQMPLYANPFVNSSSNLGPAQVEVPNQQQNAGTQTGNPFGNFPHGALIVRTVSPGPNDTVIVSMRIIPIDDILGGGNAHNHEGEGQEAGSLGVFGALLSMLSGGLNIERGMEKEALDDLPVVVYDSEAFKNVDAESKKCPICFDDYEDGHELRYLWCLHRFHKNCVDQWLGNHTTCPVCKKDYSDAQKTTFEEEEVPSE

SEQ ID NO: 7863 - DNA, 1736 bp, Panicum virgatum
  misc_feature: Ceres CLONE 1958524
  misc_feature: Encodes the peptide sequence at SEQ ID NO. 7864
attaacatgggctagcaatggcattactgatgccccttccttttaagatgtatcccttcccctcaggtaggggtggtaatgggccatggccctaatggcctcttcacagcccaataaaacccttaaaatttttagttcaaaaatacatatgtttagagcccggctcttttagggcccgatccttagattttctagttcaaaatgttgggccctttaccacccctaccctcaggtctagttctgtaggaacaagtagcatttgaatttgagtaactgctgctacatatgttcatgtaagcctgttcagggggaaaccgcactgtaactacactagtgctgtcattttctgttgttacagcttacatgtgcagtcatttcctttgtttattagagttgtgttttgcttacttcagcaattagctgtgaacactatgcttcctggtagcagttgatattttttttcttgatggctacatacatgctattgaaatgatcattattttttatatttcttttcttgatgaactgcaggcttctaaaccacgtgctgtagttaaactatggaaatgtaaaattgaggaaccaaagcttaatctggctgacccttccattatcatttttgacaaaggaacaaaaactcgatacaagatcttacctgcctatgaaggtgataaacaacagcttcaaaggttttataatgcatgttgtggcatggcacaggttttcaacacggctccagcgccgccagcaaatctcccaatgccaaatctattacctgcaaactcatctgcagcatcttcagaacaatctgcacccagcaaggaggatgttgaattagcgatggctatcaatgcctcaattcaatcagctatcgcagagggagtgcccaatgttcaactaaatgcatccacctccagcaccaatggctggggtacccctccaagcaattctcacaacggatggggacctccagcagctcctgctcctgcaccatcaaagttgagcagccaatcccaaggccaggttgacaccccaagcagcagcacatacaatggatgggacatgcctggaacaagctctagccaaagctcatctagacccaacaaaactcaaaccaatcctccagtcgtgattccgcaggaagcacctccggctcttcctaccccaaccgccccaccatttgcggaagaaaccttctacagcggccctgttcagtatccatccgtagatgctactcctgtcgatgtagccatgcctgctaccaccgaaggtggcacagcggcagcatctgctagaccaggagaaaatgaggctaatgcgaacggcagtggcaacactccctccgtcacctgtgttatttgtctggatgcccctgtggaaggcgcctgcattccgtgcggccacatggctggttgcatgtcctgcttgaaggatatcgagtccaagaagtgggggtgccctatctgccgcgccacgatcaaccaggttgttcgcctctatgctgtttgaggggttgaaacggtgagcctggaacgtcagcaatggatggttctcgcgacaagttttgatgggagcatctttattatatataaaaaaaaattatgcagctgtgattgtgcagttcgtactgcagtgtaaattatgactcgtgtgtaatgtgatactcgggccgttatatacagtgatgtgtatataagtgtaagacaattttgttgtgataccaataacagatctcg

SEQ ID NO: 7864 - protein, 339 aa, Panicum virgatum
  misc_feature: Ceres CLONE 1958524
  misc_feature (1)..(39): Pfam Name: zf-C3HC4 Pfam Description: Zinc finger, C3HC4 type (RING finger)
MIIIFYISFLDELQASKPRAVVKLWKCKIEEPKLNLADPSIIIFDKGTKTRYKILPAYEGDKQQLQRFYNACCGMAQVFNTAPAPPANLPMPNLLPANSSAASSEQSAPSKEDVELAMAINASIQSAIAEGVPNVQLNASTSSTNGWGTPPSNSHNGWGPPAAPAPAPSKLSSQSQGQVDTPSSSTYNGWDMPGTSSSQSSSRPNKTQTNPPVVIPQEAPPALPTPTAPPFAEETFYSGPVQYPSVDATPVDVAMPATTEGGTAAASARPGENEANANGSGNTPSVTCVICLDAPVEGACIPCGHMAGCMSCLKDIESKKWGCPICRATINQVVRLYAV

SEQ ID NO: 7865 - DNA, 1431 bp, Panicum virgatum
  misc_feature: Ceres CLONE 1958538
  misc_feature: Encodes the peptide sequence at SEQ ID NO. 7866
gaggcgccaccgcacgggaccagcgccattagaggccgcacctgcatccattccttctccaacgcagacaagaggaggtagcagcagaggagagggaggagccagcccctgctgattggaaagagacgtcggtttgaagttcaggtaagcggattcggagtcctcaactgacaagggcggcgcataccgcagctgggcaagatgaccgccggtttccagctcggtgtgattgggtctctcacgctctccgtcgcatcgtcggttgccattgtcatctgcaacaaggccctcatcagcaccctagggtttccattcgctacaacattgacaagctggcatctcatggtgaccttctgcacccttcacgttgcgcagcgcttgcgctttttcgagccaaaggcaattgatggacagacggtggttttgttcgggttgctgaatggaacctcaattggccttctcaatcttagtttaggattcaattccatcggattctaccagatgacaaagctggccataatacccttcacagtgctgttggagactatattcctgaaaaaaagattcagtgagactatcaagttctctctactggtcttgctacttggagttggcattgcttcagtcaccgacctcaagctaaattttcttgggtctattctttccggcctcgccatcgccacgacttgtgttggccaaattctcacaaacacaatacagaggaagctgaaggtcacctcgacgcagctcctgtaccaatccgcgccttaccaagcagcaatcctgttcgcgaccggccccttcgtggatcagctcctcaccagccgaagcgtcttcgcccacaaatacacattcccagttgtgggcttcatcgtgctgtcgtgcgtgatcgcggtgtcggtgaacttcagcacgttcctggtgatcgggacgacgtcgccggtgacgtaccaggtgctggggcacctcaagacgtgcctggtgctgtcgttcgggtacacgctgcttcgcgaccccttcaccgcgcgcaacatcctgggcatcctcgtcgccatcttcgggatggcgctctactcctacttcttggtgcgcgagggcaggaagaaggccgcgggcgacgccctcccggtgtcacagatgccggagaaggagacggagccgctgctggcgacgaccaaggacggcggcgacgccaagaaggccaacggcgtagctcacgactgctagatgctcctttctctcgtctgttatagcttagccagctctagtgtgtcgctactctacgcagtacgcacactgttctgaatctgatgtcggggaagcaagaattcctttcgtttatttgtacgatagaaagtgggggcgcgttgtactcgtccacaattaagagaaaatcgatggttcctctcttcaaaaaaaaaaaaaaaaaaa

SEQ ID NO: 7866 - protein, 341 aa, Panicum virgatum
  misc_feature: Ceres CLONE 1958538
  misc_feature (1)..(143): Pfam Name: TPT Pfam Description: Triose-phosphate Transporter family
MTAGFQLGVIGSLTLSVASSVAIVICNKALISTLGFPFATTLTSWHLMVTFCTLHVAQRLRFFEPKAIDGQTVVLFGLLNGTSIGLLNLSLGFNSIGFYQMTKLAIIPFTVLLETIFLKKRFSETIKFSLLVLLLGVGIASVTDLKLNFLGSILSGLAIATTCVGQILTNTIQRKLKVTSTQLLYQSAPYQAAILFATGPFVDQLLTSRSVFAHKYTFPVVGFIVLSCVIAVSVNFSTFLVIGTTSPVTYQVLGHLKTCLVLSFGYTLLRDPFTARNILGILVAIFGMALYSYFLVREGRKKAAGDALPVSQMPEKETEPLLATTKDGGDAKKANGVAHDC

SEQ ID NO: 7867 - DNA, 1005 bp, Panicum virgatum
  misc_feature: Ceres CLONE 1958631
  misc_feature: Encodes the peptide sequence at SEQ ID NO. 7868
agcaaacacaccacctcatctcatctcatctcattctcagctagctgctgcagagagagacgtgttagcgacgacgcggatcggaggcagctgcaaccggagcaggaggatttcaaaagttgggagatggaaaccgtcgtgggcgacctcatggccaccgagctcaggctcggcctcccgggaaccatcgacgagatgaaggccgcggcgccgtcgacgcctaggggaaagaagcgcaccaccaccgacgccgtggagggcgccgccgccaaggaggccagcaagcgtgatgccgaggcagcacctcctgcagccaaggcccccgtcgtaggttggccgccggtgaggtcgtaccggaagagctgcttccaggcgagcagcaagcagagcaaggcgaccaaggaggaggcggcgcccagcagcaacgccgccgcgccatccgcggccgcgaacacctccaccaccgccggcgccttcgtcaaagtgagcatggacggcgcgccctacctgaggaaggtggacctgaggatgtacaagggctacagggagctccgggaggccctggaggccatgttcgtctcctccaacagcggcggcgccaacctgtccgagttcgccgtcacctacgaggacaaggacggcgacctgatgctcgtcggcgacgtgccattcgagatgttcactagcacttgcaagaagctgaggatcatgaagagatctgaagccacaggtctgggatcagcgagacaatgaagatggatctgagggccaggcagcttgtcatgagcttcttgtttctttctattatttttgttcttctggttggatccccaagccaaaggatgagcttggtgcatcaaagtgctcacatggatgtgagcggctttggttctgtaagacatttaggtcttttagcagcacaaaggagatgtgagactgcttcagttaactccccatgtgtttgtacaaacgaaacacagttatattgatcgttggttattactt

SEQ ID NO: 7868 - protein, 208 aa, Panicum virgatum
  misc_feature: Ceres CLONE 1958631
  misc_feature (1)..(208): Pfam Name: AUX_IAA Pfam Description: AUX/IAA family
METVVGDLMATELRLGLPGTIDEMKAAAPSTPRGKKRTTTDAVEGAAAKEASKRDAEAAPPAAKAPVVGWPPVRSYRKSCFQASSKQSKATKEEAAPSSNAAAPSAAANTSTTAGAFVKVSMDGAPYLRKVDLRMYKGYRELREALEAMFVSSNSGGANLSEFAVTYEDKDGDLMLVGDVPFEMFTSTCKKLRIMKRSEATGLGSARQ

SEQ ID NO: 7869 - DNA, 989 bp, Panicum virgatum
  misc_feature: Ceres CLONE 1958692
  misc_feature: Encodes the peptide sequence at SEQ ID NO. 7870
tttcataatggctcacaggtaaaaggctcccactcatctgcaatccccaaaacccacgcacgccggcgtcggccggagaacctccccgccggccgccgccatgccgccgcctctccaggcccaccgcctcttcatctcccaccgccgcctccccactcttgcccgccgccgcttcgccgccgtctcttccgtccaatccgctcccgccacgacctcggtcccgggccccgccacatcctccatcctctccatccgcgagtccctgctctcaggcgagaggaccgctgcggacatcacctccgagtacctatcccgcctccgccgcaccgagccgagcttgcgcagcttcatccacgtcgcggacgccgccgccgagcgggaggcggaggagctcgaccggaggattgcctccggggagaaggatgctgtagggccgctcgctggagtgctggtgggagtgaaggacaacctctgcaccgccaacatgccctccactggcgggtcgcggatacttgacggataccggccggcgtacgacgccacggcggtgcggcggctgcgggaggctggcgccattgtggttgggaagacaaacctcgacgagttcggcatggggagcaccaccgagggctccgcgtttcaggtttggccgattggggaccggattctcataccatttttacggggagcatttacgtttgaagcattgccgctgaggatggctcgggctcaaatattgaaattaagtgtcaagtatgatttttttacgttggttgtaacaaacaacgacacgaaaatatttgtaacgctgccaaactcttttcacgtttgtggttggttcaaggacaatgttagggccatattaatgcaaggcagctctaagagaagtagttggtttgttgcgtgccactgttgatgttgaagtgtcgaaatttcttccaaagaggaattaaacctgaattggaatcgaaaaaaaaaaaaaaaaaaaa

SEQ ID NO: 7870 - protein, 271 aa, Panicum virgatum
  misc_feature: Ceres CLONE 1958692
  misc_feature (1)..(119): Pfam Name: Amidase Pfam Description: Amidase
MPPPLQAHRLFISHRRLPTLARRRFAAVSSVQSAPATTSVPGPATSSILSIRESLLSGERTAADITSEYLSRLRRTEPSLRSFIHVADAAAEREAEELDRRIASGEKDAVGPLAGVLVGVKDNLCTANMPSTGGSRILDGYRPAYDATAVRRLREAGAIVVGKTNLDEFGMGSTTEGSAFQVWPIGDRILIPFLRGAFTFEALPLRMARAQILKLSVKYDFFTLVVTNNDTKIFVTLPNSFHVCGWFKDNVRAILMQGSSKRSSWFVACHC

SEQ ID NO: 7871 - DNA, 728 bp, Panicum virgatum
  misc_feature: Ceres CLONE 1958816
  misc_feature: Encodes the peptide sequence at SEQ ID NO. 7872
agtgcctaccccacagacgacgcgcaccaccagcacgccgacgactgaacgaggcgaggcgagaaccggccgaggcggaggcgatgggcggcggcggcgcgcacggcggcaccacctacaagggctacaccatcccgcacaacaagcgctggcacaccgtcgccggcaagggcctctgcgccgtcatgtggttttgggttttctacagggctaagcaggacggtgctgtgctcttgggcttgcgccatccttgggatgggcatgatgatcactctcatggacatggacatggacatggacatggacatggacatgaacatgaggcatcatcgtcatcgtcttcttctcattgagttcactacaacttgcagctgatggtgatgcgatgttccaactaaagtttcagttaataaattctgccccgctgcatgggagtcatgttgtttgcgagttgcttagcacaaactgttttcctgacaattgtgcttatgtatttgatttcaagcttcagttgatatgttgtgggaaagaatttggtgtatgtcgcttctcgttgtgaccactacctgtgccccttgctctgctcttgcccataagacccaaacatctttggacacagtctctttttgtattttgtatttattggggcttgatagcaactcagtcgagaagaggaatggcgactcgtggtgcttttatttttggttgaaaaaaaaaaaaaaaaaaaa

SEQ ID NO: 7872 - protein, 89 aa, Panicum virgatum
  misc_feature: Ceres CLONE 1958816
  misc_feature: Great-hit functional homolog of the protein sequence given in SEQ ID NO 9351
  misc_feature (124)..(153): Pfam Name: Cation_efflux Pfam Description: Cation efflux family
  misc_feature: Useful for making plants with modulated flowering time
  misc_feature: The plant flowers significantly late compared to wild-type.
MGGGGAHGGTTYKGYTIPHNKRWHTVAGKGLCAVMWFWVFYRAKQDGAVLLGLRHPWDGHDDHSHGHGHGHGHGHGHEHEASSSSSSSH

SEQ ID NO: 7873 - DNA, 601 bp, Panicum virgatum
  misc_feature: Ceres CLONE 1958870
  misc_feature: Encodes the peptide sequence at SEQ ID NO. 7874
ccaaaccttcccttctcccggactccctcctccttgctcttgcttccctggcggcgacgactgggcgtgcgccggcgccatttgtgacatcttcgcccagcccttggccggcgacgggcatccaccagcttcaagcagaagacaccacttcttcaagatgccaagggccccgggcgatgcaaagcttctgatccagtccctgaacaaggcatatgctgccacaccaacaaatcttaagattatcgacctgtatgtgatttgtgcagtcgctactgccgtgattcagattgcgtacatgggcttagctgggtcattccctttcaactccttcctctcaggtgtcctttcatgcataggaactgcagtacttgctgtttgcctccgcattcaagtgaacaaagacaacaaggaatttaaggatcttcccccggaaagggcctttgctgactttgttctgtgcaacctggtgctccacctggtgatcatgaacttccttggataagaaactaccggacactgagtggttagattttgtagccccagattgtggtcgctgatcagtgcgttttaatgtttggaactgtcataatgtcgagtatcc

SEQ ID NO: 7874 - protein, 114 aa, Panicum virgatum
  misc_feature: Ceres CLONE 1958870
  misc_feature (7)..(114): SWISSPROT Homolog: EC 2.4.1.119 Dolichyl- diphosphooligosaccharide--protein glycosyltransferase subunit DAD1
MPRAPGDAKLLIQSLNKAYAATPTNLKIIDLYVICAVATAVIQIAYMGLAGSFPFNSFLSGVLSCIGTAVLAVCLRIQVNKDNKEFKDLPPERAFADFVLCNLVLHLVIMNFLG

SEQ ID NO: 7875 - DNA, 1347 bp, Panicum virgatum
  misc_feature: Ceres CLONE 1959380
  misc_feature: Encodes the peptide sequence at SEQ ID NO. 7876
acacagctatctcccaacattcatccggacacagaccgaataactcaactcaccatgaagctctctgcgtccatcgccctggctgcggccatgggagcctcggcaaccttcaacctccccgcgttcgagcagcttgccatcgactcaggcctcgccctatccggcctcaacggtcttgctctgttgcagtcggccaccaagtacggcggctcgtgcaacattggcaacgtcaagatccgcagggagtggaggacgctatccaaggcccagcgcaagagctatatcaaggccgttcagtgtctccagaagagccctagcctcctccccgcgggtgtctcggcggggtccaagaccctttttgacgactttgtctacgtgcacctgcaatcgacgcccttcatccacttcaccggcaacttcctcatctggcaccggaactacatccacgagtacgagaagaagctcaatgcctgtggttacaaggatgcgctcccctactgggagtggggtttcgatgccagcgcccctcatctctcccccatctttgacgggtctgacacctccatgagtggtgacggcgagttcattccgggtcctgacctctctcttgagattcctggcaacgccgaacccgtcgtgctgaagaagggcaccggtggcggctgtgtcaagacgggcccctttgccgacatgacggtccggctgggccccatcacgcagccggacccgactgcggacaacccgcgttgcctgaagcgcgacctgaacgccgatgccggctcgaggttctcgagcttccggaacacgaccgacctgatcatcaactcgcccaacattgaaatcttccggacgaccatggaggccgaccccaactacattcccaactcgctcggtgtgcacggtggcggccacttcatgatcagcggcgaccccggctctgacgctttcatctcgtcgggcgacccggccttctacctccaccacgcccagatcgaccgcgtctactggatctggcagatgctcgacttccaaaaccgccagggcgtttttggcaccaacaccttgctcaacgcgccccccagcgccaacaccactgttgaggacactgtcgacgtcggccacatcggggccccgatcaagatcaagaacctcatgagcacgactggccagaatggctcgccgctctgctacatctacctttaaggtgcggattgggcttgtagcgacaaaggttggttaactcgcggcgttggtatgggaacaagagcgatagttattgttttttgttggtctctagcgaatgtttgagccttgagctacagatatagtttaatatctcttgaaacg

SEQ ID NO: 7876 - protein, 382 aa, Panicum virgatum
  misc_feature: Ceres CLONE 1959380
  misc_feature (2)..(321): Pfam Name: Tyrosinase Pfam Description: Common central domain of tyrosinase
MKLSASIALAAAMGASATFNLPAFEQLAIDSGLALSGLNGLALLQSATKYGGSCNIGNVKIRREWRTLSKAQRKSYIKAVQCLQKSPSLLPAGVSAGSKTLFDDFVYVHLQSTPFIHFTGNFLIWHRNYIHEYEKKLNACGYKDALPYWEWGFDASAPHLSPIFDGSDTSMSGDGEFIPGPDLSLEIPGNAEPVVLKKGTGGGCVKTGPFADMTVRLGPITQPDPTADNPRCLKRDLNADAGSRFSSFRNTTDLIINSPNIEIFRTTMEADPNYIPNSLGVHGGGHFMISGDPGSDAFISSGDPAFYLHHAQIDRVYWIWQMLDFQNRQGVFGTNTLLNAPPSANTTVEDTVDVGHIGAPIKIKNLMSTTGQNGSPLCYIYL

SEQ ID NO: 7877 - DNA, 617 bp, Panicum virgatum
  misc_feature: Ceres CLONE 1959465
  misc_feature: Encodes the peptide sequence at SEQ ID NO. 7878
attataattttaaaatattttgaaatttaccaagcatggctcttaagagaatccagaaggaacttatagatctcggcaaggatccccccgcaaactgctctgctggtccccaagacgaaaaggaccaattccactggcaagctaccatcatgggacctgatgacagtccatatgccggtggtgtctttttcttgaacatacatttccccacagactatccgtttaagccaccaaagattaacttcgtcaccagaatctatcaccccaatataaactccaatggaagcatctgcttggatatcttaaaagaccaatggagccctgctcttacgatttctaaagttctgctttccattagttctctgttgacggaccctaatcccgacgatccactcgttccagaaattgcccatctctgcaaaaccgataaagccagatatgaagccactgctagagaatggaccaagaaatacgctatgtagagttaagagttaagacacgtaggaatagatattgtaagatctctatagaatgtatgcgtatttttaatgagtctaataaagaaactcacacttcatgtcccttatactttcgtgtgaagagcacgacagcgcgct

SEQ ID NO: 7878 - protein, 148 aa, Panicum virgatum
  misc_feature: Ceres CLONE 1959465
  misc_feature (1)..(148): SWISSPROT Homolog: EC 6.3.2.19 Ubiquitin-conjugating enzyme E2 4
  misc_feature (1)..(148): SWISSPROT Homolog: EC 6.3.2.19 Ubiquitin-conjugating enzyme E2-16 kDa
MALKRIQKELIDLGKDPPANCSAGPQDEKDQFHWQATIMGPDDSPYAGGVFFLNIHFPTDYPFKPPKINFVTRIYHPNINSNGSICLDILKDQWSPALTISKVLLSISSLLTDPNPDDPLVPEIAHLCKTDKARYEATAREWTKKYAM

SEQ ID NO: 7879 - DNA, 983 bp, Panicum virgatum
  misc_feature: Ceres CLONE 1959469
  misc_feature: Encodes the peptide sequence at SEQ ID NO. 7880
aacaaacgctaaaaaagtaacagtttctgtactttattgcgacgctgactttaccagcgctcgtcggaaccctctcaccgtcgtagacagaccactcgctatggccctccgccgcattcaaaaagagctgaaggatgtgcagaaggacccgccgtccaacacgtccgcaggccccgtgacggaatcggacctgttcaactggaaggccacgatcatcggcccggaagactcgccgtacgccggcggtctcttcttcttgaacatccactttccgtcggactacccgttcaagccgccgcgcctgcagttcacgacgaagatctaccacccgaacatcaacgcgaacggcggcatctgcctggacatcctcaaggaccagtggtcacccgcgctgacgatcagcaaggtgctcctgtcggtgtgctcgctgctgacggacccgaaccccgacgatccgctcgtgcccgacgtggccaagctgtacaaaaccgatcgtgcgaagttcaaccagacggcccgcgaatggacgcagcgctacgcgacataaaagcccgcacgcgggtgaatggcgtgtgtgtcgcactccaacgcaaaagagacagctaggaaatggaaatacgacgagaacacaccggccgcggagatattctccccgcggcccggtgcttatctatgtgcccttaggtctctcgggtccccccgcataccacgacgacgctgcgctgatgtgccgagatgctaccgtcatcgtcgcaccaactccctcctcctcccactcggcgtcgccccgcggggcggcacccgcttctttgcattgcgcccacacgccgtgcgtggcgcggacaccaccgtcgcgagcgcttccgtcgcccgtatgatcgttctgccgcacatggcagcactgatcgagcctcggggtgcgttacttcggcggcgcaccaaccccgcaaaaacagtacgacgaaaaaaaaaaaaaaagaaaa

SEQ ID NO: 7880 - protein, 148 aa, Panicum virgatum
  misc_feature: Ceres CLONE 1959469
  misc_feature (1)..(147): SWISSPROT Homolog: EC 6.3.2.19 Ubiquitin-conjugating enzyme E2 4
  misc_feature (1)..(147): SWISSPROT Homolog: EC 6.3.2.19 Ubiquitin-conjugating enzyme E2-17 kDa 11
MALRRIQKELKDVQKDPPSNTSAGPVTESDLFNWKATIIGPEDSPYAGGLFFLNIHFPSDYPFKPPRLQFTTKIYHPNINANGGICLDILKDQWSPALTISKVLLSVCSLLTDPNPDDPLVPDVAKLYKTDRAKFNQTAREWTQRYAT

SEQ ID NO: 7881 - DNA, 1266 bp, Panicum virgatum
  misc_feature: Ceres CLONE 1959493
  misc_feature: Encodes the peptide sequence at SEQ ID NO. 7882
gagcgaggctagctatccggcggccggagctgctgcctgatgagctagctgtgactgtgaggctgtgagctaccaccacacactggcgcactgcaccgacagaccacacactgctagcttagctcctggacaataattgattaattaattagcagttcgccggcggccggatcggaatcggattcgtcggacggagatactagcagctagctgctagctgctccgatatgatcccgtacgcgacggaggcggaggcggaggcggcgctggggcgcgccatgacgtgggcggaggcggcgtggttccggtactcggcggcgacgccggactactgcctctactgccacaacgtggtgatcctgctggtggtgtacacgctggcgccgctgcccctggcgctgctggagctccgggcgccggcgaagctgacctcgccgtacaaggtgcagccccgggtgcggctgacggcggccgagttcctccgctgctataaggccacggcgcgcttgctgctcctcaccgtcggcgcgctgcagctcgtctcctacccggccgtcaggatggtcgggatccggacgggcctcccgctgccgtcggcgggggaggcggcggcgcagctggtggtctacttcctggtggaggactacctggggtactggctgcaccggctgctgcacacggcgtggggctacgaccgcatccaccgcgtccaccacgagtacgccgcgcccatcggctacgccgcgccgtacgcgcactgggcggaggtgctcatcctcggcgtgccggcctttgcaggcccggccatggtgccctgccacatgaccaccttctggctctggttcgtcctccgccacgtcgaggccgtcgacacgcacagcggcttcaccttccccttgagccccaccaagttcatccccttctacggcggcgccgagtaccacgactaccaccactacgtggggaggcagagccagagcaacttcgcctccgttttcacattctgcgactacatctacggcacggataaaggttacagataccataagcaggcggcagagagcttagccaagatgaaggacatggcgatgcacaatgatgagaaagcaggaggccttgctgcattcaacggctggaagcaagattaactcactgccatgctagcactgcagaggcagcagcgcgctattagccagtgcccatcatcatgcatgtggacgtcgtatgtatgtccagatccgatccataaatcttcagatgtactat

SEQ ID NO: 7882 - protein, 306 aa, Panicum virgatum
  misc_feature: Ceres CLONE 1959493
  misc_feature (1)..(207): Pfam Name: Sterol_desat Pfam Description: Sterol desaturase
MIPYATEAEAEAALGRAMTWAEAAWFRYSAATPDYCLYCHNVVILLVVYTLAPLPLALLELRAPAKLTSPYKVQPRVRLTAAEFLRCYKATARLLLLTVGALQLVSYPAVRMVGIRTGLPLPSAGEAAAQLVVYFLVEDYLGYWLHRLLHTAWGYDRIHRVHHEYAAPIGYAAPYAHWAEVLILGVPAFAGPAMVPCHMTTFWLWFVLRHVEAVDTHSGFTFPLSPTKFIPFYGGAEYHDYHHYVGRQSQSNFASVFTFCDYIYGTDKGYRYHKQAAESLAKMKDMAMHNDEKAGGLAAFNGWKQD

SEQ ID NO: 7883 - DNA, 1426 bp, Panicum virgatum
  misc_feature: Ceres CLONE 1959564
  misc_feature: Encodes the peptide sequence at SEQ ID NO. 7884
actcagctcacctgcactacactgctctggactagtataagctgccattgttcttgagacaagcagcagacagcaggtgcgatcgagagcgcgagatggaggcggccattcctctgctgacgccgtacaagatgggcgacttcgagctgtcgcaccgggtggtgatggcgcccctgacgcggcagcgctcctacggcaacgtgccgcagccgcacgccgccgtctactactcgcagcgcgccaccaagggcggcctcctgatcaccgaggccacgggcgtctccgacacggcgcagggctacgccgacaccccgggcatctggacggccgagcaggtgggcgcgtggcggcccatcgtcgacgccgtccacgccaagggcgccgtcttcttctgccagctctggcacgtcggccgcgtctccaccaccgcgttccagcccggcggcgcggcgcccatctccagcaccgaccgcgcggtgccgccccagcggagcttcgacggccacatggaggagttctccgcgccgaggcggctggaggcgcgcgagatccccgccatggtggacgacttccgccgcgccgcgcggaacgcgctcgacgccgggttcgacggcgtcgagatccacggcgccaacgggtacatcatcgagcagttcctcaaggacagcgccaacgaccgcgccgacgagtacggcggcacgctcgagcggcgctgccgcttcgcgctcgaggtcgtggaggccgtcgccggcgaggtcggcgcgcgccacgtcggggtccgcctctcgcccttcacggactacatggactgccacgactccgacccggaggccctggcggggtacctcgtcggcaagctcagcgccgtcggcgtgctctactgccacatgatcgagccgcggatggcgctggtggacgggcggcggcagatcccgcaccggctgctgccgtacaggaaggcgttccggggcaccttcatcgccgccggcgggtacgacagggcggaggggaacaaggtggtggaagaggggtacacggacctggtgtccttcggccggctgttcctggcgaacccggacctgcccaggaggttcgagatccccgacgcgccgctcaacaagtacgaccgcgccaccttctacacctccgaccccgtcgtcggctacaccgactacccgttcctcgacgacgtcgtcgtccaggccgcctgatggtcgtccatcgacctctgctcttccagcgtgcttgaatctgttgacccccactcgtcgtctgcagccttgtactctgctgctttattggctctgcacgcatgatatatatgctatgttacgaatagcaaaataaactaagtttgatccgtattttcccccccaagggaattgtatcatcaaatttacataaagtttgagtcgtatttgttgcc

SEQ ID NO: 7884 - protein, 371 aa, Panicum virgatum
  misc_feature: Ceres CLONE 1959564
  misc_feature (1)..(332): Pfam Name: Oxidored_FMN Pfam Description: NADH:flavin oxidoreductase / NADH oxidase family
  misc_feature (1)..(334): Pfam Name: Oxidored_FMN Pfam Description: NADH:flavin oxidoreductase / NADH oxidase family
  misc_feature (1)..(332): Pfam Name: Oxidored_FMN Pfam Description: NADH:flavin oxidoreductase / NADH oxidase family
  misc_feature (1)..(336): Pfam Name: Oxidored_FMN Pfam Description: NADH:flavin oxidoreductase / NADH oxidase family
  misc_feature (1)..(333): Pfam Name: Oxidored_FMN Pfam Description: NADH:flavin oxidoreductase / NADH oxidase family
  misc_feature (4)..(364): SWISSPROT Homolog: EC 1.3.1.42 12-oxophytodienoate reductase 1
  misc_feature (4)..(364): SWISSPROT Homolog: EC 1.3.1.42 12-oxophytodienoate reductase 2
MEAAIPLLTPYKMGDFELSHRVVMAPLTRQRSYGNVPQPHAAVYYSQRATKGGLLITEATGVSDTAQGYADTPGIWTAEQVGAWRPIVDAVHAKGAVFFCQLWHVGRVSTTAFQPGGAAPISSTDRAVPPQRSFDGHMEEFSAPRRLEAREIPAMVDDFRRAARNALDAGFDGVEIHGANGYIIEQFLKDSANDRADEYGGTLERRCRFALEVVEAVAGEVGARHVGVRLSPFTDYMDCHDSDPEALAGYLVGKLSAVGVLYCHMIEPRMALVDGRRQIPHRLLPYRKAFRGTFIAAGGYDRAEGNKVVEEGYTDLVSFGRLFLANPDLPRRFEIPDAPLNKYDRATFYTSDPVVGYTDYPFLDDVVVQAA

SEQ ID NO: 7885 - DNA, 1459 bp, Panicum virgatum
  misc_feature: Ceres CLONE 1959567
  misc_feature: Encodes the peptide sequence at SEQ ID NO. 7886
gtgggggtgttcttcaatttttccccaagcatctcgtccaatccaatccaaattagtactgtagtagtgtagctgtagaaattcaataagagagctcgagggaggggattgcgaaggtgagagattggattagttcccgtcgatcggattccatcggatcctacctataccaaaccctaaaggaaatccatgtcgtcctcgtcgtcctccccggcggcgcagcgctactactgccaccagtgtgaccgcaccgtctccatctcgccgcccgcctccccggacgacgacgtcctctgcccccgctgcggcggcggtttcgtcgaggagcttcacccagatgccagccccgccgcccccgcggccttcctcccctcgccgccctccttcgatctccgccactccggcgacctctccgcctttttcggcccgccctccccggagtcgcccgccccgggcctcttcgacccctccaacttccttcacgaccacttcggcggcctcctctccggcggcgccaccatccagatcgtcctcgagggcgggagcgccgcgcccctcctcgccccgggcgtcagcttcgcggactacttcatgggcccctcgggcctcgagcagctcatccagcagctcgccgagaacgaccccaaccgctacggcacaccgcccgccgccaagtccgccgtcgccgcgctccccgacgtcgccgtctccgccgacatgatgcaggccgacgggggcgcgcagtgcgccgtctgcatggacgacttccacctagggtccgccgccaagcaactaccgtgcaagcacgtcttccacaaggactgcatcctcccgtggctcgacctccacagctcctgccccgtctgccgcttcgagctgcccacagacgacccggattacaaccatcagcgcgcgtcgtccgcccccgcccccgcccccgcccccgcccccgctgcctcctcccccagggtggccgagaggaggttcaggatatcgctgccttggcctctcagggctgccttcggtgctgctgcccaggctgagtccagccatcctaccaatgatgatgtgcctccttctggtgccaacaataacgaccatgatgcaagtggtggtggtcctcaaactcaaagcgaatatgatgatctagactgaggcctcatagtcttctggtaaagagccgttgtgcgaaacaaagagggcaaggtaacgatgcttggtaggggacattcatcatgaaacaaaaggccggtgcggcactgtagcctgttcgccataacgaagagaaggcttttgctttatttctcattggtacttggatgtaaagaatagaaaggtggaattttggtactttggatgttggtgtagggattattattattattcctcttagggtggttaggagcatgactaccttttggcagccgcagatggaggacaaaaaaaaaaaaaaaaaaaa

SEQ ID NO: 7886 - protein, 321 aa, Panicum virgatum
  misc_feature: Ceres CLONE 1959567
  misc_feature (1)..(41): Pfam Name: zf-C3HC4 Pfam Description: Zinc finger, C3HC4 type (RING finger)
MSSSSSSPAAQRYYCHQCDRTVSISPPASPDDDVLCPRCGGGFVEELHPDASPAAPAAFLPSPPSFDLRHSGDLSAFFGPPSPESPAPGLFDPSNFLHDHFGGLLSGGATIQIVLEGGSAAPLLAPGVSFADYFMGPSGLEQLIQQLAENDPNRYGTPPAAKSAVAALPDVAVSADMMQADGGAQCAVCMDDFHLGSAAKQLPCKHVFHKDCILPWLDLHSSCPVCRFELPTDDPDYNHQRASSAPAPAPAPAPAASSPRVAERRFRISLPWPLRAAFGAAAQAESSHPTNDDVPPSGANNNDHDASGGGPQTQSEYDDLD

SEQ ID NO: 7887 - DNA, 803 bp, Panicum virgatum
  misc_feature: Ceres CLONE 1959668
  misc_feature: Encodes the peptide sequence at SEQ ID NO. 7888
aatcaaaatttgtgaaaaactaataacccaagccaacgtcttaaatcctatttatcccatgaaccaacctattcaaggacaacaagaccccgagaccaacaaccaaatcgaatatcacgtcagagaaatcctcaaactccttaccatcaccaatgaagaagtcctcagagaaaccccaaggagattccgtaaaaccctccaaaatagaacagcaagcaacagacaagaactcgacaagaatgtactcaagacctttgaaatggagaaccccggcatcgtcattgtgaaggatgtcgaagtgaactccatctgtgaacatcatctgatgcccttctttggaactgcatctgttgcttatctcccaaagaaagaagtcttgggactcagtaaagttgccagaattgtaaactattgttgtaaaaaggagaatcttcaagaaagattgacagaagagatcatgaagaccatcaataatgcagtggacaatgatggtatttgtgtgttagtgaagtgcaagcacttctgcatgatcttgaacgatgaaatcaaaagcaagggtgaaactatcactatagttaagaccggaaagtttaaggaagatgacaagctgttcaaggagttccaagacagtttgaagttataaatatgtattaattgtttcaagggcaattattgagctttcttttgagcaattaaatttatattttgggttatgagtatgtactttctgacctaacattctataattgctttgctttgctttaataacaactctcttcgttcaaaaaaaaaaaaaaaaaaaa

SEQ ID NO: 7888 - protein, 194 aa, Panicum virgatum
  misc_feature: Ceres CLONE 1959668
  misc_feature (2)..(77): Pfam Name: GTP_cyclohydroI Pfam Description: GTP cyclohydrolase I
MNQPIQGQQDPETNNQIEYHVREILKLLTITNEEVLRETPRRFRKTLQNRTASNRQELDKNVLKTFEMENPGIVIVKDVEVNSICEHHLMPFFGTASVAYLPKKEVLGLSKVARIVNYCCKKENLQERLTEEIMKTINNAVDNDGICVLVKCKHFCMILNDEIKSKGETITIVKTGKFKEDDKLFKEFQDSLKL

SEQ ID NO: 7889 - DNA, 494 bp, Panicum virgatum
  misc_feature: Ceres CLONE 1959782
  misc_feature: Encodes the peptide sequence at SEQ ID NO. 7890
aatcacaagcgaagcagagcacaagcaacaagaagcaccacaccttcttcagcgccagttcctgctcgtgatcaacacaaggatcagcatggcttgctgcagcggcaactgcgggtgcggcgccggctgcaagtgcggcaccggatgcggcggctgcaagatgtcccctgacgtggaggccacctccaccaccaccaccatggtcatcgccgccgccaccagcaaggcgagctccggcgggttcgaggcggcgacggagagcggcggctgcgactgcagcacctgcaagtgcggcaccagctgcggctgcaactgaggcagcgccgcgatggagcgtactatatagtagcaggccagcgtttaaataagatcttgattggcaactgaaaattgtggtcaactgaacactactgtatcaaggaaattgatgcgcctgcctgttggggaagaagttacatgcccccttgaaatgaagacattactacagtttggcc

SEQ ID NO: 7890 - protein, 75 aa, Panicum virgatum
  misc_feature: Ceres CLONE 1959782
  misc_feature (1)..(79): Pfam Name: Metallothio_2 Pfam Description: Metallothionein
MACCSGNCGCGAGCKCGTGCGGCKMSPDVEATSTTTTMVIAAATSKASSGGFEAATESGGCDCSTCKCGTSCGCN

SEQ ID NO: 7891 - DNA, 559 bp, Panicum virgatum
  misc_feature: Ceres CLONE 1960193
  misc_feature: Encodes the peptide sequence at SEQ ID NO. 7892
atttggtcaatcgagcagctagccatcctgctagtaagtgacacagcaaactatctacaacgaacatggccgccgtcggagagcactacatgaggggcctctacggcgacgactatcctggccagcagcggtcggcgcccgcggcggtagccaaggcgctggccgccttctccatgctgctgctgtcggggctggcgctgacgggcacggtgctggcgctcatcgtggcgacgccgttgctggtgatcttcagccccgtgctggtgcccgctgccatcacggtggcgctgctcacggcgggcttcgtgtcgtcgggagggttcggcacggcggcggtgggcgtgctggcgtggatgtaccgctacctcaagacgccgccggagcagcagctatccctatccaccaagcactgggcgcaccaacgcctcgagcactgatctccatctcctgtactaccagttcgggttgcggctgtgagcaatataactaaaataatactagaataagtgtgtttgcaacttcaacaatttaattattcctgcaccttgtactctgatct

SEQ ID NO: 7892 - protein, 123 aa, Panicum virgatum
  misc_feature: Ceres CLONE 1960193
  misc_feature (3)..(99): Pfam Name: Oleosin Pfam Description: Oleosin
  misc_feature (4)..(101): Pfam Name: Oleosin Pfam Description: Oleosin
MAAVGEHYMRGLYGDDYPGQQRSAPAAVAKALAAFSMLLLSGLALTGTVLALIVATPLLVIFSPVLVPAAITVALLTAGFVSSGGFGTAAVGVLAWMYRYLKTPPEQQLSLSTKHWAHQRLEH

SEQ ID NO: 7893 - DNA, 409 bp, Panicum virgatum
  misc_feature: Ceres CLONE 1960637
  misc_feature: Encodes the peptide sequence at SEQ ID NO. 7894
acacatccactctctctcttacacacaacaaccaacccatcttacatctttgcaaacatgtctgacgctggacgacaggacttcaccgacaaggcctcttcggctcttaagcccgactcgcagaagggtgttggcgagaaggccaaggagaacctcgacaaggccgccgccactctccagcccgactcgaccaagtcggactcgcagaagctcggcgacaaggtcagcggctcggacaagtcggacgagtcgatcctcgacaaggccaagaacgccgtcggcctgggcaacaacaacaacgtctaagctctcgtagccactcccatctgatgtcgctgtcgtttcctcacacagcgcaccgatggcgtaacccctatgcaatcaaatgaataccacacaaatactattg

SEQ ID NO: 7894 - protein, 82 aa, Panicum virgatum
  misc_feature: Ceres CLONE 1960637
  misc_feature (2)..(53): Pfam Name: HSP9_HSP12 Pfam Description: Heat shock protein 9 / 12
MSDAGRQDFTDKASSALKPDSQKGVGEKAKENLDKAAATLQPDSTKSDSQKLGDKVSGSDKSDESILDKAKNAVGLGNNNNV

SEQ ID NO: 7895 - DNA, 651 bp, Panicum virgatum
  misc_feature: Ceres CLONE 1960767
  misc_feature: Encodes the peptide sequence at SEQ ID NO. 7896
  misc_feature (649)..(649): n is a, c, t, g, unknown, or other
  misc_feature (650)..(650): n is a, c, t, g, unknown, or other
atcctgcgtcaagtcatgcgcgttactgctgccctactgtccgccatggccaaccccaaggtgttcttcgacgttgccatcggcggcaaggcggccggccgcatcgagttcgagctgttcgcggatgtggtgcccaagacggcggagaacttccgcgcgctgtgcacgggcgagaagggcaccggccgctccggcaagccgctgcactacaagggctccacgttccaccgtgtcatccctgagttcatgctgcagggcggtgactttacgcgcggcaacggcacgggcggcgagtccatctacggcgagaagttcgcggacgagaacttcaagctgaagcacacgacgccgttcctgttgtccatggccaacgcgggccccggcaccaacggcagccagttctttatcaccacggtgccctgctcgtggctggacggcaagcacgtcgtgttcggcaaggtcaccaacggcagcaacgtggtcaaggcggtggaggcggtgggctcctcgtcgggcacgacgcgccagccggtggtgatcaccgactgcggccagctggcgtaaacggcgtccctcggcgccgtacggcccgcgcgcagtcgggtgcgcagcacgcagtacacctgtgaatcctagagtctcaggcttnnc

SEQ ID NO: 7896 - protein, 182 aa, Panicum virgatum
  misc_feature: Ceres CLONE 1960767
  misc_feature (1)..(167): Pfam Name: Pro_isomerase Pfam Description: Cyclophilin type peptidyl- prolyl cis-trans isomerase/CLD
  misc_feature (11)..(181): SWISSPROT Homolog: EC 5.2.1.8 Peptidyl-prolyl cis-trans isomerase
MRVTAALLSAMANPKVFFDVAIGGKAAGRIEFELFADVVPKTAENFRALCTGEKGTGRSGKPLHYKGSTFHRVIPEFMLQGGDFTRGNGTGGESIYGEKFADENFKLKHTTPFLLSMANAGPGTNGSQFFITTVPCSWLDGKHVVFGKVTNGSNVVKAVEAVGSSSGTTRQPVVITDCGQLA

SEQ ID NO: 7897 - DNA, 721 bp, Panicum virgatum
  misc_feature: Ceres CLONE 1960775
  misc_feature: Encodes the peptide sequence at SEQ ID NO. 7898
cttctccgcttcatcccctcgccgtcgtcggagccgaaggtgcgggcgcttcctcgccgccggtcggggaccgaggaatggccgggacggcggcgtccgtggagcgcgtgagggaccgcgccaccggcctcgacaagttcgtcctccgcgaggtccggggcagctccgtcgaggtatatttatatggaggtcaggtgacattttggaaaaataacttcggtcatcaactgctttttgtcagtaaaaaggctacttttaaaccgccaaaagccattcgtggtggcatccaaatttgcttccctcaattaggtagccatggagttcttgaacagcatggatttgcaaggaaccgattctggagtgttgatgaaagtccacctccttttccagttgctacttccaattgtcatattgacttgatactcaagtcatgtcaagaggatttgaaggtctggccacatagctatgaatttcgtctgagagttgcacttagtccaaggggagatcttattctcacatctcgaattaaaaatatgagctcagatggcaagccattccaatttacatttgcatatcatacttacttttcggtatctgatatcaggtacattgcaaaatgacatttgtctgccccaccaagctattttcagcatctcttatggccctctgtagaagaactgatagctgataggaaaattgctgcaatatacgttgaacttcg

SEQ ID NO: 7898 - protein, 180 aa, Panicum virgatum
  misc_feature: Ceres CLONE 1960775
  misc_feature (1)..(158): Pfam Name: Aldose_epim Pfam Description: Aldose 1-epimerase
MAGTAASVERVRDRATGLDKFVLREVRGSSVEVYLYGGQVTFWKNNFGHQLLFVSKKATFKPPKAIRGGIQICFPQLGSHGVLEQHGFARNRFWSVDESPPPFPVATSNCHIDLILKSCQEDLKVWPHSYEFRLRVALSPRGDLILTSRIKNMSSDGKPFQFTFAYHTYFSVSDIRYIAK

SEQ ID NO: 7899 - DNA, 1270 bp, Panicum virgatum
  misc_feature: Ceres CLONE 1961048
  misc_feature: Encodes the peptide sequence at SEQ ID NO. 7900
aaaaaaaaaaaaaaaaaaaaaaaaaagtcagatcggatcccttgacgagtcctctcgcctccctcgccaatcgccatggcggcgctactgctgcgtaggctcgccggggcccaccgcggccgcgtcccgctgggggccgccgccgtcgccgcctgtggtggagccgcgctcttctacgcctcgtcttcccctaccgttgcgcacctggagaagggcgaggaagccggtgagaaagttgcacttaaccctgataagtggttggagttccaactccaagagaaggcgaaagttagccacaactcacagttattcagattttcatttgacccaaatactaagctgggcctcgatgttgcctcgtgtctcatcacaagggctcctattggtgaggaagtggagggaagaagaaaatatgttattcgcccgtacacgcctatctctgatccagattctaaaggatattttgacctactgatcaaggtttatcctgatgggaaaatgagccagtactttgcaagtttgaagccaggagatgttgttgaagtcaaagggcccattgagaagctcagatatagcccgaacatgaaaaaacagattggcatgattgctggtggtactggtataacaccaatgctgcaggttgtcagggctatcctaaaaaatcctgatgacaaaactcaggtctccttaatttatgccaacgtgtcgccagatgatatcttgctcaaaagggaattggatagacttgccagtagctatcctaacttcaaggtgttctatacagttgataagccatcagctgactggaggggtggtgttggttttgtatcgaaggacatgattttgaaaggtttgccaggcccaggggaggattcgctgatccttgtttgtggtccaccaggaatgatgaatcacatctctggggacaaggcaaaggatagatctcagggcgaggtctctggccttctgaaagatttaggatacacggcagagatggtatacaagttctgagagtacagtagattctactgacatacctgctgctcttgcagtgaataaaacacacctgaaccttttgtttcgcgcgtcatttggttcagaacttgcctcctttgaataatgttcgtccgaggattctataggttttgagctatgcgttatttctgcggttggcgtgtccctgtttgcgcctgcgtgcgatgtttacgaaacaggaacctgtactctgtttggcagtttcagatacatctacccagttctgttactcgac

SEQ ID NO: 7900 - protein, 311 aa, Panicum virgatum
  misc_feature: Ceres CLONE 1961048
  misc_feature (1)..(104): Pfam Name: FAD_binding_6 Pfam Description: Oxidoreductase FAD-binding domain
  misc_feature (1)..(109): Pfam Name: NAD_binding_1 Pfam Description: Oxidoreductase NAD-binding domain
  misc_feature (10)..(311): SWISSPROT Homolog: EC 1.6.2.2 NADH-cytochrome b5 reductase-like protein
MAALLLRRLAGAHRGRVPLGAAAVAACGGAALFYASSSPTVAHLEKGEEAGEKVALNPDKWLEFQLQEKAKVSHNSQLFRFSFDPNTKLGLDVASCLITRAPIGEEVEGRRKYVIRPYTPISDPDSKGYFDLLIKVYPDGKMSQYFASLKPGDVVEVKGPIEKLRYSPNMKKQIGMIAGGTGITPMLQVVRAILKNPDDKTQVSLIYANVSPDDILLKRELDRLASSYPNFKVFYTVDKPSADWRGGVGFVSKDMILKGLPGPGEDSLILVCGPPGMMNHISGDKAKDRSQGEVSGLLKDLGYTAEMVYKF

SEQ ID NO: 7901 - DNA, 935 bp, Panicum virgatum
  misc_feature: Ceres CLONE 1961056
  misc_feature: Encodes the peptide sequence at SEQ ID NO. 7902
aagcacgccatgatttctcttctcttcttggccctctccctccctaaacacgccatgtaatcccgttcttccccgccgagctgcggccggaacgccattgatcggcagtagcggcggaacgcagaagttgcgtgctcgttcaagccagtcaagtgcagcggtgatgaacgcgccgccgggcgacgacggcggcgacagcgcgcacggcgtcttcgggtcgaccggcatcagcgggttcggctacggcgtgggcgtctccgtcggcatcctcctcgtcgtctccaccatcgcgctcgccgtctacttctgcacgcgcacgtccatgcccgtggccgctgccgccgccggcggcggaggcgcgccgccgcgccccgacgtcgagcggggcatcgacgaggccacgctcgaggcgttcccggcggtggcgtacgcggaggcgaggaaggcgcggcggcaggagcggcagcagcagcagcagcaggcgtgctgccccgtctgcctcgacaactacggcgacggcgacgtggtccgggtgctccccgactgcggccacctgttccaccgcgcgtgcgtcgacccctggctccggcagcgccccacgtgccccgtctgccggacctcgccgctgccgagccccatgccgacgccgctcgccgaggtcacgccgctcgcgtccgcaaggccgtcgtgaggcttcttcgtgcctttcttttttaccagcactctgcttcgtttcctatttggtcgccaaccatttcattcgtacacatacatagcacggtgtaattaggaggtaccgcaaaaatgatttcctggggttgtaaactttagtagaatagtgttcagtgtacacatacattgtagtgtaggacagttaagaggtttttggtctctgaagaatttgaagtttcatccaaaaaaaaaaaaaaaaaaaa

SEQ ID NO: 7902 - protein, 175 aa, Panicum virgatum
  misc_feature: Ceres CLONE 1961056
  misc_feature (1)..(42): Pfam Name: zf-C3HC4 Pfam Description: Zinc finger, C3HC4 type (RING finger)
MNAPPGDDGGDSAHGVFGSTGISGFGYGVGVSVGILLVVSTIALAVYFCTRTSMPVAAAAAGGGGAPPRPDVERGIDEATLEAFPAVAYAEARKARRQERQQQQQQACCPVCLDNYGDGDVVRVLPDCGHLFHRACVDPWLRQRPTCPVCRTSPLPSPMPTPLAEVTPLASARPS

SEQ ID NO: 7903 - DNA, 1297 bp, Panicum virgatum
  misc_feature: Ceres CLONE 1961105
  misc_feature: Encodes the peptide sequence at SEQ ID NO. 7904
gcggctgcgcgcccacccagacccaggtagcgcagcgagcaactccctgaccctgagctgtcgcctctcccctgatccccaaatgtccccgccccccccccccccccccctgcttccgtcttaaaccctgcataagcctcgtcctccccacccccaccgtcgagccttcgtctcctcctgcccgcccgcttcttgctccttcctagttctcacgagggcaccgggagaccgccggcaggacggagcgaggcggcgcgggcgcgagcagggaaaagaagcgcgcagctgctggctcggtcggtcgcttcccggtgagaggaaagctcgtcgcgccacctcgacgcccatcgccacgcctcgcgctcgctctcctcccggagccgggagacgcccgcagggattgccgtcgatcctgcaagaaaacacggcaaggaaataccagtagtgagccagagtgcgaagaagatgatgatggctgaagtggccaatcacagcaagaggaaccacaccgacagctacttcagcgggaaggccgtcgtcaccaccaccagctcggaggagtttggaagcatgacctcgaagaagccgaggaacacgagcccaaggacgtctccagtgtcaccgaaggagaagaaggacaagatcggcgagagggtcgcagcgctccaacagctagtgtcaccgtttgggaagacggatacggcgtctgttctgcaggaggcgtcagggtacatcaagttcctgcaccagcagctcgaggtccttagctccccctacatgcgtgctcctccggccgctggcgccgcgcctgaggatcccgagcactacagcctccggaaccgcgggctgtgcctggtgccggtggacctgacgctgcagctgacccagagcaacggggccgacctgtgggcgccggcgaacacgaccaggcgccggtgaggagcgagctcgcccacctcgccgggagcacagcagccggtccggtctctggtctgccaccggaggaaaccgaggaagtcctacagcatctgcatgtgcagggtatagaatttccaagcgcttgaccccattcgatctcctaacaagaaactaagcgagcgtcaacctccgcttgtattatctactagtgacctgtctgcatgcctctgtctgatcccctctgggcaccgtatatgtacgatcagatgtggctgggaaccgcgtctccatgtgatatgtatgtatgtgttcagtgccatgtcaattagcagcctgttgccgtcgtcagcaactgaagcggcagtttttaaggccagtc

SEQ ID NO: 7904 - protein, 157 aa, Panicum virgatum
  misc_feature: Ceres CLONE 1961105
  misc_feature: Great-hit functional homolog of the protein sequence given in SEQ ID NO 9299
  misc_feature: Great-hit functional homolog of the protein sequence given in SEQ ID NO 9548
  misc_feature (2)..(50): Pfam Name: HLH Pfam Description: Helix-loop-helix DNA-binding domain
  misc_feature: Useful for making plants with altered Lignin content
  misc_feature: Useful for making plants with modulated nitrogen use efficiency
  misc_feature: Useful for making plants with modulated heat sensitivity
MMMAEVANHSKRNHTDSYFSGKAVVTTTSSEEFGSMTSKKPRNTSPRTSPVSPKEKKDKIGERVAALQQLVSPFGKTDTASVLQEASGYIKFLHQQLEVLSSPYMRAPPAAGAAPEDPEHYSLRNRGLCLVPVDLTLQLTQSNGADLWAPANTTRRR

SEQ ID NO: 7905 - DNA, 1047 bp, Panicum virgatum
  misc_feature: Ceres CLONE 1961134
  misc_feature: Encodes the peptide sequence at SEQ ID NO. 7906
atgaagcttcaccgaagcaaatgagtggacgagagcattcgaagccttcccgctgcaggcagtgctgctgctcactgctcagaaacaagaagcactgtgtgtcgaggcaagaagagaagccgggccgagcgcctccgagcggtgactgagagcaggatggagccgcagcagggaggggagcagctcgcgtgggggccgccgggcgccggcgcggcctgcctctgccccgccgccgtggcatcgtcagccgcgggtaacgtgttcccccgccaggcgctggagcaggagatgctgcgccgcgccgagctgcagctgcagctgcaggtcggcggcggcggcggcggcggcggcggcgaccgtcggagggagcggaagatgaagaaccgcgagtcggcggcgcggtcccgcctgcggaggatggcgtacgtgagcgagctggagaaggaggtgagcctcctccgcgccgagaaagaggagctcgccaagctctgccaggagctcaaggaggctgccgcggacgaggcgccggcgccgacgccggggaagagggctgctgcagctccacggcggctgcagaggacggcgtccgcgccgttctagcaaggccctggccggccgcatcaatctactaccttattaccagccgggccgatcgacaaggtttttggtgcagtgtgaatcgatctactgtcctgctctgttcttttgttcgtcgatgagcaagggagattcatcgagtgttggtagtatagttattagctagtgctgcagcaggtgtagatagcttgttcagttatttcgtcgctgtttgttcttgttgcggcgtcgccgctccgtccgtacccccacggcggggatgggatcatgggatggagggctccgtgcctgccaggacagaaatggtaaatgccggttcctgcgacacgccacgtttcggggaagaggccgatgaatggtttgtttggttttgtcctcgagctattttgatcgttatttacgatgtcaaagaaaattagtttacaaaatcaaaaaaaaaaaaaaaaaaaa

SEQ ID NO: 7906 - protein, 147 aa, Panicum virgatum
  misc_feature: Ceres CLONE 1961134
  misc_feature (1)..(55): Pfam Name: bZIP_2 Pfam Description: Basic region leucine zipper
  misc_feature (2)..(57): Pfam Name: bZIP_1 Pfam Description: bZIP transcription factor
MEPQQGGEQLAWGPPGAGAACLCPAAVASSAAGNVFPRQALEQEMLRRAELQLQLQVGGGGGGGGGDRRRERKMKNRESAARSRLRRMAYVSELEKEVSLLRAEKEELAKLCQELKEAAADEAPAPTPGKRAAAAPRRLQRTASAPF

SEQ ID NO: 7907 - DNA, 1508 bp, Panicum virgatum
  misc_feature: Ceres CLONE 1961353
  misc_feature: Encodes the peptide sequence at SEQ ID NO. 7908
gtcattcagtttaatacagagttgttgcctggttttcttgccattcagtttaatacagagttgtttgttgcctaatcgtcatcatccatgcaatatattattacacaccagagccaaatgcagatttgccgaatattgccaccgcaatatgtgaaagataagattttcggacgaacgagaaggatgtgtggacgctggcgcctttgttcgttccctcgcgtcgtcgtctttggccgccgccgcctccttctacctcagcccagcccaggaggaccgcgggagagattcctcgttgattcgctccgaggtggtccgccgtccgcctcgtctcagattctcaggcgtctcagattctcaggggctccccagcctctcagtctcaggtactctactatccttcacctcccgccggcagtgtgtggcggcgccttgagatcctcctgctcgctgcctgctcgtgctacttcagtccccgcatcttgtgaccctttcttcgcgcgaatcaaatctttctgcgtttccaatttcaaagaaaaaaacctacttgcgtttcaaatttaggtgcgaattgtgtggcgagtagattagattcgttcacttttaggagtctactacgatccataaggttcaggaagtaggatatgggaatattacttgcaattttctgcctaacgtttctgtttctctgtctcagcatccatcccttgttcctggcttccaccttctggtatgctcactaccttgtgggttcgtcagattgcgcatctgcccaagtgcgcaaattcaggggtagcctgtgccccttccttccttgctgtcacgcagccacctctccaatttagtttggttcacagggcatccttcagctcccaacacagccagttgacaagaagcgctgcaggtcctcttatggctgaaagggagttgattggcaaggataagcttgtgcttagaggtttgcagtttcacggattccatggagtgaaacaagaagaaaagacactgggccaaaagttcgctgtagacgtcgatgcttggatggatctgagcattgctggtgaaactgacagcatatatgatacagtcagttacacagatatttacagaattgtcaaggatgtggttgaaggaccatctcagaatcttttggagtcagtggctcaccggattgcaagtgccacattgctcaagttctctcaaatatctgctgtacgggttgaagttaagaaacctcatgttgctgtacaaggaattatcgactatttaggtgttgagatagttaggtatagaaaggacatggcaggaatttcaccatgagctccactgcactagcattccgaggatggcatatccatgttcaatctgtcaatggcgctgactgctcaacattgcgttccttcagatgtatatactgcaacaattcgtactgaatgttgctctcagaagctgttcggctcaaaattgatctagttttattggaattgaagtaggcaattaaatttttcctc

SEQ ID NO: 7908 - protein, 195 aa, Panicum virgatum
  misc_feature: Ceres CLONE 1961353
  misc_feature (1)..(114): Pfam Name: FolB Pfam Description: Dihydroneopterin aldolase
  misc_feature (49)..(187): SWISSPROT Homolog: EC 4.1.2.25 Dihydroneopterin aldolase
MLTTLWVRQIAHLPKCANSGVACAPSFLAVTQPPLQFSLVHRASFSSQHSQLTRSAAGPLMAERELIGKDKLVLRGLQFHGFHGVKQEEKTLGQKFAVDVDAWMDLSIAGETDSIYDTVSYTDIYRIVKDVVEGPSQNLLESVAHRIASATLLKFSQISAVRVEVKKPHVAVQGIIDYLGVEIVRYRKDMAGISP

SEQ ID NO: 7909 - DNA, 1479 bp, Panicum virgatum
  misc_feature: Ceres CLONE 1961412
  misc_feature: Encodes the peptide sequence at SEQ ID NO. 7910
attcgcttccccgccgcgccgcccccgcccaaaaccctagccaccgccgccgccgccgccgccatggtcgcctccagccgccccctggtctccgtgaaggccctggagggcgacatggccactgacgccgcgggcctcgccatcccggccgtcttcagcgcgccgatccgccccgacgtggtcaccttcacccacaagctgctgtcctgcaacaagcgccagccctacgccgtctcacgccgcgccggtcaccagacctccgccgagtcatggggtaccggccgcgccgtctcccgtatcccccgtgtccccggtggcggcacgcaccgcgccggccagggagccttcggcaacatgtgccgcggaggacgcatgttcgcgcccaccaagatctggcgcaagtggcaccgccgcgtcaacgtcaacctccgccgcgtcgccgtcgcctccgcgctcgccgccaccgccgtcccggccctggtccaggcccgcggccaccgcatcgataccgtccccgagctgcccctggtcatctccgactccgccgagtccatcgagaagacctcccaggcgctcaagatcctcaagcaggtcggtgcctacgctgacgccgagaaggccaaggactcggtcggcatccgcccgggcaagggtaagatgcgcaaccgccgctacatcaacaggaagggcccgctcatcgtctacggcaccgagggctccaagatcgtcaaggccttccgcaacctccctggtgtggatgtcgccaacgtcgagcgcctcaacctgcttgaccttgcccccggtggccacctcgggcgctttgtgatctggaccgagagcgccttcaagaagctcgaggaggtgtatggaacatttgaggcgccttctctgaagaagaagggcttcgtgctgccgagggccaagatgaccaacgctgacctgggcaggctcatcaactctgatgaggtccagtctgttgtgaagccactcaacaaggaggtgaagcgcagggagaagaggaagaaccctctcaagaacatggatgctgtgctcaagctaaacccctacctcggcactgcccgcaagatggccaccctcgctgaggctgcccgcgtcaaggccaggaaggagaagctcgacactaagaggaccaagcttagcccggaggaggctgccaaggtcaaggctgctggaaaggcatggtacaagaccatggtctcagacagcgactacactgagtttgagaacttctcaaagtggcttggtgtgacacagtgagcgcatgctatctagttaagttttgagtagaagtgtcaccgaacttatctcgagagggtttatcattctgttctatcctgcatcatcataagaattttaccaacctgtgggattatgagacaagtctggtccattttgttaatgtcttgccgtaagaacatagtatcagcagtttcaaaccaaaaaaaaaaaaaaaaaaaa

SEQ ID NO: 7910 - protein, 404 aa, Panicum virgatum
  misc_feature: Ceres CLONE 1961412
  misc_feature: Great-hit functional homolog of the protein sequence given in SEQ ID NO 9421
  misc_feature: Useful for making plants with modulated biomass
  misc_feature: The plant is abnormally small.
MVASSRPLVSVKALEGDMATDAAGLAIPAVFSAPIRPDVVTFTHKLLSCNKRQPYAVSRRAGHQTSAESWGTGRAVSRIPRVPGGGTHRAGQGAFGNMCRGGRMFAPTKIWRKWHRRVNVNLRRVAVASALAATAVPALVQARGHRIDTVPELPLVISDSAESIEKTSQALKILKQVGAYADAEKAKDSVGIRPGKGKMRNRRYINRKGPLIVYGTEGSKIVKAFRNLPGVDVANVERLNLLDLAPGGHLGRFVIWTESAFKKLEEVYGTFEAPSLKKKGFVLPRAKMTNADLGRLINSDEVQSVVKPLNKEVKRREKRKNPLKNMDAVLKLNPYLGTARKMATLAEAARVKARKEKLDTKRTKLSPEEAAKVKAAGKAWYKTMVSDSDYTEFENFSKWLGVTQ

SEQ ID NO: 7911 - DNA, 937 bp, Panicum virgatum
  misc_feature: Ceres CLONE 1961417
  misc_feature: Encodes the peptide sequence at SEQ ID NO. 7912
aacctctcccattcctcccgcagaaaacggatcgggcgccaggggcctctcaggagtcaggaccgagcgccgcctccagctcctccaggcgcgttgcagcgctcctccccacccaggccgcggcgcccctcctgcgcagctccgccccaaggccgcggcgccctcccggcgcagctccgccccagggcgcggcgcccctccccgcgcagctccgcccaggccgtgcccccctccccgcgtgcagcactcctggggaggagctcctgctgcaacggcgtggagagaggcggggcggggcacaaggacgtctggagcgcggcggcgaagcgcggcgatggagttctgcccggcgtgtgggctgctgctgcagatagatccgggcacaggaggccaccgcctgcgcctcttctgtcccgtctgcccctacgtctgcccgatgcagaacaagatcgtgaagaaggcgaaggtggtaaagaaggaggtagagcccatcttcagcaaagccgacgcgatgaagttggcccccaagaccgcaacttcatgcccaagatgcaaccatggagaagcatacttcaagcagatgcagattcgatcagccgatgagccaatgacaacattctataggtgttgcagagaagaatgccagcttgaatggagagatgactgatctagcaactagcattttccactttgctttcactacatgctcgttctgcttcagttttgagtggtgatatgccctgttgcacatgtaattcttcttgtaaccaccttgtccttcagtacaaacttcggtgaaatgttattatggtgccgcattttggctgcagaagacactactagtaggagtgaagtgttttggaatgtatgtgcttcatgctggctacatttggtagcgtgaatggcattttcaaacgaaaaaaaaaaaaaaaaaaaa

SEQ ID NO: 7912 - protein, 110 aa, Panicum virgatum
  misc_feature: Ceres CLONE 1961417
  misc_feature (1)..(54): Pfam Name: RNA_POL_M_15KD Pfam Description: RNA polymerases M/15 Kd subunit
MEFCPACGLLLQIDPGTGGHRLRLFCPVCPYVCPMQNKIVKKAKVVKKEVEPIFSKADAMKLAPKTATSCPRCNHGEAYFKQMQIRSADEPMTTFYRCCREECQLEWRDD

SEQ ID NO: 7913 - DNA, 1808 bp, Panicum virgatum
  misc_feature: Ceres CLONE 1961491
  misc_feature: Encodes the peptide sequence at SEQ ID NO. 7914
actccaactccagtaccccacgcctctcgtgctcgttgcttcgccgttcgaccacccaacgctagccgcagtccgacctagcaaggcggcggcggcggtagcagcagcagccagcagggcgctcctcggctccggtccatctatcgcgtcgccatggccgcgcaaccgacgatcccgcgccgctgcctcttcatcggcgggggctggagggagccgtcgctcgggcgccgcctccccgtcgtcaacccggccaccgaggccaccatcggcgacatcccggcggccacggcggaggacgtggagatcgcggtcgcggcggcgcgggacgcgttctcgcgcgacggcgggaggcactggtcgcgcgcccctggggccgtgcgggccaagttcctcagggcgatcgctgccaagattaaagatagaaaatctgatctggctttgctggagacacttgattccgggaagcctctggatgaaacaaatgcggatatggacgatgttgctgcatgctttgagtattatgctgatctggcagagtctttagatgagaagcaacgttcaccaatctctctacctatggagaatttcaagtcccatatactcaaagaacccattggggttgttggactgatcactccttggaactatcctctgttgatggctacttggaaggtcgcaccttccttggctgctgggtgtacagctgttttaaagccatcggagttggcttctctgacttgcttagagcttggtgcaatatgcatggaagtagccctacctccaggtgtgctgaacataattactggtctgggccctgaagctggtgctccattatcttcacatcctcatgtggataaggttgcctttaccggaagtacagagactggtaagagaataatgactgctgctgcccaaatggttaagcctgtttcgttagaacttggaggcaaaagtcctcttattgtctttgatgacgttgacattgacaaagctgttgaatgggccatgtttggggtctttgcgaacgctggtcaagtctgcagtgctacttctcgtctacttctgcatgagaaaatagcaaaacaattcttggatagattggttgcatgggcaaagaatatcaaagtctccgacccactggaggaaggctgcaggctggggtctgttgtcagtgaagagcagtatgaaaagataaagaagttcatctcaacagcaagaagcgaaggtgccacaattttatatggtggtgcccgaccacagcacctcagaagagggttctttattgaacctacaattataacagatgttagtacatcaatgcaaatttggcgagaggaagtctttggaccagtcatctgtgtcaaagagttcaggacagagagtgaagctgtggaacttgcaaatgatactcactatggtttagctggtgcagtgatctctaatgatgaagagaggtgtcagcgcatttcgaaggctcttcattctggtattgtttggataaattgctctcaaccaacctttgtccaagctccatggggagggaataagcggagtggttttggtcgtgagctcggagaatggggccttgacaactacctgaccatcaagcaagtcaccaagtactgctcggatgagccatggggatggtaccagcctccatcgaagctgtaaacgggttcacgccaggagtgtggagcgtatcattcacggaagacgcaacatcaatcctgagcgtggacagaaacttatgtacagtacggtgctctttcaataaaaagtccttacgacaaaaaaaaaaaaaaaaaaaa

SEQ ID NO: 7914 - protein, 505 aa, Panicum virgatum
  misc_feature: Ceres CLONE 1961491
  misc_feature (1)..(321): Pfam Name: Aldedh Pfam Description: Aldehyde dehydrogenase family
  misc_feature (1)..(470): Pfam Name: Aldedh Pfam Description: Aldehyde dehydrogenase family
  misc_feature (1)..(469): Pfam Name: Aldedh Pfam Description: Aldehyde dehydrogenase family
  misc_feature (1)..(470): Pfam Name: Aldedh Pfam Description: Aldehyde dehydrogenase family
  misc_feature (1)..(471): Pfam Name: Aldedh Pfam Description: Aldehyde dehydrogenase family
  misc_feature (1)..(470): Pfam Name: Aldedh Pfam Description: Aldehyde dehydrogenase family
  misc_feature (1)..(471): Pfam Name: Aldedh Pfam Description: Aldehyde dehydrogenase family
  misc_feature (1)..(470): Pfam Name: Aldedh Pfam Description: Aldehyde dehydrogenase family
  misc_feature (1)..(470): Pfam Name: Aldedh Pfam Description: Aldehyde dehydrogenase family
  misc_feature (1)..(470): Pfam Name: Aldedh Pfam Description: Aldehyde dehydrogenase family
  misc_feature (1)..(505): SWISSPROT Homolog: EC 1.2.1.8 Betaine aldehyde dehydrogenase
MAAQPTIPRRCLFIGGGWREPSLGRRLPVVNPATEATIGDIPAATAEDVEIAVAAARDAFSRDGGRHWSRAPGAVRAKFLRAIAAKIKDRKSDLALLETLDSGKPLDETNADMDDVAACFEYYADLAESLDEKQRSPISLPMENFKSHILKEPIGVVGLITPWNYPLLMATWKVAPSLAAGCTAVLKPSELASLTCLELGAICMEVALPPGVLNIITGLGPEAGAPLSSHPHVDKVAFTGSTETGKRIMTAAAQMVKPVSLELGGKSPLIVFDDVDIDKAVEWAMFGVFANAGQVCSATSRLLLHEKIAKQFLDRLVAWAKNIKVSDPLEEGCRLGSVVSEEQYEKIKKFISTARSEGATILYGGARPQHLRRGFFIEPTIITDVSTSMQIWREEVFGPVICVKEFRTESEAVELANDTHYGLAGAVISNDEERCQRISKALHSGIVWINCSQPTFVQAPWGGNKRSGFGRELGEWGLDNYLTIKQVTKYCSDEPWGWYQPPSKL

SEQ ID NO: 7915 - DNA, 1079 bp, Panicum virgatum
  misc_feature: Ceres CLONE 1961795
  misc_feature: Encodes the peptide sequence at SEQ ID NO. 7916
gccgataccgcccgctcccgaccgcggcgagccccacccaaagccaagcagcagccatggcgcggcacctcgcgccttcctcgggaagcctccaccgcctcctcgcgtcccgccactaccctccctcctcccaggcgccgcctccccgcccgctcctcctcccgaagcccctatcggcggctaggcagctccagcgacgcgggcggcgcggtgtcgtcatcgccgccgcagccgcctccccgccgtccccatcttctccgcggacggaggtggcggaggggcctgcctgggggaaggtctccgctgtgctcttcgacatggacggcgtgctctgcaacagcgaggagccctcgcggcaggctggcgtcgacgtcttcgcggagatgggcgtcgaggtcaccgtggatgatttcgtccccttcatgggcactggtgaggcgaatttccttggaggtgtcgcaagagtaaaaggagtaaaagatttcaatcctgaaattgccaaaaagagattttttgagatatatcttgacaagtatgcaaagccaaattctggcattggttttcctggggcattggagctcatcatggagtgcaaaaatgccggtcttaaggttgctgttgcatccagcgctgataggattaaggtggatgcaaatctggctgctgctggtttgcctgtgtctctatttgatgccattgtttctgctgatgcatttgaaaatttgaagcctgccccggacatattcctgtcagcatcaaagaacttaggtgttgacacaagtgagtgcattgtgatagaagatgcgcttgctggtgttcaagctgcaaaagctgcggaaatgaggtgtatcgctgtgacgactactctagaggaagatgcattacaacaaggcagtccctcgctcataagaaagaacattggagatgtttcaattaacgacattttttatggtggttctaatgctcgccacagtatgtagttcaagcaaaatccgtttgatccaatagcatatctcttgtatgaaaaagtggaaataaatcttttggatcttcttgcgcaaaaaaaaaaaaaaaaaaaa

SEQ ID NO: 7916 - protein, 307 aa, Panicum virgatum
  misc_feature: Ceres CLONE 1961795
  misc_feature (1)..(190): Pfam Name: Hydrolase Pfam Description: haloacid dehalogenase-like hydrolase
MARHLAPSSGSLHRLLASRHYPPSSQAPPPRPLLLPKPLSAARQLQRRGRRGVVIAAAAASPPSPSSPRTEVAEGPAWGKVSAVLFDMDGVLCNSEEPSRQAGVDVFAEMGVEVTVDDFVPFMGTGEANFLGGVARVKGVKDFNPEIAKKRFFEIYLDKYAKPNSGIGFPGALELIMECKNAGLKVAVASSADRIKVDANLAAAGLPVSLFDAIVSADAFENLKPAPDIFLSASKNLGVDTSECIVIEDALAGVQAAKAAEMRCIAVTTTLEEDALQQGSPSLIRKNIGDVSINDIFYGGSNARHSM

SEQ ID NO: 7917 - DNA, 1539 bp, Panicum virgatum
  misc_feature: Ceres CLONE 1961834
  misc_feature: Encodes the peptide sequence at SEQ ID NO. 7918
ctctctctgggcataacttcctgccgccttcctcagttgctttctctctctaccagtctacctcccaagcaaaaacttgactctacattaacaaaatcccaaggccttttaaaggaggaagcaaagacatttggaagtggagggagagcaagaacatagcaagggaagaggggcgagatggaggtggtggtgcctgtcatggcgccaagcgcaccgtgcagcccaagaaccgcggccatggccggcggcgaccacctcccgggctactgttacttcttctccagcgcaccgacgagcccgtccagggcgagctacgccggggacgcctcgccgggcgtcggcggcggcgacgaggccacgtttgacttcacgctcggcttcagcggccagctgcaggaggccacgccgatcctcgccgacgccgacgagctcttcgagggcggcaggatccggccgctgaacatgccgcacccgagcattctgctgatcgacgacacctcctccacttcctactcctccaccggccctcggtccccaaggagagccggggcgcacggcggggatcaagcggaggcgttggggaggggcaggtcgggaaggcccaccgccgcgcctgcctccgccgcttcgtcgcgcagcaggagagccacgcggtctctctccccgttcaggggcggcggcggcggcggcggcatcgaggacgacgagtacccttcctccccgccgtccccccgaacctccatgatgcggggctgcggcagcgggagcaagaagtggaggctcaaggacttgttcctcttccggagcgcgtcggagggccgcgccaccggaagcgggagcaaggacccgctcttcaagtacaccatgctctcgccctccacgtcgttctcgcaccctcagaagctcaagagcggcgacggcagcgcgtccatgcggaaggggagagggtcgacggcgtccgcgagtgacatgccgtaccccatgaaccgggcgtccgccgaggacatgcggcggcggaccacgacgccgctgccgttccaccggaacagcctcttcggctacctgctctccaacccggcgatccacagcatcagcaggaagctgggcaaccactcctccaatcgcggcaggccgacatgatccccacgcaccgggtcgcagtatgcatgcgctggcctggcgccgccgtcctgaaaccttgacgacgatgcagacctgcctgaaatggccgccggagaagcgtcgccgttttacttgtccatttttctttttgatcccctctaaaatctctatcagagaaaaggacttaattccatcagttgatccccaatggcggtctagctaatcccgcgtctgcgtgcgcgccggatcgcgacacgtgtccggattagccaaccaaaccccgcctcggttcgcgtattaaatcggggagacgcagctcatcaacatgggagcactgttacgagattccatcggagttgcattttcagatgccgcgagatcggttttaatttgtggcaaaaaaaaaaaaaaaaaaaa

SEQ ID NO: 7918 - protein, 320 aa, Panicum virgatum
  misc_feature: Ceres CLONE 1961834
  misc_feature: Great-hit functional homolog of the protein sequence given in SEQ ID NO 9739
  misc_feature: Useful for making plants with modulated biomass
  misc_feature: The rosette leaves do not appear in the normal fashion, i.e., their phyllotaxy may be abnormal or too many leaves may be emerging in comparison to the control.
MEVVVPVMAPSAPCSPRTAAMAGGDHLPGYCYFFSSAPTSPSRASYAGDASPGVGGGDEATFDFTLGFSGQLQEATPILADADELFEGGRIRPLNMPHPSILLIDDTSSTSYSSTGPRSPRRAGAHGGDQAEALGRGRSGRPTAAPASAASSRSRRATRSLSPFRGGGGGGGIEDDEYPSSPPSPRTSMMRGCGSGSKKWRLKDLFLFRSASEGRATGSGSKDPLFKYTMLSPSTSFSHPQKLKSGDGSASMRKGRGSTASASDMPYPMNRASAEDMRRRTTTPLPFHRNSLFGYLLSNPAIHSISRKLGNHSSNRGRPT

SEQ ID NO: 7919 - DNA, 1153 bp, Panicum virgatum
  misc_feature: Ceres CLONE 1961986
  misc_feature: Encodes the peptide sequence at SEQ ID NO. 7920
ttgcctttgcccgctgcgcttgcgcgtccgcggaaggggacgacgacgcgtccccgtctcctccccttccccgataaaaaggccgggcgcctctcgttcattcctcgctcatcgccgatcacaaccgcgccctccccccaatccccgattcgcgagctcgtccgcgcctcccggcctctcctccccacccccacccgccgcccctccgagaagcgaagcgaagctccgggccgcgccaccgcgcaggcaggcacccaaggcagcaggcgcgggttccttccgccaggtgcgcgggtaggcggcggcatggcgcagcgcgacaagaaggaggagcccacggagctccgggcgccggagatcacgctctgcgccaacaactgcggcttcccggggaacccggccacgcagaacctctgccagagctgcttctcggcggccacggcgtcgatgtcgtcgtcgccgacgtcctcctcgtcgtcctccacggccccggcgccggccgcgccgccccagccgaggccggcgccggcggagctggcctcccccgccgacgcggccgtggcggccccggctccggaggccgcgaaggcgccggcgaggacgtcggcgaaccggtgctcgagctgccggaagcgggtggggctgacggggttccggtgccggtgcggcgagctgttctgcggcgcgcaccggtactcggaccggcacggctgcagctacgactacaagggcgccgccagggacgccatcgcccgggagaacccggtggtgcgcgccgccaagatcgttaggttctgatcgacgacggagtcaaaattcctccatccatccacaggatcaagcaagcgaggaagacaaagaggaagcacacatccacggaaatggaaggccttttcccttggtgttactatgctgttcttcgaagcgtttgattttcaatctcctttttctttttacgatttctcaaatggaagaaaaaatgggaggaaaagaggtggacaaggaatagtgtaataataatgggggcaatgaggccgcggcggtggttgagagcaaaaggatcaacgcaatggattgggtgtatgtacctgtcacacgcaagctttgtgcaaaaactattatacatttctatcaaaaaaaaaaaaaaaaaaaa

SEQ ID NO: 7920 - protein, 163 aa, Panicum virgatum
  misc_feature: Ceres CLONE 1961986
  misc_feature (1)..(41): Pfam Name: zf-AN1 Pfam Description: AN1-like Zinc finger
MAQRDKKEEPTELRAPEITLCANNCGFPGNPATQNLCQSCFSAATASMSSSPTSSSSSSTAPAPAAPPQPRPAPAELASPADAAVAAPAPEAAKAPARTSANRCSSCRKRVGLTGFRCRCGELFCGAHRYSDRHGCSYDYKGAARDAIARENPVVRAAKIVRF

SEQ ID NO: 7921 - DNA, 1412 bp, Panicum virgatum
  misc_feature: Ceres CLONE 1962017
  misc_feature: Encodes the peptide sequence at SEQ ID NO. 7922
atcggctccctccttgcactcgcacaccaccgctacttaacaaaccagcagagggagcgggcggaattgccaggccaagcgatcatactgctggagtagcggaccgggacgaggagaggggctccggttccttcccggagaaggagctcgaggggagggagaaagagacagagatccagcggcggcggcggcgatggggatgaggcccgggtgggttgccggcctggtggcggagagcttcttcgtggcgtgccccgcgcacgagaaccacaagaagaacgagcgcaacatcttctgcctcgcctgctgcgccagcatctgccccaactgcgccgccgcgcaccgccaccacccgctcctccaggtgcgacgctacgtgtaccatgacgtcgtccgccttggcgacctcgagaaactcattgactgctcctatgttcaggcctacacgatcaacagtgccaaggtcatcttcctgaagccgaggcctcagtccaggcccttcaagggctccggcaacgtctgcctgacatgcgacaggatcctccaagaacccttccatttctgctccctctcttgcaaggtggatcatgtcacgatgcagggaggggacctcttcaacaccctgcagtactacggcggggtcggcggcggcgacaccacatacccagatcaccttgccttcccgcagtttgaaaacctccgcgtcgacggctcggacctcgacgacgacactgatggcgggcagaatcggcagatcaccccgaactcgacccttgaagacccaacgcagcactacggcaatggtggcggggcatcgagcgacaacggtgacactagggctgttgtaaatgcccgtcgcggcgaggcggggaagaggaagaaagggggagggttcttcccccagatcgtgctgtcactcggcaacaggaggaagggtgccccccacaggtcccctctggcctaagcactttgtcgatgtgccctggtgttcgttatcactggctatagctagtagtagttgcagttatggtggtggtagctattagtagcgtgttgtaatagtcctatgattagccttgtagagatcggtgagagagctggttggtctgtcggttggttgctttgggagggtcctggcattgtgatccacctagctttgctagggccatggccatcccaaggctgttgtgttgatgacacttgagagagggtggcaaagcagttcccctgttacaggcctaggtaggcactggtaagtggggcccacgtttgcgggccgggcccccacagaggtggctaccaattttgtatttgatgtaacaagggttacttgcatacacttccacagctatatatgaatgttccccagactaaatatgtttttagcaaggtaaaaaaaaaaaaaaaaaaaa

SEQ ID NO: 7922 - protein, 256 aa, Panicum virgatum
  misc_feature: Ceres CLONE 1962017
  misc_feature (1)..(111): Pfam Name: PLATZ Pfam Description: PLATZ transcription factor
MGMRPGWVAGLVAESFFVACPAHENHKKNERNIFCLACCASICPNCAAAHRHHPLLQVRRYVYHDVVRLGDLEKLIDCSYVQAYTINSAKVIFLKPRPQSRPFKGSGNVCLTCDRILQEPFHFCSLSCKVDHVTMQGGDLFNTLQYYGGVGGGDTTYPDHLAFPQFENLRVDGSDLDDDTDGGQNRQITPNSTLEDPTQHYGNGGGASSDNGDTRAVVNARRGEAGKRKKGGGFFPQIVLSLGNRRKGAPHRSPLA

SEQ ID NO: 7923 - DNA, 1429 bp, Panicum virgatum
  misc_feature: Ceres CLONE 1962141
  misc_feature: Encodes the peptide sequence at SEQ ID NO. 7924
aaccatatacatcaactcgatcacagtcatccaaatggggttcctcatggtgcttcggtacttagtagccatgaaaagtagcagcgttctcgctaccattgcaatggtaatgatatcggcccaagctcttgacaacgccaacctggacgggtatgtgccagtgccaccagtggccattgctgggcagcctgccgcgccgccacctgctgccacttctgcagggcagcctgcggcagcgccgccgccggcgatcttcgtgttcggggatggggcgctggatgtcggcaacaacaatgacttgactggtggggagattggggaccctgaccgcgccaactacccttactacggcatcgactaccccggagggcaggccaccggaaggttcagcaacggatacaacattgccgactttatcgcaaaggacctgggattcgagatgagcccgccggcttaccggtcgcttccggatcgcagccctgacaaaatggagggtttcaccggagtcaactatgcgtctgccagagccgggattcaggactccaccttcgtaaacacgaccattccattgtcgacgcaagtggaaaacttcagggaaacaagagaccggctcaaggccctgctcggcggccgcaagcctctgagcacgttcttgtcgaaatccttgttcctgatcgggctgggcaccgggatggacctcatcccggacagcaaccctttcgcctcattcttctcaccaaaggacaacaaaacccaggtgcagcgcctcacggagttgttggggacaaccatcaccacgatgcacggcatgggcgcaaggaagttcgggatcatcaacgctgggctcatcgggtgcatgccgtccgtgcagtcgatgtatggcggcctcggcggtgacggtccatgcgacgatgacttgaacaggctcgccgccgagttcaactccgcgctcgggacactcgtgtctgacctggccagcaaactccatcgcttccgctactcgctcgccgacttctacggcttctccaacgccaccttcactaacccatcagcctccggatttgcgaacaccatcggcgcctgctactccgggtccgggaaaccatgctcgaaccgtgcggagtactggttctgggattattggtacacaacggagcaggccgctaagctcgccgctgccgcattttacagtggcaagaggttcgccatgcctgttaacttcaagcgattgatcgcgatgaaaggatgaataatttcttaggatttaggtgaaataaaggtgtgtatccagtgttcacgagagtgaccttattgggttgtattgtgcttgcttgcacttgtagctggttatggcatgttaattgggtgatgtgatgcgactccactgcataatgatttcatcaaagaataataaaaccaatctattgtt

SEQ ID NO: 7924 - protein, 404 aa, Panicum virgatum
  misc_feature: Ceres CLONE 1962141
  misc_feature (1)..(319): Pfam Name: Lipase_GDSL Pfam Description: GDSL-like Lipase/Acylhydrolase
MGFLMVLRYLVAMKSSSVLATIAMVMISAQALDNANLDGYVPVPPVAIAGQPAAPPPAATSAGQPAAAPPPAIFVFGDGALDVGNNNDLTGGEIGDPDRANYPYYGIDYPGGQATGRFSNGYNIADFIAKDLGFEMSPPAYRSLPDRSPDKMEGFTGVNYASARAGIQDSTFVNTTIPLSTQVENFRETRDRLKALLGGRKPLSTFLSKSLFLIGLGTGMDLIPDSNPFASFFSPKDNKTQVQRLTELLGTTITTMHGMGARKFGIINAGLIGCMPSVQSMYGGLGGDGPCDDDLNRLAAEFNSALGTLVSDLASKLHRFRYSLADFYGFSNATFTNPSASGFANTIGACYSGSGKPCSNRAEYWFWDYWYTTEQAAKLAAAAFYSGKRFAMPVNFKRLIAMKG

SEQ ID NO: 7925 - DNA, 1307 bp, Panicum virgatum
  misc_feature: Ceres CLONE 1962157
  misc_feature: Encodes the peptide sequence at SEQ ID NO. 7926
gaatccaagcgcacgccgcccgccgcccgcccagcccagccgcccaggacggccgcggagcccccccgaccccaaaccgcaccagcgcaccaaaaacccgcccgcccggccgccagcggtctcgtcgccggccttcgcgaagcctctccagcccctccgtctccgtctcgcggcctggagcgatgcagctataccaccacccctattctctggacagccagaaagtgcggatggcgctggaagagaagggtatcgactacacctcctaccacgtcaatccgctcacgggcaaaaacatgaacgtggacttcttccgcatgaacccctccgcgaagctccctgtcttccagaacggcgctcatgtcatctatcgtgccatcgacatcattcagtacatagacagacttgcggtgcatttgagtggcgagatcccccctgtgaatactgtggttcaccattggatgcagaaagttgatgcttggaatcccaagatgttcaccctcacacataccccggtcaagtaccgtgcgtttgtctccaagttcataaggcgggtgctgattgctcgcatggctgaagcctctgatctagctagcatgtaccatgtcaagctccgtgaggcttatgagaccgaggacaaagtaaaggaccctgacatcatgaggcaaagtgaggaagaactgagcaaactccttgatgatgttgaagtgcagctcagcaagaccaaatacctcgctggcgatgacttctcacctgctgattcgatgttcatccctattcttgcgcgtataactcttctggaccttcatgaggaatacatcaactgcagacccaagatacttgagtactacaatttggtgaagcaccggccaagctacaaggttgccattggcaagtacttcaatgggtggaagaagtaccggactctcttcaagacatcattcttcctttgcgttcgaaccttgttcaggaggtactagatagctcagcagctgcatagctgaatccataccttgtgaaccgacatgtacagtgatttcggctaaaaatatatattatgtatatcttccatgtgtttttcctgtggtcctgagttttgttttcacttgtgaaaggctgaaagcaaatgcatttgtttgcttgtatatttccacttcatgttgtattccaaactgcagacaataggatttgtatacagaataggcctaggtatacatttcggttttgtcacttgttatagtccagtttatgtctgatataaatagttgttaacttgattttggtacgaaaaaaaaaaaaaaaaaaaa

SEQ ID NO: 7926 - protein, 265 aa, Panicum virgatum
  misc_feature: Ceres CLONE 1962157
  misc_feature (1)..(74): Pfam Name: GST_N Pfam Description: Glutathione S-transferase, N-terminal domain
  misc_feature (1)..(95): Pfam Name: GST_C Pfam Description: Glutathione S-transferase, C-terminal domain
MQLYHHPYSLDSQKVRMALEEKGIDYTSYHVNPLTGKNMNVDFFRMNPSAKLPVFQNGAHVIYRAIDIIQYIDRLAVHLSGEIPPVNTVVHHWMQKVDAWNPKMFTLTHTPVKYRAFVSKFIRRVLIARMAEASDLASMYHVKLREAYETEDKVKDPDIMRQSEEELSKLLDDVEVQLSKTKYLAGDDFSPADSMFIPILARITLLDLHEEYINCRPKILEYYNLVKHRPSYKVAIGKYFNGWKKYRTLFKTSFFLCVRTLFRRY

SEQ ID NO: 7927 - DNA, 1710 bp, Panicum virgatum
  misc_feature: Ceres CLONE 1962189
  misc_feature: Encodes the peptide sequence at SEQ ID NO. 7928
aatccaatccacatctccacccccaccaccaccgccaccttcgcgcacgcggccacctccccgatgcgcgccgccgagcccgccgcgctgccccagccgcagtccgatccgaggcagccatgatcccgttgcgcccgcacgcggcgacgaccgtcaccgccaactgcacggacagcccgctcgactgcctccggctctgccccggcggcgtcgaggactgctccgagtacgcgctgcccccgccgcccccgatcccggcgatcccgcgcgcgccggacgccggccgccacgctcccgtgcgcctcctcctcgtcgtctccctgctctccgccttcctcttcatctcgctcgcgctctccacgctcctcctctaccgccgccgccgcctcatcctgcgccggcgccggcgcctcgccgcggccgccgccgaaggggccgacgacggcggcgggtccggcgacgaggaggagggcgggggagggggaggggtggtgcaccacgtgtggtacatccgcacggtggggctcgacgaggccaccatcgcgtccataacagccgtggagtaccgccgcggggtgggccgggccggggactgcgcggtgtgcctcggcgagttcagcgacggggagctagtccgcctcctcccgcgctgcgcgcacccgttccacgcgccctgcatcgacacctggctccgcgcccacgtcaactgcccgatctgccgctcccccgtcgtcgtcgttccttccgatttacccgccacggccgcggaggctgcggcggatggtgtccaagcggaagagcaccaagtgcatgacgaaatgtcgctgtcgcaatctgaaccggagactttgggctcggaggtctctgaggcctcttcagacactcaaagtgaggacacatctgcttcaggggaggagaatgtaagggcggccgccaaaccaattcggcgctcggcgtccatggactcgccattgttccttgtagctgttcctgaagttcaggatggtgtcgtgccgtctaattgcaagttaccaattgcccgagagatgaagatcttcagggtgaaagagaaggaggcagcaggcacttcttcgtcttcttgtcagtcaggtcggtttaagattggcaggtccatgtcaagcagtggccaggggttcttctttgcacggaatggccgctccagtggcactgtgctgccactgtgagtcggcaagttttttatcgtcaaggggatgcagcctcagcaaagccgggagctggtagtgtgtcagtgtctgttgatagaaagcatatacgagagtgctgaagtcgctctcggagaaaatctcctttgagatgcgaactgaagagttgttggtgataaggattttaagagtgatgtggtcgtgttagcttcaaagtcccaagtttcctgtatgataacttcaagcttgggccttgggttaagtgaatttggggaagctgatgtttttatgtagcaatcacgtaaaaaggaatggactatcacctatatcaacttctatttatctcaaaaaggaatggaacaaaaatactaaagtaagaatcttagccttggagaccagtacttcctggtggcggtgtatgatattgttagatctcttctttgtatggatagcattgagcatgtattgattgcaaactcaattagtaatttgtgattgtcttatttaaaaaaaaaaaaaaaaaaaa

SEQ ID NO: 7928 - protein, 361 aa, Panicum virgatum
  misc_feature: Ceres CLONE 1962189
  misc_feature (1)..(42): Pfam Name: zf-C3HC4 Pfam Description: Zinc finger, C3HC4 type (RING finger)
MIPLRPHAATTVTANCTDSPLDCLRLCPGGVEDCSEYALPPPPPIPAIPRAPDAGRHAPVRLLLVVSLLSAFLFISLALSTLLLYRRRRLILRRRRRLAAAAAEGADDGGGSGDEEEGGGGGGVVHHVWYIRTVGLDEATIASITAVEYRRGVGRAGDCAVCLGEFSDGELVRLLPRCAHPFHAPCIDTWLRAHVNCPICRSPVVVVPSDLPATAAEAAADGVQAEEHQVHDEMSLSQSEPETLGSEVSEASSDTQSEDTSASGEENVRAAAKPIRRSASMDSPLFLVAVPEVQDGVVPSNCKLPIAREMKIFRVKEKEAAGTSSSSCQSGRFKIGRSMSSSGQGFFFARNGRSSGTVLPL

SEQ ID NO: 7929 - DNA, 1095 bp, Panicum virgatum
  misc_feature: Ceres CLONE 1962210
  misc_feature: Encodes the peptide sequence at SEQ ID NO. 7930
gacaaactgcacgcatatccaagctcacaccaggtacctttctacgcaatcgacagtacatccagttccagccatgcttgccaacgctcagctcatcgctctcgccctcctcggcgccgcccccaccgccctggcctgcctgggctatgagggcggactccctacgcccacgtctaccaagcagatctcttcccctatttacgtcagggctggtcaggtctttgacggcggctgggccaagtacgacagaaaccccagcacttgcaacggtcaaaatgagggtggcgagtcagacaccgctttcgtcgttgagcgtggaggcactctccgcaatgtgatcatcggcaaaactgccggtgagggcgtctactgcaagggtggcggctgcaacttcgagttcgtctggttcgaggacgtctgcgaggacgccatctccattaaggacgacagagccggcgaccagacctggatcgtcggcggcggcgctttcaaggcgtcggacaagatcatccagcacaatggatgcggcaaggtcaacattatcaacttttacgccgaggactatggcaaggtctaccgatcctgcggtacctgcggcacgtgcgctcgcgaggtctacgtcgagggtgtcaccgcccgcaagggcagcggcaaggccggcgaggtcgtgggcatcactaagagcaacggcgacagggctacgctccgcaatgtctgcaccgatgccaaggttccttgccagaactacagcggccctggggataaggatggcccgtgctagattgttgatagtagcgtatgccctccatacaagttggtgtcatggattggcgagtttggtgtaagtatgtgcatattgcacttgcttaagattggtgctgcagttggacttgagagtggatgggtggtagctatatcaaagtattggctgttgttttcacattgaatttcgtcgaaggaaagatgcgagatatcgaacagactcgcagtcttgggcaatgctccagctagccggggtgactggtttggagagccattccccaatctttagtataacactacggtttccacagtcaaaaaaaaaaaaaaaaaaaa

SEQ ID NO: 7930 - protein, 235 aa, Panicum virgatum
  misc_feature: Ceres CLONE 1962210
  misc_feature (1)..(136): Pfam Name: Pectate_lyase Pfam Description: Pectate lyase
MLANAQLIALALLGAAPTALACLGYEGGLPTPTSTKQISSPIYVRAGQVFDGGWAKYDRNPSTCNGQNEGGESDTAFVVERGGTLRNVIIGKTAGEGVYCKGGGCNFEFVWFEDVCEDAISIKDDRAGDQTWIVGGGAFKASDKIIQHNGCGKVNIINFYAEDYGKVYRSCGTCGTCAREVYVEGVTARKGSGKAGEVVGITKSNGDRATLRNVCTDAKVPCQNYSGPGDKDGPC

SEQ ID NO: 7931 - DNA, 1156 bp, Panicum virgatum
  misc_feature: Ceres CLONE 1962414
  misc_feature: Encodes the peptide sequence at SEQ ID NO. 7932
atttatgcacggcactacttgcttgctcatctcgcaatctcggccagcatcagccatgacgaacgggtacctgttccgggagtacatcggcgcgcagttcaccggcgtccagttcgccgacgtgcccatcaacgccatgctcagcttccacttcatcctcgccttcgccatcgactacacccccgtggggcagccgacgccgccggcgccgaccaacggcgtgttccgcccgttctgggacacggccaacctgtccccctccgccgtggccgccttcaaggccgcgcacccgaacgtcgccgttatggcggggctcggcggcgacagcgtgcaggacgtcgtcaaggccgtcttcaccccgacctccgtcgactcgtgggtgtccaacgccgcggcgtcgctgaccgccatcatcaacgcgtacgggctcgacggcgtggatgtcgactacgagcacttcgccgccggcgccgacgtgggcacgttcgtcgagtgcgtcggccagctcctgacgcggctcaagaggacgatgccgtggatcaccacctccatcgcgccgttcgaggaccccgtgatccagcgctactaccagccgctgtggcgcaagtacggcggcgtcatcgactacgtcaacttccagttctacggctacggcgccaacaccgacgtgcccctgtacgtccggttctacgacgagcagacggcgaactaccccggcgccagggtgctcgccagcttcatgaccggcaacacgaccgggctgatctcgccggacctcggcatcagtgcggccaaggagctgcagcggcagaacaagctgccggggctcttcatctggtcagcggacagctccaagaagagcagctacggcttcaagtacgagatccaggggcagcagatcatcgccgaccattgatttctgatccgacggtgccgatactactctgctatggatgggcacacaaaatatttattactttgctacggactagtaaggaataatcacgttgctgcgcctacgtgcactactggtgttgttgtggtatgaataatgggttttgtttccatgtatgcagaaatttgtatgctcatatttcctaaatttggcaatttcaagtaacaagcatgatttttttaaaaaaaaaaaaaaaaaaaa

SEQ ID NO: 7932 - protein, 303 aa, Panicum virgatum
  misc_feature: Ceres CLONE 1962414
  misc_feature (1)..(246): Pfam Name: Glyco_hydro_18 Pfam Description: Glycosyl hydrolases family 18
  misc_feature (14)..(301): SWISSPROT Homolog: EC 3.2.1.14 Chitinase 1 precursor
  misc_feature (23)..(301): SWISSPROT Homolog: EC 3.2.1.14 Chitinase 2
MHGTTCLLISQSRPASAMTNGYLFREYIGAQFTGVQFADVPINAMLSFHFILAFAIDYTPVGQPTPPAPTNGVFRPFWDTANLSPSAVAAFKAAHPNVAVMAGLGGDSVQDVVKAVFTPTSVDSWVSNAAASLTAIINAYGLDGVDVDYEHFAAGADVGTFVECVGQLLTRLKRTMPWITTSIAPFEDPVIQRYYQPLWRKYGGVIDYVNFQFYGYGANTDVPLYVRFYDEQTANYPGARVLASFMTGNTTGLISPDLGISAAKELQRQNKLPGLFIWSADSSKKSSYGFKYEIQGQQIIADH

SEQ ID NO: 7933 - DNA, 1481 bp, Panicum virgatum
  misc_feature: Ceres CLONE 1962430
  misc_feature: Encodes the peptide sequence at SEQ ID NO. 7934
gagcaagaaaaggagctgcctttgagtaaccatacgtatggcagatatccagaaaaatctcgtgcattaggtaattcttttttgtttcgatcctccaatttcaggtcgtattgggcttccgagatggcggaccattccgaggtaatggcgggccgattgctcacggagtcgacgcttcagtctgccattgatgaggcatccgatgcgccttcttccacaatgactccgtgtgatcccgctgttgaagagggcagggcaacgagtggcgtcttggtagaatgcagaatctgccaagaggatgatgatgaggcctgcatggaggccccttgctcctgcaagggcagcttgaagtacgctcatcgcaaatgcattcagaggtggtgcgatgagaagggagacaccatatgtgagatctgccttcagcaatttacaccgaattacactacctcttcaaagctatttcagcatggaagaaacacgattttcttcagcgccccaggttacatccaagcacggccgtacgctgaccaaacatctgccacatcaacaagctacgagtatgaccgccaggcttcaactcctaccggcgtaatctgctgtcgcataatcgctataaaattgatggttctcttggtcctccacgacgccctctcggttctcctcggcgaccaaggcgcttataccgtcgccatgctcactctgctgatgctcagaacagcgggagtcgtcataccggtgtacatcataatggtagcggttgccgagctgcttcaacgacgcagccggcggcagggtgcgcacgagcagaatttagaacctgcgggagcggagagcgcgcagccacagcagcatgtcatcagcatccagtagtgtgcgctggctgcggaacctgcaacgaactgaaaccaaggactgagcttcggatgaaatttgcccgcagaaatgggaaagatatgtgactgtacagctttgcaattgtacatagtaggatatatttggctgctgccagcagctttgtatagagatcactgtacgtgattactctcttcaaatgaaggtgaagtgggtttactgtacataacaagatgatgtactagcagaggatcgatctgtcaaaccgatgcagagaaaaatggaaggcgaattgacggttgcattgtctgtgcactgggcgtggtgcatcaaacagcaggtcaagtatcaaaaaaaaaaaaacagcaggtcggcaagaactgaaccgtagtgggcggtctggcgagggggcggcggtcagagatcggcagttcggctcttgcgtgtcgtcggatctgctggaccgtgaaggaagttcagaaacgctggtaatcgagatgtcgatacttggcctttaaaatatataagctttagtcgctaatacatagttaacatatgtaaatcttgtaacaatacgataataactttgaaggcgagcatattcaaatcaaaaaaaaaaaaaaaaaaaa

SEQ ID NO: 7934 - protein, 248 aa, Panicum virgatum
  misc_feature: Ceres CLONE 1962430
  misc_feature (1)..(46): Pfam Name: zf-C3HC4 Pfam Description: Zinc finger, C3HC4 type (RING finger)
MADHSEVMAGRLLTESTLQSAIDEASDAPSSTMTPCDPAVEEGRATSGVLVECRICQEDDDEACMEAPCSCKGSLKYAHRKCIQRWCDEKGDTICEICLQQFTPNYTTSSKLFQHGRNTIFFSAPGYIQARPYADQTSATSTSYEYDRQASTPTGVICCRIIAIKLMVLLVLHDALSVLLGDQGAYTVAMLTLLMLRTAGVVIPVYIIMVAVAELLQRRSRRQGAHEQNLEPAGAESAQPQQHVISIQ

SEQ ID NO: 7935 - DNA, 1182 bp, Panicum virgatum
  misc_feature: Ceres CLONE 1962432
  misc_feature: Encodes the peptide sequence at SEQ ID NO. 7936
acccccctcccgtcctcgccccgccccgcctcgccgcgcgccctaaccctagctccccgattccacgctgctccagccgagctcgctcgcggggcgccctggttggcctccgtgcccttctaatctcgcgcggattcggcgcggcggctgaagatggacccgatggacatcgtgggcaagtccaaggaggacgtctccctccccaaatcaacaatgtttaagataattaaggagatgcttcctcctgatgttcgagtggcaagagatgcacaggatcttcttgttgagtgctgtgtagagttcatcaatctcctctcttcggaatccaatgaagtatgcagccgagaagagaagaaaacaattgctcctgagcatgttctcaaggccctaagtgatcttggcttcagagagtacattgacgaggtttatgctgcatatgaacaacacaaacttgatactctggactcaccaaaagctagcaagttcactgggattgagatgacagaggaagaagctgttgctgagcaacaaaggatgtttgctgaggctcgtgcaaggatgaataatggaacccccaagccaaaggagcctgaacaagagcagcagcagcaaccacatcctcaacttcagttgcatacaacaccacagcaacccatgcagcctcaactgcagctgcatcctcagccgcagaagcacccgcaagtgcagctgcattctcagtcgcagcaaccccatgtccagccgcagcagcccacacaagtgcagctgcactctcagccacaacaggccccacaagtgcagctccacccacagcggcagcaacccccacaagcgccgccgcatccatcaccagagcaatcctcgcaacctgaacctcaggtgcatctgcaatcacaggagcccccacaagcgcagctgcaacctcacctgcaagctcagccgcagccacaggcacaaaccgaacatggtggggacagttagagactctgttgtgtagcctcagtataagtcaaaaaccaggtgcttttgctggcatttactaggaccttgtatgcctgcttgtgacttgttagatcctgatttaggtttctgtgcttcatgtacaatgtaaatccagtgtgattgcagttgccttgttgctaataaaccaaagccgttagccaaaaaaaaaaaaaaaaaaaa

SEQ ID NO: 7936 - protein, 275 aa, Panicum virgatum
  misc_feature: Ceres CLONE 1962432
  misc_feature (1)..(66): Pfam Name: CBFD_NFYB_HMF Pfam Description: Histone-like transcription factor (CBF/ NF-Y) and archaeal histone
  misc_feature: The sequence is a functional homolog of  SEQ ID NO 2190 in the  10/374,780 US patent application
  misc_feature: The sequence is a functional homolog of  SEQ ID NO 24 in the  11/375,241 US patent application
  misc_feature: The sequence is a functional homolog of  SEQ ID NO 715 in the  11/479,226 US patent application
  misc_feature: The sequence is a functional homolog of  SEQ ID NO 824 in the  10/374,780 US patent application
  misc_feature: The sequence is a functional homolog of  SEQ ID NO 92 in the  10/374,780 US patent application
  misc_feature: Useful for making plants with modulated growth and phenotype characteristics
MDPMDIVGKSKEDVSLPKSTMFKIIKEMLPPDVRVARDAQDLLVECCVEFINLLSSESNEVCSREEKKTIAPEHVLKALSDLGFREYIDEVYAAYEQHKLDTLDSPKASKFTGIEMTEEEAVAEQQRMFAEARARMNNGTPKPKEPEQEQQQQPHPQLQLHTTPQQPMQPQLQLHPQPQKHPQVQLHSQSQQPHVQPQQPTQVQLHSQPQQAPQVQLHPQRQQPPQAPPHPSPEQSSQPEPQVHLQSQEPPQAQLQPHLQAQPQPQAQTEHGGDS

SEQ ID NO: 7937 - DNA, 634 bp, Panicum virgatum
  misc_feature: Ceres CLONE 1962648
  misc_feature: Encodes the peptide sequence at SEQ ID NO. 7938
acagacgacgcgcaccaccagcacgccgacgactgaacgaggcgaggcgagaaccggccgaggcggaggcgatgggcggcggcggcgcgcacggcggcaccacctacaagggctacaccatcccgcacaacaagcgctggcacaccgtcgccggcaagggcctctgcgccgtcatgtggttttgggttttctacagggctaagcaggacggtgctgtgctcttgggcttgcgccatccttgggatgggcatgatgatcactctcatggacatggacatggacatgaacatgaggcatcatcgtcatcgtcttcttttcattgagttcactacaacttgcagctgacggtgatgcgatgttccaactaaagtttcagttaataaattctgccccgctgcatgggagtcatgttgtttgcgagttgcttagcacaaactgttttcctgacaattgtgcttatgtatttgatttcaagcttcagttgatatgttgtgggaaagaatttgttgtatgtcgcttctcgttgtgaccactacctgtgccccttgctctgctcttgcccataagacccaaacatctttggacagtctctttttgtattttgtatttattggggcttgatagcaactcagtc

SEQ ID NO: 7938 - protein, 83 aa, Panicum virgatum
  misc_feature: Ceres CLONE 1962648
  misc_feature: Great-hit functional homolog of the protein sequence given in SEQ ID NO 9351
  misc_feature: Useful for making plants with modulated flowering time
  misc_feature: The plant flowers significantly late compared to wild-type.
MGGGGAHGGTTYKGYTIPHNKRWHTVAGKGLCAVMWFWVFYRAKQDGAVLLGLRHPWDGHDDHSHGHGHGHEHEASSSSSSFH

SEQ ID NO: 7939 - DNA, 1308 bp, Panicum virgatum
  misc_feature: Ceres CLONE 1962707
  misc_feature: Encodes the peptide sequence at SEQ ID NO. 7940
aattttcactctccactctcccaccagcatcacttgacaccgccgccgcctcatctccatctgcatcctcgagcaccattccaagaacagcaaccgcatacgttgagcttgaccggcgacggcaacccatggctctccgcgcgctcgacaacacgatgcccgctgccgtcgaggaacggcccaagaaggtcgctaaggtggccgcccccaccgaggccgcccccgtcaaggctgcctcccccgagagcggcaagaggaagaagaagaacgacgagaactcggcgcccagggccacggccgcggcaggggagcaggccgtggagtacatcccgtcggaggagctggaggcggcggcgcacccgaaggccaaggccgcggggctggtcgcggagctggactccaaggactggatccgggcgtgcgaggcgctcaacgacgcgcgccgcctcgcgatccaccactccgcgctcctgaacccgatcgtggagaaggtgatgctggcgatcgtgaagacgatgaagagcccgcgcagcgcggtgctgaagacatccatcatggcctgcaccgacatcttcaactccttcggcaacctcctctcctccgtctccgacgacgcgttcgacaagctgctgctccaactcctgctgaaggcgtcccaggacaagcggttcgtgtgcgaggaggccgagaaggcgatgcgcgccatggcggcgtcgatgcctccgctgccgctgctgaagaagctcaaggcgtacgtccaccacgccaacctcagggtcagggccaaggccgccgtcgccatctcccactgcgccgccaggatggacatcgcggcgatgaaggagttcgggatgtcggcgctcctccaggtggcggcggagctgctgaacgaccggctgccggaggccagggaggccgcccgcagcgtggtggggtcgatgcacggcgccttcaccaaggaggccgctgataaggggaaggaggaggaggacgcaccctccgtggccgcctcctgggagagcctctgctcgctcagcctgccgcccatctccgcgcaggccgtcgccaagatcgccgcctcgcagtgaccaatgcgcagtttgggcttcagctggtccacttcagaaatcagaacccgctgcatggcccagccgtttactagttttttttaaattattgctgcaggttcattttcgtttgtttatatactccatgctatctcgcatggtttgttctgttaatccatttggtgttcctgcaagtaataacatatcagttcatatggcttaaaaaaaaaaaaaaaaaaaa

SEQ ID NO: 7940 - protein, 319 aa, Panicum virgatum
  misc_feature: Ceres CLONE 1962707
  misc_feature: Great-hit functional homolog of the protein sequence given in SEQ ID NO 9559
  misc_feature: Useful for making plants with modulated nitrogen use efficiency
MALRALDNTMPAAVEERPKKVAKVAAPTEAAPVKAASPESGKRKKKNDENSAPRATAAAGEQAVEYIPSEELEAAAHPKAKAAGLVAELDSKDWIRACEALNDARRLAIHHSALLNPIVEKVMLAIVKTMKSPRSAVLKTSIMACTDIFNSFGNLLSSVSDDAFDKLLLQLLLKASQDKRFVCEEAEKAMRAMAASMPPLPLLKKLKAYVHHANLRVRAKAAVAISHCAARMDIAAMKEFGMSALLQVAAELLNDRLPEAREAARSVVGSMHGAFTKEAADKGKEEEDAPSVAASWESLCSLSLPPISAQAVAKIAASQ

SEQ ID NO: 7941 - DNA, 1271 bp, Panicum virgatum
  misc_feature: Ceres CLONE 1962751
  misc_feature: Encodes the peptide sequence at SEQ ID NO. 7942
ggaaggggcgcgcacacaggcatcgcgtcttcacctttggggccaaacagaaatggcggcttcttgcgcctccaccctcctcccttcactctccttcgtttgctcctcctcctcctcctcctcctccttttccaattcacctcggcggttcaggcgctctagggtggtggccatggccagcgtggggcagaaggtgtacgcgcccggcgtggcggtgtcggagggcaatggcggactgccaaaaatcaatctcaaatccccgcatggaagcgaggctgagatctatctgttcggagcatgtgttacttctttcaaagtccctaatggcaaggacctactctttgttcgaccagatgcagtgttcaataggcagaaacccatcagtggcggaattccacattgtttcccccagtttggcccaggtcccatgcagcagcatgggtttgcacggaatgtgaattggtccatcgcagattcagaagtcaccgaaggagatccagctgtaattttggaacttaaagatgactcttatagtcgttctatgtgggattttagcttccaagcattgtacaaggtttccctgcactctaaaagcttgtcaacaactctaaaaataacaaatatggatgacaagcctttctcattcaactcagcactccacacttatttccgtgcttccataactggcgtttctgtgaaaggtctgaaaggttgtaagactctcaataaggaccctgacccaaaaaatcctttggagggcaaagaagagagggaggaggtgacttttccaggatttgttgactgcatctaccttggtgcaccgggtgagctcatcctggacaatggattgggtgacaaaattgccatctcaaattcaagttggtcagatgcagtgttgtggaatcctcatttgcagatggaggcctgttacaaagattttgtctgtgtcgaaaacgcaaagattgaaacagtacaactggagccgaaacaatcttgggtggcagagcagaaaattgaactgatctgaagataatgccttgctgcaactgcatcaagcagtgagatacaaatggcattcccccccaatgaaattcttcatggcacatgtcatcacaatagttgtgcacccaagttatccaatatttcctgtaaaaaggaataagtgatgcaaatcaggatgcttttttggcagtatgatgtttactgcgttgcaaatgtacaattcaaactacacggactctgttgaaacggaaaaaaaaaaaaaaaaaaaa

SEQ ID NO: 7942 - protein, 324 aa, Panicum virgatum
  misc_feature: Ceres CLONE 1962751
  misc_feature (1)..(260): Pfam Name: Aldose_epim Pfam Description: Aldose 1-epimerase
MAASCASTLLPSLSFVCSSSSSSSSFSNSPRRFRRSRVVAMASVGQKVYAPGVAVSEGNGGLPKINLKSPHGSEAEIYLFGACVTSFKVPNGKDLLFVRPDAVFNRQKPISGGIPHCFPQFGPGPMQQHGFARNVNWSIADSEVTEGDPAVILELKDDSYSRSMWDFSFQALYKVSLHSKSLSTTLKITNMDDKPFSFNSALHTYFRASITGVSVKGLKGCKTLNKDPDPKNPLEGKEEREEVTFPGFVDCIYLGAPGELILDNGLGDKIAISNSSWSDAVLWNPHLQMEACYKDFVCVENAKIETVQLEPKQSWVAEQKIELI

SEQ ID NO: 7943 - DNA, 795 bp, Panicum virgatum
  misc_feature: Ceres CLONE 1962859
  misc_feature: Encodes the peptide sequence at SEQ ID NO. 7944
aaagacagctcagtcagctgaaggccgagcgatcgagctgcagaggttacaatcacaatgaaggggagcacggtccacgagcacgagacagacgtctccgcctccgacctgtgggcgatctacggcacgctccgcgccgccgagctgttggcggagctgctcccgcaagtcctggccaaagtcgaggtcatcagcggcgacggcggcgtcggtaccatcttgcagctgacgtacccccctggcattccgggcctggagagttacaaggagaagttcatcaaggttgacaacgagaactacatcaaggaggcgcaggtgatcgatggcgacatcctgaagctggggttcctctcctacatggtacggttcgaggtcatcgcaaaggggcccgactcgtcggtgatacgatcgactgtcgagtacgagattgatgaagcgcacccggagcttgaagccatggtgagcccggcgccttttgctgcgatcgccgagaaattctctgagtataccaaggagaagaagctcatcactcaggcagcctcttgattggaagagctcaagagcaaaggttatcaccaacgacaaataatgttctactacaattaatgcgtgtctttctattttgcatctccattgttgctgtgaacgcaaattcatccggatcgaacaaatcacagatgcttcatctaatttgttcaccacatccactgtttctcatatatacaactattgtaaggtaccataataaaggcatatgtacccgttgtgattgagcaaaaaaaaaaaaaaaaaaaa

SEQ ID NO: 7944 - protein, 162 aa, Panicum virgatum
  misc_feature: Ceres CLONE 1962859
  misc_feature (1)..(142): Pfam Name: Bet_v_I Pfam Description: Pathogenesis-related protein Bet v I family
MKGSTVHEHETDVSASDLWAIYGTLRAAELLAELLPQVLAKVEVISGDGGVGTILQLTYPPGIPGLESYKEKFIKVDNENYIKEAQVIDGDILKLGFLSYMVRFEVIAKGPDSSVIRSTVEYEIDEAHPELEAMVSPAPFAAIAEKFSEYTKEKKLITQAAS

SEQ ID NO: 7945 - DNA, 556 bp, Panicum virgatum
  misc_feature: Ceres CLONE 1963007
  misc_feature: Encodes the peptide sequence at SEQ ID NO. 7946
ggtaacagctcatcagtgctcaagatctcaagcttcatctcgctcttttgcatagaagttcttgagtttacaagaggccggattcctgaagatgtcttgcggtggaagttgcaactgcggttcgagctgcagctgcggcggcggctgcggaaagatgtaccctgacctgactgagaagaacgcctccactgccccggcagccatggtccttggcgtcgcacctgagaaggggcgcctcgaggatgggttcgagaaggccgctgagtccggcgaggctggccatggctgcagctgcggctccagctgcacctgcaacccctgcaactgctgaagatgaaggcatgcacactcgtgcctttctgtgacatggcctactatacgtaaataagaagccatctgatgcgcaatggcttggctgcttgatgatctcctgttaccctgtccatgcaatggcttagctgtggcttgtgaaaccatggactagtctttgtgtggtgtgtgtatgcatgtgttgtactgtttcggtgaagtgaatataaatacagtttgcttgtgc

SEQ ID NO: 7946 - protein, 79 aa, Panicum virgatum
  misc_feature: Ceres CLONE 1963007
  misc_feature (1)..(78): Pfam Name: Metallothio_2 Pfam Description: Metallothionein
MSCGGSCNCGSSCSCGGGCGKMYPDLTEKNASTAPAAMVLGVAPEKGRLEDGFEKAAESGEAGHGCSCGSSCTCNPCNC

SEQ ID NO: 7947 - DNA, 1100 bp, Panicum virgatum
  misc_feature: Ceres CLONE 1963102
  misc_feature: Encodes the peptide sequence at SEQ ID NO. 7948
accacctcacagtccgctaaacccactggctcacgcaggcaggatagccctgcgccgagctcgatctccctgcgcgtccccgaaccccaccaccaaaagggccgggcgcgagcgcgatcaatggccacctccgaagccgggggcgcggcgccccgcgtggcgtggcgcgtcgtgctggcggcgaaggtcctcgtcctggccgtgggcgtctacggctgcttcctgcagctcccgtgcgccgccgccgcggcgtccgccgtcctccgcgtcgccgcctccctctcggcccagcagtacctcttcctggtcggcaacgccatcgtgatcgtcctcttcgagcacttccgccgcgacgacgaggcctcctcgttctcgacaggggccttcttcagcaggtggtggcccgccgaggccgacacgcagggccggtacctcccgttcccgggcgcgcagctggtgccgccgccgtcgccgaccaccgaggcggggggagagaaggaggagaaggagaaagagaaggagaaggagaaggcagtgttcgaggacaagaaggcggtgcacgtgacggcggtgcgcgccaagcccccgcggccgagcaggtcggagaaggccggcggcggcgcgtcgggccggaggccggccgcggcgccggagctgcggcggggggactcggagaatgggcggcagcggcagcaggcggtggcggtggcggaggcggaggcggacccagaggcgttccggctttggatcgaggcgttcatcctgaagaagcagcaggacttcctgcgcgaggagtccgccgccgccgccgccgcctccgggaagaaaggcgcgccggtggccgccggagccgtggtggcggtgaagtgatcatcagctgccgggtaaacgcagcatcagcagcagggaagaagaacaagaaaaaaaacaccaaagcctgctatgcatctgcaataaggaagagagtgtgaaaggattgagatgaacccaagcaacaggggccagcagccaaaactagcgtcttgtaaagaactcgcgctggcgcctttgtttagcgaacaagttttgccttttgcctccaaaaaaaaaaaaaaaaaaaa

SEQ ID NO: 7948 - protein, 249 aa, Panicum virgatum
  misc_feature: Ceres CLONE 1963102
  misc_feature: Great-hit functional homolog of the protein sequence given in SEQ ID NO 9737
  misc_feature: Useful for biocontainment applications
  misc_feature: The plant produces a reduced number of seeds.
MATSEAGGAAPRVAWRVVLAAKVLVLAVGVYGCFLQLPCAAAAASAVLRVAASLSAQQYLFLVGNAIVIVLFEHFRRDDEASSFSTGAFFSRWWPAEADTQGRYLPFPGAQLVPPPSPTTEAGGEKEEKEKEKEKEKAVFEDKKAVHVTAVRAKPPRPSRSEKAGGGASGRRPAAAPELRRGDSENGRQRQQAVAVAEAEADPEAFRLWIEAFILKKQQDFLREESAAAAAASGKKGAPVAAGAVVAVK

SEQ ID NO: 7949 - DNA, 977 bp, Panicum virgatum
  misc_feature: Ceres CLONE 1963116
  misc_feature: Encodes the peptide sequence at SEQ ID NO. 7950
acagacctctcctctctccatcctccaatctccaagcagcagcagcagcagatcccatccatggcggggggcaagtccaccggcaacgccgcgcgcaccaggaagcgcgtcgaggccaccgtcctcaagcgctccagggacggcagcgcattcaccagatgcgaggcctgcaacaaggacgtccccgtcgtcctcatcgacatgcacagctgcagcctcgacgccaagatcaggatgacgctcgaggcgcaggtggtcgagaggaccgtcgaggtcaccaagcccgaccgcaagaagccctccaagaccgccaaggaccccaagcgcaagcgcacgcccaccgccttcttcctcttcatggccgacttcaggaaggagttcaaggccgcccatcctgacaacaagaatgtcgccaccgttgcaaaggaaggaggggagaagtggaactccatgaccgaccaagagaagaagccctacatggacaaggctgccgagctcaaggctcttgctgagaatggcgagggcagtggtgagaacaatgtcgctggtgccgagaacgagaaagccaaggcagatgaggagggggaccaggaggtggatcagccaccgcccaagaggcgccgccgccgcaaggtcgctgatgatgaggatgaggaggacgaggcgggtggccagggagacgatgatgagaagaacgagctggatgatgacatgtagatggaagagcagagcgacctgctcttttatttatgtaaatggcgggcagatgtgctagatcgtggcttgtttgattcgagagctggattgtagtcgtagcacgccatcactgtagctattcactactagtgatgaagatggcattttcgttttggtagcttgcagtcggtgctacctgtggcgacagtgctagctaaatgttgttggcacatgaatgaatatctatctatctatctgttcaaaaaaaaaaaaaaaaaaga

SEQ ID NO: 7950 - protein, 218 aa, Panicum virgatum
  misc_feature: Ceres CLONE 1963116
  misc_feature: Great-hit functional homolog of the protein sequence given in SEQ ID NO 9360
  misc_feature: The sequence is a functional homolog of  SEQ ID NO 1446 in the  11/479,226 US patent application
  misc_feature: The sequence is a functional homolog of  SEQ ID NO 682 in the  10/412,699 US patent application
  misc_feature: Useful for making plants with altered Lignin content
  misc_feature: Useful for making plants with altered alkaloid content
  misc_feature: Useful for making plants with modulated growth and phenotype characteristics
MAGGKSTGNAARTRKRVEATVLKRSRDGSAFTRCEACNKDVPVVLIDMHSCSLDAKIRMTLEAQVVERTVEVTKPDRKKPSKTAKDPKRKRTPTAFFLFMADFRKEFKAAHPDNKNVATVAKEGGEKWNSMTDQEKKPYMDKAAELKALAENGEGSGENNVAGAENEKAKADEEGDQEVDQPPPKRRRRRKVADDEDEEDEAGGQGDDDEKNELDDDM

SEQ ID NO: 7951 - DNA, 1209 bp, Panicum virgatum
  misc_feature: Ceres CLONE 1963192
  misc_feature: Encodes the peptide sequence at SEQ ID NO. 7952
attaatgggcttcgcgagccttcgatccgagctcccgacgaacttcattcacatcgcctcttgattcttgaactaaacaactctccgtcctcctcctcgatcggctcctcctgatctccacgagaagagaacccttacttgctgttctcctagccaagttgatgagctacctgcctgctgctttgatcctttcagccccttattagctagcttcgtcctcccgatcgagagccgccgatgcctcctgccgtcccccaagagccatgagcaacgccagcaacagcaagaagcacagcctcctcgcgccaaaggccaccatggacatgtctcgcctgcaccaggcctacgaccgcggctagcttagctcgctcgctcgctcgctccaccatctctactaggttctttgaacgtagtctagcgcctcgcgtggttcgtcgtgttccgcgtgctcatcagtttgtgcgcagtcgtagcttttattagcaacgatatgaaggaagaaggaggcgagaagaagaacatcctggccaagacgctccagcggtgccggacctcgctggcccaccggaggcgcccgccgccgccggccccctacagggcggcggccggctacttcaccgtgctggtgggcccggagaaggagcgcttcggcgtgcgcgcgcgctgcgccaaccacccgctgttccgggcgctgctggacgaggccgagaccgagtacggcttcgccggctgcgacggcccgctcgagctgccctgcgccgtcgacgacttcatggaggtcatgtgggagatggagcaggccgaccccgccgcctcgccgggctgcgggcgcttcgccgccgccggcagcagagggcaccaccaggggtaccagatgatgagccccgccagattcctcgtcgccggacgctcgtgatcttgccgatggccggcgtcggcgacggtctaataagtccgatcgtcgccgcgcctgccgttcactgtcaatcaacttcttttgttttactttgtacgtagaccagcgtattagtctcgctccagccgcatgcatgcagaacagcaggagtttgtccacctgctttgctttgcttgcttgcttttgctaagctgtcaacgcttgttttcagttttactctcttgttcgctgcttgtaatcatatatagttacgttgctcgtctactgaatcccaaaaaaaaaaaaaaaaaaaa

SEQ ID NO: 7952 - protein, 141 aa, Panicum virgatum
  misc_feature: Ceres CLONE 1963192
  misc_feature (1)..(98): Pfam Name: Auxin_inducible Pfam Description: Auxin responsive protein
MKEEGGEKKNILAKTLQRCRTSLAHRRRPPPPAPYRAAAGYFTVLVGPEKERFGVRARCANHPLFRALLDEAETEYGFAGCDGPLELPCAVDDFMEVMWEMEQADPAASPGCGRFAAAGSRGHHQGYQMMSPARFLVAGRS

SEQ ID NO: 7953 - DNA, 1329 bp, Panicum virgatum
  misc_feature: Ceres CLONE 1963215
  misc_feature: Encodes the peptide sequence at SEQ ID NO. 7954
agcttctttaaccacccaccgcccgccattatcatctcgctccatccccttcgcttctctctctccttgcatctcgccggccagccgtgtgctgctgctctctgtctctgcgtgcgcccgccgacaggccaaaagccgaagccttccgcagcagcctctggtgtgcgcattggagcggcggcgccggcgggggaattaattgatccatggcaggcctcgggtacgaggagaccgagctccggctcggcctgcccggcggcgggagcgacgccaccggggacgccgcggccgcgaggaagcggtgcttcgaggagaccatcgacctcaagctgaagctggaacagccggcgtcgtcgcccgcggcgcgcgtcgagaaggaagcagaggaggacggtgaggccgaggaggaggcggtggcggcggccgatgtcgtcgcggccgcgtcgccggcagcgtccgccaccggcggagctggaggtaacaatatgaagaggtcgccgagccagagcagcgtggtcaccgccgacgacgacgcgcagccggaccctgagaagcctcgcgcgcccaaggcgcaggcggtggggtggccgcccgtccggtcgtcccgcaagaacatcttctccgtgcagaaaaccggcggcggcaaggacgacgacggcaagtccggcgccggcgcggcggcggcgttcgtgaaggtgagcatggacggcgcgccgtacctgcgcaaggtggacctgaggatgtacgggagctaccaggagctgtccaaggcgctcgagaagatgttcagctccttcaccatcggcagctgcggcgggtcccaggggatgcagggtatgaacgagtccaagctggcggacctgctcagcggctccgagtacgtgcccacctacgaggacaaggacggcgactggatgctcgtcggcgacgtgccctgggagatgttcgtggagtcgtgcaagcgcctccggatcatgaaaggatcggaagccgtcggcctcgcgccgagggcgatggagaagtgcaagaacagttgctgaggaaggcacacatcatcgcaagcgtccggcctgtattaactgcaaggatgatggatacgcgtctgcccgtctctgtatcatattaatgttgttgttgatcgagtttactgccctgaaagcctgtgtcgatctctcatcgtcgtctcagtcaaggcgtgttcatgtattagtctgttctttctcgttcttttagggattccatgcttgtattgttgttgcggttaagtttcatcttgttatatgaagtatatatatacacacgtaacaaagatggtgtgattattgatcg

SEQ ID NO: 7954 - protein, 277 aa, Panicum virgatum
  misc_feature: Ceres CLONE 1963215
  misc_feature (1)..(265): Pfam Name: AUX_IAA Pfam Description: AUX/IAA family
MAGLGYEETELRLGLPGGGSDATGDAAAARKRCFEETIDLKLKLEQPASSPAARVEKEAEEDGEAEEEAVAAADVVAAASPAASATGGAGGNNMKRSPSQSSVVTADDDAQPDPEKPRAPKAQAVGWPPVRSSRKNIFSVQKTGGGKDDDGKSGAGAAAAFVKVSMDGAPYLRKVDLRMYGSYQELSKALEKMFSSFTIGSCGGSQGMQGMNESKLADLLSGSEYVPTYEDKDGDWMLVGDVPWEMFVESCKRLRIMKGSEAVGLAPRAMEKCKNSC

SEQ ID NO: 7955 - DNA, 1281 bp, Panicum virgatum
  misc_feature: Ceres CLONE 1963217
  misc_feature: Encodes the peptide sequence at SEQ ID NO. 7956
ggcatcgcgcacacaccccattgtatcgggaggctgctgctgctgctgctggtagctaaccatggctggagccccgcccccgctgctgctcgcgctgctgggcctcgccctcgcggtcctcgccgcggccggcggcgccaatgccgccgggaggaagacggtcggcgtgtacgagctcaggaagggcgatttctccgtcagggtcaccaactggggcgccaccctcacctccgtcgtgctgccggactccaaagggaacttggctgacgtcgtcctcggctacgacaccattgctgaatacgtgaatggctctgcatattttggagcgctcgtcggacgcgtagccaaccgggttgctgatgcgcggtttgtgctcgatggaaaagtctaccatctgtatcgcaacgatggcaagaacgcactccacggtggcaggaggggcttcagcaaagttatatggacggtgaaggagtatgtcggtggcggcgactccccgtacatcacgttgtactaccacagcttcgacggcgaagaagggttccccggcgacctggatgtgtacgtgacgtaccggctgtcaggcccctacgagctgagcctgcggatgaacgcgacggcgctgagcaaggcgacgccggtgaacctggcgagccacgcgtactggaacctgggcggccacggcagcggcgacgtcctgggccacacggtgcagctgctcgcgtcgcggtacacgcccgtgaacggctccctgatcccgacgggcgcggtggcgcccgtggccggcacgccctatgacctccgcgccccgacccggctgggcgcgcgcctccgcgaggtctacggcggcagggccggcgtgtacgggttcgacaccaacttcgccgtggacggggaggcccgcgcgctgcggaaggtggtcgtggtccgcggcggcggcggcgcgccgggggcggggcgggcgatggagctgtgggcggaccagcccggggtgcagttctacacgggcaacttcctggcgggcgtggaggggaagggcggcgcggtgtacgggccgcacgccgcgctgtgcctggagacgcaggggttccccgacgccgtgaaccaccccaacttcccgtcggtgatcgtcaggcccgggcaggtgtacaggcacctcatggtcttcaagttctcgttctaggtgcgcgctgctgtattagcagcctgtgttgtgagtttgtggctgtgacctgggctgggactggacacacaataatatccgattcggagtcgtcaatttgc

SEQ ID NO: 7956 - protein, 372 aa, Panicum virgatum
  misc_feature: Ceres CLONE 1963217
  misc_feature (109)..(363): Pfam Name: Aldose_epim Pfam Description: Aldose 1-epimerase
MAGAPPPLLLALLGLALAVLAAAGGANAAGRKTVGVYELRKGDFSVRVTNWGATLTSVVLPDSKGNLADVVLGYDTIAEYVNGSAYFGALVGRVANRVADARFVLDGKVYHLYRNDGKNALHGGRRGFSKVIWTVKEYVGGGDSPYITLYYHSFDGEEGFPGDLDVYVTYRLSGPYELSLRMNATALSKATPVNLASHAYWNLGGHGSGDVLGHTVQLLASRYTPVNGSLIPTGAVAPVAGTPYDLRAPTRLGARLREVYGGRAGVYGFDTNFAVDGEARALRKVVVVRGGGGAPGAGRAMELWADQPGVQFYTGNFLAGVEGKGGAVYGPHAALCLETQGFPDAVNHPNFPSVIVRPGQVYRHLMVFKFSF

SEQ ID NO: 7957 - DNA, 1348 bp, Panicum virgatum
  misc_feature: Ceres CLONE 1963218
  misc_feature: Encodes the peptide sequence at SEQ ID NO. 7958
gtccagagctcagaccatcttcccagcacactccggcgatggcgccgcccggggacccgccgccggcgaccaagtacttctggggcgacacccccgagcccgacgagtactacgccgcgcaggggctccggcacgccgagtcctacttccagtcccctcacggccgcctcttcacccacgccttccacccgctcgccggcgacgtcaagggcgtcgtcttcatgacccacggctacggttccgactcctcgtggctcttccagaccgccgccatcagctacgcgcgctgggggtacgccgtcttctgcgccgacctcctcggccacggccgctccgacggcctccgcgggtacgtcggcgacatggaggccgccgccgcggcgtccctcgctttcttcctctccgtgcgcgccagcgcggcgtacgccgcgctcccggcgttcctgttcggcgagtccatgggcggcgccgccacgctgctcatgtacctccgctccccgccgtccgcgcgctggacggggctcgtgctctcggcgccgctcctcgtcatccccgacggcatgtacccgtcccgcctccgcctcttcctgtacggcctcctcttcggcctcgccgacacctgggccgtgctcccggacaagaggatggtggggaaggcgatcaaggaccccgacaagctgcggcttatcgcgtccaacccgctcggctaccgcggcgcgccgcgggtgggcacgatgcgggagctggtccgcgtgacggatctgctgcgggagagcctcggggaggtggcggcgccgttcctcgccgtgcacgggacggacgacggcgtgacctcgccggaggggtccaggatgctgtacgagcgcgcgagcagcgaggacaaggagctcatcctgtacgaggggatgtaccactcgctcatccagggggagcccgacgagaaccgcgaccgcgtgctcgccgacatgcgcaggtggatcgacgagcgcgtgcgccgctacggccccgccgccgccgccaacgggggcggcggcaaggaggagccgccggcgccctgacggtgcggtgcagtgttggttgtcacttattcccatcacaactccattcctgtttcttgtttttcttttgggtaatcgctcattcgcttgtagttttacgaagatgatgggcgtcgagtgccatcgactgcaagaaatatctgaactataccttttgctttccttaaaaaaaaagagcttttgctttccttggaccaaatttgttgccagtggtgcacttgcaattacattggttgggcgactcaatcaaattgaataattgttcagatcaaaaaaaaaaaaaaaaaaaa

SEQ ID NO: 7958 - protein, 339 aa, Panicum virgatum
  misc_feature: Ceres CLONE 1963218
  misc_feature (1)..(221): Pfam Name: Abhydrolase_1 Pfam Description: alpha/beta hydrolase fold
MAPPGDPPPATKYFWGDTPEPDEYYAAQGLRHAESYFQSPHGRLFTHAFHPLAGDVKGVVFMTHGYGSDSSWLFQTAAISYARWGYAVFCADLLGHGRSDGLRGYVGDMEAAAAASLAFFLSVRASAAYAALPAFLFGESMGGAATLLMYLRSPPSARWTGLVLSAPLLVIPDGMYPSRLRLFLYGLLFGLADTWAVLPDKRMVGKAIKDPDKLRLIASNPLGYRGAPRVGTMRELVRVTDLLRESLGEVAAPFLAVHGTDDGVTSPEGSRMLYERASSEDKELILYEGMYHSLIQGEPDENRDRVLADMRRWIDERVRRYGPAAAANGGGGKEEPPAP

SEQ ID NO: 7959 - DNA, 1044 bp, Panicum virgatum
  misc_feature: Ceres CLONE 1963330
  misc_feature: Encodes the peptide sequence at SEQ ID NO. 7960
ggacaccggccttcaacctggcctctgctcttggcttggctgccgcattggcaaaaatccagatggcgatggcctcgcgggcgctcgccgcgtggcggcagctcgggctcgtcgctctgctgccgcacctcctcctcctcctcgacgccgccggcgcgaggcagtgcttctggccggggcaggcgcccgaggaccccggctgcctgagctggcgcgtcatggtggaggccaacaacgcccgggggtggcgcacggtgcccgcgcagtgcgtcggctacgtcaaggggtacatgacgcggggccagtacctcagggacctggccggcgtcatggagcaggcgtcaggctacgccgaccagatcgccgccggcgccggcgccgaccccgacggcctcgacgcctgggtcttcgacatcgacgacacctgcctctccaaccttccctactacgagaccaagcagttcggggcgtacgatccgtcagccttcaaggcgtgggcgagcaaggaggcctgccaggggatacccccggtgctcgggctgttcatggcgctgctggacaagggcttcaaggtctttctcctctccgggcgggacgaggagacgctgggcccctgcacggccgggaacctggaagcagagggcttcttcgggtacgagaggctcatcatgaggaccccggagtaccgagggcagagctcgtcggtgttcaagtcggcgatgaggaagcagctcgtggacgaaggctacaggatccgcgggaacgtcggggaccagtggagcgacctgcagggcgactgcgccggcgaccgcgtgttcaagatacccaaccccatgtacttcgtcccttgaggcgatttttttttttcagcctttacctgcctgactgaactcgtcaggaaatcaggatcaaacaaatgatgtagtgaatgatgtaaacggatggctaatgtggaagaagcacaggccgtaaagcaaatataatcgacgacgacgaagaagaagaacacttcttcttttactccaaaaaaaaaaaaaaaaaaaa

SEQ ID NO: 7960 - protein, 262 aa, Panicum virgatum
  misc_feature: Ceres CLONE 1963330
  misc_feature (5)..(227): Pfam Name: Acid_phosphat_B Pfam Description: HAD superfamily, subfamily IIIB (Acid phosphatase)
MAMASRALAAWRQLGLVALLPHLLLLLDAAGARQCFWPGQAPEDPGCLSWRVMVEANNARGWRTVPAQCVGYVKGYMTRGQYLRDLAGVMEQASGYADQIAAGAGADPDGLDAWVFDIDDTCLSNLPYYETKQFGAYDPSAFKAWASKEACQGIPPVLGLFMALLDKGFKVFLLSGRDEETLGPCTAGNLEAEGFFGYERLIMRTPEYRGQSSSVFKSAMRKQLVDEGYRIRGNVGDQWSDLQGDCAGDRVFKIPNPMYFVP

SEQ ID NO: 7961 - DNA, 949 bp, Panicum virgatum
  misc_feature: Ceres CLONE 1963936
  misc_feature: Encodes the peptide sequence at SEQ ID NO. 7962
ctcttgctttcttggctgccgcctcctccctcgggacctcctcaccacggaggagatctcctctaccgggcgagcaggagagcaggggagagacatgggcgggcgggtggatcacgagtactcgtaccttttcaagatggtgctcattggggacagcggcgttggcaagtccaacatcctctctcgcttcacgcgcaaccacttctccctcgactccaaatcaaccatcggcgttgagttcgccaccaaatccctgcagatggagggcaaaacaataaaggctcagatctgggacacggccgggcaggagaggtaccgtgccattacaagtgcgtactaccgtggtgctgttggggctctactcgtatatgacatcacaaagaggcagagctttgacaatgttcacaggtggctgcgtgagctccgcgaccatgctgattccagcattgtgatcatgatggtcgscarcaagtctgacctgatacacttgagggctgtttctgaggatgaaggcaaagcgttggcagaaaaggaagggttattcttcctggaaacatcagctatggaggcggtaaacgtggaggaagccttccagactataatctcggaggtctatggcattgtgaacaggaaagcgctggctgccaaagaaatggcagctgcagcagctccactgccttcccagggcaagaccatcagcattgacagcacttcagaaaacacaaagaaggcatgctgctccacttgaaatgtaattgggcttcggacatcatattatagagaactttgggcaacaaatgttggtagaaagcggagcatagtactcacaaatggtgttgagggaatatctattcgtaccttgttttttctttgttgcgtgaactcgctggatcatatgcagtttgttcagtgtttctgaatcaaaagttagatgtgtgtattaggattc

SEQ ID NO: 7962 - protein, 217 aa, Panicum virgatum
  misc_feature: Ceres CLONE 1963936
  misc_feature: Great-hit functional homolog of the protein sequence given in SEQ ID NO 9381
  misc_feature: Useful for making plants with altered Lignin content
  misc_feature (124)..(124): Xaa is any aa, unknown, or other
  misc_feature (125)..(125): Xaa is any aa, unknown, or other
MGGRVDHEYSYLFKMVLIGDSGVGKSNILSRFTRNHFSLDSKSTIGVEFATKSLQMEGKTIKAQIWDTAGQERYRAITSAYYRGAVGALLVYDITKRQSFDNVHRWLRELRDHADSSIVIMMVXXKSDLIHLRAVSEDEGKALAEKEGLFFLETSAMEAVNVEEAFQTIISEVYGIVNRKALAAKEMAAAAAPLPSQGKTISIDSTSENTKKACCST

SEQ ID NO: 7963 - DNA, 709 bp, Panicum virgatum
  misc_feature: Ceres CLONE 1964293
  misc_feature: Encodes the peptide sequence at SEQ ID NO. 7964
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
catcgcatctcctattctcctctcgctctctgttgtgtgactgattgccaagaaagctctctgcttgcttgtgttccagcctctgaatctcgcgaggatgtcgtgctgcggaggcaactgcgggtgcggctccggctgcaagtgcggctccggctgcggagggtgcaagatgtacccggacatgactgagcagggcaccaccagcagcagccagactgtcatcatgggcgttgcaccaaccaacaaggggcacgccgagggcggatttgaggccggcgccggagccgagaacggctgcaagtgcggtgccaactgcacctgcaacccctgcacctgcaagtgaggagctcatggccatggccggaccggaggagatctgaagctagtatagcggcgttgtgtgtgcgtcgttcgtttgtctgaaagtgtgtgtggcatgcttaataacggtgttgcgcgtgctgctagtagatggtactgatgaggaacaataataatgatggtgctgagatgtcgtcggcgtcgccgccgtcgtgtccttcctccccggccggtcgagcacctgtggcggtgctctagcagtgtgtcggtgtgtgcagcnnnccatgctctgatctgtggtgttggtgtgtggtctgcttggtgtcccttgtgtctcgtgtaaccatccatctatatctatatctatctatcgacatccatgttggtg

SEQ ID NO: 7964 - protein, 81 aa, Panicum virgatum
  misc_feature: Ceres CLONE 1964293
  misc_feature (1)..(80): Pfam Name: Metallothio_2 Pfam Description: Metallothionein
MSCCGGNCGCGSGCKCGSGCGGCKMYPDMTEQGTTSSSQTVIMGVAPTNKGHAEGGFEAGAGAENGCKCGANCTCNPCTCK

SEQ ID NO: 7965 - DNA, 1995 bp, Panicum virgatum
  misc_feature: Ceres CLONE 1964821
  misc_feature: Encodes the peptide sequence at SEQ ID NO. 7966
atgtatcgtcttggagctggagctgcagctgcagcttgcttacccccgccgccgcaactgggccgggccggccgtcctccagctgccgccggccgcatcttctcttctcttcgacttggatcgtgcgtgccttataaatttctttccaaataggagtagatcccagccaccatcaacactacctgtcgcggcgcttagctctattgccacggagcccggcggcgagggcgcaggaagcagcaatgcgccgggggcggggctcgctcctcccgctgctgctgcttgcggcagcggcgcttgcggccgccgagccggcgtccacgctgtccgggccggcgcgcccggtgacggtgcagctcggggacatgggccacgcggtggacctgccggatacggacccgcgggtgcagcgccacgtcacgggctgggcgcccgagcaggtcgccgtcgcgctctccgccgagcccacctccgcctggctctcctggattacaggggagttccagatgggcggcgccgtcaagcccctggaccccagcaccgtgggcagcgtcgtgcgctacggcctcgccgccgactccctcctccacgaggccgccggcgagtcgctcgtgtacagccagctctaccccttcgagggcctccgcaactacacctccggcatcatccaccacgtccgcctccgagggctggagcccgggaccaggtactactaccagtgcggcgacccgggcatccccggcgccatgagcgacgtccgggcgttccggacgatgccggccgtcgggcccaagagctacccggggaggatcgccgtggtcggggaccttggcctcacctacaacaccacgtccacggtggagcacatggtgcgcaaccagcccgacctggtgctcctcctcggcgacgtctgctacgccaacctctacctcaccaacggcaccggaacggactgctactcgtgcaccttcgccaactccacgcccatccacgagacctaccagccgcgctgggactactggggaaggttcatggagcccgtgacgtccagcattccgatgatggcggtcgaagggaaccacgagatcgaggagcagatccacaacaggacgttcgcgtcttacagctccaggttcgcgttcccgtcagaggagagcggatccctgtccccgttctactactcgttcgacgttggtggcatccactttgtcatgctcgcggcgtacgtcgactacaagaaatcaggtgagcaataccggtggctgcagaaagacttggagaaggtggacaggtcggtgaccccgtggctgatagccggctggcacgcgccctggtacaccacctacaaggctcactacagggaggccgagtgcatgagggtggagatggaggagctcctctactcgtacggcgtcgacgtcgtcttcaccggccatgtgcacgcgtacgagcgatcgaaccgggtgttcaactacacgctggacccgtgcggccccgtgcacatctcggtgggcgacggcggcaaccgggagaagatggcgacgagccacgccgacgaggccggccactgcccggagccggcgtcgacgccggaccccttcatgggcggcttctgcgcctccaacttcacgtcgggccccgccgccgggagcttctgctgggaccggcagccggagtacagcgcctacagggagagcagcttcggccacggcatcctggaggtgaagaacgagacgcacgcgctctggcggtggcaccgcaaccaggacctgcacgccaccgtcgccgacgaggtttacatcgtccgggagccccacaagtgcctcgtcagctccaccagactagcctactgaactcattgattgattatttattacctcgttatagttggttttattaccaattttgatattcaaagcaacactcggatcaaatttgagggacatatttagctatatattttgtcttcaaataaccattttacagaattattct

SEQ ID NO: 7966 - protein, 536 aa, Panicum virgatum
  misc_feature: Ceres CLONE 1964821
  misc_feature (1)..(215): Pfam Name: Metallophos Pfam Description: Calcineurin-like phosphoesterase
MRRGRGSLLPLLLLAAAALAAAEPASTLSGPARPVTVQLGDMGHAVDLPDTDPRVQRHVTGWAPEQVAVALSAEPTSAWLSWITGEFQMGGAVKPLDPSTVGSVVRYGLAADSLLHEAAGESLVYSQLYPFEGLRNYTSGIIHHVRLRGLEPGTRYYYQCGDPGIPGAMSDVRAFRTMPAVGPKSYPGRIAVVGDLGLTYNTTSTVEHMVRNQPDLVLLLGDVCYANLYLTNGTGTDCYSCTFANSTPIHETYQPRWDYWGRFMEPVTSSIPMMAVEGNHEIEEQIHNRTFASYSSRFAFPSEESGSLSPFYYSFDVGGIHFVMLAAYVDYKKSGEQYRWLQKDLEKVDRSVTPWLIAGWHAPWYTTYKAHYREAECMRVEMEELLYSYGVDVVFTGHVHAYERSNRVFNYTLDPCGPVHISVGDGGNREKMATSHADEAGHCPEPASTPDPFMGGFCASNFTSGPAAGSFCWDRQPEYSAYRESSFGHGILEVKNETHALWRWHRNQDLHATVADEVYIVREPHKCLVSSTRLAY

SEQ ID NO: 7967 - DNA, 1725 bp, Panicum virgatum
  misc_feature: Ceres CLONE 1965403
  misc_feature: Encodes the peptide sequence at SEQ ID NO. 7968
attcttctcttctccaggcccaaacccaaccgaaccggacccaaaagcgagagcagacaactcgaaagaggaagagagagagagagatccacgccgcggcgccattcctccctccctccctccgctgcagctcttccgtccggcagatcgccctccctcccgcgggaccatggactgccgggttctcggctccaggtgcgccggcggcaagatcttggggaagacagggtccgcgacgtcatgtggtcaagctacttgttttacaagtttcagtgcgtctaccaaacgtgagcacaacttgcagttagcagcaagtggatgctctcatttgattaacagaagcccagtacttaaacaccagcggaaccttgctgctgcatctagctctgcagatgtgtgtacttcattcgatgaagccaaaagtgtatcttctgaagctattgaagaaaaagttggagtgctcttattgaatcttggtggtccagagaccctggatgatgtccaaccatttctgttcaacctatttgctgatcctgatattattcgtctccctaggctgttcagatttcttcaaagaccactggccaagcttatttcaacttttagagcacctaagagtaaggaggggtatgcttctatcggtggtggatcacctttgaggaaaattaccgatgagcaggcaaatgctttgaagattgcactggaaaagaaaaacttgcatgcaaacatatatgttggaatgcggtattggtaccctttcacagaagaagctattgatcagattaagaaggatagggtcaccaagctggttgttcttccactttaccctcagtactccatatcgacaagtgggtcaagcattcgtatcctacaagacattgtaaaggaagattcatacttttctggcttgccaatttccattatcgaatcatggtaccaacgtgacggctatgtgaaatcaatggctgacttaattaagaaggagctatctattttctccaatcctgaagaggttatgatattcttcagtgcacatggtgtgccactaacctatgttgaggatgctggagatccttaccgagatcagatggaggaatgcattgctttgatcatgggagagttgagatccagaggaattttaaacagccacactctggcgtaccagagtcgggttggaccagttcaatggttgaagccatatactgatgaagttttggttgaacttggtcaaaagggtgtaaagagcctcctggctgttccagtaagttttgtgagcgagcacattgagacattggaagaaattgacatggagtacaaggagttggctctagaatctggcattgagaactggggcagggttcctgctcttggatgcacatcgtcgttcatctctgaccttgctgatgctgttgtcgaagctctgcctgctgcttcagcccttgcgaccaggaagaccgacgacactgattctgatatggattttatgcactacctgacaaagatgttctttggctcagttttggccgtcatcttactgttgtcaccaagactgatttccgcttttcggaatacaatgctttaggtggtctaggcaaggaaaaatactatagttgtaatcttctatttttggctatggatccgtgagtataaagaaataacttttggatgattgtaactaggaaccatttattttactgaatgggaatttgaaaattttactggctg

SEQ ID NO: 7968 - protein, 470 aa, Panicum virgatum
  misc_feature: Ceres CLONE 1965403
  misc_feature (1)..(325): Pfam Name: Ferrochelatase Pfam Description: Ferrochelatase
  misc_feature (1)..(326): Pfam Name: Ferrochelatase Pfam Description: Ferrochelatase
  misc_feature (1)..(325): Pfam Name: Ferrochelatase Pfam Description: Ferrochelatase
  misc_feature (1)..(325): Pfam Name: Ferrochelatase Pfam Description: Ferrochelatase
  misc_feature (1)..(325): Pfam Name: Ferrochelatase Pfam Description: Ferrochelatase
  misc_feature (1)..(325): Pfam Name: Ferrochelatase Pfam Description: Ferrochelatase
  misc_feature (1)..(325): Pfam Name: Ferrochelatase Pfam Description: Ferrochelatase
  misc_feature (1)..(325): Pfam Name: Ferrochelatase Pfam Description: Ferrochelatase
  misc_feature (1)..(469): SWISSPROT Homolog: EC 4.99.1.1 Ferrochelatase-2, chloroplast precursor
  misc_feature (59)..(470): SWISSPROT Homolog: EC 4.99.1.1 Ferrochelatase-2, chloroplast precursor
MDCRVLGSRCAGGKILGKTGSATSCGQATCFTSFSASTKREHNLQLAASGCSHLINRSPVLKHQRNLAAASSSADVCTSFDEAKSVSSEAIEEKVGVLLLNLGGPETLDDVQPFLFNLFADPDIIRLPRLFRFLQRPLAKLISTFRAPKSKEGYASIGGGSPLRKITDEQANALKIALEKKNLHANIYVGMRYWYPFTEEAIDQIKKDRVTKLVVLPLYPQYSISTSGSSIRILQDIVKEDSYFSGLPISIIESWYQRDGYVKSMADLIKKELSIFSNPEEVMIFFSAHGVPLTYVEDAGDPYRDQMEECIALIMGELRSRGILNSHTLAYQSRVGPVQWLKPYTDEVLVELGQKGVKSLLAVPVSFVSEHIETLEEIDMEYKELALESGIENWGRVPALGCTSSFISDLADAVVEALPAASALATRKTDDTDSDMDFMHYLTKMFFGSVLAVILLLSPRLISAFRNTML

SEQ ID NO: 7969 - DNA, 517 bp, Panicum virgatum
  misc_feature: Ceres CLONE 1965643
  misc_feature: Encodes the peptide sequence at SEQ ID NO. 7970
acgctgaagacgacgccatccctcgccagctcgcctcctccactcctcccaaacccctcgccgactcagatcccgccgccgccatgccgttcaccccgggtccctactccggcgtcagcaccctcgccctcgtggcgagggcgtcggccttcggcgtcggcgtcgtctacgggagcatcaagctctccatcctcaaggcgacaaaacctaaaaaggaggaagcacatgcccatcactaaggatggcagggatgcaatgtgttacctgcagttcaaggatgtcataaattggcagtgtaccccttcttcatacgtgcatttgggtttatgatttgtggacctcttgtctgtaacacacctgctgagttaccttagctttgcgtcgtaataagttcttgatcccatgacttgaaatgaggtattaaatccaaaagctgaaaagaaccttttagttcttgatcccatgacttgaaatgagtaagtgaatggcgaaagctgaaaagaaccctttttttgcc

SEQ ID NO: 7970 - protein, 51 aa, Panicum virgatum
  misc_feature: Ceres CLONE 1965643
  misc_feature (1)..(42): Pfam Name: ATP-synt_E Pfam Description: ATP synthase E chain
MPFTPGPYSGVSTLALVARASAFGVGVVYGSIKLSILKATKPKKEEAHAHH

SEQ ID NO: 7971 - DNA, 837 bp, Panicum virgatum
  misc_feature: Ceres CLONE 1966002
  misc_feature: Encodes the peptide sequence at SEQ ID NO. 7972
gagtcgaagtcgagcccggactcgagtccccttcctcctcttcctccgcctcccatataaccccgccgcacgggatagggctccgccgtcccgccgccgattcgctgtgttgccttccgtccccgccgcccgttcgatttctcctgcccgcgcctcgtagcccccaagtcagcagcctctcgccgtatcgcgtcgcggcggccgcagcgggttttgcgccgagttagggttagggtttgcgcggtagcggagaagggggtaggaggaggaggagaggagccggagatggaggaggtgacggagggagtgaacaacctggcggttacggagccgcacaagaagaaccggatccaggtctccaacaccaagaagccgctattcttctacgtcaacctcgccaagaggtacatgcagcagcacgaggaggtagagctctcggcccttggcatggccattgccacagttgtgactgttgctgaaattctgaaaaataatgggcttgctgttgaaaagaagatcatgacgtcaacagttgatgtcaaggatgattcaaggagtcgccctattcagaaggccaagatcgaaatagtgctgggcaagacagagaaatttgatgagctgatggcagctgctgaggaggagagggaagctgccaaggctgaggagcagagctaaacatctattttaaattttgctgttgtagtttaattagtatcatgctagcagttgcgtttgaatctcttggctatcaagagatatgttctttgttatcaatcaagagctctgctcatcgattagttggaatggtaactttgtcaaaaaaaaaaaaaaaaaaga

SEQ ID NO: 7972 - protein, 129 aa, Panicum virgatum
  misc_feature: Ceres CLONE 1966002
  misc_feature: Great-hit functional homolog of the protein sequence encoded by LOCUS At2g34160
  misc_feature: Useful for making plants with modulated nitrogen use efficiency
MEEVTEGVNNLAVTEPHKKNRIQVSNTKKPLFFYVNLAKRYMQQHEEVELSALGMAIATVVTVAEILKNNGLAVEKKIMTSTVDVKDDSRSRPIQKAKIEIVLGKTEKFDELMAAAEEEREAAKAEEQS

SEQ ID NO: 7973 - DNA, 826 bp, Panicum virgatum
  misc_feature: Ceres CLONE 1966084
  misc_feature: Encodes the peptide sequence at SEQ ID NO. 7974
accgaagaaaccaaaaaacagcaggcgccagcgaagcgcagcaaggaaaccacatgccccacctcgccgccactccccccacttcctccgccgcccggcgggagggcggcggcggcgtgcgcacggaggaacaggagcaggagcaggagcaggacacggcgaagcggacgttctacgacctgctcgggatctcggcggaggggagcgccgacgaggtccggacggcctacaggcggctggcgctcaagtaccacccggacgtgtccccgccgggcgccgcggcggagaacacccgccgcttcatcgaggtgcaggaggcctacgagacgctctccgacccgagccgccgcgccagctacgaccgtgcgctcgcccgtggcgtctgccgcctcgccttctccggctcccgctcccatcgcgcctaccaccaccaggaccatgaagagaaatctggctggagaagatcttgggaagaccaggttgcggaactgaagaggaggagcatggcgaaggattcagacgagaatctatcgtggggagctcggatgcggagaagaagggccgaggcatcatcggcagaatagctgttatagtaacccttccaacgcaacaatgatcatatctagcatgttagccaaaaccaattataattttgtgtagcgcgattcgaaggctgttgcctgcgaggttttatgttgtgcatcaaagatgagcctgctggaaaacctgcaggctgcagctgaccccttatcagaatcgcttagtactagtaatgtagtagtagctgtagcagtggcatcttccagaaaaaaaaaaaaaaaaaaaa

SEQ ID NO: 7974 - protein, 176 aa, Panicum virgatum
  misc_feature: Ceres CLONE 1966084
  misc_feature (1)..(65): Pfam Name: DnaJ Pfam Description: DnaJ domain
MPHLAATPPTSSAARREGGGGVRTEEQEQEQEQDTAKRTFYDLLGISAEGSADEVRTAYRRLALKYHPDVSPPGAAAENTRRFIEVQEAYETLSDPSRRASYDRALARGVCRLAFSGSRSHRAYHHQDHEEKSGWRRSWEDQVAELKRRSMAKDSDENLSWGARMRRRRAEASSAE

SEQ ID NO: 7975 - DNA, 508 bp, Panicum virgatum
  misc_feature: Ceres CLONE 1966815
  misc_feature: Encodes the peptide sequence at SEQ ID NO. 7976
ctagccgcacccgcgccgccgccgccccgctcctcgtcgccgcagacgcctccgccgcgatgacgaagcgcaccaagaaggctcacatcgttggcaaatatggaactaggtatggtgctagcttgcgtaagcaaatcaagaagatggaggtatctcagcattccaagtacttctgcgagttctgcggaaagtttgctgtgaagaggaaagcagttggaatctggggatgcaaggactgtgggaagttcaaggctggtggtgcttacaccatgaacactgctagtgcagtcacggtcaggagcacaatccggcgcttgagagagcagactgaagcatgatgggagctcttctctgcagtagtcctgggctttttgtagtgccttgaatcactatatggctgtttggcctaagaacatccttcaatattctggttatgcctaaggatatctaaaattatggtgctaaaatttgtacttggttgctgttgcaaagttgacctgtcttgatc

SEQ ID NO: 7976 - protein, 92 aa, Panicum virgatum
  misc_feature: Ceres CLONE 1966815
  misc_feature: Great-hit functional homolog of the protein sequence given in SEQ ID NO 9687
  misc_feature: Useful for making plants with modulated cold sensitivity
MTKRTKKAHIVGKYGTRYGASLRKQIKKMEVSQHSKYFCEFCGKFAVKRKAVGIWGCKDCGKFKAGGAYTMNTASAVTVRSTIRRLREQTEA

SEQ ID NO: 7977 - DNA, 1028 bp, Panicum virgatum
  misc_feature: Ceres CLONE 1966816
  misc_feature: Encodes the peptide sequence at SEQ ID NO. 7978
aagacacaacagagtagcacaccacgacctccaaggctagaagccccagcgttccatctcctcacacacagactcgcaggctaagatagagctggcagcaatggcgggcggcggcgacctgaaggtgctgggcgtgtggacgagcccgttcgtgatccgcgtccgcatcgtgctgaacctgaagggcctggcgtacgagtacgccgaggaggacctcggcaacaagagcgcgctcctcctcgggtccaacccggtgaacaagaccgtccccgtgctcctccacggcggccgccccgtgaacgagtcccaggtcatcatccagtacatcgacgaggtctgggccgggtccggccccgccgtgctgccgcgcgacccctacgagcgcgcggtggcgcggttctgggcggcctacgtcgacgacaaggtggggtcggcatggacggggatgctgttccggtgccgcaacgaggaggagagggcggaggcggtggcgcgcgccgacgaggcgctcctgacgctggagggcgcgctcggggagcgctccggggggaagaagcccttcttcggcggcgatggcatcgggctcgtcgacgtcgtgctcggcggctacctcgggtggttcgcggccatcgacaggatcatcgggcgcaggctgatcgacccggccaggacgccgctgctggccgcgtgggagcagcggttccgcgccgccgacgcggccagcggcgtcgtgccggacgacgtcgacaaggtgctcgcgttcctgcagaccctgctcgccattggatcgaataagtgagctcggcccgtcgtctgtcgtcagtccggggacagtcggttcctgcaccttttttttttggctcaatataaataaattgtatgtgctcgacgaatgcacaacagtacttttgttgtaacgagggcggtctgtctatgctgctcgtaatttgcatgtttttttctcaacaaaccgtgttctaatcaaatgtacaacagtactagtgatgtaaaaaaaaaaaaaaaaaaaa

SEQ ID NO: 7978 - protein, 232 aa, Panicum virgatum
  misc_feature: Ceres CLONE 1966816
  misc_feature (1)..(105): Pfam Name: GST_C Pfam Description: Glutathione S-transferase, C-terminal domain
  misc_feature (2)..(74): Pfam Name: GST_N Pfam Description: Glutathione S-transferase, N-terminal domain
MAGGGDLKVLGVWTSPFVIRVRIVLNLKGLAYEYAEEDLGNKSALLLGSNPVNKTVPVLLHGGRPVNESQVIIQYIDEVWAGSGPAVLPRDPYERAVARFWAAYVDDKVGSAWTGMLFRCRNEEERAEAVARADEALLTLEGALGERSGGKKPFFGGDGIGLVDVVLGGYLGWFAAIDRIIGRRLIDPARTPLLAAWEQRFRAADAASGVVPDDVDKVLAFLQTLLAIGSNK

SEQ ID NO: 7979 - DNA, 1912 bp, Panicum virgatum
  misc_feature: Ceres CLONE 1985023
  misc_feature: Encodes the peptide sequence at SEQ ID NO. 7980
aggtaagaccgtggaacgtcctaaacaaacctagccgcgcaacgcgctccggcacccccgtgtgtttttcaacccgccccctcttccctccgcgagctcaagcgctcaaggacacagcacgcggaagagagagagagagagagaggaatccatctccccattcacattccttccccccgcccgcggcacgccccccggcccgaccagagcccccagggcgccgctcgctccagggccccctgcgccgtccgccgcaagcgattcggatccctccctaccgccccccaggttgcagacttcaatggagaaaaacgttgatggaaataacatgatgaaagagttatatatcccaacttatattttcacgccggagtctccagtggagcatgtttctcagataccaacatgtcctgttattgtttttatcaacaccaaaagcggtggccagttgggacgtaatttaattgtcacataccgtaagcttctcaaccatgctcaggtgttcgatctgcttgatgaagctccagataaggtcttgcacaaattatatagcaacttggaaaggctcaagcatggtggtgatactcttgcttctgaaatctacaggagactaagactaatagttgctggaggtgatggaacggctggttggttgcttggaattgtatctgatcttaagttagcacatccacctcctgttgctacagttccattgggaactggaaataacttgccatattcttttggatgggggaagagaaaccctggaacagatcaggattcggtcatgtcatttcttcaactggtaagagaatccagagagatcaacattgatagctggcatattgtcatgagaatggaaagcccaaaaggttcgccttgcgatccaattgcacctccagacttgcctcattctttgcatgcatttcgccgcatgccaaagacagatccacaagatatggaatattcttacacatatcgtggtgggttttggaattacttcagtatgggaatggatgcccaagtatcttatgtgtttcattctgagaggaaactgcatccagagaagttcaagaatcagttgtccaatcagaaacaatatttaaagctcgcatgcacgcaaggatggttctgtgcctctctgtttcatccaatgtctcggaacattgcttgccttgcaaaagtaaagataatgaagaaatgtggaaaatgggaaacattggaaattccgcagagtatccggtccattgtttgtctcaatttgcctagcttctctggtggactaaacccttggggaacaccaagtaagaggaagcaaagaaaaagagacttggtaatgcctccgcttgtggatgatggccttctagagattgtgggtttcaaagatgcttggcatgggcttgtcttgctatccccaaaaggccatggaactcgtcttgcacaggctcaccgtgttcgattcgagttcctcagaggtgcaaccgatcatgcttacatgagaatggatggggagccctggaaacagcctcttccgacagatgacggcaaggtcgtggtagagatctcccatgctgggcaggtcaagatgctcgcgaccaaagactgcatagccagaggcatccatgagtcgtgcccagctatttcaacgattcatccagagtccagctccagcgatgacacggacgatgacttcgagatggagaggggaactttggggccgccttgtcatttcggtacacgggcgatgtgaacaaacaataaaaggtcatgtttctattgagccttgtacagtttgtttgcgtaggctgtaggaagtaggtagatgcgctaatttacggatgattggaaggcgtccatgtaagataactttggttgacaagttggttttgatataacaaagttgtattgtgcc

SEQ ID NO: 7980 - protein, 482 aa, Panicum virgatum
  misc_feature: Ceres CLONE 1985023
  misc_feature (1)..(174): Pfam Name: DAGK_acc Pfam Description: Diacylglycerol kinase accessory domain
  misc_feature (1)..(144): Pfam Name: DAGK_cat Pfam Description: Diacylglycerol kinase catalytic domain ( presumed)
MEKNVDGNNMMKELYIPTYIFTPESPVEHVSQIPTCPVIVFINTKSGGQLGRNLIVTYRKLLNHAQVFDLLDEAPDKVLHKLYSNLERLKHGGDTLASEIYRRLRLIVAGGDGTAGWLLGIVSDLKLAHPPPVATVPLGTGNNLPYSFGWGKRNPGTDQDSVMSFLQLVRESREINIDSWHIVMRMESPKGSPCDPIAPPDLPHSLHAFRRMPKTDPQDMEYSYTYRGGFWNYFSMGMDAQVSYVFHSERKLHPEKFKNQLSNQKQYLKLACTQGWFCASLFHPMSRNIACLAKVKIMKKCGKWETLEIPQSIRSIVCLNLPSFSGGLNPWGTPSKRKQRKRDLVMPPLVDDGLLEIVGFKDAWHGLVLLSPKGHGTRLAQAHRVRFEFLRGATDHAYMRMDGEPWKQPLPTDDGKVVVEISHAGQVKMLATKDCIARGIHESCPAISTIHPESSSSDDTDDDFEMERGTLGPPCHFGTRAM

SEQ ID NO: 7981 - DNA, 1724 bp, Panicum virgatum
  misc_feature: Ceres CLONE 1985126
  misc_feature: Encodes the peptide sequence at SEQ ID NO. 7982
gatgcaggtagaggtaggtaggtgcaccggcgaacctcccagctcctcgatcgtttgttgccatggatgtcaaggggtcctcaccgccgccatcgtcgcggccgatgcgcttcgtcatctgtccatggctcgccttcggccacatcctcccctacctcgagctcgccgagcgcctcgcctcgcgaggccaccacgtctcctacgtctccacgcctcgcaacctcgcgcgcctccctcctcgccgccacaactcctcaatcaacctcatctccctccctctcccacacgtcgagggcctccccgacggtgccgagtccaccaacgacgtccccaacgacaagctctcccacctctgggacgccttcgaccgcctcgccgcacccttcgccgactacctcgccgccgcttgctccggcgataacactaccaaacccgactgggtcctcgccgacacgttccaccactgggccaccgccattgcggccgaccacgggataccctccatgctgctccagccgaccgcagccatgatcgccgccatcgcctgcggcgcatccgatcactctgacctcatcgccgccaccgtctacgagcagatgatggccgtggtcgaccggccggcaaccatgccacactacgagtgggagggtgacaaggtgctcttcgccccgctcggctccttgggtctccccgttgcccggcgctgctcgctggctctcgaccggtgcacgttgaccgccatgcggagctgccatgagtgggagctggaggccttcgcgctcgcggagaagctcctcggcaagcctctcatccctctcggcctcctgcccccatctcccgatggcggccgcggcgttgacacgcacagaaatgaccccactttgcgctggcttgacacgcagccagccaagtcggtggtctacgtggcgctagggagcgaggtgcccctgcccctgccactagtgcacgagctggcactagggctagatctcgccggaacacgcttcctctgggctctccggaaaccgaccggcgtccacgacgacgacgtcctcccggctggcttccgagatcgcacccatggctatggtcacgtcgctatgggatgggtgcctcaggtcgccgtgctgtcccacgcctccgtgggcgcgttcttgacgcactgtggcaggaactcacttattgaggggcttcaacacgggcacccactggtgatgttgccgatcttcggcgaccaaggtccgaatgcgaggctcatggaggggaggaaggttggggtgcaggtggcgagagaggagagcgacgggtccttcgaccgccatggtgttgctagcgcggtccgggctgtcatggtggatgaaggtaccaggagggtctttgtggagaatgccgagaagatgcgagagattgtaggcgataaggaattgcaggatagctacgttgatgagtttgtagagcgtcttagatgttacagcaacgttgatggcaactcttctggtgctgctgtcgaggccacctggacctgagacttgtgagcttttatgggtacattttcttcgtcagtttagagtctatttataatatggaaagaaccatgcatgtattgaataaaattattgttaccctaatactactatactagtagtagtatgtaaaagtatataaatgtgtatatttgtaaaagatattgagattatttatttgaaaaaaaaaaaaaaaaaaaa

SEQ ID NO: 7982 - protein, 487 aa, Panicum virgatum
  misc_feature: Ceres CLONE 1985126
  misc_feature (1)..(125): Pfam Name: UDPGT Pfam Description: UDP-glucoronosyl and UDP-glucosyl transferase
  misc_feature (1)..(135): Pfam Name: Glyco_transf_28 Pfam Description: Glycosyltransferase family 28 N-terminal domain
MDVKGSSPPPSSRPMRFVICPWLAFGHILPYLELAERLASRGHHVSYVSTPRNLARLPPRRHNSSINLISLPLPHVEGLPDGAESTNDVPNDKLSHLWDAFDRLAAPFADYLAAACSGDNTTKPDWVLADTFHHWATAIAADHGIPSMLLQPTAAMIAAIACGASDHSDLIAATVYEQMMAVVDRPATMPHYEWEGDKVLFAPLGSLGLPVARRCSLALDRCTLTAMRSCHEWELEAFALAEKLLGKPLIPLGLLPPSPDGGRGVDTHRNDPTLRWLDTQPAKSVVYVALGSEVPLPLPLVHELALGLDLAGTRFLWALRKPTGVHDDDVLPAGFRDRTHGYGHVAMGWVPQVAVLSHASVGAFLTHCGRNSLIEGLQHGHPLVMLPIFGDQGPNARLMEGRKVGVQVAREESDGSFDRHGVASAVRAVMVDEGTRRVFVENAEKMREIVGDKELQDSYVDEFVERLRCYSNVDGNSSGAAVEATWT

SEQ ID NO: 7983 - DNA, 1790 bp, Panicum virgatum
  misc_feature: Ceres CLONE 1985144
  misc_feature: Encodes the peptide sequence at SEQ ID NO. 7984
gtgtccaagttcccgagccactctgcgctggcaaccgggcggccccaccgctcagtgaccgaccccaaaccccccaagcccgcccgccatggcgccgccggagccggaggtcttcgacatcgtcatcttcggggcctcgggcttcaccggcaagtacgtcatccgcgaggccctcaagttcctctccccctcctccccactccgctccctcgcggtcgccggtcgcagccgcgaccgcgtggccgcggcgctccgctgggcggcggcccctgccccgccgccagatgacgtggaaatcctcgtcgcgaacgcctccgacccggcgtccctcgcggcgctcgcttcccgcgcccggatcgtgctctcctgcgcgggacccttccgcctccacggccacgccgtcgcggcggcctgcgcggccgcgggcgccgactgcctcgacatctctggggagcccgagttcatggagcgcgtcgaggccgagctccacgagcccgcggcaaaaagcgggtcgctcatcgtatccgcctgcgggttcgactccgtccccgcggagctggggtttctgttccactccaggcagtgggagccgccgtccgcgccggtgaccgtggaggcgtacgtcagcctgcagtccacaaaggggatcgtcgggaacatcggcacctacgagtcggccgtgctcggggtggccaacgccgaccagctgcgggcgctgcgccgatcacgtcccaggccccccaaacccaatatcccatgtcctccacctcccaaagggtcgctgatggaggctcacaatcctctgggaatgtgggctatgaagctgccttctgccgacacaacggtcgtgaagagaactctatcaaccatcaccgagcatcccgagggccttgctgaggctgaagaaactccagagtacgccgagcacaggaagacgttctggtcctctgttaaacctgcacatttcggcgtgaagatcgcctccagatccctggtggtcctcatgcgctccatcatcctgggactgtccatcggcctgctcggaaacttccccttgggcaggtacctcctgctggcctaccccgagttcttctccaccgggctgttccgcagggccggcccgacggaggaagaggtgcggagcggctcgttcaagatgtggttcgtcgggcgcggctacggcgacgcggcccgggcgtcggagcgcggcggcaagccggacaaggaggtgatcaccgaggtctcggggcctgaggtcgggtacatcacgactccgatcgtgctggtgcagtgcgccctcgtcctgctgacccagcgtgggaacctgccccggggaggggtgtacacgccgggcgccgtcttcggccccaccgacctccagcggcgcctccaggagaacgggatgtcgttcgatgttcacgtgaagaggtcgatgctctgaggctggctgtggccgggctccatttggtgggaaagagttgggccgaagcatgtgcgagtgcgaccttgttgggaataattaagaagcgatcacagtggcgagccaattgtatgtgtgtgcgtgagtccaaagggcctactatgttccggtgaagtaccgagtctcttgtttgtgtgctgtgtgtttatctgaggcgacagtaggaaaacaagtctacttgtgtgtacagagagaggatcgtatgggttgtggttgcagtgcaatgtgtgtaatgtaatgcgtgaatacaaatggacatgagaataaacaagggaggcccgactggctcgaaaaaaaaaaaaaaaaaaaa

SEQ ID NO: 7984 - protein, 450 aa, Panicum virgatum
  misc_feature: Ceres CLONE 1985144
  misc_feature (1)..(433): Pfam Name: Saccharop_dh Pfam Description: Saccharopine dehydrogenase
MAPPEPEVFDIVIFGASGFTGKYVIREALKFLSPSSPLRSLAVAGRSRDRVAAALRWAAAPAPPPDDVEILVANASDPASLAALASRARIVLSCAGPFRLHGHAVAAACAAAGADCLDISGEPEFMERVEAELHEPAAKSGSLIVSACGFDSVPAELGFLFHSRQWEPPSAPVTVEAYVSLQSTKGIVGNIGTYESAVLGVANADQLRALRRSRPRPPKPNIPCPPPPKGSLMEAHNPLGMWAMKLPSADTTVVKRTLSTITEHPEGLAEAEETPEYAEHRKTFWSSVKPAHFGVKIASRSLVVLMRSIILGLSIGLLGNFPLGRYLLLAYPEFFSTGLFRRAGPTEEEVRSGSFKMWFVGRGYGDAARASERGGKPDKEVITEVSGPEVGYITTPIVLVQCALVLLTQRGNLPRGGVYTPGAVFGPTDLQRRLQENGMSFDVHVKRSML

SEQ ID NO: 7985 - DNA, 1874 bp, Panicum virgatum
  misc_feature: Ceres CLONE 1985152
  misc_feature: Encodes the peptide sequence at SEQ ID NO. 7986
aagtcgcttgcccctccctcctccccaatccccacacccatctcactctcaccccctgcgcccgcgcacaccgccgcgcgagatcgcgaggaggccatggccaaggccaagccctcctcctcggccgccgccgccaagccggccgcggccgcggcgccggccacggtgcactcggcgctggtcacctacagctccatgctcgcgctcctctccctctgcccgcccttcgtcatcctcctgtggtacacgatggtgcacgcggacggatcggtgttgaagacctacgagcacctccgggagcacggcctggtggaggggctcaaggccatctggcccatgcccaccgtcgtcgcgtggaagatcatcttcggcttcgggctcttcgaggccgtcctgcagctgctgctccccgggaagcggttcgagggcccgatctcccccacggggaacgtgccagtctacaaggcaaatggcttgcaagcatatgcagtgaccttgataacttatctcggtttgtggtggtttggaatatttaaccctgcaatagtatatgaccacttgggggagatattctctgctcttgtttttggaagctttgtattctgtatttttctgtacataaagggtcatgtagctccatcttcatctgactcaggatcatcagggaatctgataattgacttctactggggtatggaactgtaccctcggattggcaagtactttgacatcaaagtcttcacaaactgtcgttttggcatgatgtcctgggctgttcttgctgtaacctactgcataaagcagtatgaaatgaatggcagagtcgcagattctatgcttgtgaatactgcactgatgttgatctatatcactaaattcttttggtgggaatctggatattggtgtaccatggacattgctcacgatagagctggtttctatatttgctggggatgcttggtttgggttccatccatatacacctctcctggaatgtaccttgtaaaccaccctgtgaatttgggtccccagcttgcactctcaattcttcttgctggaattttgtgcatatacataaactatgattgtgaccgccagcgccaagaatttcgacgcacaaatgggaaatgctcagtctggggcaaggctccatccaagattgttgcctcatatcagactacaaagggagaaactaaaaccagtcttctcttgacttctggatggtggggcctgtcacgacacttccactacgtcccagagatattatctgcatttttctggactgttcctgctcttttcagtcatttcctaccatacttctacgtgatctttcttacaatattattgtttgaccgagcaaagagggatgatgatcggtgctcatcaaagtatggaaagttctggaagatgtactgcaacaaagtaccttacagggtcatccctggcatttactgagcatctaagatgctacaactctcttcagctcggcagatgcttccagtcttcaacttcatctgccacagcttgtgtaacttcaatgatattagcttcccttgtatgcagtattagatgtaggcagctcggcatctaccttgaatgtgatgtacccaggactggattgtttctttcgccgttcctagtacgggaggaattaaagtgcaggacagtactctgccttgtcgggtatttttcacttagagtcacaaggcagcataacaataaggcaccgagatgctcgcttgaataatactgtgctgcacgaaatgtaactatagttgctatggttcaaatattttacctttgccaaaacattttgtgcatgatgatattgtgtatgggtatgtaatgccttgtaaaaaaaaaaaaaaaaaaaa

SEQ ID NO: 7986 - protein, 452 aa, Panicum virgatum
  misc_feature: Ceres CLONE 1985152
  misc_feature (23)..(452): SWISSPROT Homolog: EC 1.3.1.21 7-dehydrocholesterol reductase
MAKAKPSSSAAAAKPAAAAAPATVHSALVTYSSMLALLSLCPPFVILLWYTMVHADGSVLKTYEHLREHGLVEGLKAIWPMPTVVAWKIIFGFGLFEAVLQLLLPGKRFEGPISPTGNVPVYKANGLQAYAVTLITYLGLWWFGIFNPAIVYDHLGEIFSALVFGSFVFCIFLYIKGHVAPSSSDSGSSGNLIIDFYWGMELYPRIGKYFDIKVFTNCRFGMMSWAVLAVTYCIKQYEMNGRVADSMLVNTALMLIYITKFFWWESGYWCTMDIAHDRAGFYICWGCLVWVPSIYTSPGMYLVNHPVNLGPQLALSILLAGILCIYINYDCDRQRQEFRRTNGKCSVWGKAPSKIVASYQTTKGETKTSLLLTSGWWGLSRHFHYVPEILSAFFWTVPALFSHFLPYFYVIFLTILLFDRAKRDDDRCSSKYGKFWKMYCNKVPYRVIPGIY

SEQ ID NO: 7987 - DNA, 1538 bp, Panicum virgatum
  misc_feature: Ceres CLONE 1985214
  misc_feature: Encodes the peptide sequence at SEQ ID NO. 7988
gcctcctcgttctccagtctgcccgccgccgccgccgccgtgtggctgactagacgaaccttgaggctctcgctgtccccgaccacggaaagggcctccggctccgcacgatcacgaagcctcgatccgcgggcccccgcatgacgaggctcctggtcgtcctggcagccgccgcggccctcctcgcggccgccgccgcgcacgagcaccacggcgaggcgcccacgtgctccagtggcggtgggcgcgttctcgcggagttccgccccggggaggtgaccgtggacggccacagcgacgactgggacagcgtggaggactcggagttcgccctgctgccggcgctcgacccagacgaagacaaggtctactccggcggcaaagtcgccatcaaggctgtgcatgatggcgtcaacgtcttcttcatgctgcaggttgatggggcttacgcttacagtaaagggaaaagtaacaagtgcccttctgtttctctgatgttccaagttggagataaagccacatattacaatatgggaggatgcaaagatatgcgaggttcttgcacgagtaaaagttgtagaggccatgaggttgacattatgcacttcgaaattggaaatgccattcctggacgtctttatggtggcaatcacatagataatgctgttggaaatggaggtgacagatttggtcaccttgttgatgtctatgcatggaatccgcattgccgataccttgatggtgtcggccctaaagagaacaattcaaatgctcaaaatgattggcacggggcttggtggcacagttcactgactgtccattcaggctttgttgatgatgataatccttatggaaaacaagatgagaagggcacatattattttgagttctcaagacccttaagaacaatggatcaatttcagcaggatgcgcagttcacaataggccagcccagcaatatggccgtagccttctggtacccaactgacggcaaagaatggagtgattctgagcattactcagccagctgcaactggttaattttggatatacagccttcgtctgaggctgcatattacaggccggcgcctaatcgttcttgggatgctgcaaccgcctttgctttgctcctttcggtggtagccatttgcctgtctatctttgtgggctaccgggtttctaagaataggagcactgcacagtttacaccacttgaacagatccagtttgctgaagaacgccattgattggacttagttgatactacgcgaggcagcaagcggtgctgtttcatctgtatgtgtaggatcctttgtacgattccaagttgacagattgctgcattgtagttttgaacctgcggttgatgtgatctagtgtaggacacattgaaagcataaagcgatacaaaattacagactgccaaattttgattgtaagaaacgatttctgtaaatgctctatgtaactctgggctactgctacgtgaaaattttaaatgtagcttagttttgttcgaaaaaaaaaaaaaaaaaaaa

SEQ ID NO: 7988 - protein, 368 aa, Panicum virgatum
  misc_feature: Ceres CLONE 1985214
  misc_feature: Great-hit functional homolog of the protein sequence given in SEQ ID NO 9732
  misc_feature: Useful for biocontainment applications
  misc_feature: The plant produces a reduced number of seeds.
MTRLLVVLAAAAALLAAAAAHEHHGEAPTCSSGGGRVLAEFRPGEVTVDGHSDDWDSVEDSEFALLPALDPDEDKVYSGGKVAIKAVHDGVNVFFMLQVDGAYAYSKGKSNKCPSVSLMFQVGDKATYYNMGGCKDMRGSCTSKSCRGHEVDIMHFEIGNAIPGRLYGGNHIDNAVGNGGDRFGHLVDVYAWNPHCRYLDGVGPKENNSNAQNDWHGAWWHSSLTVHSGFVDDDNPYGKQDEKGTYYFEFSRPLRTMDQFQQDAQFTIGQPSNMAVAFWYPTDGKEWSDSEHYSASCNWLILDIQPSSEAAYYRPAPNRSWDAATAFALLLSVVAICLSIFVGYRVSKNRSTAQFTPLEQIQFAEERH

SEQ ID NO: 7989 - DNA, 1657 bp, Panicum virgatum
  misc_feature: Ceres CLONE 1985225
  misc_feature: Encodes the peptide sequence at SEQ ID NO. 7990
agaggattcccaccgcgctctccctggcctgtccgtccactcccctcctccgcatctttcggccggcgcccgcatcgccccagtcgccgcggcttcaggcatggccgcggaggcggagcagggcttccgcccgcttgacgaggcgtccctggtcacctacatcaaggccacgcccgcgctcgcctcccgcctcggcggcggcggctccgtcgagatcaaggaggtcggcgacggcaacctcaacttcgtctacatcgtcaagtccagctccggcgccatcgtcgtcaagcaggcgctcccgtacgtgcgctgcgtgggggactcgtggcccatgacgcgggagcgcgcctacttcgaggcctccacgctgcgggagcacggccgcctgtgcccggagcacacccccgaggtctaccacttcgaccgggccatgtcgctgatggggatgcgctacatcgagcccccgcacatcatcctccgcaagggcctcatcgccggcgtcgagtacccgctgctcgccgaccacatgtcaaattacatggccaagacgctcttcttcacttccctcctctataacaacaccacggatcataagaaaggagttgctgagtactgtgcgaatgtggagatgtgtaggctcacggagcaagttgtgttctcagacccataccgggtctccaaatttaatcggtggacctcgccgtatcttgacaaagatgctgaggcggttcgagaggacgatgagctgaagttagaaatagctgagttgaaatcaatgtttatcgagagagctcaggctctgattcatggagatctccacactggttctatcatggtgacccccaattcaactcaagtcattgatccagagtttgggttctatgggccaatgggttttgacattggagccttcctaggaaacctgattttggcatactatgcacagaacggacatgctgatcaaacaaatgatcgcaaagcttacaagaaatggatcttgaagacaattgaagactcgtggaatttgttccaaaagaagtttgttgaactatggaataaacacaaagaagggaatggggaggcgtacctacctgatgtatacaacaactcaaacctgttgagccttgcgcagaagaagtacatgacaaacttatttcatgatagccttgggtttggttcagccaaaatgatcaggagaatagtcggaattgcccacgttgaggatctggagtcaattaaggatgccagcaagagagcagagtgcgagcgtgctgccctcaattgtgcaaagacgatcctgaagggtaggcgccaatttgagaccatcgagcaagtcattgagcatattcaatcgtttgatcgggactgagaagatatcaatctattcggcgttcaacgagacggattttcgttgttaacctatgcacacctgagtattgatgaattgtttgttctgaagcatatccatttctggccccttttagtttgaactgtgtacactactagagtaaagatcttattaaaggatattagccaggagccgaataatcaaatgtacgacatttctccaagcttatctcagtacatatagacgtgtgtattagcaaataaagttaattctgatgtttttttttgccaaaaaaaaaaaaaaaaaaaa

SEQ ID NO: 7990 - protein, 422 aa, Panicum virgatum
  misc_feature: Ceres CLONE 1985225
  misc_feature (2)..(258): Pfam Name: APH Pfam Description: Phosphotransferase enzyme family
MAAEAEQGFRPLDEASLVTYIKATPALASRLGGGGSVEIKEVGDGNLNFVYIVKSSSGAIVVKQALPYVRCVGDSWPMTRERAYFEASTLREHGRLCPEHTPEVYHFDRAMSLMGMRYIEPPHIILRKGLIAGVEYPLLADHMSNYMAKTLFFTSLLYNNTTDHKKGVAEYCANVEMCRLTEQVVFSDPYRVSKFNRWTSPYLDKDAEAVREDDELKLEIAELKSMFIERAQALIHGDLHTGSIMVTPNSTQVIDPEFGFYGPMGFDIGAFLGNLILAYYAQNGHADQTNDRKAYKKWILKTIEDSWNLFQKKFVELWNKHKEGNGEAYLPDVYNNSNLLSLAQKKYMTNLFHDSLGFGSAKMIRRIVGIAHVEDLESIKDASKRAECERAALNCAKTILKGRRQFETIEQVIEHIQSFDRD

SEQ ID NO: 7991 - DNA, 1842 bp, Panicum virgatum
  misc_feature: Ceres CLONE 1985306
  misc_feature: Encodes the peptide sequence at SEQ ID NO. 7992
gatccaaactccaaagcaaatgccacctcccctcctgccagccatccatggcagcaaggcctccccctgacactcatcactgatctggcccaccaccaccaccaccttcccttcctcccccccggcgaggcgccgacggccatgccccccgtcgccgtccagctccacagcctcctcttcaagttcctcctccgccgccgcctctccaccctctccgcgcccgcgcccgcccccgcggcgccgttcggcgtctcctcccgccccgccgaccagcgcccctcgccgccctccaacccgtccttctcgcccgcctcccccgacggcgtcgccaccaaggacctccacccggacccactctcctccctccacctccgccttttcctccccaaccccaaccaccacgccgccgcccctgttccgcgccccctccgccgcaactcattcccccagcgcgatcccgcgccgggcccggaccagctctcccgacgtgccagcgccagcttccacgccgtcggcgtctcgcccgagcccgagcccgcgcccgcgacgcgcgactacggcgggtacctaccgaccgccggcgccgcgcggtccgccgtgaggcggaggctgccggtgatcgtgcagttccacgggggcgcattcgtgacgggcgccgcggacagcgcagccaacgacgccttctgccgccgcgtcgcccgactctgcgacgccatcgtggtggccgtcgggtaccgcctcgcgcccgagagcaggtaccccgcggcgttcgaggacggggtcgccgtgctgcgatggatcgccaagcaggccaaccttgccgcgtgcgggcggacgatgatgggtaagggtaccggcgccgactcgttcggcgccgcgatggtcgaaccgtggctcgccgcgcacgccgatccgtccaggtgtgttctacttggcgtcagttgtggagcaaatattgctgactatgtggcccgaaaagctgttgaggctgggaaactcctggaccctgtgaaagttgttgcacaagttctgatgtacccattcttcatgggaagtgcacccactcgatcagaactgaagctggcaaactcctacttctatgacaagtcatcgtgtttactggcctggaaactcttcttacctgagggtgaattcagcttggatcacccagctgcaaaccctcttgtgcctggaagaggccctccgttgaagcttatgcctccaaccctgacagtcgttgcagagcttgactggatgaaggatcgtgcaatcgcgtactcagaggagctccgcaaggtaaatgtggatgcccctgttcttgagtacaaggatgcagtccatgagttcgccacgctagacgtcctgctgaagaccccgcaggctcaggcttgtgctgaggatatagctatctggattaagaagtacatatcactgcgcggccatgaattatcatattgacccacagcatggtgttttcatctggcctcgcatacatcaagtcatcaagctgctactacatgctcttcaccaggctgtacggaggtaaccatttgatgatcatgccttgatgggtgatagtcgattggccggctgtaacatagcgggaagcggaagagagggagaatcactcgttgaagcaggcttcgacagttgtgaggtccgcgactctgtctttgttccgtggcaattcaagctgtccggggtaatctgcaaccagtctgagattgtacatttccacgtcagatgtcaattgatgcttttgtgtgttcaattccgcagctttgtacaaaacttagtacaaaactagtacaaaactttgtccaaaaaaaaaaaaaaaaaaaa

SEQ ID NO: 7992 - protein, 438 aa, Panicum virgatum
  misc_feature: Ceres CLONE 1985306
  misc_feature (153)..(297): Pfam Name: Abhydrolase_3 Pfam Description: alpha/beta hydrolase fold
MPPVAVQLHSLLFKFLLRRRLSTLSAPAPAPAAPFGVSSRPADQRPSPPSNPSFSPASPDGVATKDLHPDPLSSLHLRLFLPNPNHHAAAPVPRPLRRNSFPQRDPAPGPDQLSRRASASFHAVGVSPEPEPAPATRDYGGYLPTAGAARSAVRRRLPVIVQFHGGAFVTGAADSAANDAFCRRVARLCDAIVVAVGYRLAPESRYPAAFEDGVAVLRWIAKQANLAACGRTMMGKGTGADSFGAAMVEPWLAAHADPSRCVLLGVSCGANIADYVARKAVEAGKLLDPVKVVAQVLMYPFFMGSAPTRSELKLANSYFYDKSSCLLAWKLFLPEGEFSLDHPAANPLVPGRGPPLKLMPPTLTVVAELDWMKDRAIAYSEELRKVNVDAPVLEYKDAVHEFATLDVLLKTPQAQACAEDIAIWIKKYISLRGHELSY

SEQ ID NO: 7993 - DNA, 1940 bp, Panicum virgatum
  misc_feature: Ceres CLONE 1985320
  misc_feature: Encodes the peptide sequence at SEQ ID NO. 7994
accgcgctgcctgcctccactccgcttccttcctttccttccatctcttcttcccccttccacttcctgggtcctggtttgctcttcttggaatccttctcgggttcaggcagattggaagttgcagtgaaggcggtgggtgccttgcttcttacccgttggggagagggacggagcagttggagagcgataaagattgcagcgacaggggagacctgcagggctgcaagttctttcggggggcttgtcttgcggcaacatgaagaagctgctcttcgtcttcttcctcttcctgctaggcgtcgcagcagttcatggtgaagatggtgcgtacatcggcgtgaacattggcacggccatgtcgtcggtgccggcgccgacgcagatcacgacgctgctccgctcgcagaacatccgccacgtccggctctacgacgccgacccggcgatgctggcagcgctcgcgaacaccggcatccgcgtcatcgtctcggtgcccaacgagcagctgctcgccatcggcaactccaacgccacggcggccaactgggtggcgcgcaacgtggccgcgcacttccccgccgtcaacatcacggccatcgccgtggggtccgaggtgctctccgcgcagcccaacgccgcgccgctgctcatgccagccatgcgctacctccagaacgcgctggtggccgcggcactggaccggtacatcaagatctccacgccgcactcctcgtccatcatcctcgactccttcccgccgtcccaggccttcttcaaccggtcgctggacaacgtgctcgtgccgatgctcaagttcctgcagtccacggggtcgccgctcatgctcaacgtgtacccctactacgactacatgcgctccaacggcgtcatcccgctggactacgcgctgttccggccgctgccgccgaacaaggaggccgtggacgccaacaccctgctgcactacaccaacgtcttcgacgccgtcgtggacgccgcctacttcgccatgttgtacctcaacgtcaccaacgtgccggtgatggtgaccgagaccgggtggccgcacaagggcgatccctcctccgagcccgacgcgacccctgacaacgccgacacctacaacagcaacctcatccggcacgtgatgaacagcaccggcacgccgaagcaccccggtgtggccgtgccgacctacatctacgagctgtacgacgaggacacccggccggggtcgacatcggagaagtactggggcctgttcgacatgaacggcatccctgcgtacaccctgcatctgacgggctccggcgtgctgctggccaacgacacgacgaaccagacctactgcgtggcgcgggagggcgcggacccgaagatgctgcaggcggcgctggactgggcgtgcggccccggcaaggtggactgctccgcgctgacgcaggggcagccgtgctacgagccggacaccgtggaggcgcacgcgacgtacgccttcaacgcctactaccacggcacggggatgggctccgggacgtgctacttcagcggtgtcgcggtgatcacgacgaccgacccaagtcatggatcttgcgtctacgctgggaagaacgggtcagcgttgctgaacggcacctcgctggcgccgtcgtccaactccacggagggtggctccggtgcgcaccgggcgatcggcgacgtctcagctctcacccgcgtcgtctccgccgtgctgctcttgagcgtcctcctgttgtagagaggctgtagtttgtagttctaggcacccgcaatcatgcagagacttgcagaggagttaggcgttgacgagagggatgattctttttgctgtcgagtgggatttggcctgggtgttggtttgtggaggggactattgtcactccgaatggaatgggatgtgcttctgttggtcttgc

SEQ ID NO: 7994 - protein, 500 aa, Panicum virgatum
  misc_feature: Ceres CLONE 1985320
  misc_feature: Great-hit functional homolog of the protein sequence encoded by LOCUS At2g01630
  misc_feature (1)..(323): Pfam Name: Glyco_hydro_17 Pfam Description: Glycosyl hydrolases family 17
  misc_feature: Useful for making plants with altered cell wall content and/or composition
MKKLLFVFFLFLLGVAAVHGEDGAYIGVNIGTAMSSVPAPTQITTLLRSQNIRHVRLYDADPAMLAALANTGIRVIVSVPNEQLLAIGNSNATAANWVARNVAAHFPAVNITAIAVGSEVLSAQPNAAPLLMPAMRYLQNALVAAALDRYIKISTPHSSSIILDSFPPSQAFFNRSLDNVLVPMLKFLQSTGSPLMLNVYPYYDYMRSNGVIPLDYALFRPLPPNKEAVDANTLLHYTNVFDAVVDAAYFAMLYLNVTNVPVMVTETGWPHKGDPSSEPDATPDNADTYNSNLIRHVMNSTGTPKHPGVAVPTYIYELYDEDTRPGSTSEKYWGLFDMNGIPAYTLHLTGSGVLLANDTTNQTYCVAREGADPKMLQAALDWACGPGKVDCSALTQGQPCYEPDTVEAHATYAFNAYYHGTGMGSGTCYFSGVAVITTTDPSHGSCVYAGKNGSALLNGTSLAPSSNSTEGGSGAHRAIGDVSALTRVVSAVLLLSVLLL

SEQ ID NO: 7995 - DNA, 1808 bp, Panicum virgatum
  misc_feature: Ceres CLONE 1985329
  misc_feature: Encodes the peptide sequence at SEQ ID NO. 7996
gcaggcgggcaagcgcgcgcattacttgcagcgcggggacacgccccggcaagccaagccagccaaggaaccgccactcctctctctctctctctctctgcttgcggcgacgactgggagagcgccgccgcccttcgccgggtcgtcgcccggcggcgagaaccaccagttgatcttctggctggaaaatcgcgttgacggtggcggagtaggtgttctaccatcggcagcttcatctcaaggagcagaattcttacatgatccctttaaaccggagggcaagcctgcctagggctgggatggagtacttcgatgcaaggcggaagcctcataatgttgggaaaatcattgcagccctggtcctcacagctctctgtatatttgttctgaagcaatctcctagttttggtggcaatagtgtgttttctcgccatgaacctggtgttacccacgtcttagtaacaggaggagctggttatattggatcacatgcctctttaaggctcttaaaggataactatcgagttaccattgtggataatctctctagaggaaacatgggagcagtaaaggctctgcagaagttatttccgcagcctgggaggctacaattcatctttgctgatctgggggaccagaaatctgtcaacaagatatttgctgaaaatgcatttgatgctgtgatgcattttgcagctgttgcttacgtgggtgagagcacactggaaccccttaggtactatcacaatattacatcaaacaccttactgattttggaggctatggcatcccatggagtcaagacccttatctattccagtacatgtgctacctatggagaaccagagaagatgcctattacagaagccacacctcagttccctatcaatccatatggaaaagctaagaaaatggcagaggatatcatattagatttctcaaagtcgaagggagctgatatggctgtcatgattttaagatatttcaatgttattggatctgaccctgagggaagattaggtgaagctcccaggccagaactacgagagcatggtcggatatctggggcatgctttgatgcagcattaggagtcattccaggattaaaggttaaaggaacagattatcctacagctgatggaacctgcataagagactacattgatgtcacagatctagttgacgctcatgtgaaagcactcaacaaggcagaacctagaaaagttggcatttataatgttggaaccggaagaggccgctcggttagagagtttgtggatgcctgcaagaaggcaattggggttgacatcaaagttgagtacctcaacagaaggccaggagactatgcagaagtatacagcaacccaacaaagatcaacaaggagctcaactggacggctcaatacacagacctcaaggagagcctgtcagtcgcatggaggtggcaaaagtcacatccacacggctatgggacaaactaaatatagcctgctgatcaataatttcactgaatcgtcgatacatattgattctttagttagtggtataagatcttgctgcaatactcttctcaaaatcactcattgttgtattcttctcaccctctttcttttcttttcttttttcaaaggttggttttttggctagcaaagacaaacaatgatttgggtatgctgtaaatcctggatgcattcctgtaagagcaaactacattgtttctgacatgaagtgttgattaaaaaaatgtacatttattcagccagtccaagctgcaaagctatttgaccgaaaaaaaaaaaaaaaaaaaa

SEQ ID NO: 7996 - protein, 407 aa, Panicum virgatum
  misc_feature: Ceres CLONE 1985329
  misc_feature: Great-hit functional homolog of the protein sequence encoded by LOCUS At1g30620
  misc_feature: Great-hit functional homolog of the protein sequence encoded by LOCUS At2g34850
  misc_feature: Great-hit functional homolog of the protein sequence encoded by LOCUS At4g20460
  misc_feature: Great-hit functional homolog of the protein sequence encoded by LOCUS At5g44480
  misc_feature (1)..(263): Pfam Name: Epimerase Pfam Description: NAD dependent epimerase/dehydratase family
  misc_feature (5)..(405): SWISSPROT Homolog: EC 5.1.3.5 UDP-arabinose 4-epimerase 1
  misc_feature: Useful for making plants with altered cell wall content and/or composition
MIPLNRRASLPRAGMEYFDARRKPHNVGKIIAALVLTALCIFVLKQSPSFGGNSVFSRHEPGVTHVLVTGGAGYIGSHASLRLLKDNYRVTIVDNLSRGNMGAVKALQKLFPQPGRLQFIFADLGDQKSVNKIFAENAFDAVMHFAAVAYVGESTLEPLRYYHNITSNTLLILEAMASHGVKTLIYSSTCATYGEPEKMPITEATPQFPINPYGKAKKMAEDIILDFSKSKGADMAVMILRYFNVIGSDPEGRLGEAPRPELREHGRISGACFDAALGVIPGLKVKGTDYPTADGTCIRDYIDVTDLVDAHVKALNKAEPRKVGIYNVGTGRGRSVREFVDACKKAIGVDIKVEYLNRRPGDYAEVYSNPTKINKELNWTAQYTDLKESLSVAWRWQKSHPHGYGTN

SEQ ID NO: 7997 - DNA, 1409 bp, Panicum virgatum
  misc_feature: Ceres CLONE 1985349
  misc_feature: Encodes the peptide sequence at SEQ ID NO. 7998
gaggagcactacagacttcaacaaggcgcttgaagtggttccaatcaaccaaaggtcatatatagcggatctcaaggcatccaaattaaacaaacaggccgcgccggcaacaatgtcttctcgggtccaacaatgccccgacaaacccgcatccatgaacgtggaggccgtcctccacatgaaggccggcctcggcgacagcagctatgcacagaactcttcgcttcagaagaaaagcaccgacaccttgaaaagcctcgtcatcgactccgcaactcgagtgtacgagacgctacggccggagagcttcaccgtagctgacctcgggtgcgcctccgggagcaacgcgctcggcgtggtggaagccgtcgtcaggagcatcggcgaggtctgctgcgcccgcggatctccgccgcccgagttctcggtgctcctcaacgacctccccaccaacgacttcaacactgtcttctcctgcgcgccggaggtcaccagcaggctcaaggctgacgccaaggccgtagtcttcctttcaggcgtcccgggatccttctacgggaggctcttcgttagcaggagcgtgcatttggtttgctccttcaacagcctgcactggctctctcaggttcctgccggtcttcgtgacgagacaaacacgccacttaacaaggggaagatgttcgtatcaagcacgagccctcccgccgtgccggcggcctaccggcggcagttccagaaagacttgagcctgttcctcaagtcgcgcgccgctgaggtcgtccccggcggccgcatggttgtgtcgatgctgtgccgggaaaccgaggactacacggacgtgaaggcgacccaattatgggatctcctctccgactcactcgccgcgctggtatctcaggggctgctcgagcaggaggtggtggacgcctacgacgccccgtgctacgcgccgagcgcacaggagatccaggaggaagtgaccaaggaaggctccttcagcctggactacgtgcggacgtacgaagccaacctgaacagcgccggggacgccaagagaaacggcaggacgctgtcgatggcgatcagggccatccaggagtccatgctcagccaccacttcggcgccggcatcgtcgacgcgctgttcgacaagtataccgagctcgtcaccgagtccatggagaagggggtggtcaagagcgtccagataggggccgtcctggtcaggttgtggtatgtagatattgctggtactacttaacgattcagtctggcacatcacagattgattgatgttctaaaagggaacatatcaggtgcaaaccaacatcttcatgtaaattatgaaaacttcaatctgagtcattggatcaacatctaagaggtatggggggattgagtaatttttc

SEQ ID NO: 7998 - protein, 382 aa, Panicum virgatum
  misc_feature: Ceres CLONE 1985349
  misc_feature (1)..(329): Pfam Name: Methyltransf_7 Pfam Description: SAM dependent carboxyl methyltransferase
MSSRVQQCPDKPASMNVEAVLHMKAGLGDSSYAQNSSLQKKSTDTLKSLVIDSATRVYETLRPESFTVADLGCASGSNALGVVEAVVRSIGEVCCARGSPPPEFSVLLNDLPTNDFNTVFSCAPEVTSRLKADAKAVVFLSGVPGSFYGRLFVSRSVHLVCSFNSLHWLSQVPAGLRDETNTPLNKGKMFVSSTSPPAVPAAYRRQFQKDLSLFLKSRAAEVVPGGRMVVSMLCRETEDYTDVKATQLWDLLSDSLAALVSQGLLEQEVVDAYDAPCYAPSAQEIQEEVTKEGSFSLDYVRTYEANLNSAGDAKRNGRTLSMAIRAIQESMLSHHFGAGIVDALFDKYTELVTESMEKGVVKSVQIGAVLVRLWYVDIAGTT

SEQ ID NO: 7999 - DNA, 1600 bp, Panicum virgatum
  misc_feature: Ceres CLONE 1985357
  misc_feature: Encodes the peptide sequence at SEQ ID NO. 8000
atcgattccgctcgcctctccctttcgccgtcgtcgtcacagcctcacactagctagctacctttacgcgagaagaagaggagcgcgcctcgcgcgcggctaggggtagctagtctagctccaccgcggcgagcgagagcatgtcggcggtggtgtcgtctccccgcgcggccggcgccgcacggcggctgtctccgtctcccaagccggccggcgccagggacaagggcgacaaggaggagcctccatcgctcgagggcgccgccgacaaggccaggaggaggctgctgccgtcggccccggccaggggcgccgcggcgtccatgctgctgcgccgcgccggcgccggcgcgcgggggagcagctacgtgcacccgtcctcgtcgctcagcgtctcgtgcgcgtcggaggcgtccaccgagtccttctgcagccgcgcgtcgacgggccgcatcggccgccgccccgcgggcccgcccgtgggagccccgcgccggcgggcggcgggctcggccgggcctccttcggcgcggccggcctcgtccaggaaggttgccggcgccgtgccaggcggtgcggcggtcactgctgctccggcggtgccgccgatgctgggccccgtgaatggagagcacaccgcgacgtcggcggggccgccgaggtgcccctgggttacccctaacactgatccctgctacgctgccttccatgaccacgagtggggagtgccagtgcatgacgacaagaaattgtttgaaatgctaactctgtctggtgcactggctgagatggcatggcctgcgattctcagcaagagggacaccttcagagaagtgttcatggacttcgaccccgtgttggtggccaagctgagcgagaagaaattcttggcgccaagcaaccctgctagctccctgttgtccgaacacaggctgcgcataatcatcgaaaacgcgcgtgagctgctgaaggtcatagaggagttcggatcattcgacagctactgctggagcttcctgagcaacaagccgatggttggcacataccggcacacgcgggaggtgccgctgcggacggcgaaggccgacgccatcagccaggacctgatgcgtcggggtttcctcggcgtcggcccgacggtggtctacgccttcatgcaggccgtcggcatggccaacgaccacctcgtcacctgctaccgcttcgaggagtgctgcgacatcaaggacgacgacgtcgccggcgccgcaactgacggctacggtgagagttgcaaaccggcagcggcggtgagcgagcaggaggtgagcatgctctgtgggctggtgcagtgcgtcgccctggagccgtcgagagccgccacggtgatcagcatctcatagcacagccagctgcagctagtaccaaccagacaatgcaaggtgatgactgatgacacgaatgagtagggttaattaggcgagttgatttcacttaatcgtgctggtgcagtgattgcatgtgtgtagatatcggtcgtgttcgagcgaggtgtgtacatggttgtgttgatgtgaggtttgagaaattggggtttgcttaaaaaaaaaaaaaaaaaaaa

SEQ ID NO: 8000 - protein, 413 aa, Panicum virgatum
  misc_feature: Ceres CLONE 1985357
  misc_feature (1)..(181): Pfam Name: Adenine_glyco Pfam Description: Methyladenine glycosylase
MSAVVSSPRAAGAARRLSPSPKPAGARDKGDKEEPPSLEGAADKARRRLLPSAPARGAAASMLLRRAGAGARGSSYVHPSSSLSVSCASEASTESFCSRASTGRIGRRPAGPPVGAPRRRAAGSAGPPSARPASSRKVAGAVPGGAAVTAAPAVPPMLGPVNGEHTATSAGPPRCPWVTPNTDPCYAAFHDHEWGVPVHDDKKLFEMLTLSGALAEMAWPAILSKRDTFREVFMDFDPVLVAKLSEKKFLAPSNPASSLLSEHRLRIIIENARELLKVIEEFGSFDSYCWSFLSNKPMVGTYRHTREVPLRTAKADAISQDLMRRGFLGVGPTVVYAFMQAVGMANDHLVTCYRFEECCDIKDDDVAGAATDGYGESCKPAAAVSEQEVSMLCGLVQCVALEPSRAATVISIS

SEQ ID NO: 8001 - DNA, 1669 bp, Panicum virgatum
  misc_feature: Ceres CLONE 1985462
  misc_feature: Encodes the peptide sequence at SEQ ID NO. 8002
aaaaaacttcgaacaaagcacctcaaccctgccagttctctcactcaagtcaccttgcaattccatgctaccaatctccaaactagtataggaactagaagcaggcagcagactaattcttctagggattgtttggttccatatctcccgaaatgatccgcagccacccaatgcgaagtcgacaggtgtcgccatcctagccagccctaactatttggctttggcgtccaaaaatcctgtagcacattggcacgtccgtacgaggactaggccgggtgatcgatggagcaggagctgaggaccggcggcctcagggtcagggcgcacagctcctccgtgtgcttctccggcgcgctcatcgacggcccgcgcatccagcagctgctcctccactgcgccgccgcgctggagtccaacgacgtcacgctggcgcagcaggccatgtgggtgctcaacaacatcgcgtcgtcccagggggaccccaaccagcgcctcacgtcgtggctgctccgcgcgctggtcgcgcgcgcgtgccgcctgtgcggcccggcggccggggctccccaggcggcggcgcccgcgccgcgggagcgggccatgtccgtgacggagctcgccgagtacgtcgacgtcacgccgtggcaccggttcggcttcacggcctccaacggcgccatcctccgggccgtggcgggcagcgccgccgtgcacgtcgtcgacctcggcgtcacgcgaggcatgcagtggccgacgctcatcgacatgctgtccaagcggcccgggggcccgccggcgctccgcatcaccgtgccgtccgcccggcccgccgtgccgcctctgctcggcgtgccggacgaggagctcggcgcccggttggccaacttcgccaagtccaaaggcgtgcagctagagttcaacgtcgtcagaaagggcacgggcacgagcacgagcccgacgtcgtctccaaagaagaagcaggcgccgccgctctgccagcaggacctggcgtccgtgctgtcggacccgccgtcgctggcgctccgggacggcgaggcgctggtcgtcaactgccagagctgggtccgccacgtcgcgcagggctcgagggacgcgttcctcggcaccgtccgcgagctgaagccgtgcctggtcacggtgaccgacgaggacgccgacctggactcgccgagcctcgcgtcccgcatcgaggggtgcttcaacttccactggatcctgttcgacgccctggacacgtccgcgcccagggacagcccgcggcgggtggagcacgaggcggccgtgggccggaaaatcgagggcgtcgtgggtgccgacgacgcggacggcgccgagcggtccgagtccggcgcgaggctcgccgagcggatgcggcggaacgggttcacgggcgtagcgttcgacgaggaggcggcgggcgaggtgaggcgcctgctgagcgagcacgcgactggctggggcgtgaagcgggaggaggacatgctcgtgcttacctggaaaggccatggcgccgtgtacacgggcgcctggacgcctagctagtatagctatctgatctgctgctaggagcctatgtttccgattagctcaagaagaatcaagctaacggacttaacacagacagatttccgtaatatagtcagttccattc

SEQ ID NO: 8002 - protein, 425 aa, Panicum virgatum
  misc_feature: Ceres CLONE 1985462
  misc_feature (1)..(327): Pfam Name: GRAS Pfam Description: GRAS family transcription factor
MEQELRTGGLRVRAHSSSVCFSGALIDGPRIQQLLLHCAAALESNDVTLAQQAMWVLNNIASSQGDPNQRLTSWLLRALVARACRLCGPAAGAPQAAAPAPRERAMSVTELAEYVDVTPWHRFGFTASNGAILRAVAGSAAVHVVDLGVTRGMQWPTLIDMLSKRPGGPPALRITVPSARPAVPPLLGVPDEELGARLANFAKSKGVQLEFNVVRKGTGTSTSPTSSPKKKQAPPLCQQDLASVLSDPPSLALRDGEALVVNCQSWVRHVAQGSRDAFLGTVRELKPCLVTVTDEDADLDSPSLASRIEGCFNFHWILFDALDTSAPRDSPRRVEHEAAVGRKIEGVVGADDADGAERSESGARLAERMRRNGFTGVAFDEEAAGEVRRLLSEHATGWGVKREEDMLVLTWKGHGAVYTGAWTPS

SEQ ID NO: 8003 - DNA, 1501 bp, Panicum virgatum
  misc_feature: Ceres CLONE 1985579
  misc_feature: Encodes the peptide sequence at SEQ ID NO. 8004
actgcactcagcttcttcagcttcttgtcgatcaccagtcagtgtggagagacagagaagcagagcggcatcagccatgggtagcaggcaattgtgctgcctgtcgaccctgctcctcctccttggcctggcttccggccaggtcctgttccaggggttcaactgggagtcgtggaagcagagcggcgggtggtacaacatgctgatggggaaggtcgacgacatcgccgccgccggcgtgacgcacgtctggctcccgccgccgtcgcactccgtctccacccaaggatacatgcccggccggctttacgacctggacgcttccaagtacgggacggcgtcggagctcaagtccctgatcgcggcgttccacagcaagggcgtgcaggcggtggcggacatcgtcatcaaccaccggtgcgccgactacaaggactcccgcggcatctactgcatcttcgagggtgggacccccgacgggcgcctggactggggcccccacatgatctgccgcgacgacacccagtactcggacggcacggccaacctcgacaccggcgccgacttcgccgccgcacccgacatcgaccacctcaacgaccgcgtccagcgcgagctcaccgactggctgctgtggctcaagtccgacgtgggcttcgacgcctggcgcctcgacttcgccaggggctactccgccgcggtcgccaaggtctacgtggacgccacggcgccgagcttcgccgtggcagagatatggaacaacatggtgcccggcgatgacggcaagccggcgtacgaccaggaccagcaccggcagacgctggtggactgggtcaacggcgtgggcggggccgcgtcgccggccaccgtgttcgacttcaccaccaagggcatcctcaacgccgccgtggaaggcgagctgtggcggctcgtcgacgcgcaggggaaggcgccaggtgtcatcggatggtggccggccaaggccgtcaccttcgtcgacaaccacgacacggggtccacgcaggccatgtggccattcccctccgacaaggtcatgcagggatacgcatacatcctcacgcaccccggcaacccctgcatcttctacgaccatttcttcgactggggcttcaaggacgagatcgccgcgctggtggccgtgaggaagcgcaacggcatcacgcccacgagcgacctcaccatcctcgagcacgacgccgacgcctacgtggcggagatcgacggcaaggtcatcgtcaaaatcggctccaggtacgacgtcggccacctcatcccggccgggtttcaggtggccgcccacggcaacgactacgccgtctgggagaaaaactaaaggcgccggccaagaatcggacagagcacaattgtcaggggctcctcttcgtaatatgatttatttctctgctacatagtacaatacaagcagagatggagtatacatgattgggataccaccatttatacctgtatacacaggatt

SEQ ID NO: 8004 - protein, 425 aa, Panicum virgatum
  misc_feature: Ceres CLONE 1985579
  misc_feature (1)..(339): Pfam Name: Alpha-amylase Pfam Description: Alpha amylase, catalytic domain
  misc_feature (1)..(339): Pfam Name: Alpha-amylase Pfam Description: Alpha amylase, catalytic domain
  misc_feature (1)..(341): Pfam Name: Alpha-amylase Pfam Description: Alpha amylase, catalytic domain
  misc_feature (1)..(342): Pfam Name: Alpha-amylase Pfam Description: Alpha amylase, catalytic domain
  misc_feature (1)..(339): Pfam Name: Alpha-amylase Pfam Description: Alpha amylase, catalytic domain
  misc_feature (2)..(337): Pfam Name: Alpha-amylase Pfam Description: Alpha amylase, catalytic domain
  misc_feature (1)..(341): Pfam Name: Alpha-amylase Pfam Description: Alpha amylase, catalytic domain
  misc_feature (1)..(342): Pfam Name: Alpha-amylase Pfam Description: Alpha amylase, catalytic domain
  misc_feature (1)..(342): Pfam Name: Alpha-amylase Pfam Description: Alpha amylase, catalytic domain
  misc_feature (1)..(318): Pfam Name: Alpha-amylase Pfam Description: Alpha amylase, catalytic domain
  misc_feature (1)..(425): SWISSPROT Homolog: EC 3.2.1.1 Alpha-amylase type A isozyme precursor
  misc_feature (12)..(424): SWISSPROT Homolog: EC 3.2.1.1 Alpha-amylase isozyme 2A precursor
MGSRQLCCLSTLLLLLGLASGQVLFQGFNWESWKQSGGWYNMLMGKVDDIAAAGVTHVWLPPPSHSVSTQGYMPGRLYDLDASKYGTASELKSLIAAFHSKGVQAVADIVINHRCADYKDSRGIYCIFEGGTPDGRLDWGPHMICRDDTQYSDGTANLDTGADFAAAPDIDHLNDRVQRELTDWLLWLKSDVGFDAWRLDFARGYSAAVAKVYVDATAPSFAVAEIWNNMVPGDDGKPAYDQDQHRQTLVDWVNGVGGAASPATVFDFTTKGILNAAVEGELWRLVDAQGKAPGVIGWWPAKAVTFVDNHDTGSTQAMWPFPSDKVMQGYAYILTHPGNPCIFYDHFFDWGFKDEIAALVAVRKRNGITPTSDLTILEHDADAYVAEIDGKVIVKIGSRYDVGHLIPAGFQVAAHGNDYAVWEKN

SEQ ID NO: 8005 - DNA, 1636 bp, Panicum virgatum
  misc_feature: Ceres CLONE 1985674
  misc_feature: Encodes the peptide sequence at SEQ ID NO. 8006
gactctgcgagggagaggggaggacccaaggactcgaaggctcggcgagctccgacgccgtggaactggagtggagggcaaaccgcaggagctggacttggcgcccaggagcgacaggatcggcctaggatgtggtgcgcgtcgtgcctggcgtccgcctgcgcgggctgcgcctgcaacctctgcacgtcggcggcgtcggccgtgacccgccgctccgcgcgcatcgcctactgcggcctcttcgccgcctccctcatcctctccttcctgctccgccagttcgccacgcctctcctgcagcacatcccatggataaatgcatttgaccagacaccaccagacgaatggtttcaaatgaatgctgttcttcgcgtaagcctgggtaacttcttgttttttgcaatatttgccatcatgatgattggtataaaagaccagaatgatcggcgagatgcatggcaccatggtggctggattgcaaagattgctgtctgggctgttctcattgttcttatgttctgtgttccgaacattgtaattaatatttacgaggtactatcaaagtttgggtctggtttgtttcttctagtacaggttctgatgcttttagacttcacaaataattggaatgactcatgggttgagaaagatgagcagaagtgggaaatagctttactggtagtgactgtggtttgctatctctctacatttgccttctctggtgtgcttttcatgtggtttaatccctctggtcatgactgtggtctcaacgtgttctttattgtcacgactcttattcttgcctttgcctttgcaatagttgctttgcacccccaggtcaatggaagcattatgcctgcttctgtcatttctgtctactgtgcatacctgtgttacactagtctctcaagtgaaccagacgactacaaatgcaatgggcttcacaggcattctaagcaggtttcattgagcgctcttatactcgggatgctcactaccgtgctatctgttgtgtactctgctgtccgtgctggatcttccactacattcctctcaccaccatcgtctcctagatctggagacaaaaaccctttactcggtgacgaggagacaggcaaaggcaacgataaagaaagcgaaccgcgccctgtgagctattcctacaccttcttccacctcatcttcgcccttgcaagcatgtactcagccatgcttttgactggctggacgagtgcggcgtcggagaagtcagagctaatggatgttggatggacaaccgtctgggtgcgcatctgcactgagtgggtcaccgccgctttatacatctggaccctcattgccccgctgctcttcccggaccgtgatttctcctaggcacctgtgaccatgagttccgcatttgtgaattggctgtgattgtgaatataaataagcagaatttggaagtagaacgagtagcatctgatgttatctggcctgcaagcggtagcatttcgtatctgtttgtgtggctacaaacctatgtggctatatctatgccaaagtttggttgtggtattgaatcatatatagttgtatgctaagttgtgacaattactagtggttacagtaaagtgattaacaatggagtagc

SEQ ID NO: 8006 - protein, 415 aa, Panicum virgatum
  misc_feature: Ceres CLONE 1985674
  misc_feature (1)..(409): Pfam Name: Serinc Pfam Description: Serine incorporator (Serinc)
  misc_feature (1)..(405): Pfam Name: Serinc Pfam Description: Serine incorporator (Serinc)
  misc_feature (1)..(403): Pfam Name: Serinc Pfam Description: Serine incorporator (Serinc)
  misc_feature (1)..(407): Pfam Name: Serinc Pfam Description: Serine incorporator (Serinc)
MWCASCLASACAGCACNLCTSAASAVTRRSARIAYCGLFAASLILSFLLRQFATPLLQHIPWINAFDQTPPDEWFQMNAVLRVSLGNFLFFAIFAIMMIGIKDQNDRRDAWHHGGWIAKIAVWAVLIVLMFCVPNIVINIYEVLSKFGSGLFLLVQVLMLLDFTNNWNDSWVEKDEQKWEIALLVVTVVCYLSTFAFSGVLFMWFNPSGHDCGLNVFFIVTTLILAFAFAIVALHPQVNGSIMPASVISVYCAYLCYTSLSSEPDDYKCNGLHRHSKQVSLSALILGMLTTVLSVVYSAVRAGSSTTFLSPPSSPRSGDKNPLLGDEETGKGNDKESEPRPVSYSYTFFHLIFALASMYSAMLLTGWTSAASEKSELMDVGWTTVWVRICTEWVTAALYIWTLIAPLLFPDRDFS

SEQ ID NO: 8007 - DNA, 1813 bp, Panicum virgatum
  misc_feature: Ceres CLONE 1985714
  misc_feature: Encodes the peptide sequence at SEQ ID NO. 8008
aacggggagccgggaaccgggagccgggagcaatattctgggcatggagtttggggcttttcttttgtatggacgtttggtactaatacattacttctgaaaaaaaaaaaaaaaaaaaaaaaagtgccacacatcccgtccccgcctcttctccctccggccgggtccccgaataaagagcagcagcgcaagaggttggtggagtaatttaccccagaacaacaaggtagcagcggcaatggcggcggagagcttcctcttcacctccgagtccgtgaacgaggggcaccccgacaagctgtgcgaccaggtctcggacgccgtcctggacgcgtgcctggcgcaggaccccgacagcaaggtggcctgcgagacctgcaccaagaccaacatggtgatggtgttcggcgagatcaccaccaaggccaccgtcgactacgagaagatcgtgcgcgacacctgccgcgagatcggcttcacctccgacgacgtgggcctcgacgccgaccgctgcaaggtgctcgtcaacatcgagcagcagtcccccgacatcgcgcagggcgtgcacggccacttcaccaagcgccccgaggagatcggcgccggcgaccagggccacatgttcggctacgccaccgacgagacccccgagctcatgccgctcagccacgtgctcgccaccaagcttggcgcgcgcctcaccgaggtccgcaagagcggcacctgcgcctggctccgccccgacggcaagacccaggtcaccgtcgagtacctcaaccagggcggcgccatggtccccgtccgcgtccacaccgtcctcatctccacccagcacgacgagaccgtcaccaacgacgagatcgccgccgacctcaaggagcacgtcatcaagcccgtcatcccggacaagtacctcgacgagaagaccatcttccacctcaacccgtcgggccgcttcgtcatcggagggccccacggcgacgccggcctcaccggccgcaagatcatcatcgacacctacggcggctggggcgcccacggcggcggcgccttctccggcaaggaccccaccaaggtcgaccgcagcggcgcctacatcgccaggcaggcggccaagagcatcgtggccagcggcctcgcccgccgctgcctcgtgcaggtgtcctacgccatcggcgtgcccgagcccctgtccgtgttcgtcgaatcgtacggcaccggcaccatccccgacaaggagatcctcaagatcgtcaaggagaacttcgacttcaggcccgggatgatcaccatcaacctcgacctcaagaagggcggcaaccggttcatcaagaccgccgcctatggccacttcgggcgtgacgacgccgacttcacctgggaggtggtgaagcccctcaagttcgaaaaggcatcagcttagagaagaagaggatgttgaccagtgtctgtctccgtgctttcatctactacctcttgctgttgatgttacctgcaagcattgctgctgctgctcctgctcctggatgtgtgtctgatcagtgactggctgcttccttagaagaagatgcagatcgagaagatgaagaaggctttaatttggcaatcgccgcagcaagccatctcgccggcggcggcttagtgattgggtataatttggtgtggcagccaggattacgcgctgatctttacctttactagtttggtcgtccggtatcttttttttcatcctttctcctccccgccccttttcgagtctgtactgaaactgctgagagatttgcagttttgatctgtcataattcgtatgttt

SEQ ID NO: 8008 - protein, 394 aa, Panicum virgatum
  misc_feature: Ceres CLONE 1985714
  misc_feature: Great-hit functional homolog of the protein sequence given in SEQ ID NO 9521
  misc_feature (1)..(142): Pfam Name: S-AdoMet_synt_C Pfam Description: S-adenosylmethionine synthetase, C-terminal domain
  misc_feature (1)..(394): SWISSPROT Homolog: EC 2.5.1.6 S-adenosylmethionine synthetase 1
  misc_feature (1)..(394): SWISSPROT Homolog: EC 2.5.1.6 S-adenosylmethionine synthetase 2
  misc_feature: Useful for making plants with modulated biomass
  misc_feature: The plant is abnormally small.
MAAESFLFTSESVNEGHPDKLCDQVSDAVLDACLAQDPDSKVACETCTKTNMVMVFGEITTKATVDYEKIVRDTCREIGFTSDDVGLDADRCKVLVNIEQQSPDIAQGVHGHFTKRPEEIGAGDQGHMFGYATDETPELMPLSHVLATKLGARLTEVRKSGTCAWLRPDGKTQVTVEYLNQGGAMVPVRVHTVLISTQHDETVTNDEIAADLKEHVIKPVIPDKYLDEKTIFHLNPSGRFVIGGPHGDAGLTGRKIIIDTYGGWGAHGGGAFSGKDPTKVDRSGAYIARQAAKSIVASGLARRCLVQVSYAIGVPEPLSVFVESYGTGTIPDKEILKIVKENFDFRPGMITINLDLKKGGNRFIKTAAYGHFGRDDADFTWEVVKPLKFEKASA

SEQ ID NO: 8009 - DNA, 1492 bp, Panicum virgatum
  misc_feature: Ceres CLONE 1985793
  misc_feature: Encodes the peptide sequence at SEQ ID NO. 8010
aactaacgctaaaaaagtaacagtttctgtactttattgatccgacgatcatcatcccttgatcaatcattatccaaaccacacaagccaacatcatgattcacggaatcgcagacgtgggtgtccgcaaacagcccagcgggcgcatgacgtcgtgcgttgtcctgagcgtgctgggagccgccgacgcgtcgtacatggtgccgtggccgcgcgtggagcacatgccgcgcgacctgcgcccgacggagcgtcctgtcctctgccccgccttcgaccccaacggcggcgtcggtgattgccgcatgggtcacaactgccgactcgtccacgcagacgtttccggcctccagcgcctgagctcgcacatcaacttcgcgtggcgcagcctcggcgacgtgaactacacccggcacccgccgggccagctcgcgcacgtcgcggcgccgaacagccgctccgacgttgatgtgatggactcaggctatttgctcgtgacgaaggccctcgaatcgactcgccgcccgctgacgcactgcgcccactactactacaaccgccagtgcaacctcggctgcgagtgccgcttcgtccacgccgtctttgtcgacccctccgcgcgcccgcgccaacgcgctcccgcgccgatccaacttggccgccggatggctcagcgccaccgtgagcttctcgacaaccgctcgccgtcagacgactgcgactccgccggcgagtacggttccatggtccgcgctaagtcgtctcacggcacgccgcaggccccaccgtcggcggacttctcgctgtcgggcagcatttcgccccccgagtcgccgcacgccactcgccgctggaagcacgagccctacgctgccggtggccccatcgaggccggctaagcagtaacggaactcattgtaaccagccggctggtggagcccgtgcatgttaactcgtcggctggctggccacactcacctctctgccttgaaacacacacacaaacaattgcgtccgtctcggcgtgcgaactcagtgcgggcaccacacgacccgctactcacccccgtattccagcgccgcgcgcgccccgcgtctcaagcgactacggcgcgacgagtgcagctggtccctccgtgcagatgccgcgacctccacgcggcctatcccttcgcacgccttcctcacagtccaccaaggggttccgccgcctgttcttccgcgacggcctcgcctccacgtttcgctgctgtgtccttcccccgtgtgagctgccgaccaccgccaaaaagccctttgtgtgcccttcgagtccgccacgcgcacccgcgatgtgcgcaggcgttacactcgcacccacatccctttctcgtttttttcccccgcgcttctcagttcgttgttctctcggcaccgcttggcgagagttcgaagggtcggaggtgcaccaccaatcggaccaggagcgtcacaaaaaaaaaaaaaaaaaaaa

SEQ ID NO: 8010 - protein, 267 aa, Panicum virgatum
  misc_feature: Ceres CLONE 1985793
  misc_feature (2)..(27): Pfam Name: zf-CCCH Pfam Description: Zinc finger C-x8-C-x5-C-x3-H type (and similar)
MIHGIADVGVRKQPSGRMTSCVVLSVLGAADASYMVPWPRVEHMPRDLRPTERPVLCPAFDPNGGVGDCRMGHNCRLVHADVSGLQRLSSHINFAWRSLGDVNYTRHPPGQLAHVAAPNSRSDVDVMDSGYLLVTKALESTRRPLTHCAHYYYNRQCNLGCECRFVHAVFVDPSARPRQRAPAPIQLGRRMAQRHRELLDNRSPSDDCDSAGEYGSMVRAKSSHGTPQAPPSADFSLSGSISPPESPHATRRWKHEPYAAGGPIEAG

SEQ ID NO: 8011 - DNA, 1831 bp, Panicum virgatum
  misc_feature: Ceres CLONE 1985974
  misc_feature: Encodes the peptide sequence at SEQ ID NO. 8012
aacaaacgctaaaaaagtaacagtttctgtactttattgctaagtttctgatatgtactcggacagcgagactgagcgcgagatcgaccgcaagcgcaaccgcgcggagcaggctcgcgttagcgcgcgcaagagcggccgccagtcgagcaacaacgccagcggcgtcatccagacccgtctgtacatcgacggccagttcgtcgactccatctcgggcaagaccttcgccgtgctgaacccggccaccggcgaggagatctgccgcgtgcaggaggccgacaaggcggacattgacctcgccgtcaaggccgcgcgccgctgcttcgagaccacgtggaaatacacggacggctccgcgcgccgcgacctgatgctgaagctcgccgacctcattgagcgcaacaaggaggagctcgccacgctcgagtcgctcgacaacggcaagccgtacagcgagtcgctcaacgtcgatctgaccctcgtcatcaagtgcctgcgctactacgccggctgggcggacaagatcagcggcaagacgaacccggttgacggtcagttcttctccttcacgaagcacgagccggtcggcgtcatcggtcagatcatcccgtggaacttcccgctgctcatggccgcgtggaagctcggccccgccctcgccatgggctgcaccgtcgtgctcaagccggcggagcagacgccgctctccgctctccgcctcgcggagctcgtccacgaggcgggctaccccgcgggcgtcctgaacgtgctgcccggcttcggcccgaccgcgggcgcggccatcgccggccacccggacatcgacaaggtcgcgttcaccggctcgacggaggtcggccgcatcgtgatgcaggccgctgcgaagagcaacctgaagaagtgctcactggagctcggcggtaagtccccgctgatcatcaacgacgacgccgacatcgaggccgccgtcgccgcggcgcaggtcggtgtgttcttcaaccagggccaggtctgcactgcgtcctcccgcatcttcgtgcacgagcgcatctacgataccttcgtctcgaagctcgtcgccgcgtcgaagaagcgcacgcagggcaacccgttcaaggatgtgaacatgggcccgcaggtgtcggcggagcagcaggagaccgtgtggagcttcatcaaggcgggcaagaaggagggcgccgattgcgtcctcggcggcaagcgcgttgaggaggcgggctacttcatccagccgaccatcttcacgaacgtcaccgacgacatgaagattgcccgcgaggagatcttcggtccggtgatgtccatcctgaagttcaagacgctcgacgaggcgatccgccgcgcgaacaagtccatgtacggcctcgccgcgggcatcttcacgcgcgacctcaacacggcgctcaagtacgccaacgaggtcaaggcgggccccgtgtggatcaacacgtacaacagctttgatacggggcagccctttggcggcttcaagcagtcgggcattggccgcgagctgggggagtacgcgcttgaactgtacactgaggtcaagacggtcatgatcaagcttaacgacgcccccgtcaagaactgagaaagctttgaccgggaccgtaccgcacccctttgaacgatttgacacaaccggataccccttcctgggcacccggaaaatgaggcatttcgcttttggaagaaaacaaaactgctaactgcatggttcaatgagctgtttttttaaccgattcagctcggcccgccccaaaattgttttgtgggtgcccaacccgaacggtgtgcccatttc

SEQ ID NO: 8012 - protein, 521 aa, Panicum virgatum
  misc_feature: Ceres CLONE 1985974
  misc_feature (1)..(463): Pfam Name: Aldedh Pfam Description: Aldehyde dehydrogenase family
  misc_feature (1)..(461): Pfam Name: Aldedh Pfam Description: Aldehyde dehydrogenase family
  misc_feature (1)..(463): Pfam Name: Aldedh Pfam Description: Aldehyde dehydrogenase family
  misc_feature (2)..(413): Pfam Name: Aldedh Pfam Description: Aldehyde dehydrogenase family
  misc_feature (1)..(462): Pfam Name: Aldedh Pfam Description: Aldehyde dehydrogenase family
  misc_feature (3)..(464): Pfam Name: Aldedh Pfam Description: Aldehyde dehydrogenase family
  misc_feature (1)..(462): Pfam Name: Aldedh Pfam Description: Aldehyde dehydrogenase family
  misc_feature (3)..(464): Pfam Name: Aldedh Pfam Description: Aldehyde dehydrogenase family
  misc_feature (4)..(464): Pfam Name: Aldedh Pfam Description: Aldehyde dehydrogenase family
  misc_feature (1)..(463): Pfam Name: Aldedh Pfam Description: Aldehyde dehydrogenase family
  misc_feature (13)..(521): SWISSPROT Homolog: EC 1.2.1.3 Aldehyde dehydrogenase, mitochondrial precursor
  misc_feature (34)..(521): SWISSPROT Homolog: EC 1.2.1.3 Aldehyde dehydrogenase, mitochondrial precursor
MYSDSETEREIDRKRNRAEQARVSARKSGRQSSNNASGVIQTRLYIDGQFVDSISGKTFAVLNPATGEEICRVQEADKADIDLAVKAARRCFETTWKYTDGSARRDLMLKLADLIERNKEELATLESLDNGKPYSESLNVDLTLVIKCLRYYAGWADKISGKTNPVDGQFFSFTKHEPVGVIGQIIPWNFPLLMAAWKLGPALAMGCTVVLKPAEQTPLSALRLAELVHEAGYPAGVLNVLPGFGPTAGAAIAGHPDIDKVAFTGSTEVGRIVMQAAAKSNLKKCSLELGGKSPLIINDDADIEAAVAAAQVGVFFNQGQVCTASSRIFVHERIYDTFVSKLVAASKKRTQGNPFKDVNMGPQVSAEQQETVWSFIKAGKKEGADCVLGGKRVEEAGYFIQPTIFTNVTDDMKIAREEIFGPVMSILKFKTLDEAIRRANKSMYGLAAGIFTRDLNTALKYANEVKAGPVWINTYNSFDTGQPFGGFKQSGIGRELGEYALELYTEVKTVMIKLNDAPVKN

SEQ ID NO: 8013 - DNA, 1555 bp, Panicum virgatum
  misc_feature: Ceres CLONE 1986045
  misc_feature: Encodes the peptide sequence at SEQ ID NO. 8014
gtaaccaccaaaccaaacctctcgccgcagcagccagcaacagcaacgacgagaacgcgtaaacgagggagagcctcccgcgattacgaagagcccaggcacgccgaagcagcgaagcgccgaggaaggaagggagcaacagccatggggctcgactactacaagatcctgggcgtcgacaagggtgccaccgacgacgacctcaagaaggcctaccgcaagctcgccatgaagtggcaccccgacaagaaccccaacaacaagaaggaggccgagaacaagttcaagcagatctcggaagcatacgaggtcctgagcgaccctcagaagcgcgcggtgtacgaccagtacggagaggaggggctcaaggggcaggtgccgccgccgggcgccggcggggtgggccccgggggtgccaccttcttctccacgggcggcgacgggccgacgacgttccggttcaacccgcgcaacgcggaggacatcttcgcggagttcttcggcgggtccagccccttcggcggcatgggtggcggcatgggcggcatgggtggcggcggaatggggggaggaatgcccggcatgcggaccggtgggacgaggttctcctcgtccatctttggggatgatatattcggctcggcgttcggcggcggccccgacgggcacggcatgcacaccggcgggcgggcggtgaaggcgcccgcgatcgagcggaagctgccgtgcagcctcgaggagctgtacaagggcaccaccaagaagatgaagatttccagggaaatcgctgatgccagtgggaagacgatcccggtcgaggagatcctgacgatcgacgtgaagcccggatggaagaagggcaccaagatcacgttcccggagaagggcaacgagacgcccaacacgatcccggccgacctcgtcttcatcatcgacgagaagccgcacccggtgttcacccgcgacggcaacgacctggtggtgacgcagaagatcccgctcgcggaggccctgacggggtacaccgcgcacctgacgacgctggacgggcgcagcctgacggtgcccatcacctccgtgatccacccgtggtacgaggaggtggtgcgcggcgagggcatgcccatccccaaggacccgtcgaggaagggcaacctccggatcaagttcgacatcaagttcccgtccaggctcacggcggaccagaagtccggcgtcaagaggctgctcgggcagtagtgagagcgagcgagctagtgagctagcgggggcgcagagacggtgctctgttctgtgtcaagacttgatcgtttggactggagagtggagacggtgcgcagcgcagagacggttgaggtgcataggagtccttgtacaatcttccggattggtgtttgttcactggcccatttcgtggcgactggcaatggtggacggaataatcgtcgagcacatagattatgtgagaaactttctacaagtgttggttaaaatggtaatagtagaatactaagcgatatggaaatttgaagtgcaaaaaaaaaaaaaaaaaaaa

SEQ ID NO: 8014 - protein, 364 aa, Panicum virgatum
  misc_feature: Ceres CLONE 1986045
  misc_feature (1)..(64): Pfam Name: DnaJ Pfam Description: DnaJ domain
  misc_feature (1)..(123): Pfam Name: DnaJ_C Pfam Description: DnaJ C terminal region
MGLDYYKILGVDKGATDDDLKKAYRKLAMKWHPDKNPNNKKEAENKFKQISEAYEVLSDPQKRAVYDQYGEEGLKGQVPPPGAGGVGPGGATFFSTGGDGPTTFRFNPRNAEDIFAEFFGGSSPFGGMGGGMGGMGGGGMGGGMPGMRTGGTRFSSSIFGDDIFGSAFGGGPDGHGMHTGGRAVKAPAIERKLPCSLEELYKGTTKKMKISREIADASGKTIPVEEILTIDVKPGWKKGTKITFPEKGNETPNTIPADLVFIIDEKPHPVFTRDGNDLVVTQKIPLAEALTGYTAHLTTLDGRSLTVPITSVIHPWYEEVVRGEGMPIPKDPSRKGNLRIKFDIKFPSRLTADQKSGVKRLLGQ

SEQ ID NO: 8015 - DNA, 1072 bp, Panicum virgatum
  misc_feature: Ceres CLONE 1986134
  misc_feature: Encodes the peptide sequence at SEQ ID NO. 8016
gaactgccggttcgagctactagtctcgttgctctgctttggtgtgtttggtttgtactgttcagtcctttcagcctgcagactgtgtcatgtactcctactactgctagcttctttcctgtttggtgagatcgggtgtgtaggagtatgttctaccttctgcgagtgaataaataaagaataaagcagatcttgtgtaaaaaaaaaaaaaaaaaaaaaaaaaaaaaaaaaaaaaaaaaaaaaaaaaaaaaaaacccaaaaaggcaaaaaggaacccccaacacacaaaaataacaaagccttcttcctacagcgcacttgcaatccacaaacaaagctcagctcatccaagcacacaaagcaccagcaatgtcgctcgtcaggcgcaccaacgtgttcaaccccttctccatggacctctgggaccccttcaatagcatgttccgctccgtcgtcccgtcgtcctcctcctccgactccgacaccgccgccttcgccaacgcccgcatcgactggaaggagacccccgaggcgcacgtcttcaaggccgacctccccggcgtcaagaaggaggaggtcaaggtggaggtggaggacggcaacgtgctggtcatcagcggccagcgcagcaaggagaaggaggacaagaacgacaggtggcaccgcgtggagcgcagcagcggccagttcatgaggcgcttccgcctggctgaggacgccaaggtggagcaggtcaaggccgggctggagaacggcgtgctcaccgtcaccgtgcccaaggccgagggcaagaagcccgaggtgaagagcatccagatctccggttaggcgaccgtggggacggacggtgaggtggtgagcgtgtgcggcggaggaactgccggttcgagctactagtctcgttgctctgctttggtgtgtttggtttgtactgttcagtcctttcagcctgcagactgtgtcatgtactcctactactgctagcttctttcctgtttggtgagatcgggtgtgtaggagtatgttctaccttctgcgagtgaataaataaagaataaagcagatcttgtgt

SEQ ID NO: 8016 - protein, 152 aa, Panicum virgatum
  misc_feature: Ceres CLONE 1986134
  misc_feature (1)..(104): Pfam Name: HSP20 Pfam Description: Hsp20/alpha crystallin family
MSLVRRTNVFNPFSMDLWDPFNSMFRSVVPSSSSSDSDTAAFANARIDWKETPEAHVFKADLPGVKKEEVKVEVEDGNVLVISGQRSKEKEDKNDRWHRVERSSGQFMRRFRLAEDAKVEQVKAGLENGVLTVTVPKAEGKKPEVKSIQISG

SEQ ID NO: 8017 - DNA, 1742 bp, Panicum virgatum
  misc_feature: Ceres CLONE 1986164
  misc_feature: Encodes the peptide sequence at SEQ ID NO. 8018
tcatataaaccttttcttcgctccctgccgactccttccgtcgtcctacttcgcagaccgatccaaatccccaactgaaatttgcgcccgggcccttcgccggagatggcgtcggagctgacgaaccggcgcggcgccgcggcgcacggctccgcctccaacggcggggagtactccccgaagccctccaagccgctctcctggctctcccgcgccgcccgctacgccgccgccgagcaccgccccgtcttcgccctcgccggcatgctcttcgccgccgccctcttcaccttctcctcctcctcctccacatccacctcgtcctaccccgccgcgtcggtcggattcggccacctcgccatcggcgggcacccgtccttccgcgagtcctccgtcggcggcaaggtgcccctgggcctgcggcggcgcgcgctgcgggtgctcgtgacgggcggcgccggcttcgtggggagccacctggtggaccggctggtggagcgcggcgacagcgtcatcgtcgtggacaacttcttcacggggcgcaaggggaacgtcgcgcaccacctccggaaccccaggttcgaggtgatccgccacgacgtcgtcgagcccatactactcgaggtcgaccagatctaccaccttgcctgcccggccagccccgtgcactacaagtacaacccaatcaagaccatcaagacaaatgtagttgggacactgaatatgcttggattggcaaagaggattggggcaaggtttctactcaccagcaccagtgaggtctatggcgatcccctccagcaccctcaggtggaaacttactggggcaatgtcaatcctattggtgtcaggagctgctatgatgagggtaagcgcactgctgaaacattaaccatggactatcatcgtggtgccaaccttgaggtaaggatcgcccggatctttaacacatatggtcctcgcatgtgcatcgatgatggccgcgttgtcagcaatttcgttgctcaggcgctgaggaaggagcctttgactgtctatggtgatggcaagcagactaggagctttcagtacgtctcggatttggtggaagggctgatgaagctaatggaaggggaccacattggaccattcaacctgggaaaccctggtgaattcacgatgctggagctggctaaggtggtccaggacaccattgacccagaagcacgcattgagttccgtccaaacactgcagatgatccacataagcgcaagcctgacatcagccgtgccaaagagcttcttggctgggagcccaaggttcccctacatgagggccttcccctcatggtcaccgacttccgcaaacgtatcttcggggaccaggaagaatccactgaggcagctggtggcctttcttaatcctcaccatgtcaaagtgacgcatttgttcagtctatgatcacatgacacgaaattggaagacgggagcaaacgatctggacagttttggtggtatatgccctttggctgctctgtacaacacggacaaaaggtcatggctgcatacgtagttcttagaagatgttggatactaccaaatatcttggtactgctgtaatgctgttcttttctttttttggttcttttgcctgtaataattctatatgtaacaacatacaatttgtaatggtgtcgttaacagataatatgagttgctaataatacattaaggttataagcaaaaaaaaaaaaaaaaaaaa

SEQ ID NO: 8018 - protein, 431 aa, Panicum virgatum
  misc_feature: Ceres CLONE 1986164
  misc_feature: Great-hit functional homolog of the protein sequence encoded by LOCUS At2g47650
  misc_feature: Great-hit functional homolog of the protein sequence encoded by LOCUS At3g62830
  misc_feature (1)..(234): Pfam Name: Epimerase Pfam Description: NAD dependent epimerase/dehydratase family
  misc_feature (111)..(416): SWISSPROT Homolog: EC 4.1.1.35 UDP-glucuronic acid decarboxylase 1
  misc_feature: Useful for making plants with altered cell wall content and/or composition
MASELTNRRGAAAHGSASNGGEYSPKPSKPLSWLSRAARYAAAEHRPVFALAGMLFAAALFTFSSSSSTSTSSYPAASVGFGHLAIGGHPSFRESSVGGKVPLGLRRRALRVLVTGGAGFVGSHLVDRLVERGDSVIVVDNFFTGRKGNVAHHLRNPRFEVIRHDVVEPILLEVDQIYHLACPASPVHYKYNPIKTIKTNVVGTLNMLGLAKRIGARFLLTSTSEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMKLMEGDHIGPFNLGNPGEFTMLELAKVVQDTIDPEARIEFRPNTADDPHKRKPDISRAKELLGWEPKVPLHEGLPLMVTDFRKRIFGDQEESTEAAGGLS

SEQ ID NO: 8019 - DNA, 1276 bp, Panicum virgatum
  misc_feature: Ceres CLONE 1986241
  misc_feature: Encodes the peptide sequence at SEQ ID NO. 8020
aaatgtccccgccccggcccccctgcttccgtccttaaacccctgcataaccctgaagcctctccaccgtccagcctcgtctcctcctcctgccggcctcgtcgtctcttgagttctcacaacgccgccacgccgggagagacacacgacgccggaggcggcacgggcgcgagcaggaagaagaggcgcgcagcgctcggtcgtttcccggtgagaggtagctcgtcgcgtcgcgccacctctgcgccgccacgccccgcgctcgctctccttccctccgggccgggtagcgctagccacagggattgccatcgatcctgctgtaaaagtcagcttttaccctaggagcaggaagtgctcactttcctactgaagtaggaaaacacggcaaggaagtaccagtagcgagccagagggtgaagaagatgatgatggctgaagtggccaatcacagcaagaggaaccacaccgacagctacttcagcgggaagcccatcgtcaccaccagctcggaggagtttggaagcatgacctccaagaagccgaggaacccgagcccaaggacgtctccagtgtcaccgaaggagaagaaggacaagatcggcgagagggtcgcagcgctccagcagctagtgtcaccgtttgggaagacggatacggcgtctgttctgcaggaggcgtcagggtacatcaagttcctgcaccagcagctcgaggtcctgagctccccctacatgcgtgctcctccggccgccggcgccgcgcctgaggatcccgagcactacagcctccggaaccgcgggctgtgcctggtgccggtggacctgacgctgcagctgacccagagcaacggggccgacctgtgggcgccggcgaacacgaccaggcgccggtgaggagcgagtccgcccgccccaccgggagcagagcagccgccccggtctctggtccgcccggtggaaaccaaggaagtcctgcgtctgcacctgcatgtgcagggtacagaatttccaagcgcctgaccccattcgatctcctaacaagaaactaaagcgagcgtcaatctccgcttgtattatactagtgacctgtctgtatgcctgcctgcctgtctgatctcccctgggcaccgtatatgtatgatcagatgtggctgggaaccgcgtctctatgtactagtatgtatctatgtgttcagtgacatgtcaattagcaggctggtgccgtcagcaactgaaacggcaagttttaaggccaaaaaaaaaaaaaaaaaaaa

SEQ ID NO: 8020 - protein, 156 aa, Panicum virgatum
  misc_feature: Ceres CLONE 1986241
  misc_feature: Great-hit functional homolog of the protein sequence given in SEQ ID NO 9299
  misc_feature: Great-hit functional homolog of the protein sequence given in SEQ ID NO 9548
  misc_feature (2)..(50): Pfam Name: HLH Pfam Description: Helix-loop-helix DNA-binding domain
  misc_feature: Useful for making plants with altered Lignin content
  misc_feature: Useful for making plants with modulated nitrogen use efficiency
  misc_feature: Useful for making plants with modulated heat sensitivity
MMMAEVANHSKRNHTDSYFSGKPIVTTSSEEFGSMTSKKPRNPSPRTSPVSPKEKKDKIGERVAALQQLVSPFGKTDTASVLQEASGYIKFLHQQLEVLSSPYMRAPPAAGAAPEDPEHYSLRNRGLCLVPVDLTLQLTQSNGADLWAPANTTRRR

SEQ ID NO: 8021 - DNA, 1363 bp, Panicum virgatum
  misc_feature: Ceres CLONE 1986244
  misc_feature: Encodes the peptide sequence at SEQ ID NO. 8022
gaaaaaaatccttctccttgctccatgttcggtggcgtggtcatggtggcgagggcagcccagctgagcgttagtcgtagctcgtgcctactaggtagataggaggctggtgttgcttggaaggaggaaggccaggccatggcgctcgaagccgtggtgttcccgaaggagcacctcgcgtgcgcggccaaggcgggatcggcgtcgctgggctgcggcttcgacattggcgacctcgaggagaagggcggcgtggttctgcaggtagaggccgccggcgcgctgccgctcggtgccggtgcggccaccgcatgggacgcggcgctctgcccgtgctccgtcgctcctggcgccgtggaggagtgctgggacgcgccgcgccacctctccgtgtcgccgccgccggtgcccgcggtagcggcgcagggaggacgcgggaaggcggccgcgtcgggggcggcgcggaggcggcgacggcggccgaaggcggtgaagaacacggaggagatggagagccagcgccgcaaccacattgccgtggagcgcaaccagcggcggcagatgaacgagtacctcgccgtgctccgctccgtcatgccgccctcctacgcgcagcggggcgaccaggcgtcgatcgtggccggcgccatcaacttcgtcaaggagctggagcagctgctgcagtcgctggaggcgcggaagcggcgcgcgggctgcaccgagccgccgccgccgccgtttgccggcttcttcacgttccctcagtactcgaccggcgccaccggtgctgccggcgctagcgatagttctggctctgcggccggcgatcagagcggcggcggcggctgcgcgggggcgcgccgcggcgtggccgagatcgaggtggccgtggctgagagccacgccaacgtgaaggtgctcgcgccgcggcggcccaggcagctgctgaggatggtggtggcgctgcagtgcctcgggctcaccgtgctccacctcaacgtgaccaccaccgccgaccacctggccttctactccttcagcctcaagatggaggatgaatgccggctatcgtcggtcgacgacatcgccgccgcggtgaacgagatcgtcgcgaaggtctccgacgaggtcatcagtcagttagctgcttagctgcaacagtactaagctagtgtcatgtattgtaacaacaatttgatcctagtacatggataactgaggcaacaagtggcaattcgcgccattgtcaggcatgtactaagtagtagggttccatgtttgcgtgcaagtaaacatgtatcgattggaccagcttaattataattttgcatctcagtactaataaaaaaaaaaaaaaaaaaaa

SEQ ID NO: 8022 - protein, 337 aa, Panicum virgatum
  misc_feature: Ceres CLONE 1986244
  misc_feature (1)..(52): Pfam Name: HLH Pfam Description: Helix-loop-helix DNA-binding domain
MALEAVVFPKEHLACAAKAGSASLGCGFDIGDLEEKGGVVLQVEAAGALPLGAGAATAWDAALCPCSVAPGAVEECWDAPRHLSVSPPPVPAVAAQGGRGKAAASGAARRRRRRPKAVKNTEEMESQRRNHIAVERNQRRQMNEYLAVLRSVMPPSYAQRGDQASIVAGAINFVKELEQLLQSLEARKRRAGCTEPPPPPFAGFFTFPQYSTGATGAAGASDSSGSAAGDQSGGGGCAGARRGVAEIEVAVAESHANVKVLAPRRPRQLLRMVVALQCLGLTVLHLNVTTTADHLAFYSFSLKMEDECRLSSVDDIAAAVNEIVAKVSDEVISQLAA

SEQ ID NO: 8023 - DNA, 1608 bp, Panicum virgatum
  misc_feature: Ceres CLONE 1986275
  misc_feature: Encodes the peptide sequence at SEQ ID NO. 8024
gtctcaatctcaactccaaaacctcgcaacaaagcccgtgagcgaccaacccccaccccatccatcctctccttcctcgcagatcccaccaaccccggcggcgatgaccggcacagtgtccaagctggcggcgccccggccggcggcgccccggccggcggcggcgctgctcccgccggcgtccctccgctccgccgccctcgccttcgccccctccccgcgccggttccgcgtctccatcgccagccgcgccaggagccccgtcattgcgatggcttctgccaaggaagggaatggtgctccgaccaagaagaccgcacttcacgatctctatgagctccagggcctgtcaccatggtacgacaacctctgcaggcctgtcaccgacttgctgccccttatcgccagtggtgttcgcggagtcaccagcaaccctacgattttccagaaagccatttcatcatcaagcgcatatgatgatcaattcaagcagctcattacagctggaaaggatgcagagagtgcttactgggaactcgttataaaggatatccaagatgcgtgcaaactttttgagcctatctacaacgagacagatggtgctgatgggtatgtctctgtggaggtgtctcctaggttggcaaatgacactcaaggaacagttgaggctgcaaagtggttgcacaaagtggtcaaccgccccaatgtctacataaagatccctgctactgcagaatgtgttccttctatccgggaagtcatctctaatggcattagcgtcaacgtcacacttattttctctattgtaagatatgaggctgtgattgatgcttaccttgatgggctggaggcatcgggtttgagtgacttatctcgagttaccagtgttgcgtccttctttgtcagccgagttgacacccttgttgacaaaatgctcgaaaagattggaacacctgaggcgcttgcccttagaggaaaggctgctgtagcacaggcaaaattagcaaatcagctctaccagaagaaattctctggcccaagatgggaagctttggctaagaaaggtgccaagaaacagaggttgttgtgggcatcaactggcgtcaagaaccctgcttatcctgacaccctttatgtggacagtctgattggacctgacacggtcaacacaatgcccgaccaagcgttgcatgcattcatagaccacggcactgtttcaaggacagttgatgcgaatgtgtcggaggcagaaggtgtatacagtgccctggagaagcttggcatcgactgggatgaggtggggaagcggcttgagctggaaggagtagactcgttcaagaagagctttgacagtctacttgtgagtcttcaggagaagggcaacagcctcaaggcggcaagtgtgtaaaactgaaatgatttggtaccggcaggtgaacgattactaaataaattgctagctcgctggctctcctcttagttttgtgactgtgcgggtgctcatgattctgtgaatcagctttgtattctcgtcttgcctggctgtcattgtgtaacgaggcttgtaactgctatgcgctatccaataaataatttttgagcaagttt

SEQ ID NO: 8024 - protein, 434 aa, Panicum virgatum
  misc_feature: Ceres CLONE 1986275
  misc_feature (1)..(340): Pfam Name: Transaldolase Pfam Description: Transaldolase
  misc_feature (13)..(322): Pfam Name: Transaldolase Pfam Description: Transaldolase
  misc_feature (1)..(340): Pfam Name: Transaldolase Pfam Description: Transaldolase
  misc_feature (1)..(340): Pfam Name: Transaldolase Pfam Description: Transaldolase
  misc_feature (1)..(340): Pfam Name: Transaldolase Pfam Description: Transaldolase
  misc_feature (1)..(340): Pfam Name: Transaldolase Pfam Description: Transaldolase
  misc_feature (1)..(335): Pfam Name: Transaldolase Pfam Description: Transaldolase
  misc_feature (80)..(423): SWISSPROT Homolog: EC 2.2.1.2 Transaldolase 2
  misc_feature (80)..(426): SWISSPROT Homolog: EC 2.2.1.2 Transaldolase 1
MTGTVSKLAAPRPAAPRPAAALLPPASLRSAALAFAPSPRRFRVSIASRARSPVIAMASAKEGNGAPTKKTALHDLYELQGLSPWYDNLCRPVTDLLPLIASGVRGVTSNPTIFQKAISSSSAYDDQFKQLITAGKDAESAYWELVIKDIQDACKLFEPIYNETDGADGYVSVEVSPRLANDTQGTVEAAKWLHKVVNRPNVYIKIPATAECVPSIREVISNGISVNVTLIFSIVRYEAVIDAYLDGLEASGLSDLSRVTSVASFFVSRVDTLVDKMLEKIGTPEALALRGKAAVAQAKLANQLYQKKFSGPRWEALAKKGAKKQRLLWASTGVKNPAYPDTLYVDSLIGPDTVNTMPDQALHAFIDHGTVSRTVDANVSEAEGVYSALEKLGIDWDEVGKRLELEGVDSFKKSFDSLLVSLQEKGNSLKAASV

SEQ ID NO: 8025 - DNA, 1352 bp, Panicum virgatum
  misc_feature: Ceres CLONE 1986282
  misc_feature: Encodes the peptide sequence at SEQ ID NO. 8026
actttgagattcgtgcgacagatattcaccctcccctgcgccgcctcctctgcctacccgccgccaccgcccctcccctgcgccgccgctccgcctccgcctgctcccctgtgccgcgcgccgccgcctgcccctgctcccctgcgccgccgcgccgcacgcctccgccctgctcccctgcgctgccgcctccgcctccgccctgctccatcgcgccgcacgcgcgctgccacccccgcgcgcgggctcgctggcggccgccggagccggaggaggagccaagacgagggtagagaaaaaagataggggcccccaagtcggccacactctccgacgcccgggcccgactcccactccctctacttcctcgtttcgaagtccgaaccctaggtggccgccggcggcaagcacggcggcggagcttgcggggtagcagagggcggcccagcggcgctccacggggacagcgtgtgcgcccgcagctacgcagggcagggttgccgcggtctccccagcggccggcggcggccgaacgccagcgccggaggggctccgccgccggcgggcattgcggcctacggcatcgactccatccctctcccctctgcgcattcgcccgttctcccttctcttctccgccataaccacaggcgcactgcgagttagcaactgagttactgaggcgcccctgaagccgaaactcctgcgggccccttcccacaggagcccctgaagcctgcgctctcccttgccggcttccacaacctccgttcagcagccctacaacaactgcctcccttttcatcgctgtcgaggtactgcaatgaaggttaagattcttcagtggcatgcggtagcttcttggacgtgggatgcacaagatgaaacatgtggcatatgcaggatggcatttgacggctgctgccctgactgtaagttccctggtgatgattgcccgctgatctggggcgcctgcaaccatgcttatcatcttcactgcatactgaagtgggtcaattctcaaacatctacacccctttgccccatgtgccgtagagagtggcagtttaagggctaaggcacaatgacacatctggagctgtattatcaccatgtggctttcgtttctcattggacattgctgtattgtttgctgaaaaagtagaaatcctgattgtcagcacctgcttaagtgacactgtgtatgctatgcttctgactttgtattgaagcaactgaaccacaactaggcacctgcttaagtgacagtgtaatagtatatgctccctgactttatcgtaaatttgtctgttcttattgtttgacttctggaaaaaaaaaaaaaaaaaaaa

SEQ ID NO: 8026 - protein, 84 aa, Panicum virgatum
  misc_feature: Ceres CLONE 1986282
  misc_feature: Great-hit functional homolog of the protein sequence given in SEQ ID NO 9597
  misc_feature (1)..(43): Pfam Name: zf-C3HC4 Pfam Description: Zinc finger, C3HC4 type (RING finger)
  misc_feature: Useful for making plants with altered alkaloid content
  misc_feature: Useful for making plants with altered terpenoid content
MKVKILQWHAVASWTWDAQDETCGICRMAFDGCCPDCKFPGDDCPLIWGACNHAYHLHCILKWVNSQTSTPLCPMCRREWQFKG

SEQ ID NO: 8027 - DNA, 1189 bp, Panicum virgatum
  misc_feature: Ceres CLONE 1986288
  misc_feature: Encodes the peptide sequence at SEQ ID NO. 8028
acctcggttcctcctctctttctctcgccgctattggttagttccataaatagtagccagttgctcactggtacggtggtctctcctaccagctgcggctgcttccccgacgacgcgcgccgcagatctacaccctcggcgccgggcggagcagggagggaggaagggagggagggaccatggctgggaagagggagcggatagcgatacggaggatcgacaacctggcggcgaggcaggtgaccttctccaagcgccgccgggggctgttcaagaaggccgaggagctctccatcctatgcgacgccgaggtcggactcgtcgtcttctccgccaccggcaagctcttccacttcgccagctccagcatgaatcggatcatcgatcggtatgactcccattccaagacgctgcagaagtcagaagcaccgtctcaactgcaatcccatgtggatgacagcacttgtgcaaggctaagggaggagctctccgaagcaagccttaagctcaggcagatgagaggagaggaactccagaggctgagcgtccaacagctgcaggagttagagaagaccctcgaatccggcctcggctctgtactcaaaaccaagagccaaaaaatcctcgacgagatcaacagtctggaaagaaagagaatgcaactgatcgaggagaattcaaggctaaaggagcaagtgacccggatggcaaggatggagacgcaactcggcgccgattcagaagttgtgtacgaggaaggacagtcatctgaatccgtgaccaacgcgtcgtatccgcgcccgccggccgacaccaacgatggtggctccgatacatcgctgaggctcgggttaccactgttcagctcgaagtgatggaaaccgaattgtcctggagcagagtgacgccgattacctgccctccccattgtaaatctgggagcagaattcctggcttgagaagcggccaacgcgtcgcttcaaaataagaggcattatcgagtgctggatgatgtgtgtattctgaaagtgacttgcttttgttatacggcttgttaataaacaacgggttccctcttgatgttacctgcagttcatgttctgttctctgttttgagaactcgtaattccctgcacttcatgttacctacaatccctactttcgctgatcaaaaaaaaaaaaaaaaaaa

SEQ ID NO: 8028 - protein, 231 aa, Panicum virgatum
  misc_feature: Ceres CLONE 1986288
  misc_feature: Great-hit functional homolog of the protein sequence given in SEQ ID NO 9403
  misc_feature: The sequence is a functional homolog of  SEQ ID NO 1454 in the  10/374,780 US patent application
  misc_feature: The sequence is a functional homolog of  SEQ ID NO 2064 in the  10/374,780 US patent application
  misc_feature: The sequence is a functional homolog of  SEQ ID NO 572 in the  10/412,699 US patent application
  misc_feature: The sequence is a functional homolog of  SEQ ID NO 816 in the  10/225,066 US patent application
  misc_feature: Useful for making plants with altered alkaloid content
  misc_feature: Useful for making plants with modulated growth and phenotype characteristics
MAGKRERIAIRRIDNLAARQVTFSKRRRGLFKKAEELSILCDAEVGLVVFSATGKLFHFASSSMNRIIDRYDSHSKTLQKSEAPSQLQSHVDDSTCARLREELSEASLKLRQMRGEELQRLSVQQLQELEKTLESGLGSVLKTKSQKILDEINSLERKRMQLIEENSRLKEQVTRMARMETQLGADSEVVYEEGQSSESVTNASYPRPPADTNDGGSDTSLRLGLPLFSSK

SEQ ID NO: 8029 - DNA, 1228 bp, Panicum virgatum
  misc_feature: Ceres CLONE 1986357
  misc_feature: Encodes the peptide sequence at SEQ ID NO. 8030
acgggcaccacgcaccagcaccacggcagcacgaacgacgcgtcctgctcatatgcatggtgcagcctagctccccgccgccggcgaccaccaccaccacatgttgcatgagcagcaggcaccggcagtagcagcagcagcgccgccgccagtgccttcggcgcccagcaacgacggcggcgatgccgcgggcggggacgagggcgccgcgacgttccgcgacatccaccctctgacccccgacgtgccgacgccccccgcgcgcacgacctccgccgcgtcctgggacaccgccagccaccgctcctactcctccgacgagcagtacatgacgatgagccgcgagttcacgaccatggtcgccgccggggcgaccatgcataccggccccaacgccaacggcagcgccggcgccggctacgacaacggcaccgaccagctcaccagcatcggcgaggacgagctggaggagaccaacccactggccatagtaccggacagccaccccatcgcgacgccggcaagatccagggcgtccgggctggaggtggtgcccgcggggccgccgcccccgcccccgccggcgcatgtggaggctagccaggtgaagaaggaggaggtggagacgaaggtcacagcgtggcagacggcggaggtggccaaaatcaacaaccgcttcaagcgggaggaagtagtcatcaacggatgggagaccgagcagatggagaaggcatccgcatggctcaagaagatcgagaggaagctggacgagcagcgcgccaaggcggtggagaagacgcagaacgacatcgccaaggcgcggcgcaaggcggaggagaagcgggcgtcggcggaggccaagcgggggctcaagctggccaaggttctggagctcgccaacttcatgaaggccgtcgggagggtgcccaccaagcgctccttcttctagctagccggcgacccgtgtctcctccatcaccgcctgttccagccggccctgtgcctgtgtgtcctgaacctgtttgttgctgctgctccatcacgcctagctagtagcacgtttgtgtgacgatgtatgcttctgcatccgagaaccctagttgtaaaaaagatttgtacgctgtatacgatgtactgtcgccgccctgcgatgcctgtgatccatcacggcacagagtggcctttttcttctctttttgttggcttgtaaaaaaaaaaaaaaaaaaaa

SEQ ID NO: 8030 - protein, 282 aa, Panicum virgatum
  misc_feature: Ceres CLONE 1986357
  misc_feature: The sequence is a functional homolog of  SEQ ID NO 126 in the  10/374,780 US patent application
  misc_feature: The sequence is a functional homolog of  SEQ ID NO 134 in the  11/375,241 US patent application
  misc_feature: The sequence is a functional homolog of  SEQ ID NO 394 in the  10/412,699 US patent application
  misc_feature: The sequence is a functional homolog of  SEQ ID NO 925 in the  11/479,226 US patent application
  misc_feature: Useful for making plants with modulated growth and phenotype characteristics
MLHEQQAPAVAAAAPPPVPSAPSNDGGDAAGGDEGAATFRDIHPLTPDVPTPPARTTSAASWDTASHRSYSSDEQYMTMSREFTTMVAAGATMHTGPNANGSAGAGYDNGTDQLTSIGEDELEETNPLAIVPDSHPIATPARSRASGLEVVPAGPPPPPPPAHVEASQVKKEEVETKVTAWQTAEVAKINNRFKREEVVINGWETEQMEKASAWLKKIERKLDEQRAKAVEKTQNDIAKARRKAEEKRASAEAKRGLKLAKVLELANFMKAVGRVPTKRSFF

SEQ ID NO: 8031 - DNA, 1270 bp, Panicum virgatum
  misc_feature: Ceres CLONE 1986363
  misc_feature: Encodes the peptide sequence at SEQ ID NO. 8032
gagcctccaacaaggcaaatcaacccacccacacacccgcttcgccgagatgtcgcgttcccctccgctgctcctgctcctctgcgccgtcggcgctgccgccgccgccgtgccagggtaccgcgaggcgccgcacttcaccaactcggcggcggcgcagtgcccgccgccgctcccgccgtcggacgcggacgcggcgtgctcgccgcgcgcggcggtgcacgtggccatgacgctggacgcgtcctacctgcggggcaccatggcggccgtgctctccgtgctgcgccacgcgtcctgcccggagtcaatcttcttccacttcgtcgcctccgcggcggcctcctcgggggcgacggcggcggagctgcgcgccacggtgcgcgcgtcgttcccgtcgctggcgttccgggtgtacccgttcgccgacgaggcccgcgtggcggggctcatctccacctccatccgcggcgcgctcgaccgcccgctcaactacgcgcggtcctacctggcctccacgctcccgccctgcgtgcgccgcgtcgtgtacctcgactccgacgtcgtgctcacccacgacatcgcggccctcgccgcgacgccgctcccgggggaggagacggccgtggcggcgcccgagtactgcggcgccaacttcaccgcctacttcacgccggggttctgggcgtcgcccgcgctctcctccgccttcgccggccgccgcgcctgctacttcaacacgggcgtcatggtgctcgacctcgcgcggtggcgccgcgcgggctacaccgcgcagatcgaggagtggatggagctccagaagcgcgtgcgcatctacgagctgggctcgctgccgccgttcctgctcgtcttcgccggccgcatcgcgtcggtggaccaccggtggaaccagcacggcctcggcggcgacaactaccgtgggctctgccgcgggctccacgccggcgccgtcagcctgctgcactggagcggcaaggggaagccctgggaccggctcgacgccgggcggccgtgcccgctcgacgccgtctgggccaagtacgacctgctccggtcggccgccggcatcgagagctcgtgaggattcggcgctcgatcgagcgcttgttttttgatcggtttagacattagaagcatgtgctcttcgttcttttgctgatctagatattgatagatcatcagagtgttcatgggaactgtacatagtgctgcttagtttaataacagagactgattagccattttgatc

SEQ ID NO: 8032 - protein, 350 aa, Panicum virgatum
  misc_feature: Ceres CLONE 1986363
  misc_feature: Great-hit functional homolog of the protein sequence encoded by LOCUS At1g19300
  misc_feature (1)..(268): Pfam Name: Glyco_transf_8 Pfam Description: Glycosyl transferase family 8
  misc_feature: Useful for making plants with altered cell wall content and/or composition
MSRSPPLLLLLCAVGAAAAAVPGYREAPHFTNSAAAQCPPPLPPSDADAACSPRAAVHVAMTLDASYLRGTMAAVLSVLRHASCPESIFFHFVASAAASSGATAAELRATVRASFPSLAFRVYPFADEARVAGLISTSIRGALDRPLNYARSYLASTLPPCVRRVVYLDSDVVLTHDIAALAATPLPGEETAVAAPEYCGANFTAYFTPGFWASPALSSAFAGRRACYFNTGVMVLDLARWRRAGYTAQIEEWMELQKRVRIYELGSLPPFLLVFAGRIASVDHRWNQHGLGGDNYRGLCRGLHAGAVSLLHWSGKGKPWDRLDAGRPCPLDAVWAKYDLLRSAAGIESS

SEQ ID NO: 8033 - DNA, 1486 bp, Panicum virgatum
  misc_feature: Ceres CLONE 1986368
  misc_feature: Encodes the peptide sequence at SEQ ID NO. 8034
catcctcgtcgtctcatcgatcgggaattttagctaatcgcgattaggccattcagctagctcctccgaccctcgtctcatcgatcgggaatcaacaatatctcaataatatagctacctagtactaggtgatgcttctggccagctcgtcgtcggcggtcgtgagcatgaacggcagcggcgagggcgacacgagctacgccaacaactccaacttccagcgtgtcatcgcctccgtcaccaggaaggccaggcgggacatggccgccgcgctgtaccgcgccctgggccgcccggcctccctggccatcgccgacctgggctgcggcaccgggcccaacgcgctgctcatggtgtccgacgccgtcgacgccgtgctggcggagaccaacaacaacaagggcgcctcggcggcgcccctgccgcagctgcacgtcttcctcaacgacctccccgccaacgacttcaacgccgtcttccgcctcctcccgtcgtcaccgctcgccgccgccggctgcctcgtgtcggcctggccgggctccttctaccgccgcctcttcccggaggccagcctcgactacgtcgtctcctcctccagcctccacttcctctcaaaggcgccgccgatggcgccggagcatctgaaccgggggcgcgtgcacgtctcggcggccggcccggcggcggtgctggacgcgtaccgggcgcagttccacgccgacttcctcgccttcctccgctgccgcgccgccgagacgcgggcccggggcctcctcctcctcaccttcgtcggcaggaggagcgcgcgccccaccgcacacgactgctacctctgggacctcctcgccgacgccctcatggacatggccgccgccgggctcgtcgacgaggagcgggtgcactccttcaacgcgccctactacgcgccctgccccgacgacctcgccagggtcgtcgccgaggagggctccttcgccatcaggaccatgcacctcttcgacaccacgcgccgccacctgctcgccggcggcggccgctctcacccgctgactagtaatagtaataaacacgacggcgacggcgacgacgagttgccgcggtggctcgccgcggagacggcggccaccatcaaggcggtcgtagagcctatgctgcggacccacttcggctgggccgccatggacgggctcttctgcaggtaccgcctcctgctcgaggcatactaccgcagcaaggccaccaggaacaaggatgacatcaccaacgtcttcctcgtcctggagaagaaacaacgctgctactagctagctcccccttcggccggcggtggattattcagccggtcgaggatctctggttggattgtttggaagcgcgacggcggatgctgcacatagcccttcccttttttatttttcattcgtgatgtgtggcgtcaaattaaagtttgaaacgctatatatattaaaaaaaaaaaaaaaaaaaa

SEQ ID NO: 8034 - protein, 390 aa, Panicum virgatum
  misc_feature: Ceres CLONE 1986368
  misc_feature (1)..(247): Pfam Name: Methyltransf_7 Pfam Description: SAM dependent carboxyl methyltransferase
MLLASSSSAVVSMNGSGEGDTSYANNSNFQRVIASVTRKARRDMAAALYRALGRPASLAIADLGCGTGPNALLMVSDAVDAVLAETNNNKGASAAPLPQLHVFLNDLPANDFNAVFRLLPSSPLAAAGCLVSAWPGSFYRRLFPEASLDYVVSSSSLHFLSKAPPMAPEHLNRGRVHVSAAGPAAVLDAYRAQFHADFLAFLRCRAAETRARGLLLLTFVGRRSARPTAHDCYLWDLLADALMDMAAAGLVDEERVHSFNAPYYAPCPDDLARVVAEEGSFAIRTMHLFDTTRRHLLAGGGRSHPLTSNSNKHDGDGDDELPRWLAAETAATIKAVVEPMLRTHFGWAAMDGLFCRYRLLLEAYYRSKATRNKDDITNVFLVLEKKQRCY

SEQ ID NO: 8035 - DNA, 1328 bp, Panicum virgatum
  misc_feature: Ceres CLONE 1986400
  misc_feature: Encodes the peptide sequence at SEQ ID NO. 8036
gagaggggaacatcggggcatggcgagcggggaagccaagggggagacggtgctggtcaccggcgccagcggcttcatcggctcgacgctcgtccgcggcctcctcgaccgcggctacaccgtccgcgccggcgtcctcaaccccgatgacagggcggagacggaccacctcctggcgctcgccgccggcgccggcgagggccgcctcagcatcttccgctgcgacctcctcgacggcgccgcgctcgccgacgccgcgcggggctgctcgggcgtcttccacctcgcctccccctgcaccgtcgaccccgtcaaggatcacctgaatcagctgatggtgccagccgtggaggggacgcggaacgtgctgcgcgccgccaaggcggccgggggcgtgcggcgggtggtggtgacctcgtcgatctcggccatcgtgcccagccccgggtggcccgccggcgaggtccgcgacgagcgctgctggaccgacatcgactactgcgagaagaacggggtgtggtaccctgcttccaagacactggcagagaaggcagcgtggaagtttgcagaggagaacggcctagatgtggttgtggttaacccggggacagttctggggccgatgattccaccaaccatcaacgctagcatggccatgtttcgtcgcctcctggaaggttgcatagaggagtacgcggatttcttcatgggaccagtccatgtggaagacgttgccttggctcatatccttgtgttcgagaacccgtcagcgtccgggaggcacatctgcgtggagtccatctgtcactggagcgacttcgcggccaaagtcgcggagatctatcccaattacaaagtgcccaagttgcccaaggatacgcagcctgggctggtgagagcggaggtggggtcgaagaagctcatcgcgctagggctgcaggtcagccccatggagaagatcattagggatgccgtggagagcctcaagagcagagggttcatctcctaatgggtgatggctggttgtaatgtgataagtaaaaaaaaaaaggtactgtgatgtcttcctgggccttgctagtactacaaaacagtaataagggtggcaacataagacaccgttggaatcgtgcaatctagcgcggggctgggcaaaaaatgctgaaacgtttgcaagatgtccattctcaagcatgtagtttcaagcaccaaatgatgcgcatagcttgttctgactgttctaatggttgacgtgacagtatggggccatgccattttgctcgttcttatctaaacgaaaaggttcggaaaaaaaaaaaaaaaaaaaa

SEQ ID NO: 8036 - protein, 329 aa, Panicum virgatum
  misc_feature: Ceres CLONE 1986400
  misc_feature: Great-hit functional homolog of the protein sequence encoded by LOCUS At5g58490
  misc_feature (1)..(253): Pfam Name: Epimerase Pfam Description: NAD dependent epimerase/dehydratase family
  misc_feature: Useful for making plants with altered cell wall content and/or composition
MASGEAKGETVLVTGASGFIGSTLVRGLLDRGYTVRAGVLNPDDRAETDHLLALAAGAGEGRLSIFRCDLLDGAALADAARGCSGVFHLASPCTVDPVKDHLNQLMVPAVEGTRNVLRAAKAAGGVRRVVVTSSISAIVPSPGWPAGEVRDERCWTDIDYCEKNGVWYPASKTLAEKAAWKFAEENGLDVVVVNPGTVLGPMIPPTINASMAMFRRLLEGCIEEYADFFMGPVHVEDVALAHILVFENPSASGRHICVESICHWSDFAAKVAEIYPNYKVPKLPKDTQPGLVRAEVGSKKLIALGLQVSPMEKIIRDAVESLKSRGFIS

SEQ ID NO: 8037 - DNA, 1800 bp, Panicum virgatum
  misc_feature: Ceres CLONE 1986418
  misc_feature: Encodes the peptide sequence at SEQ ID NO. 8038
aacggaagccacagccaggccgcccccaactccacaaacccccgaagcccagacacggcgcgcatggcggcggcgccggcgctccgctgctgcttccccggctccgctgtcggtggcggcttcatcaggccctcctcctccaggcgaggccgacacgcagcggccgtggtggctccgcctcccgcttcgctggggcaccgtacccgcgttgacttccctatcctccaccaggaatttgatggtgccaaattagtttacttcgacaatggtgcaacctcacagaaaccttatagtgtaatgaaaacattagatgagtactacagatcgtacaactcgaatgttcatcgtggtattcatgcactcagtgcgaaagctactgatgcgtatgagggtgcaagaagaaaagttgcaaattttgtcaatgcagccgatagcagagagattgttttcacacgtaatgctacagaagctatcaatttggtagcctattcatggggtctatctaacataaaacaaggagatgagattcttcttactgttgcggagcatcatagtgctattgttccatggcaatttgtttcccagaagactggtgccactttaaagtatgttgggctgactaaagaagaggttccagacattgaacagttaaaagggcttctgtcaaacaaaacaaagatagttgttgtacatcatgtctcaaatgtacttggttcaatgcttcctattgaggagattgtaacatggtcaaaaggagttggagctaaggttcttgtagatgcttgtcaaagtgttcctcatatgccagttgatgttcagaaacttggtgccgactttcttgtagcatcctcacataagatgtgtggccctacaggcgttggatttatgcatggtacatttgagatgttgtcatctatggagcctttcttaggtggtggtgaaatgattgcagatgtgttcaatgacaaatctacatatgctgagcctccctctagatttgaggctggaactcctgcaattggagaagctataggattgggagcagcaattgactatctatcatgcattggcatggatcagatccatgaatatgagaaagagttggcaacctatctctatgaaagccttatttcagttccaaatgtcctggtatatggtccagcaccttcccaaacagatcaccgtgctcctttatgctctttcaatgttgagaatgttcatccaacagatattgcagaaattcttgatctccagcatggcgtagcaattcgatcagggcatcattgtgcacagattttgcataggacccttggtatcaatgcaagtgctcgtgcaagtcttcacttttacaatacaaaagaggaggtggatgttttcatcaatgcacttaaagatactattcacttccttacatctcaacactagtgcagttgaatttgtgccaaaagcagaaggttatgtgcagtatgcagtaacaggatctggtcgagttgaagctctttcggaaaatgtttaacaaaactgcttctcaatgacaaacgtgagtaatttttaggatattaaatgctggaaatgcaggagagggtagaagccatttttttctgttcttctagtctagttacaaaacagttttggctttgcaagtgcttcttggaaaaccttcttagttttcatcgttcggtagggcttcagtataaaccactgagaagctactgaaaaatgccctaagctagaggttccatctaaggaatgaaattgttcctcagatttccatatttaaaacgtacaccagatttgttc

SEQ ID NO: 8038 - protein, 453 aa, Panicum virgatum
  misc_feature: Ceres CLONE 1986418
  misc_feature (1)..(375): Pfam Name: Aminotran_5 Pfam Description: Aminotransferase class-V
  misc_feature (233)..(412): Pfam Name: Aminotran_5 Pfam Description: Aminotransferase class-V
  misc_feature (1)..(375): Pfam Name: Aminotran_5 Pfam Description: Aminotransferase class-V
  misc_feature (42)..(451): SWISSPROT Homolog: EC 2.8.1.7 Cysteine desulfurase 2, chloroplast precursor
MAAAPALRCCFPGSAVGGGFIRPSSSRRGRHAAAVVAPPPASLGHRTRVDFPILHQEFDGAKLVYFDNGATSQKPYSVMKTLDEYYRSYNSNVHRGIHALSAKATDAYEGARRKVANFVNAADSREIVFTRNATEAINLVAYSWGLSNIKQGDEILLTVAEHHSAIVPWQFVSQKTGATLKYVGLTKEEVPDIEQLKGLLSNKTKIVVVHHVSNVLGSMLPIEEIVTWSKGVGAKVLVDACQSVPHMPVDVQKLGADFLVASSHKMCGPTGVGFMHGTFEMLSSMEPFLGGGEMIADVFNDKSTYAEPPSRFEAGTPAIGEAIGLGAAIDYLSCIGMDQIHEYEKELATYLYESLISVPNVLVYGPAPSQTDHRAPLCSFNVENVHPTDIAEILDLQHGVAIRSGHHCAQILHRTLGINASARASLHFYNTKEEVDVFINALKDTIHFLTSQH

SEQ ID NO: 8039 - DNA, 1752 bp, Panicum virgatum
  misc_feature: Ceres CLONE 1986485
  misc_feature: Encodes the peptide sequence at SEQ ID NO. 8040
actcttggcggttgtgatgttcaaactcgccggtctctgtcttctgatcctaggggcttctgccgccaccgtcgaggaggaggagaatgtcatcgttcttaccaaggacaactttgacgaggtgatcaatggacacgagttcgtcttggccgaattctacgctccctggtgcggacactgcaaggctcttgccccagaattcgccaaggccgccacacagctcaatgaagagggatctgccatcaagctcgccaagttggacgccaccgttcacggagacgtcgccagcaaattcgagatccgcggataccccaccttgaaacttttccgtaacggaaaggccaccgagtacaatggaggacgtgactctgccgccatcatcggatggctgaagaagaagaccggacccgttgccaaggagctcaagaccgccgatgatgtcaaggaccttcaggagtccgccgatgtcgtcgttgtcggatacttcaaggaccagacttccgccgacgctaaggccttcctcgaggtcgccgccggaatcgatgacgttcccttcggaatctcctctgaggatgccgccaagaagcagctcgagctcaagaaggaaggaatcgtcctcctcaagaagttcgatgacggacgtgttgagttcgacgagaagttcgccgccgatgccatcaagacctggatccaggctaaccgcctggccctcgtctccgaattcacccaggaaaccgcttctgtcatcttcggaggagagatcaagagccacaatcttctcttcgtctccaaggagtcctccgaattcgagaagctcgagtctgagttcaagaacgccgccaaggaattcaaaggaaagatgctcttcgtctacatcaataccgacatcgaggacaacgcccgtatcatggagttcttcggactgagaaaggacgacctccccgccatccgcctcatctccctcgaggaagacatgaccaagttcaagcccgacttcgacgagatcaacaccgagaacatcgtcaagttcaccaggacctacctcgacggaaacctcaagccccacctcatgtccgaggaaatccccgaggactgggacaagagccccgtcaagacccttgtcggaaagaacttcgaacaggttgcccgcgacaacaccaagaacgtcctcgttgagttctacgccccctggtgcggacactgcaaacagctcgcccccacctgggacaagctcggagagaagtatgccgaccacgagaacatcgtcatcgccaagatggactccactgccaacgaggttgaggatgtcaaggtccaatccttccccaccatcaaattcttccctgctggatccaacaaagtcatcgactacaccggagaccgaaccatcgaaggattctccaaatttttggaaagcaacggaaaggacggagccggaccatctgaggatgacgaggcctccgaggaaggagagaaacccaaggatgagctctaagctactgggtcaactacacgggcttcttctattgttccccattctatcaactcctcgttgttaatttttcctgttttgccttctcttcttattcttgtcatttcttgtgatccgcccttcatgatgaatggtttaataagtatttattcgcaaatcatctcatggcgtcgtgtcaattgcactgggttctgtttttttccttaagagaatatttcgtacaataaatattctatatttaaaaaaaaaaaaaaaaaaaa

SEQ ID NO: 8040 - protein, 492 aa, Panicum virgatum
  misc_feature: Ceres CLONE 1986485
  misc_feature (1)..(487): SWISSPROT Homolog: EC 5.3.4.1 Protein disulfide-isomerase 2 precursor
  misc_feature (1)..(491): SWISSPROT Homolog: EC 5.3.4.1 Protein disulfide-isomerase precursor
MFKLAGLCLLILGASAATVEEEENVIVLTKDNFDEVINGHEFVLAEFYAPWCGHCKALAPEFAKAATQLNEEGSAIKLAKLDATVHGDVASKFEIRGYPTLKLFRNGKATEYNGGRDSAAIIGWLKKKTGPVAKELKTADDVKDLQESADVVVVGYFKDQTSADAKAFLEVAAGIDDVPFGISSEDAAKKQLELKKEGIVLLKKFDDGRVEFDEKFAADAIKTWIQANRLALVSEFTQETASVIFGGEIKSHNLLFVSKESSEFEKLESEFKNAAKEFKGKMLFVYINTDIEDNARIMEFFGLRKDDLPAIRLISLEEDMTKFKPDFDEINTENIVKFTRTYLDGNLKPHLMSEEIPEDWDKSPVKTLVGKNFEQVARDNTKNVLVEFYAPWCGHCKQLAPTWDKLGEKYADHENIVIAKMDSTANEVEDVKVQSFPTIKFFPAGSNKVIDYTGDRTIEGFSKFLESNGKDGAGPSEDDEASEEGEKPKDEL

SEQ ID NO: 8041 - DNA, 973 bp, Panicum virgatum
  misc_feature: Ceres CLONE 1986685
  misc_feature: Encodes the peptide sequence at SEQ ID NO. 8042
aaaaaaacttcgatctttgctttctagtccatcacgtcctcgcgctcccctcgctgctagaccccagtccaatcagacgccatggcttccgctcttgccgtgaagatggggtccgccgctgcactcactgcagcgagcgctagcagcaccaagcagagctcccctgccgctgctgtgccctttgtgggtctcaaggctggctctgccttcccctctgccaagaaggcggccagctttgctgacaagaccgtgtcgaacagcggacgcgtgcaggccatgaaggtgtggacacccatcaacaacaagaagtttgagaccctttcttacctcccccccctctccgctgatgctatcgccaaggaaatcaactacatgattgccaagggctggaccccttgcattgagttcgacgaggtaggctacgtgtccagggacaacttccagggctgcggctactatgacggccggtattggaccatgtggaagctccccatgttcggttgctctgaccccagccaagtcctgaaggaggttgctgaggccaagagcgcgtaccccagggcttacatccgtgtgttgggcttcgatgccaagaggcaggtgcaatgctctggattcctcgtccagaggccaggccaggctttcttctaagcgcatgtgtttgatacggagggctagctaaattgcattccgaaataggtcgactgaaacagaagggatcatagatgtattggtaaattctgcggcacagagcaggcaggtgatgatattcagggtcaagagagagtggtttctcctcttgcttctgaatactccttggatataactatcttggcttctcatattgagggcacaagagaactgtggatgttaaagtggtaatgcagagcgactttgagcggtaagaaacattttgacggtggaaaacattcaacagaaataaggttccgacggaaaaaaaaaaaaaaaaaaa

SEQ ID NO: 8042 - protein, 189 aa, Panicum virgatum
  misc_feature: Ceres CLONE 1986685
  misc_feature (1)..(109): Pfam Name: RuBisCO_small Pfam Description: Ribulose bisphosphate carboxylase, small chain
  misc_feature (1)..(184): SWISSPROT Homolog: EC 4.1.1.39 Ribulose bisphosphate carboxylase small chain 6, chloroplast precursor
  misc_feature (9)..(184): SWISSPROT Homolog: EC 4.1.1.39 Ribulose bisphosphate carboxylase small chain 3, chloroplast precursor
MASALAVKMGSAAALTAASASSTKQSSPAAAVPFVGLKAGSAFPSAKKAASFADKTVSNSGRVQAMKVWTPINNKKFETLSYLPPLSADAIAKEINYMIAKGWTPCIEFDEVGYVSRDNFQGCGYYDGRYWTMWKLPMFGCSDPSQVLKEVAEAKSAYPRAYIRVLGFDAKRQVQCSGFLVQRPGQAFF

SEQ ID NO: 8043 - DNA, 1588 bp, Panicum virgatum
  misc_feature: Ceres CLONE 1986693
  misc_feature: Encodes the peptide sequence at SEQ ID NO. 8044
aaaggagcaaaccatccacgtctcagcagctgctgcactgccttggaaccaaggatcagccatggccgctgctacgaagcttctgcttctcctcgtctgcagctaccattctctgctcgctcacgcaagacacggccccagctacaaggttcttgccactggctctcttagccctgatgccgtctgcacggagctgaaagcgtttcctccgtcgtccggcgccggcgccaccgttccattgcaccaccggcacggtccatgttcgccgctgccctccaaggagatgccatccctggaggagatgctccgccgtgatcgtctgcgagccggctacatccagcggatgttctcgggcgccacgaacggcacccgcgacagagcacagcaatcggaggccaccgtgcgcgtccctacctcccttggttcctccctgtccctggacacgttagagtacgtgatcaccgtcgcctttgggtcgccggcggcaactcagaccatgctcatcgacaccggcagcgacgtgtcgtgggtgcagtgcaagccgtgcccggagtgccactcccaggtggacgcgctgtttgatcccagctcatcgtccacatactcctcgttctcctgcgactccgccgcctgcgcgcagctcggcgaagagggcaacggctgctcgagctcccagcagtgtcartacattgtccactacggcgaccgctcgagcgcgaccgggacgtacagctccgacatgctgacgctgggatcctacaccatcagcagcttccagtttgggtgcagccacgccaagtccggccacgacgacaaaaccgacgggctcatgggactcggcggcggcccgcagtcgctcgtgtcgcagacggctgggacctttggcacggcgttctcgtactgcctcccgccgacgccggcgtccaccgggttcctcacgctcggcgcgtcgagcggtggcggcgcggacttcgtgacgacgcccatgatcaggaacgaccggatcccggcgtactaccaagtggcccttgaggccatcgtggtggacgggacgcagctcgacgtgccgcgctcggtcttctccggcgggtcgctgatggactccggcacggtcgtcacgtggttgccgccgacggcgtactcggcgctgtcgtccgcgttcagggcccggatggcgcagtacccacaggcaccgggccggggcgccttggacacgtgcttcgacttcagcggcggcggcgtgccgtcggtgccgcctgtctcgctggtattcgctggtggcgcggtcgtcaaactcgacgtcggtgggatcatgttggacaactgcctggcgttcacggccaacgaggacgacaactccctaagcatcattggcaatgtccagcagcggacgttcgaggttctgtacgacgtcggccagagcaccgtggggttccgagctggggcctgctgatcggtgcgcgcaatatggacagcattattgtcactaaattaatatatattccgtcgtcgtcattttaggaataagggtttggcaacagtaatagctgtaatggtttcatattccgatattttactgatgtgatat

SEQ ID NO: 8044 - protein, 463 aa, Panicum virgatum
  misc_feature: Ceres CLONE 1986693
  misc_feature (1)..(346): Pfam Name: Asp Pfam Description: Eukaryotic aspartyl protease
MAAATKLLLLLVCSYHSLLAHARHGPSYKVLATGSLSPDAVCTELKAFPPSSGAGATVPLHHRHGPCSPLPSKEMPSLEEMLRRDRLRAGYIQRMFSGATNGTRDRAQQSEATVRVPTSLGSSLSLDTLEYVITVAFGSPAATQTMLIDTGSDVSWVQCKPCPECHSQVDALFDPSSSSTYSSFSCDSAACAQLGEEGNGCSSSQQCQYIVHYGDRSSATGTYSSDMLTLGSYTISSFQFGCSHAKSGHDDKTDGLMGLGGGPQSLVSQTAGTFGTAFSYCLPPTPASTGFLTLGASSGGGADFVTTPMIRNDRIPAYYQVALEAIVVDGTQLDVPRSVFSGGSLMDSGTVVTWLPPTAYSALSSAFRARMAQYPQAPGRGALDTCFDFSGGGVPSVPPVSLVFAGGAVVKLDVGGIMLDNCLAFTANEDDNSLSIIGNVQQRTFEVLYDVGQSTVGFRAGAC

SEQ ID NO: 8045 - DNA, 1252 bp, Panicum virgatum
  misc_feature: Ceres CLONE 1986758
  misc_feature: Encodes the peptide sequence at SEQ ID NO. 8046
ctcttccttcccgcacctcccgccgcttcggctcctctcctcggcgggaacctgcgagctccgattcgagtacttcccggcgccgcaggaggccgcgcgcgagctgatcgcgctgagtcgaggagaggagaggagaggagagtcgcgcggagctgctacccaccgcccccgccgcggggggcagagagagaggaggaggagccgtgtctatcccgccccgcgccggaccgatggactcggagcactggatctcgcgcctggccgccgcgaagcgcttctacgcggcgcagctcggccacagcgatcgggcggggatggaggagctggacatggacgatgaggtgaggcccgagttcgcgtgcccctactgctacgaggaccacgacgtcgcctccctctgcgcgcacctcgaggaggagcacccgttcgagccccacgccgcggcttgtcctgtttgctctgagatggttacaagggatatggttaaccatattactatgcaacatggatacttgttcaagaatcatcgccggctgcgcggatttgttattccaagcagccaagccctttctttgctgagccgagatctacgggaagcccatttgcaggtgcttctaggaggtgggcataggtcaagcaacaataacaccacgacaaatatctcagctgaccctcttctatcatcgttcggccttagcttcccaacatcagatgcagagcaaacatcaaagtcaactatttctgctcctgatgatgctaccatgataaaagagactcctcaggcacggaagttaagtatcgattcatccctcacaagtgaagaaagggagcagaaacggaagcaagccagcgtcagagcaacttttgtgcaggatctgctgctctctagtctatttggggactaatatcaggacgagctaaagttatggctggaagggtgctttcctggcgcagagctgcatatactagcgtgctccacccaagttgctgaacgtaatatcaacacaacaggagcgcttcccgggtgctatccttcatctcttccagtaaggtgcagagtcgatgtgggcatgatgtatcttctaagttatgtagctgtctctatctccggttccatcacaatccgtgatcggcatgtggtatgcatgtaagttgcggctgtacttgtaccgcgtctgtgtctgaactatgaagcattggttggttgtgccatcataataattatgctatgtaaaaaaaaaaaaaaaaaaaa

SEQ ID NO: 8046 - protein, 224 aa, Panicum virgatum
  misc_feature: Ceres CLONE 1986758
  misc_feature (1)..(215): Pfam Name: Di19 Pfam Description: Drought induced 19 protein (Di19)
MDSEHWISRLAAAKRFYAAQLGHSDRAGMEELDMDDEVRPEFACPYCYEDHDVASLCAHLEEEHPFEPHAAACPVCSEMVTRDMVNHITMQHGYLFKNHRRLRGFVIPSSQALSLLSRDLREAHLQVLLGGGHRSSNNNTTTNISADPLLSSFGLSFPTSDAEQTSKSTISAPDDATMIKETPQARKLSIDSSLTSEEREQKRKQASVRATFVQDLLLSSLFGD

SEQ ID NO: 8047 - DNA, 1163 bp, Panicum virgatum
  misc_feature: Ceres CLONE 1986772
  misc_feature: Encodes the peptide sequence at SEQ ID NO. 8048
gcacgcctcccaaagcgacagcgaggcgcgcggcgcgcggcgcgaggtctctctccaacgagtcagaagcgcccaggaaggcggcggcggctggcgagagaggcaaggaggaggaggaggacgaggacgagcagcagaggagaagaggcatggcccggcggccggcgtcgtgggagcagggcggcgacgagtacgactacctcttcaaggtggtgctcatcggcgactccggcgtggggaagtccaacctgctctcccgcttcaccaagaacagcttcgccctcgactccaagtccaccatcggcgtcgagttcgccacccgtacccttcaggtggagaataagactataaaagctcaaatatgggacactgctgggcaggagagatatcgagcaattacaagtgcttactatcgtggagctgtaggggcattgttagtctatgatgtcactaaagtaatgacatttgagaatgtgaagcggtggctgaaggagctccgggaccatgctgactcaaacatcgttgtcatgctcattggcaacaagatcgaccttaggcacctccgttctgttgcagttgaggatgctgcaagctttgcagagagcgaagggttgtttttcatagagacctctgcgcttgatgctacaaatgtggagaaagcttttcaaactgtgctagctgagatctacagagtaatcagcaagaagcccctatcatctgagcagtctgtatcagggtctggtaatatcaaagagggacaatccattcaagtgtcagccacaaattctagcaaccttacgtcacggtgctgctcttcttagatgtgctcatcaggatcttctaaacaacaattaaggtcctgttttgattcttacacttgttgaaatatattactctttgctagaacagtaactgtagatgttaagaacggcagacttgggacactaactactggacctatatagtcatgttacataaaaagctgctgtgggaggaaggtgtatcgctctgtggctgtctggctgagcagaaaactctatcactgcagcaaagctccttgctcttacccagtagcagggtagtatttatatgatttgcagttgtaacttttattgcgttaaataaaaatcaacttcacagcagaaaaaaaaaaaaaaaaaaaa

SEQ ID NO: 8048 - protein, 223 aa, Panicum virgatum
  misc_feature: Ceres CLONE 1986772
  misc_feature: Great-hit functional homolog of the protein sequence given in SEQ ID NO 9470
  misc_feature: Useful for making plants with altered Lignin content
MARRPASWEQGGDEYDYLFKVVLIGDSGVGKSNLLSRFTKNSFALDSKSTIGVEFATRTLQVENKTIKAQIWDTAGQERYRAITSAYYRGAVGALLVYDVTKVMTFENVKRWLKELRDHADSNIVVMLIGNKIDLRHLRSVAVEDAASFAESEGLFFIETSALDATNVEKAFQTVLAEIYRVISKKPLSSEQSVSGSGNIKEGQSIQVSATNSSNLTSRCCSS

SEQ ID NO: 8049 - DNA, 1480 bp, Panicum virgatum
  misc_feature: Ceres CLONE 1986890
  misc_feature: Encodes the peptide sequence at SEQ ID NO. 8050
aaaaaaacccgtcagctactcggtttccccatcctcgtcctcgtcgcctccccgctagcgctagctttgcccccacccctcgaaaccctacccgcaccatgcgcgatcgatcggtcgatcgcgaattccccagccgcgagcgcggggatcggccgccacccgggatgctgggccctccgcgccgcgggccggcgtacaagacgaagatgtgcgcgctgtggcagcgcggcggctgctcccgcgacacctgcagcttcgcgcacgggcgcgccgagctccgccggttccccggctcccgcacctcgttcccgccccgcgccgggaggggagattatagaggcggtgacttcagagaaaggtttgataggaggcgttcgcctcataggaggcattcccttgatagagattccaggggtcatcgtcctcttcatgatcgaagaccaacttctcaagaaagggaatctagctattcacgatcccccagcaggaagagcgataggaggcatgataagaaccctgatgatggagaaaccaactcatccaggagcttgagtgtctctgacaaaaatgatgatagaaaaaaggagaaaatcttaagtggtgatgataaagaggatcaagaaatacagctgaaacaaataagacaggatacggaacttctgcgtgaggataaatctcacttggagaacattttggatgagaagaacgctgaagtacgcaagatttctagcagggtaaatgatcttgatctgcagataaggaaggagaaagaggaatgccacaggatgacctcaaaaataaagaagttcattaaagctcatgctcgctttttgaaagcacaggaagaattgaaaaggtcacaagctcgttttgagagacttggtgatttgcttgcttcggatattctgaagcgtggtgctaacgaagaagtttccagtgtcaatgttgatgaagatccaaatgggccttatgaaaggagcccaaatgctgctacagctaagaagagatcaatcccttactcaacaagtgaagaagcaaaagccgtaaagaaaaggagagatcgtgattcagaatttgataaatcaagcaagggaactgagccaacaaaagctttatatttgaagaagaaattgtgggaagatgaaaaggataaaataggcaatgttgtttcctcggccaacactgacaagtatgagggtgatgatgaggaagtcgacgtggagtaagtggatgtcgagatggtagagatgatactggaataatctgtttgctcttgcccatgtaaagtcaaatgtatttggtattgggagtttaccttctataaaaacttctttggtggcaacctatagaggatgcagtttaagctgtctgttatgtgcagctcaacatttttcatgattgtgacaccccaaatatcctgttacctgtacctaatatatcccgcggacgctaatcttctcaaaaaaaaaaaaaaaaaaaa

SEQ ID NO: 8050 - protein, 375 aa, Panicum virgatum
  misc_feature: Ceres CLONE 1986890
  misc_feature (1)..(24): Pfam Name: zf-CCCH Pfam Description: Zinc finger C-x8-C-x5-C-x3-H type (and similar)
MRDRSVDREFPSRERGDRPPPGMLGPPRRGPAYKTKMCALWQRGGCSRDTCSFAHGRAELRRFPGSRTSFPPRAGRGDYRGGDFRERFDRRRSPHRRHSLDRDSRGHRPLHDRRPTSQERESSYSRSPSRKSDRRHDKNPDDGETNSSRSLSVSDKNDDRKKEKILSGDDKEDQEIQLKQIRQDTELLREDKSHLENILDEKNAEVRKISSRVNDLDLQIRKEKEECHRMTSKIKKFIKAHARFLKAQEELKRSQARFERLGDLLASDILKRGANEEVSSVNVDEDPNGPYERSPNAATAKKRSIPYSTSEEAKAVKKRRDRDSEFDKSSKGTEPTKALYLKKKLWEDEKDKIGNVVSSANTDKYEGDDEEVDVE

SEQ ID NO: 8051 - DNA, 1789 bp, Panicum virgatum
  misc_feature: Ceres CLONE 1986916
  misc_feature: Encodes the peptide sequence at SEQ ID NO. 8052
gctgctcatcattccgggcgcctcctcgcctccgccacgcgccgcgccatttcatcgagcacctcgccggcgccgccggggatcgccgccgggacgccatgggcggctccagagcccttcagttagacatttcagcagattctgaggcctctcctaggagaaatgtgccagggagtgtaagtagccctcttgtcaatggtgaaaagggtgtatttcggaatcagaatgcaggcttcaccacacttgcaagtcctgtgaggagagaaatcggaaacagatctatgacaagatcattctgtgttgatgacaatgacttggaagatggtaaggcctcaaaagaaagagatagttctttacagttacacaagctcccgaagatacagaatcaggctcttctatctggtctagcttactgcatatcatcatgcagtatgattttaattaacaaatttgttctgtctggctatggtttcaatgctccaatatttttgatgctataccagaacattgtatcagtgaccatagttttcacactatccctctccggtgctattccaactgaaccactgacatggaacctaatcaaaatttggtttcctgtgaatatcatatttgttgcgatgctgatcacaagcatgtttagtttgaagtatatcaacgttgcaatgctgactatattgaagaatgttgccaatgtcctgactgcttctggagaaacttattttttcaagaagcagcatggtgttcaagtttggattgctcttatgttgatgataatttctgcagttgcgggaggaataacagatctgtcattccatgctgttggatatacttggcagaccttaaactgttttctgacggcatcatattcgcttacattgcgacacgtcatggacagcgcgaagcaagccaccaagtctgggaatttgaacgagctctcaatggtgttactgaataacattctttcgctgccattgggaattattcttgttctttgttttaatgaagtggattaccttttggagacatctctcctaaggatgcctgaattttggctggtcatcactgtcagtggagttttggggcttggaatcagctttacctcaatgtggtttcttcatcagacaagcgcgactacatacagccttataggctccctaaataagatccctctctctgttgctggcattgttcttttcaatgttcgaacaagcatgcagaattcattgagtattctgttcggtatgtgatattcacgacagtgctaaaggttttgttggcgttttatgtaccttgtatcactaataagtatgctaaactcttaaccatacaggtctattggcaggagtatttttcgcaagggccaaattgcgagataactcaccaacctagattttgggcaggctttatagtgtgtagatggcacgacttggacaattctcaacacagaatgctctgtcaaactctctctcgctccctgggaaatttgtgcagatgcaatggttgtttcccacctgactaggcaaaggggcaacattctaactaggcggttgtcctggggctctccggttccttttttccaagctgacctggacccccagctgcttctttttgtggtggtatacgtcttcattgttgtgtgtaacggtgtaagatacaaaaacggatgaaaccgaaatcccaagcagtttgggatagaaggctcatccagtcggcgtgttgtaaaattacggtagttggatcaaaggggcatgtacattctcgagggcaaaaaaaaaaaaaaaaaaaa

SEQ ID NO: 8052 - protein, 383 aa, Panicum virgatum
  misc_feature: Ceres CLONE 1986916
  misc_feature (1)..(141): Pfam Name: TPT Pfam Description: Triose-phosphate Transporter family
MGGSRALQLDISADSEASPRRNVPGSVSSPLVNGEKGVFRNQNAGFTTLASPVRREIGNRSMTRSFCVDDNDLEDGKASKERDSSLQLHKLPKIQNQALLSGLAYCISSCSMILINKFVLSGYGFNAPIFLMLYQNIVSVTIVFTLSLSGAIPTEPLTWNLIKIWFPVNIIFVAMLITSMFSLKYINVAMLTILKNVANVLTASGETYFFKKQHGVQVWIALMLMIISAVAGGITDLSFHAVGYTWQTLNCFLTASYSLTLRHVMDSAKQATKSGNLNELSMVLLNNILSLPLGIILVLCFNEVDYLLETSLLRMPEFWLVITVSGVLGLGISFTSMWFLHQTSATTYSLIGSLNKIPLSVAGIVLFNVRTSMQNSLSILFGM

SEQ ID NO: 8053 - DNA, 1471 bp, Panicum virgatum
  misc_feature: Ceres CLONE 1986943
  misc_feature: Encodes the peptide sequence at SEQ ID NO. 8054
actccacggcgtcgtcgcttctctctctctctctctctctctctctctctctctctctcggttccgctcctcatggccgggctcgccgctggcctgggagcgcgcccctccgctgccttcgaggctacctgcttccgcccactcgcttcccccgttcgctccgggagattgatagtgcctaagcgatgcttcactgtgtcaagtagggcgcgggtggaagatgagcttatggaaataagaaagtcacaagagcaaagttcagtgaaatcaaagaaaaggccacctttgaggcgtgggaaggtctccccacaacttcctgtaccagagcacatcccaagaccatcatatgttggttcaaaaggactgccagaactatgcaagggtcaattccacgatgctcaagggattgctggaataagagctgcctgcaaacttgctgcccgtgttcttgactttgctgggactttagttaagccatcagttaccacaaatgaaatcgacgctgcagtgcataatatgatcattgaggctggtgcttatccttctccacttggctatcgtgaattccctaaaagtatatgcacatcagtaaatgagtgtgtctgccatggaatacctgattcaacacagctgcagactggggacattataaatattgatgtaaatgtgttcttcaatggataccatggtggtacctctagaacatttgcatgtggacaggtggatgattctatcaagcattttttgaaggcagctgaagaatgcttggagaagggcatttctgtctgcagggatggtgtgaactacagaaaaattggcaagaaaataagcaagcttgcttatttttatggatattatgtggtggagcgctttgttgggcatggaattggaactttgtatcattctgagccacttatccttcatcatgaacctatacttacgatggagaaaacagagtgtgttacatgggaagatggatggacgactgtcaccgctgatggtagctgggctgctcagtttgagcataccatattggtcactaggaatggcgcagaaatactgacaaaactttgagtttatatcctgctgatcctagtcagaagtgagccatctactttcgcgatgagatggttgtgcagcagcatcaccctccagcccaatatctgaaatatctactacaatgttctaggcccacatatggcaaggtttgcccctatgtagcaaccggacaggagatgtgggggcacacaactgcatctgtttgtttttgctgttcgcctgctggctgctgtagtaatattgcagggtggaagtcctgtctgacacattcatcactaatgaagttctagaaaattgatgtatatgaaattagctgtagttcagtttgttacaagtagtaatactgttccaaaaatggtatggaaaacaatcctgcatgctatctatcctagaaaaaaaaaaaaaaaaaaaa

SEQ ID NO: 8054 - protein, 333 aa, Panicum virgatum
  misc_feature: Ceres CLONE 1986943
  misc_feature (1)..(236): Pfam Name: Peptidase_M24 Pfam Description: metallopeptidase family M24
  misc_feature (20)..(332): SWISSPROT Homolog: EC 3.4.11.18 Methionine aminopeptidase 1B, chloroplast precursor
  misc_feature (53)..(285): SWISSPROT Homolog: EC 3.4.11.18 Methionine aminopeptidase 1C, chloroplast/mitochondrial precursor
MAGLAAGLGARPSAAFEATCFRPLASPVRSGRLIVPKRCFTVSSRARVEDELMEIRKSQEQSSVKSKKRPPLRRGKVSPQLPVPEHIPRPSYVGSKGLPELCKGQFHDAQGIAGIRAACKLAARVLDFAGTLVKPSVTTNEIDAAVHNMIIEAGAYPSPLGYREFPKSICTSVNECVCHGIPDSTQLQTGDIINIDVNVFFNGYHGGTSRTFACGQVDDSIKHFLKAAEECLEKGISVCRDGVNYRKIGKKISKLAYFYGYYVVERFVGHGIGTLYHSEPLILHHEPILTMEKTECVTWEDGWTTVTADGSWAAQFEHTILVTRNGAEILTKL

SEQ ID NO: 8055 - DNA, 1323 bp, Panicum virgatum
  misc_feature: Ceres CLONE 1986949
  misc_feature: Encodes the peptide sequence at SEQ ID NO. 8056
gcaaaccaatcatctccaccgcgacagcgtcgtctcgttctcgcacaacgccccggcgcactcggcctaccccgtcagtgcacgccgcaccacctgcagcagcagcgatggcccctgccaatgtcgaccagcagcagaagcaggaggtgcgggcggcggcgggcggccgcaaggtggtggacgaggtgtccggctggctgcgcgtgctggacgacggcagcgtcgaccgcacgtggaccggcccgcccgaggcgctcccgctgatgcagcccgtggcgccgtacgccgagccccgcgacgggcacacgctgcacgacctccccggggagcccaacctgcgcgtgtacctccccgaggtggcggggccgggcggcgcgcgcctgcccgtcatcctgaacctccacggcggcggcttctgcatctcccacccgtcctggctcatgtaccaccacttctacgcgcgcctcgcgtgcgccgtccccgccgtggtggtcgccgtcgagctcccgctcgcgcccgagcgccgcctgcccgcgcacatcgacacgggcgtcgccgcgctccgccagctccgcgcgatcgcgctgtccgaggacggcggcggcccggcgccggctgccgcgctcctccgcggggccgccgacgtgtcccgggtgttcctcatcggggacagctcaggcggcaacctcgtccacctcgtggccgcccaggtggggcaggacgacgctagccagtgggcgcccctccgcgtggccggcggcatcccgatccacccggggttcgtgcgggccgcgcggagccggtcggagctggagaagaagccggactcggtgttcttcacgctggacatgctggacaagttcctggcatacgcgctgccggagggcgcgaccaaggaccacccgttctcgtgccccatgggcccgctggcgccgccgctggcgtccgtgccgctgccgccgatgctagtgtccgtggccgaggacgacctcatccgcgacaccaacctcgagtactgcgacgcgctgcgcgccgccggcaaggaggtggaggtgctggtcaaccgcggcatgagccactccttccacctcaacaagtacgccgtcgacatggaccccaccaccggggagcgggcgcgggagctcatcgacgccatcaggagcttcatctcccgccactgaaaagcgcaaggacagcgctagctacaccacgcacgtgcctgcagtgctcatctacttgtcaagttcgtttcattccgcatctcaggtcgacctatgcacacgtgtccatgttacgcccagacgtacgtaacgttgctatgat

SEQ ID NO: 8056 - protein, 357 aa, Panicum virgatum
  misc_feature: Ceres CLONE 1986949
  misc_feature (1)..(234): Pfam Name: Abhydrolase_3 Pfam Description: alpha/beta hydrolase fold
MAPANVDQQQKQEVRAAAGGRKVVDEVSGWLRVLDDGSVDRTWTGPPEALPLMQPVAPYAEPRDGHTLHDLPGEPNLRVYLPEVAGPGGARLPVILNLHGGGFCISHPSWLMYHHFYARLACAVPAVVVAVELPLAPERRLPAHIDTGVAALRQLRAIALSEDGGGPAPAAALLRGAADVSRVFLIGDSSGGNLVHLVAAQVGQDDASQWAPLRVAGGIPIHPGFVRAARSRSELEKKPDSVFFTLDMLDKFLAYALPEGATKDHPFSCPMGPLAPPLASVPLPPMLVSVAEDDLIRDTNLEYCDALRAAGKEVEVLVNRGMSHSFHLNKYAVDMDPTTGERARELIDAIRSFISRH

SEQ ID NO: 8057 - DNA, 1496 bp, Panicum virgatum
  misc_feature: Ceres CLONE 1987014
  misc_feature: Encodes the peptide sequence at SEQ ID NO. 8058
gagtagggcttccccgcaccagtcgcccctcgcgccgcacccaacttgcctccaacgcaaccagctgccgcccgagctcatctccaaatcgccgcgcactcccctcccccaaatctctgcgcactcctcgatctcctccaaatctccgcgcaccttcctcttccaaaatcgacgcgccctcctgtccatcgaatcgcatccagactttctcatctatgcctctgatgccggcaccgccgggttgacgtccggctgtagcccctagcacggacgagacgagctgcagcaactccgccgctgtctcctgctgcataagtcgtccagcaccaatcgccgctttgctgcctccacccaaatctcctgtggcctcgcctcacattatccttctccttgcggctactccgactgccgatgccgccgctttctacttctgcaagcccaccaccgaacacccagatcctgctgctgtgaacgagctcctgcctgctgctgctgtgaacgagctcctcctgatttcagtgatctgctgctgatgtgtactgtttggaggagagcaattagtttgagcatataacgatctacaaaaaaatggaggcagcacaatagatcatattctatgccgccatatccatgtatgaggtaccatgtcaaggagttcaagaaagggtcacctcgccacgctcaagaattgttcaacaagtaccattcgaggctgcagatcatattctatgccgccatatccatgtatgaggtaccatgtcaaggagttcaagaaagggtcacctcgccacgctcaagaattgttcaacaagtaccattcgaggctgcgaaacgtgattgaacgtacttttgggtgcgcaaaaagtaagtggcaactcttgaatggcatacctcactacccgctaataaagcaatctcagcttgttatggctgcctgtgcactccacaactatgtgcatgagttggagggacgaaaacgtccagcgaggtacaggcaacgtggtgttggtggcagtttgggtcaagtgcttgcaatggcgttaagcccggacgcgactacagaagaaatccgagattggattaatatgggagactgggacttcctctccttgagaagaaatgaatggtttatgcaagggactgggaggacggagagtagggagttgctggatgaggaaggttgaaaatggcttttggattttgtttacgtgattgattagtaatgaagagggtggaagatggcttttggctggatgatgaatttgccttcttactgtgtgtactaattcaaattagttgtttagagaattaattaactcatgcattgggaatttatctaggagatggctgtacagaccttaaccattgggtacttagtggtaattattacttgaaatggctgtggttgtaatgcaactgtttgtatgtgaagggatctttgatgggtcatgttgtttgagtctatttgaatctgaaatagaattctagttggtgcc

SEQ ID NO: 8058 - protein, 179 aa, Panicum virgatum
  misc_feature: Ceres CLONE 1987014
  misc_feature (92)..(167): Pfam Name: Transposase_11 Pfam Description: Transposase DDE domain
MSRSSRKGHLATLKNCSTSTIRGCRSYSMPPYPCMRYHVKEFKKGSPRHAQELFNKYHSRLRNVIERTFGCAKSKWQLLNGIPHYPLIKQSQLVMAACALHNYVHELEGRKRPARYRQRGVGGSLGQVLAMALSPDATTEEIRDWINMGDWDFLSLRRNEWFMQGTGRTESRELLDEEG

SEQ ID NO: 8059 - DNA, 1674 bp, Panicum virgatum
  misc_feature: Ceres CLONE 1987021
  misc_feature: Encodes the peptide sequence at SEQ ID NO. 8060
gcaaaactcacgctgagccgccgcctgtccacctcctccagaccgaagaactgatcggtctccgcccccaccccactggcgatccgaactccagagtcaaatctccatgagccgatggtttctctggttccataaggcgaattccgatcattgcacgaatacgcgcggggcgtctcggtgaattttgctggttcttgggtattctgatctccgagacacgctaggaaggggggcgaattccccatttgttgcggttctggggctcctggagtggcgcggcaggagggaaatgagggatgtggtcgtggctgacgaagattgccgcgtgcttgggcccggtccggaggcacgcgcgtacgaggaaggatgaggacggcagcgacaatggccgcggcggcgtcgccgacgacctgctctggtcgcgggacattgggcgccacgcggccggtgagttctcgttcgccgtcgcgcaggccaacgagacgttggaggaccatagccaggtggagacaggcgctgccgcgaccttcgtcggcgtctacgacggccacggcggcgccgaggcctcccgctttatatctgaccacctcttcgcgcaccttatccggcttgctcaagaaaatggaacaatatctgaggacgttgttcggagtgcattttctgctactgaggaaggtttcttgacacttgtgcggagaacacgtttcataaagcctttgattgcagcagttggatcctgctgtctcgttggtgtcatatggagagggacgctgtatgttgctaatctaggtgattccagggctgtagttggcagtttaggtagatcaaacaagattgttgctgagccactcacaatagatcataatgcaagtgtggaggaagtgaggcaggaacttatatcacgccatccagatgattctcagattgttgttctcaagcatggtgtttggcgcattaagggcataattcaggtttcaaggacaattggggatgcttatttgaagaggcgggaattcgctcttgatccctccattactcgtttccgccttcctgagcctctccgccggcctgttcttacatcagagccttctatatgtacaagagcgcttcatccacaagataaatttattatttttgcaactgatggtctttgggagcacctgacaaatcagcaagccgttgaaattgtctacaacaatccacgaagaggaattgcaaagagactagtaagagcagcattgaaacaagctgcacagaagagggaaatgagatatgacgatctgaagaaagttgaaaagggagtgcgccgcttcttccatgatgacattacagtagttgttgtctacattgatcatggactactgcaacacagggatgcttctgtgccagaactctcagtccgtgggtttgtggattcagttggcccctcgaggttttcagatgtaactgccatatcctgaccggctaatttagcagcacaattttgatgaacggcattccagtagcatctgactatcagagtgttatgcagagtgttatgcatcaccaggctcgttttcagttttgtttttgcccagtactccaaatactttatggcacatttgtgaggcctgatattgctcgaaataagatgctcatgttgttaggtgatatttagtacaattaatattgacg

SEQ ID NO: 8060 - protein, 387 aa, Panicum virgatum
  misc_feature: Ceres CLONE 1987021
  misc_feature: Great-hit functional homolog of the protein sequence given in SEQ ID NO 9629
  misc_feature (1)..(281): Pfam Name: PP2C Pfam Description: Protein phosphatase 2C
  misc_feature: Useful for making plants with modulated biomass
  misc_feature: Useful for making plants with modulated low light sensitivity
  misc_feature: The rosette leaves do not appear in the normal fashion, i.e., their phyllotaxy may be abnormal or too many leaves may be emerging in comparison to the control.
MWSWLTKIAACLGPVRRHARTRKDEDGSDNGRGGVADDLLWSRDIGRHAAGEFSFAVAQANETLEDHSQVETGAAATFVGVYDGHGGAEASRFISDHLFAHLIRLAQENGTISEDVVRSAFSATEEGFLTLVRRTRFIKPLIAAVGSCCLVGVIWRGTLYVANLGDSRAVVGSLGRSNKIVAEPLTIDHNASVEEVRQELISRHPDDSQIVVLKHGVWRIKGIIQVSRTIGDAYLKRREFALDPSITRFRLPEPLRRPVLTSEPSICTRALHPQDKFIIFATDGLWEHLTNQQAVEIVYNNPRRGIAKRLVRAALKQAAQKREMRYDDLKKVEKGVRRFFHDDITVVVVYIDHGLLQHRDASVPELSVRGFVDSVGPSRFSDVTAIS

SEQ ID NO: 8061 - DNA, 1197 bp, Panicum virgatum
  misc_feature: Ceres CLONE 1987102
  misc_feature: Encodes the peptide sequence at SEQ ID NO. 8062
ctccctcttcctcctcctccattatctctctctttctaggcgctcccatctctctctagaaaaaaggagcgaggcgagcaggccggccggccggccatggggttcccgtcggtgtgctactgcgtgatcctgccgcagccgctcatcctggtgctgcagctgctggacatgctccggcacgccatcctgctctgcctctcctcgctcgggctcgcggcgccgccggccgccgacgaccacccggccttcgcggccccgccgccggacctctgggcgctgcctccgtccctgcaggcggccgcggccgcggcgcccccgcccacgccggccgccatcaaggcccgcctccccgccgtccggtacgccgacctcctccgcgcccgccgcgccccggccccggccacgtgcgccgtgtgcctgggcgcgctcgaggcgcggcaccgcgtccgggagctcggcaactgcgcgcacgccttccacaaggcctgcatcgacaagtgggtcgacaagggccaggccacctgcccgctctgccgcgcgctcctcctccccgacgacggcgccggcgagctcgccgcctcctcctcctcctcctcgcccttctccttctgagacctcgcgtcgcgcgcgcggtccaggcgtccagctacccaagaagaaccggagcccacccagccgattgagagccaggtcagtaaccagctcggtgtccatccatagctacctacccagctgatgcgcccccgtcatacttccggccggcccgtccatccatggatccaagcttagctacctttcttgggggaaatgaaatgggggaggaggtggaggaggagagagaaagaagagagagagaggaggtgtcagtgagtgtgaggtggtggagtattattggtaggtgaggcactaattatgaggaggacagggatggctacctgcattggatctggtgaatgcatagatccatccatccatcccctccacccttctcttctgcaactccaattcactctctcctccctcttttttttgttaattaatttcattttccctttttttttctttctgagggctcccctttttattgttaacctaatttgtgaggggaaccaagagagatgtacattgtacatagctgcctccacttgacaatattgcaagaaataatttgtctctcaaaaaaaaaaaaaaaaaaaa

SEQ ID NO: 8062 - protein, 171 aa, Panicum virgatum
  misc_feature: Ceres CLONE 1987102
  misc_feature (1)..(43): Pfam Name: zf-C3HC4 Pfam Description: Zinc finger, C3HC4 type (RING finger)
MGFPSVCYCVILPQPLILVLQLLDMLRHAILLCLSSLGLAAPPAADDHPAFAAPPPDLWALPPSLQAAAAAAPPPTPAAIKARLPAVRYADLLRARRAPAPATCAVCLGALEARHRVRELGNCAHAFHKACIDKWVDKGQATCPLCRALLLPDDGAGELAASSSSSSPFSF

SEQ ID NO: 8063 - DNA, 1670 bp, Panicum virgatum
  misc_feature: Ceres CLONE 1987116
  misc_feature: Encodes the peptide sequence at SEQ ID NO. 8064
atccgacaggctacagcgccccaacccctctcctgcacagcccccccttccccgtcttctgctctgccggtcgcagcagggctccactccccgccgggcatggcgcgcggcccgagcaccccgtcgctgctgctggcgctcctcgtggcggcggcggcggccgtgaccgcgtcggaggcgtccagggcccccgctgccatcggcaactggacggaggagctgcgcggcgccgtgaggcgggcccggcacgggcgcgggtacgcgtggcgctcgccgtcgcggcggcgcatgttcgagaacagcctcggccggacgccgcagatggggtggaatagctggaaccacttctattgcgggatcaacgaggacctcatcaagcagacagctgatgcactggtcaacactggtctggcaaaactgggctacgaatatgttaatatagatgattgctgggcagaatctgacagggactaccagggtaactttgttgcaaatagacaaaccttcccctctggcatcaaggcactagcggattatgtgcatgcaaaagggctgaagcttggaatctacagtgatgctgggacacggacgtgcagtcaaaaaatgccaggatcacttgatcatgaagagcaggatgtaaaaacattctcatcttggggtattgattatctgaaatatgataactgtaatgatgctggcaggagtgtaatggagagatatactaaaatgagcaatgccatgaagacctatggaaagaacatcttcttctcgttgtgtgaatggggaagagaaaatcctgctacctgggcaggcagcatgggcaacagctggagaacaactgatgatatcgctgacaactggggcagcatgacatcttgtgcagaccagaatgaccgatgggcctcctatgccgaacctggtggatggaacgatcctgacatgcttgaagtgggcaacggtggtatgtctgaggcggagtaccgctcccacttcagcatctgggcacttgccaaggctcctcttctgatcgggtgcgatgtacgctcaatgagccagcagacgaaggacatactcagcaactgggaagtcattgctgtcaaccaagatagtctaggcgtccaaggaaagaaagtgcaatccaacaatggcttagaggtatgggctgggccgctcagcaacaacaggaaggctgtggttctctggaaccggcagggctaccaggcaaccatcaccgctccatggtcaagcatcgggctcgcttcatccactgctgtcactgctcgcgatctatgggcgcattcgtcgttctcagctcagggccaattatcagcttcagtggcacctcatgactgcaagatgtatgttctgacgccaaagtaacttatggaagaacgagtccgtagcgtgggatgcagccattcaatcaggattcagaaaaaaagtgtatgcacgcaaggatccttaagagttaagagaaggaaatgagatctcatttggctatacaaggcaagagtgattcgagaaaaatacaaggcaagagtattatgcagaaataatctgtaagtgtatttaaggcgccgtcaaatgtcagcgcattactgaaaatgtttgtaacgaaagttgcagcagtaataaattggcttgcccaccaaaaaaaaaaaaaaaaaaaa

SEQ ID NO: 8064 - protein, 426 aa, Panicum virgatum
  misc_feature: Ceres CLONE 1987116
  misc_feature (5)..(425): SWISSPROT Homolog: EC 3.2.1.22 Alpha-galactosidase precursor
  misc_feature (61)..(426): SWISSPROT Homolog: EC 3.2.1.22 Alpha-galactosidase precursor
MARGPSTPSLLLALLVAAAAAVTASEASRAPAAIGNWTEELRGAVRRARHGRGYAWRSPSRRRMFENSLGRTPQMGWNSWNHFYCGINEDLIKQTADALVNTGLAKLGYEYVNIDDCWAESDRDYQGNFVANRQTFPSGIKALADYVHAKGLKLGIYSDAGTRTCSQKMPGSLDHEEQDVKTFSSWGIDYLKYDNCNDAGRSVMERYTKMSNAMKTYGKNIFFSLCEWGRENPATWAGSMGNSWRTTDDIADNWGSMTSCADQNDRWASYAEPGGWNDPDMLEVGNGGMSEAEYRSHFSIWALAKAPLLIGCDVRSMSQQTKDILSNWEVIAVNQDSLGVQGKKVQSNNGLEVWAGPLSNNRKAVVLWNRQGYQATITAPWSSIGLASSTAVTARDLWAHSSFSAQGQLSASVAPHDCKMYVLTPK

SEQ ID NO: 8065 - DNA, 1708 bp, Panicum virgatum
  misc_feature: Ceres CLONE 1987169
  misc_feature: Encodes the peptide sequence at SEQ ID NO. 8066
ttcgtctccctgtccctctcctggtctcctctatcggccggcccctctgtatcccccattgttgacgacttcgtgacgccgaggaagcagcccgaacgccggccatggggactcaggctccggagaaccactcccctgtaaaggatgagaggagcgcacgggagaaggcgatcgacgactggctcccgatcacctcgtcaaggaatgccaagtggtggtactctgcctttcacaatgtcactgccatggttggtgccggtgtgctcagccttccatatgccatgtctgagcttggctggggtcctggcatcgcagtgctgatcatatcatggatcatcacgctgtacacgctttggcagatggtggagatgcacgagatggtgccaggcaagcggttcgatcggtaccatgagcttggtcagcatgcattcggcgagaagctggggctctggattgttgtgccgcagcagctcatcgtcgaggtgggcgtcaacatcgtgtacatggtcactggaggcaaatccctgaagaagttccacgatgtgatctgcgatggcaagtgcaaagacatcaagaccacctacttcatcatgatctttgcctctgtccacttcgtgctatcccagctccccaactttaattccatctctggtgtctccctcgctgctgccgtcatgtcgctcagttactcaacaattgcttggggtgcatcggtggacaagggtaagcttcaagatgtggattaccacctgcgcgcgacaacgacgccggggaaggtgtttggcttctttggtgcgttgggcgatgtggcatttgcatatgcggggcacaatgtggttctagagatccaggccactatcccttcgacaccagagatgccatctaagaaacctatgtggaagggagttattgtcgcctatatcgtggtggcactctgctacttccctgttgcactcatcggctattgggctttcggcaacaaagtggacgacaacatcctcatcaccctcaacaatccaaagtggctcattgcccttgccaacatgatggtcgtgatccatgttatcgggagctaccagatctatgcgatgccagtgtttgacatgatagagactgtgctggtgaagaagctgcatttccctcctggcctgacactacgtttgattgcccggactgtttatgttgctttgacaatgttcatagccatcaccttccccttctttggtggattgctcggtttctttggtggattcgcctttgcgccaactacatattttcttccctgcatcatgtggctcgcaatctacaagcccaaaaggttcagtctctcatggttcaccaactggatctgcattattcttggggtgcttctgatgattctatcgccaattggaggactccggcaaataataatcgatgctaaaacatacaaattctactcgtaaacaactaccagcgatcgtcgtccgacttgtaaacagcgtcgacgagtttttgttgcgtcaaacagaaaaggtcctgggaagttcctagtaccagaaattgtttccaatgttgggttattagttatatatacatgttttttttctgaacattccaaaggtgaacgtggtgtgtgtctgtacataagagaattaatgctggtggctgttctagatgttggcgataatgcagtgtggtttgtagttaaaaaaaaaaaaaaaaaaaa

SEQ ID NO: 8066 - protein, 446 aa, Panicum virgatum
  misc_feature: Ceres CLONE 1987169
  misc_feature: Great-hit functional homolog of the protein sequence given in SEQ ID NO 9238
  misc_feature: Great-hit functional homolog of the protein sequence given in SEQ ID NO 9284
  misc_feature: Useful for making plants with altered oil content
MGTQAPENHSPVKDERSAREKAIDDWLPITSSRNAKWWYSAFHNVTAMVGAGVLSLPYAMSELGWGPGIAVLIISWIITLYTLWQMVEMHEMVPGKRFDRYHELGQHAFGEKLGLWIVVPQQLIVEVGVNIVYMVTGGKSLKKFHDVICDGKCKDIKTTYFIMIFASVHFVLSQLPNFNSISGVSLAAAVMSLSYSTIAWGASVDKGKLQDVDYHLRATTTPGKVFGFFGALGDVAFAYAGHNVVLEIQATIPSTPEMPSKKPMWKGVIVAYIVVALCYFPVALIGYWAFGNKVDDNILITLNNPKWLIALANMMVVIHVIGSYQIYAMPVFDMIETVLVKKLHFPPGLTLRLIARTVYVALTMFIAITFPFFGGLLGFFGGFAFAPTTYFLPCIMWLAIYKPKRFSLSWFTNWICIILGVLLMILSPIGGLRQIIIDAKTYKFYS

SEQ ID NO: 8067 - DNA, 1138 bp, Panicum virgatum
  misc_feature: Ceres CLONE 1987175
  misc_feature: Encodes the peptide sequence at SEQ ID NO. 8068
gccaaaacaaacacagctcatctcatcactcctcagattattagtagctaaagccaagagcacacaagctcatctctcttcacaattatattcagacaacccaacctcatctagctagcaatggcgcctacagcaaccatgagcaacaaagccgtggtgctcctcctgctggtgggtcttctccctctcgccaccctcggctcccgctcgggcccgtccgcgcaccacggccacgccgggcacggccccaagcactcgccgcctccgtctcctacaccggcgacgcccgcccccgtcgcggcacccgccgccgcgctggtgcgctccacctgcaactcgaccacctactacgacctgtgcgtgtccgcgctgggcgccgacccgtccagcgccacggccgacgtgcgcggcctctcctccatcgccgtctcggccgccgccaccaacgcctccggtggcgccgccaccgccgccgcgctcgccaacggcaccgccgcggcgtcgaacgcgcaggcggccccggccaccgccgccgacgccaccgtgcaggcgctgctccggacctgcgccgccaagtacggccaggcccgcgacgcgctgagcgccgccagagactccatcgcggcgcaggactacgacttcgcgaacgtgcacgtgagcgccgccgccgagtacccgcaggtgtgcaaggcgctgttccggcggcagaggcccgggcagtacccggcggagttggcggcgagggaggaggcgctcaggcagctctgctccgtcgccaacgacatcatcgccctcctcgccaacagcagcagctaataacctagctggtcgaccggcgatctccatgatgcatatccttgatctatctatccatcttgtgttggataattctagcacacggtcagttagcgagtctgttagttcgttagaaaataacgagcccctgcgtgggcgcgtcgagtcgtgggcgtgttgcccggtcttttctccttacatgtagatgcacgacgccgcctggatctcgctcgtgggatggcacgagccggtaggagatcgtggtcgcgatcaaactttgtaatccctatttaagttgttgaatagagtcagaaaacactactaaaaaaaaaaaaaaaaaaaa

SEQ ID NO: 8068 - protein, 231 aa, Panicum virgatum
  misc_feature: Ceres CLONE 1987175
  misc_feature (3)..(157): Pfam Name: PMEI Pfam Description: Plant invertase/pectin methylesterase inhibitor
MAPTATMSNKAVVLLLLVGLLPLATLGSRSGPSAHHGHAGHGPKHSPPPSPTPATPAPVAAPAAALVRSTCNSTTYYDLCVSALGADPSSATADVRGLSSIAVSAAATNASGGAATAAALANGTAAASNAQAAPATAADATVQALLRTCAAKYGQARDALSAARDSIAAQDYDFANVHVSAAAEYPQVCKALFRRQRPGQYPAELAAREEALRQLCSVANDIIALLANSSS

SEQ ID NO: 8069 - DNA, 1310 bp, Panicum virgatum
  misc_feature: Ceres CLONE 1987202
  misc_feature: Encodes the peptide sequence at SEQ ID NO. 8070
aaccatctcattccttccttcccccaccccaccttcttccgagctccttgctccccccggcgcgcagctcgcaccttgcaaggaacacccggcgggttattagttgctaactgaagtggtggccagcttctggcccctgcggcggcgtgcacgccatggctcaggaggacgtccacctggacgacgccgggctggccctgggcctgtccctcggcggcggcgcggcccctgacgcggcgcggcggcagggcgctggcgcccggctgccgccgtcgccgcgcgcgctggagccgtcgctgacgctgagcatgccggacgaggcgaccgcgacggggtccgccggcggcggggccgcgcacagcgtgtcgtcgtcgctgccggcggcgggcgtgaagagggagcgcgtggaggaggccgacggcgagcgggcgtcgtcgacggcgcgggccgaggacgatgacgacgggagcacgcgcaagaagctgcggctgaccaaggagcagtccgcgctcctggaggaccgcttcaaggagcacagcaccctcaacccgaagcagaaagtcgcgctggcgaagcaactgaacctgcggccacggcaggtcgaggtgtggttccagaacaggcgagcgaggacgaagctgaagcagacggaggtggactgcgagttcctcaagcgctgctgcgagtcgctcaccgaggagaaccgccgcctgcagcgggagctgcaggagctccgcgcgctcaagttcgccgccccgccggggccggcggcgccggcgccggcgccgttgtacatgcagctgccggccgccacgctgacgctctgcccgtcctgcgagcgcctgggcgggcccgccgccgcggccaaggccgaccccgaccgccccaaggcggcgccggcgcaccacttcttcaaccccttcacccactccgccgcctgctgatcatctaatctgcacgcgcatgcatggtgaccaccagcagcagcaacacagagcagaaaagcaccacccgccgccactgcagctagctaataccaccacgtacacgccatccaatccacctcgcgtacgccacaagtaacatgatgatgatccatcgatctccatcctcccctctagctattttcttgatccgggggagattaagctagctagtaattattgttcccatcctcagctaatccaaccaatcataggctttatttgacacataggggtagtcaaaatagccgtagcttcctcgatccatccatgtatatttttgtgcatgcatgctgtaattccgtccaaaaaaaaaaaaaaaaaaaa

SEQ ID NO: 8070 - protein, 262 aa, Panicum virgatum
  misc_feature: Ceres CLONE 1987202
  misc_feature (1)..(55): Pfam Name: Homeobox Pfam Description: Homeobox domain
  misc_feature: The sequence is a functional homolog of  SEQ ID NO 1674 in the  10/374,780 US patent application
  misc_feature: The sequence is a functional homolog of  SEQ ID NO 2326 in the  10/374,780 US patent application
  misc_feature: The sequence is a functional homolog of  SEQ ID NO 252 in the  10/412,699 US patent application
  misc_feature: The sequence is a functional homolog of  SEQ ID NO 542 in the  11/479,226 US patent application
  misc_feature: The sequence is a functional homolog of  SEQ ID NO 546 in the  11/479,226 US patent application
  misc_feature: The sequence is a functional homolog of  SEQ ID NO 8 in the  10/225,068 US patent application
  misc_feature: Useful for making plants with modulated growth and phenotype characteristics
MAQEDVHLDDAGLALGLSLGGGAAPDAARRQGAGARLPPSPRALEPSLTLSMPDEATATGSAGGGAAHSVSSSLPAAGVKRERVEEADGERASSTARAEDDDDGSTRKKLRLTKEQSALLEDRFKEHSTLNPKQKVALAKQLNLRPRQVEVWFQNRRARTKLKQTEVDCEFLKRCCESLTEENRRLQRELQELRALKFAAPPGPAAPAPAPLYMQLPAATLTLCPSCERLGGPAAAAKADPDRPKAAPAHHFFNPFTHSAAC

SEQ ID NO: 8071 - DNA, 1829 bp, Panicum virgatum
  misc_feature: Ceres CLONE 1987328
  misc_feature: Encodes the peptide sequence at SEQ ID NO. 8072
acttcgccgccacaagggtaaaccccctcctcccctccccgtcctgctatacccgcgcggccgccaccgccaccccgccgcgtcctcgagcgtctcccctccggctctccgcctctcctccctcccctcccctcccctgcaatggcgtcggcgggagggtcctccggggtcgtagggatcagtgtccgtccgaacaccaatgtggcctgccttgttcagaagggtggagccctgtcaaattccctccctactggagccgctgttcaggttcgccggcgccacaacaaggcccgcaatggccaagctatcaggtgtgcaacagcaactggaaaagagcagggtgcagtcacccctgctagtagtggtgatcaaaacaaaggtggattgcgtggcaaattaaataaagttgttttagcttatagtggtggcttggatacatctgttatcgttccatggctcagggagaactatggttgtgaagttgtttgtttcactgctgatgttggccagggtgccattgaattggaaggattggagaaaaaggcaaaagctagcggagcatgccagcttgttgtaaaggacttgagagaagaatttgttagtgaatatatatacccctgcctgcgagctggtgctgtttatgaaagaaagtatctgcttgggacttcaatggctaggcctgttattgctaaggcaatggtcgatgttgccaaggaagttggtgcagatgcagttgctcatggatgcactgggaaaggcaatgatcaggttcgctttgagcttacgttttatgctttaaatcctgaactcaaagttgtggcaccttggagggagtgggacatcacaggacgtgaagatgcaattgagtatgcaaagaaacacaatgtaccagtaccagtttcaaagaaatcaatatacagccgagatcgaaacttgtggcaccttagccatgagggtgacatcttggaggacccagcaaatgagccaaaggaagatatgtatatgatgtctgttgctccagagaatgcaccttcagaacctgagtatctggagattggcatcgttgcaggtgttcctgtttccatcaacggacgggagctctcgccagcatccctccttgcggagctcaatgaaattggtgggaagcatgggatcgggcgcattgacatggtagagaaccgccttgtaggcatgaagtcccgtggtgtctatgaaacccctggtggtaccatcatggcagccgcggtgcgggagctcgaggccttgactctggacagggagaccatgcagtggaaggacatggtggccctcaagtatgctgagctggtctatgcaggccgctggtttgaccctctccggcagtcctttgacgccttcatggagaagatcaccgcgacgaccactggttcagtgaccctgaagctgtacaaggggtcggtaaatgttgcatcccggaagagcccctacagcctctacagggaggacatctcatcatttgagaacggggagatctacaaccaggctgatgctgagggattcatccggctctatggtctcccgacacgggtccgggcgatgctggagaagggcatctaagctcctctgttttagaaataaaagccatcattcagaaactgtcaaatagtttcgagtgattgcacacacatcattttgtatcaatcgttttaagtttgtcccagtgaactctgaatgcatttggatgacagaatggatatgaatattattagtaatctgctggctgctgatgtaggacacaagttcagatgtataaataaatggtaaatataaattttacattggagcctctc

SEQ ID NO: 8072 - protein, 484 aa, Panicum virgatum
  misc_feature: Ceres CLONE 1987328
  misc_feature (1)..(390): Pfam Name: Arginosuc_synth Pfam Description: Arginosuccinate synthase
  misc_feature (1)..(391): Pfam Name: Arginosuc_synth Pfam Description: Arginosuccinate synthase
  misc_feature (1)..(389): Pfam Name: Arginosuc_synth Pfam Description: Arginosuccinate synthase
  misc_feature (1)..(379): Pfam Name: Arginosuc_synth Pfam Description: Arginosuccinate synthase
  misc_feature (25)..(482): SWISSPROT Homolog: EC 6.3.4.5 Argininosuccinate synthase, chloroplast precursor
  misc_feature (88)..(482): SWISSPROT Homolog: EC 6.3.4.5 Argininosuccinate synthase
MASAGGSSGVVGISVRPNTNVACLVQKGGALSNSLPTGAAVQVRRRHNKARNGQAIRCATATGKEQGAVTPASSGDQNKGGLRGKLNKVVLAYSGGLDTSVIVPWLRENYGCEVVCFTADVGQGAIELEGLEKKAKASGACQLVVKDLREEFVSEYIYPCLRAGAVYERKYLLGTSMARPVIAKAMVDVAKEVGADAVAHGCTGKGNDQVRFELTFYALNPELKVVAPWREWDITGREDAIEYAKKHNVPVPVSKKSIYSRDRNLWHLSHEGDILEDPANEPKEDMYMMSVAPENAPSEPEYLEIGIVAGVPVSINGRELSPASLLAELNEIGGKHGIGRIDMVENRLVGMKSRGVYETPGGTIMAAAVRELEALTLDRETMQWKDMVALKYAELVYAGRWFDPLRQSFDAFMEKITATTTGSVTLKLYKGSVNVASRKSPYSLYREDISSFENGEIYNQADAEGFIRLYGLPTRVRAMLEKGI

SEQ ID NO: 8073 - DNA, 1632 bp, Panicum virgatum
  misc_feature: Ceres CLONE 1987372
  misc_feature: Encodes the peptide sequence at SEQ ID NO. 8074
aaaagccgaaggctttctccggccgccgttaaacccgctagcaaaggtgagctccggctccgaccgaccaagccgaaaccgaccgagaggctgctccgacccacccgcagccgcagccggcaagagagaaagacgaaaccctaggggtgagcgagccagccatcggcgcacagggaagaagggacggcgatggagtacccggcggcggccgccggatcggggggctacaggtactactacccgccgcagcagccgcagccgcagccggtccgccgcccgccgcgccccgccgcgcgctgggtcaagcaatggatcccgctggatctcgcctcctccggcggaaaatgctcgctcttcaagtgggtcagagaggatgggcacagaagctccaaggaaaaccccatagtgctggaggcagaggcgcccaagtctgaacccaccacagagatccttttcctctgcagctacgagaactgcggcaagacctttgttgatgtcagcgcacttcgcaagcacgctcacgtgcacaatgagaagcagtatatctgcaatgagcccaactgtgggaagaaatttgttgatagctccaagctgaagagacactatcttacacacacaggacaaaaagattttgtctgtccgcatccaggctgtggtaaggccttctcgttggattttaacttacggtcacacctcaaaacacatgcattggagaattatcacatatgccctttcccagcttgtggcaaaagatttacaagtgactccaaactgagagtccatgtcaagtcacatgaaaagactggaactcctgttgcagtgcaacatactccaccagtagaaaaacctcacagtgcaccaaagccttcgactccagcaaccacaagctttcctgatcgcccgtatatctgcccctacgaaggttgcgacaaagcatacattcatagttacaaattgaaccttcatctaaaaactcagcatcctgaacacggccaagaggaaaatggtaagcttggtgcttctggtcagcatggtgtgaatgaaacgatgtatcagtataactatgctgaggttggtgacactgcaccaaaccccaaaagaagcaagacccacaaggtccactcgtctaaagtctacaataccaagatttcaactgcgatgccttccaatatcagtggtgtcaagcaccagtggtcaggtaaggcaacgtacgaagatgatagtgaagagaccgaagaagacgggggcaacaacaatgaagatggctggacaaggtatggcaacaatgctgatgatgaggaaactcaggatgaagattgaccaacagctcgtctttgtctctttcctgacatcctgctgagtttgtggatgaggtaaatgtggttggctgctacatttggtttttgcgaatcctaattatcagtaatttatcaatgtagtggtgggtaattctaagctttaaccataggtagtagtaggtgtagatggttcatgatatatgtactctgttatgtgctcccggatattcacttccccaggaaacctatgtgaaatagttgggatatgttttccttgacattatttttcattttaaacatttttcacttcagttaaaaaaaaaaaaaaaaaaaa

SEQ ID NO: 8074 - protein, 376 aa, Panicum virgatum
  misc_feature: Ceres CLONE 1987372
  misc_feature: Great-hit functional homolog of the protein sequence given in SEQ ID NO 9461
  misc_feature (1)..(25): Pfam Name: zf-C2H2 Pfam Description: Zinc finger, C2H2 type
  misc_feature: Useful for making plants with altered Lignin content
MEYPAAAAGSGGYRYYYPPQQPQPQPVRRPPRPAARWVKQWIPLDLASSGGKCSLFKWVREDGHRSSKENPIVLEAEAPKSEPTTEILFLCSYENCGKTFVDVSALRKHAHVHNEKQYICNEPNCGKKFVDSSKLKRHYLTHTGQKDFVCPHPGCGKAFSLDFNLRSHLKTHALENYHICPFPACGKRFTSDSKLRVHVKSHEKTGTPVAVQHTPPVEKPHSAPKPSTPATTSFPDRPYICPYEGCDKAYIHSYKLNLHLKTQHPEHGQEENGKLGASGQHGVNETMYQYNYAEVGDTAPNPKRSKTHKVHSSKVYNTKISTAMPSNISGVKHQWSGKATYEDDSEETEEDGGNNNEDGWTRYGNNADDEETQDED

SEQ ID NO: 8075 - DNA, 1342 bp, Panicum virgatum
  misc_feature: Ceres CLONE 1987481
  misc_feature: Encodes the peptide sequence at SEQ ID NO. 8076
aaaacaacatctcgcctctcggcctctcctagtcatggcggataatttaatccctcaccacaccttcctgctccgctctgttttattattgcggccacctcaccgctcccatcccgccatgtcctctcctctgcctctctctcatctctagcctccctcctcttcctcagcctccgacgacgctgttagctgagagcaagggaggccctggtctacgccagccagccagccatgctggtgcgctgcgacgtctgcggcgccgagccggccgccttgctctgctgcgccgacgaggccgcgctctgctccgcctgcgaccgccgcgtccaccgcgccaacaagctcgccgacaagcaccgccgcatcccgcttctccatccctccggcgacgactccgccgccgccgccgccgccgcgccgctctgcgacgtctgcaaggagcggaggggcctggtgttctgcgtggaggaccgcgccatcctgtgcctcgactgcgacgaccccatccacagcgccaacgacctcaccgccaagcactcccgcttcctcctcgtcggggcgaaactctccgccgggctcgtcgaccaggcgcccccctccctggacgactgccggggcagcggctccgacgagccccacgacgtcgccgccatctgcccgccgcaggcggccaagagcttggctcttgattgcagcaacagccacggcggcggcggcggaggcggcggcggcggcggaagcagcggcggcagcagcagcatctccgactacctcaccaacatctgccccggctggcgcgtcgacgacctcctcttcgacgacgccgcgttctccgccgcctcggaggaggccaggcgcgacgagcacgagcaggttccgtccctggacgccgacctcttcgacgtggtcgccggccggccggggaagcgcggcgcgtggtacggcggcgcgatgggcctcgagaaggtgcctgctgctgctgctgctgctgcctccattgcggtcccgacggcggctaagcagcaggggcgcgtgagggagaggcactggagctgcgacagcgacagcgacgtgttcgcggtgccggagatctcgcagccgccgccggccaagaaggcgcggccgccggcgccgacgttctggtgcttctgatcgagctgcgccaccagcccggccgccatgctagctcgatccgcgtgtgcacttcgctactactgtgtaccagtgtgtgtgatctcgctgttactgtactgttaccttatacttgccactactagcagtgctcaagcccagtcaaactcggtgcagtttatggccatgagagagatcgttaccgtactgc

SEQ ID NO: 8076 - protein, 306 aa, Panicum virgatum
  misc_feature: Ceres CLONE 1987481
  misc_feature (1)..(48): Pfam Name: zf-B_box Pfam Description: B-box zinc finger
  misc_feature: The sequence is a functional homolog of  SEQ ID NO 1024 in the  10/666,642 US patent application
  misc_feature: The sequence is a functional homolog of  SEQ ID NO 1646 in the  10/374,780 US patent application
  misc_feature: The sequence is a functional homolog of  SEQ ID NO 1672 in the  10/412,699 US patent application
  misc_feature: Useful for making plants with modulated growth and phenotype characteristics
MLVRCDVCGAEPAALLCCADEAALCSACDRRVHRANKLADKHRRIPLLHPSGDDSAAAAAAAPLCDVCKERRGLVFCVEDRAILCLDCDDPIHSANDLTAKHSRFLLVGAKLSAGLVDQAPPSLDDCRGSGSDEPHDVAAICPPQAAKSLALDCSNSHGGGGGGGGGGGSSGGSSSISDYLTNICPGWRVDDLLFDDAAFSAASEEARRDEHEQVPSLDADLFDVVAGRPGKRGAWYGGAMGLEKVPAAAAAAASIAVPTAAKQQGRVRERHWSCDSDSDVFAVPEISQPPPAKKARPPAPTFWCF

SEQ ID NO: 8077 - DNA, 1690 bp, Panicum virgatum
  misc_feature: Ceres CLONE 1987494
  misc_feature: Encodes the peptide sequence at SEQ ID NO. 8078
atcagccgatcacaaaagcggcgcgccccgcgctgaccgcgcccacacaaaaaaggcgggcggcgcgcgccgccccattcccttccttccctttcctctcccagtcccacccccgccggctcgcttcccaattcacaaccccgccgctgcggccgcgagcgatgcccgcgatccccacagcccctgcgcccgcccccgacagctccctcctcgcgcgccgccaccgcctccggttctcctccccgtcgccgcgctctaaccaccagcggctcctcccgcgcctgcccgctcgcccccgggccgctcccatgtccgccgaggcgcgggcgcccgcgtcgccggtggcgccgccggcgcaccccacatacgacctcagggccgtcatcgcgctcgccctctccgaggacgccggcgacagaggggatgtgtcttgtttggctacaattccttcggacgtggaagctgaagccacgtttattgctaaagcagatggtgttattgctggaataagcctagcagacatgatatttaaccaagttgatccatcgttgaacgttgaatggtttgaaagtgatggaaattatgtccataaagggttgcaatttggcaaagtatacgggtgcgctcggagcatcatcattgctgaaagggttgtgctcaatttcatgcagaggatgagtggtattgcgaccttaacaaaggctatgtctgatgctgcacgtccagcatgcatattggaaacaaggaaaactgccccaggtttacgtctggttgacaagtgggcagtgctgataggtggtggaaagaaccacaggcttggtttatttgatatggttatgataaaggataatcatatttctgtcgctggcggtattgcaaatgcaatgagatccgttgaccaattcctggagagggaaaaactaacaattcctgtagaggttgagacaaggacaattgaagaagtgaaagatgtgctgaagtatgctgctgagaacaaaacttcattaacccgtataatgttggacaacatggtcgttcctcttccaaatggggatgtggatgtatcaatgcttaaagatgcagttcaattgataaatggtagatttgagactgaggcatctggaaacgtgacaatcgatacagtaaagaaaatcggagaagcaggagttacctatatttcaagtggagcattaacgcattctgtgaaggctcttgacatgtcactcaagatagacaccgagctcgctcttcaagtcggaagacgtacaaatcgtgcctgactccaccacattagtatattgtacccgccttgccacatctacaagatgatagattaacccagcgtggcaaatcaagttaaataacttatcaaatctgcgcgtccggacgcgtggtgctgatagctgtgattgcaacaaaatgggattccttcttcagttttaggttttcagccgaaatacacaaacaccacaatatgtaacagaataattggcaggggggcaggttgcttctcgcatagtatgttctagcaccagatttggaagctggaaaaggagcggctgctgcgttctgcggccgtagccggtgaggtagatctccctgcgccctgccagaaaggtaggttactgtgaacgggatgtcgcactgaagttgcgaagttgcaataccacaaacaaaataacgagagatc

SEQ ID NO: 8078 - protein, 372 aa, Panicum virgatum
  misc_feature: Ceres CLONE 1987494
  misc_feature (1)..(182): Pfam Name: QRPTase_C Pfam Description: Quinolinate phosphoribosyl transferase, C-terminal domain
MPAIPTAPAPAPDSSLLARRHRLRFSSPSPRSNHQRLLPRLPARPRAAPMSAEARAPASPVAPPAHPTYDLRAVIALALSEDAGDRGDVSCLATIPSDVEAEATFIAKADGVIAGISLADMIFNQVDPSLNVEWFESDGNYVHKGLQFGKVYGCARSIIIAERVVLNFMQRMSGIATLTKAMSDAARPACILETRKTAPGLRLVDKWAVLIGGGKNHRLGLFDMVMIKDNHISVAGGIANAMRSVDQFLEREKLTIPVEVETRTIEEVKDVLKYAAENKTSLTRIMLDNMVVPLPNGDVDVSMLKDAVQLINGRFETEASGNVTIDTVKKIGEAGVTYISSGALTHSVKALDMSLKIDTELALQVGRRTNRA

SEQ ID NO: 8079 - DNA, 1304 bp, Panicum virgatum
  misc_feature: Ceres CLONE 1987595
  misc_feature: Encodes the peptide sequence at SEQ ID NO. 8080
gctccggccggctactaggacaaagccgaggggcagagcaagcagccgctactaacagagaggcacgaggaggagccatggggttcggcgtggtgtccctgctcaacgcggtgttccggcgcatgttcacctcggccggcctccgccccgcctccgccaccgtcgacgccgacgacaccaccatccacttctgggcccacccctccctcctccagccatcatcgtcctcggagcagcagcagccgccgccgcggccggtggtggtgctgatccacgggttcggcccggacccgacgtggcagtgggcggcgcaggcgggccagctgtcccgccacttcgacctggtggtgcccacgctgctcttcttcggcgcctccgccacgcgcgcgcccgcccgctccgatgccttccaggccgccgccctcgccgcgctcctcaccggcggcggccacctcccgggcctcggcgccgaccgcgcggtgcacgtggtgggcaccagctacggcgggctcgtggcgtaccacctggcccgggagctgcaccgccgcggcggcggcgcccgcgccgggaaggtggcgctgtgcgactcggatgcgtgcaagggcgcggaggacgaccgcgagctggcggcgagggccggcgtggcggaggtgacagagctgctcgcgccggccgacacccgggcgctgcggcggctgatggccgtctgcgcccaccgccccgtcaagtacatccccgagtgcctcctccgcgacatgctccggaagtacttcggggacaagagggaggataagatagcgctcatcaaagggatcaccaccggggaaggcttccagctcgatcctctgcctcaggaggtcctgatcatctggggcgagttcgaccaaatcttccctgtggagaaagcgcacaagatgaaagagaagcttggggagaaggcgacggtgaaggtgatcccgaacacggggcacctgccgcagcaggagaatcccaagctcttcaacaaaatcctcctcgacttcctgctgcacccggcggccacctccaacggcagcgccgccgccaaatagcgcctgctgttcgcgccacctggatgttgcgtgcatccggtgatcgttcgtggagattctgccttctcttttttttcccccagcctgttttgaaatgcagaggcaatgcagattgctgtgtttaaccaaggtgtagggagaaaggatgcagccttgcttttttctttcaatattttctgccagtgttttgaaatacatatatgaagaacgaggagccggctcctttcgtctgcc

SEQ ID NO: 8080 - protein, 330 aa, Panicum virgatum
  misc_feature: Ceres CLONE 1987595
  misc_feature (1)..(233): Pfam Name: Abhydrolase_1 Pfam Description: alpha/beta hydrolase fold
MGFGVVSLLNAVFRRMFTSAGLRPASATVDADDTTIHFWAHPSLLQPSSSSEQQQPPPRPVVVLIHGFGPDPTWQWAAQAGQLSRHFDLVVPTLLFFGASATRAPARSDAFQAAALAALLTGGGHLPGLGADRAVHVVGTSYGGLVAYHLARELHRRGGGARAGKVALCDSDACKGAEDDRELAARAGVAEVTELLAPADTRALRRLMAVCAHRPVKYIPECLLRDMLRKYFGDKREDKIALIKGITTGEGFQLDPLPQEVLIIWGEFDQIFPVEKAHKMKEKLGEKATVKVIPNTGHLPQQENPKLFNKILLDFLLHPAATSNGSAAAK

SEQ ID NO: 8081 - DNA, 1044 bp, Panicum virgatum
  misc_feature: Ceres CLONE 1987735
  misc_feature: Encodes the peptide sequence at SEQ ID NO. 8082
gatccagacgcctctcgcccgaaagcaacacgcctccccaccaatccgacgcgtcacgagtcagcagagccgagcattctcctagcttgctagtgcatgcgtacaggctctagcgatccatcatcactcatctgctgaggcgcgcggcaggcgtaacctcctgagatcgagcttcgcttgcgcagctgctagctagcgccgtccggttcgttggttggttgcaggtcgccctcggtcgatcatggagtggagggacagcttcctggacctggcgctcatcccgctcggcctgctgctccccatggcgtaccacgtctggctgtggcgcgaggtccgcctccgcccgctccgcaccgccgccggcatcaacgccgccgcgcgccgcgtctgggccgtcggcatgatgaaggacaacgcgaagaacgcggtgacggtggtgcagtcgatgcggaacgtgatcatggggtcgacgctgatggcgacgacggcgatcctcttctgcacgggcatcgcggcggtgctgagcagcacctacaccgtgaagaagccgctgagcgacaccgtgttcggggcgcacggcgagtacatgatggcgctcaagtacgtggcgctgctgctcgccttcctcttcgccttcctctgccacaccctcgccatctgcttcctcaaccaggccagcttcctcatcaacacctccgactgcctcgtctcggctgacggcgtcgcgggcccggagggcggcctgccgtccgcctgcagggactacgtcgccgaggtcatggagcgcggcttcaccctcaacctcgtcggcaaccggctcttctacgccggggtgccgctcctcctctggatcttcggcccgctcctcgccttcctgtcgtccgcggtcatgatccccatcctctacagcctcgacatcgtcgacctcaagggccacagcggctgcgtcagcgccaaatccgccgaggccaccaaggggagcgagtgcacgcacgccgtctgatacctggtccgctgatcgagcaaaaaaaaaaaaaaaaaaaa

SEQ ID NO: 8082 - protein, 253 aa, Panicum virgatum
  misc_feature: Ceres CLONE 1987735
  misc_feature: Great-hit functional homolog of the protein sequence given in SEQ ID NO 9395
  misc_feature: Useful for making plants with altered terpenoid content
MEWRDSFLDLALIPLGLLLPMAYHVWLWREVRLRPLRTAAGINAAARRVWAVGMMKDNAKNAVTVVQSMRNVIMGSTLMATTAILFCTGIAAVLSSTYTVKKPLSDTVFGAHGEYMMALKYVALLLAFLFAFLCHTLAICFLNQASFLINTSDCLVSADGVAGPEGGLPSACRDYVAEVMERGFTLNLVGNRLFYAGVPLLLWIFGPLLAFLSSAVMIPILYSLDIVDLKGHSGCVSAKSAEATKGSECTHAV

SEQ ID NO: 8083 - DNA, 1581 bp, Panicum virgatum
  misc_feature: Ceres CLONE 1987813
  misc_feature: Encodes the peptide sequence at SEQ ID NO. 8084
accgcgttgcgttgggagtagtcggatggcgcggggagtcgccgagtcgggcaatggcatccgatagccatacatcttctcgcggaggctgctgaggcggtcgccaccatgcccctgccctgcccccatcgcaacgcaccaaggaggactccgcctcgtgctcctcctgacctcctcctccccagactccagtcatcttacccacccgtaccaccctccccgctcccctttcctaacccgagtcccaatccctagccctctcctgcctcctacaccgccgccgccgccagccggcacccctgccccccgccgcgcccggagatgcaggccgccgcccgccgacgcttccggtgggtcaaggagtgggtcccgcaggacctggtcgtcgccggaggcccctgcgctctcttcaagtgggtgcgagaggatagattggtagctttgaaagctaaggacaaggaacagggggcagaatctgcaatacctgaaccgaataccgaggttctcttcctgtgcagctatgaaggatgtgggaagacattctttgatgctggggctcttaggaagcatgctcatgtccatggggagagacagtatatctgtcactatgagaactgtggcaagaagttcttagatagctcgaaattgaagaggcattttcttattcatacaggagaaaagaactttgtgtgccctcatgaaggctgcgggaaggctttttcattggatttcaatttgaaggcacacatgaaaacacattctgcggataactatcatgtgtgccagtacccagagtgtggcaggagatttacacaagaatcaaaactaagagctcatatcagggcacagcatgagaaagttgttggcctacagaatccaggtccatcgacagtgaaccacagtgcactgggagattatcaccagccccctaaaccatttaaggtttcagcaactcctccagctccctcagctgagcgtccatatgtctgcccttatgaaggctgcgacaaggcatacattcatgagtacaagctgaaccttcatttgaaaaaagagcaccccaaccactaccaggatggtggtcctgccccttcttcaaaacgcagcatctcaaagagttccaacagaagcaaaccagacatccttgctaggatgccaccgaccaagatcccgaagcacaaaggagggtacgcagcaccattgccagccgtgagcgtccccgaggagcaccagtggtcaaggaaagtgacgtacgaggatgacagcgaggagactgaggaagagggggacaacaatgttgaggatggatggagatacaacaaagctgcgagcagcgacgatgaggaaaccgaagacgaagaatgagctggtagcacccattcgttgttcagtagttgtggatataatttacatagagactttttgggggttatagttttgcattatacatgtacaatgtcaaaataaggcttgacttgttagtagacaacagaggttttagttggcctgcccgtcatgtagacgtctcatgacttcagaaattataattagtcattgttgcaaaaaaaaaaaaaaaaaaaa

SEQ ID NO: 8084 - protein, 347 aa, Panicum virgatum
  misc_feature: Ceres CLONE 1987813
  misc_feature (1)..(26): Pfam Name: zf-C2H2 Pfam Description: Zinc finger, C2H2 type
MQAAARRRFRWVKEWVPQDLVVAGGPCALFKWVREDRLVALKAKDKEQGAESAIPEPNTEVLFLCSYEGCGKTFFDAGALRKHAHVHGERQYICHYENCGKKFLDSSKLKRHFLIHTGEKNFVCPHEGCGKAFSLDFNLKAHMKTHSADNYHVCQYPECGRRFTQESKLRAHIRAQHEKVVGLQNPGPSTVNHSALGDYHQPPKPFKVSATPPAPSAERPYVCPYEGCDKAYIHEYKLNLHLKKEHPNHYQDGGPAPSSKRSISKSSNRSKPDILARMPPTKIPKHKGGYAAPLPAVSVPEEHQWSRKVTYEDDSEETEEEGDNNVEDGWRYNKAASSDDEETEDEE

SEQ ID NO: 8085 - DNA, 1060 bp, Panicum virgatum
  misc_feature: Ceres CLONE 1988046
  misc_feature: Encodes the peptide sequence at SEQ ID NO. 8086
acccaacacgagaaatgaaccagttcctcccctcccagcaatcggcgctcaccatggactccgcggaccgcacggccgccaacgccgaccccgccgcggccatcggcgacgacgacgacggcgtccccgaggtagccgcctgcatatcgtcgatgatcgaccgcgggggcagcgtcgagagccaccgcctcttcctggcgcgccgcaccgcgctggagatgctccgcgaccgcgggtacagcgtcccggaggacgagctcgcgcgcaccctcccggagttccgcgcctggtgggccgacaagcccgagctcgaacgcctcgccttctccactactctcgcctccgacccgtccaacaaggtgaaagttgtgttctgtccacctgaacctgtcaaaattgcacttatcagggagatatataacggagtcaaagaagagaacttgtctagacttattctgatattgcagagcagaataatgtctagagccaaggaatctattaaagacatcttcccatttaaagttgacacattccagatcacggaactactggtgaacattactaagcatgtcctgaagcccaagcatgaagtgttaactgcagaggagaaagccaagctcctgaaggaatacaatgtggtggattcacagttgcctcgcatgctggagactgatgctattgctcgctaccacggccttggcaagggaactgttgttaaagttacctatgacagcgagcttaccgggaaccatgtgacgtacaggtgtattttctgaggggctgtggttttccgtagatgaagtttctgataagcagttggtaaaataacttctcagcagatgataccgcccttctaggccagtgtaaggccagtgtaagcaccctactatgtaggatgaccttctctgtaaggtgtcggtaaaaattgtctcgcagcaaagttgctgccacactaggctactatattgtcctatgttatacttgtctccagtctaacactaatcttagaaacagtaacaaagctaatccggttgtgagttaaaaaaaaaaaaaaaaaaaa

SEQ ID NO: 8086 - protein, 253 aa, Panicum virgatum
  misc_feature: Ceres CLONE 1988046
  misc_feature (1)..(74): Pfam Name: RNA_pol_Rpb5_C Pfam Description: RNA polymerase Rpb5, C-terminal domain
  misc_feature (1)..(87): Pfam Name: RNA_pol_Rpb5_N Pfam Description: RNA polymerase Rpb5, N-terminal domain
MNQFLPSQQSALTMDSADRTAANADPAAAIGDDDDGVPEVAACISSMIDRGGSVESHRLFLARRTALEMLRDRGYSVPEDELARTLPEFRAWWADKPELERLAFSTTLASDPSNKVKVVFCPPEPVKIALIREIYNGVKEENLSRLILILQSRIMSRAKESIKDIFPFKVDTFQITELLVNITKHVLKPKHEVLTAEEKAKLLKEYNVVDSQLPRMLETDAIARYHGLGKGTVVKVTYDSELTGNHVTYRCIF

SEQ ID NO: 8087 - DNA, 1303 bp, Panicum virgatum
  misc_feature: Ceres CLONE 1988182
  misc_feature: Encodes the peptide sequence at SEQ ID NO. 8088
aacactagtctggacccagaagtgtgccgagcagacaaccagatcgaagcgactcctatcctgttggtcgatcgaggagatcgtggaacacgctcatggagggcacaatctccaatccgctgggcacaaggattgccgtggtcaccggcgggaacaaggggatcgggctcgaggtgtgccggcagctggccgccagcggcgtcaccgtcgttttgacggcccgggacgagacgaggggcgcggacgccgtggagaagctccgagagcagggggtcgtcggcgtcatcttccatcagctcgaggtcaccgatgcttcgagcatcgctcggctggcggagttcctcaagacccgtttcgggaggctagacatcctggtcaacaacgctgccgttggcgggatcgagcctgtagacgatccgtcttttggtccaaaacccgtgggcgaacagttcgatggcatggattggcaccagagaattggatggatgtataaaaacagccggccgacctacagcacggcgaaggagggcctgcagaccaactactacggcacaaagcacatcaccgaggctcttctgcccctcctgcaatcctcctccgacggcagggttgtaaacgtgagctccggctttggtttgctaagatacttcaggagcgaggagctgaagcaggagctgaacgacgccggcaacctcaccgaggagaggctggacgagctgctggacacgttcctcaaggacttcgaggctggggcgcccgcactggaggctcgcgggtggccggacgagttcgcgtcgtacaaggtggccaaggcggccgtgaacgcctactcgaggatcatggcgaggaggcacccggagctgcgcgtcaactgcgcgcaccccggctacgtcaggaccgacatgaccaggaactcggggctcctgacgcccgaggagggggcgagcaatgtcgtgaaggtggcactgctcccctccggtgggccgaccggcgtgttcttcgcgatggggaaggaggcgtcgttcctctgacggtgacttaacactagccactgcacgtgcggctctgttaaagtcgaataaactattgaaaatttatctgattcattcaatgccattaaaatttagatcatctcatcgctgccattgaaattgtatcatcatcccttcaaacctcggtagcacatagtttcggggttcaacttctctggaaccgaatattctaggatttaacagtactgtacttgttagaaatatagacagttttcggtatattttaattccaaaaaaaaaaaaaaaaaaaa

SEQ ID NO: 8088 - protein, 311 aa, Panicum virgatum
  misc_feature: Ceres CLONE 1988182
  misc_feature (1)..(84): Pfam Name: adh_short Pfam Description: short chain dehydrogenase
MEGTISNPLGTRIAVVTGGNKGIGLEVCRQLAASGVTVVLTARDETRGADAVEKLREQGVVGVIFHQLEVTDASSIARLAEFLKTRFGRLDILVNNAAVGGIEPVDDPSFGPKPVGEQFDGMDWHQRIGWMYKNSRPTYSTAKEGLQTNYYGTKHITEALLPLLQSSSDGRVVNVSSGFGLLRYFRSEELKQELNDAGNLTEERLDELLDTFLKDFEAGAPALEARGWPDEFASYKVAKAAVNAYSRIMARRHPELRVNCAHPGYVRTDMTRNSGLLTPEEGASNVVKVALLPSGGPTGVFFAMGKEASFL

SEQ ID NO: 8089 - DNA, 1280 bp, Panicum virgatum
  misc_feature: Ceres CLONE 1988194
  misc_feature: Encodes the peptide sequence at SEQ ID NO. 8090
acgcagcaaacccgagcacaccaccaccattagctgccactcaaagaagaaaggaggcatcttgagtttgagtgggtaggtgtccagcaggggcgagcagctcggagctcgcggcgagccatggagaaatcgccggagaatgcgggaccggcggcgccgctgaaactgttcgggtcgtgggcgagctcctacacgcaccgcgtgcagctggcgctgcgcctcaaggggctggagttcgagtacgcggaggaggacctcgggagcaagagcggcgagctgctgcgccacaaccccgtgtacaagaaggtgcccgtgctcgtccacggcggccgcgcgctcccggagtccgtcatcatcctgcagtacctcgacgacgcctggccggagacacgcccgctcctccccgccgacgccttcgaccgcgcgctcgcgcgcttctggtgccacttcgccgacgacaagctcgggccggcggtgggcgcggtgttcgcgtcgacgggggaggaccaggaggcggcggtgcgccaggtgcacgagaacctcgccctgatcgaggcggagctccgcgacggcgcgttcaagggccgccgcttcttcggcggcgacgaggtggggctcctggacgtcgtcctcggctgcggctcctactggctcgccgtgttcgaggaggtgaccggggtgcgcctcgtggacgcagacgcgttcccgctcttccacgcctggctgcgcgacttcgaggccctggaggaggtccgcgagaccatccccgccgtcgaccgcctgctcgagtacgcccgcggcgtgcgccacatgctgctcggcctcgccggcgccggcgccgcggctgccaccccggccgaggcgcccgccgcggcggcgcccgcgccggctcccgcggctgacatcgccgtggacatctgatcgttccgcaggacgccgccgtgcgcctgccggcggcgccgtccggctgctggtgatcagtagctagcctagctagtagctatagtagcagtatggttcgccgtgtcgatggcgccatgtgtggcgtgtgggtgactgttgaggctgcgtgcccgcctcaagtgcgcgcctctgcgttctcagtgctcacgcctgaaggggcgcagtctgtcttggtgtccagtttgttttctcaacttcttcctcatgttgggtctctgtctgctgtgagtcctccctgtggttgggaatcttatgtgtatctactactagtaatctagcagtttagcttgcttgtttaaaaaaaaaaaaaaaaaaaa

SEQ ID NO: 8090 - protein, 266 aa, Panicum virgatum
  misc_feature: Ceres CLONE 1988194
  misc_feature (1)..(104): Pfam Name: GST_C Pfam Description: Glutathione S-transferase, C-terminal domain
  misc_feature (1)..(74): Pfam Name: GST_N Pfam Description: Glutathione S-transferase, N-terminal domain
MEKSPENAGPAAPLKLFGSWASSYTHRVQLALRLKGLEFEYAEEDLGSKSGELLRHNPVYKKVPVLVHGGRALPESVIILQYLDDAWPETRPLLPADAFDRALARFWCHFADDKLGPAVGAVFASTGEDQEAAVRQVHENLALIEAELRDGAFKGRRFFGGDEVGLLDVVLGCGSYWLAVFEEVTGVRLVDADAFPLFHAWLRDFEALEEVRETIPAVDRLLEYARGVRHMLLGLAGAGAAAATPAEAPAAAAPAPAPAADIAVDI

SEQ ID NO: 8091 - DNA, 1209 bp, Panicum virgatum
  misc_feature: Ceres CLONE 1988202
  misc_feature: Encodes the peptide sequence at SEQ ID NO. 8092
aaagcaacgtttcttggcgcggaagaagaaaagtcggaaggagagggagagcggaaggcgacgatgtttatccagaaggcatggaggacggcggcgtttgggctctacggcttcacccagttcaccaaatccggtttcctggaacatgccaagaaattcagagaggaagatatgcagatccggttggatggtaaaaactgcctggtgactggagcaaattctggaataggttttgctacagctgagggtttggcttcacatggtgctactgtctatatgctctgtcgtaacaaggagaggggagaggctgctctcaatcaaataagatcgaaaacaggcaatgaaaatgttcatctggagatatgtgacctctcatctatcagtgaagtcaaatcatttgcaacaaagttcacttcaatggataaaccgctccatatccttgtaaacaatgctggcttactagagcacaagcgtgagactacagcagaaggtttggagctcaattttgctgtcaatgtggcagcaacatacactttaacagagctagtgatgccaatattagagaaagcagcaccagatgctcgtgttatcacagttgcatcaggaggtatgtacactgagccactgaacaaggacctacagttcagcgaaggagactttgatgggacacgacagtatgctcgaaacaaaagaattcaggtcgcactcactgaatggtgggcagataaatacaacagcaaaggagttggtttctactccatgcaccctggatgggctgacacgcctggagtcgccaagagcttgccgggattgtcagagaagttgtctggaaacctgaggtcaaatgacgaaggagctgatacagtggtttggttggcgttgcaacctaaggagaagctgtcctcaggagctttctacttcgaccgagctgaagctccaaaacatttgaagtttgctgggaccgcagcatcacactcacagataaactccattgttggtagcattaggtccatctgtggcctccctgcgttgggatgagctgcttgatggggcaacaagagcagcaactttagctgatagagataggtattaaacgttgattcattaaaaagaaataaaaaattgatttgccccagccgggaatcgaacccgaaagaaataaaaaattgatttgccccagccgggaatcaaaaaaaaaaaaaaaaaaaa

SEQ ID NO: 8092 - protein, 324 aa, Panicum virgatum
  misc_feature: Ceres CLONE 1988202
  misc_feature (1)..(140): Pfam Name: adh_short Pfam Description: short chain dehydrogenase
MFIQKAWRTAAFGLYGFTQFTKSGFLEHAKKFREEDMQIRLDGKNCLVTGANSGIGFATAEGLASHGATVYMLCRNKERGEAALNQIRSKTGNENVHLEICDLSSISEVKSFATKFTSMDKPLHILVNNAGLLEHKRETTAEGLELNFAVNVAATYTLTELVMPILEKAAPDARVITVASGGMYTEPLNKDLQFSEGDFDGTRQYARNKRIQVALTEWWADKYNSKGVGFYSMHPGWADTPGVAKSLPGLSEKLSGNLRSNDEGADTVVWLALQPKEKLSSGAFYFDRAEAPKHLKFAGTAASHSQINSIVGSIRSICGLPALG

SEQ ID NO: 8093 - DNA, 1082 bp, Panicum virgatum
  misc_feature: Ceres CLONE 1988268
  misc_feature: Encodes the peptide sequence at SEQ ID NO. 8094
gatggtgggcttcctcagggccttcgccgccgccaccgccgccgtgcccgcagcagcagccgcagcctacgccctgtcctcctcgggcccctccacctccaagctccgcttccctctgcctgcctccttcctctccgcctccgcctccgcctcctcgacctccgggcgcgcgcccaacgccgtgcctccgatggccaccgcggccacggccgatctctcggcgcccgataaggagtcggcgcttccggagctcacgacggaattcatggtggacatgaaatgtgagggctgcattacagctgtgaaaaacaagctgcaaactcttgaaggaataaaaaacattgaagtggacttgcctaaccaagttgtcagagttcttgggtctcttccagtgaagacaatgttagatgccctgcatcaaacaggccgagatgcacgtctgattggacaggggaacccaaatgacttcttggtttccgctgctgtagctgagtttaaagggccggctgtatttggtgttgttcgtctggcccaagtcaacatggagttggctagagttgaagccacctttagtggtttatcacctggtaaacatggatggtcgataaatgagtttggggatttgacaagaggggcagaaagcactggcaaagtatataatccaccagattatgaagctgataaggctcttggtgacctgggaacactagaagctggagacaacggggaagcccatttctcaggatcaaaagagaaattgagagttgttgacttgattggccgctcggttgcgttgtatgcaactgaggacagatcagaccctggcattgcagcagccgtgattgcacgaagtgccggtgtaggagagaactacaagaagctctgcacctgtgatggtgtcaccatctgggaatcaagttaaatctgctgccagcgaattttccataatgtttgctcgcatatgttgttgtacacacattaatttagaaaaaattaaaccagcaactgaacatctggaataagcagaatacaacattgaggaataaagcctgttttccccggaaaaaaaaaaaaaaaaaaaa

SEQ ID NO: 8094 - protein, 306 aa, Panicum virgatum
  misc_feature: Ceres CLONE 1988268
  misc_feature (1)..(128): Pfam Name: Sod_Cu Pfam Description: Copper/zinc superoxide dismutase (SODC)
MVGFLRAFAAATAAVPAAAAAAYALSSSGPSTSKLRFPLPASFLSASASASSTSGRAPNAVPPMATAATADLSAPDKESALPELTTEFMVDMKCEGCITAVKNKLQTLEGIKNIEVDLPNQVVRVLGSLPVKTMLDALHQTGRDARLIGQGNPNDFLVSAAVAEFKGPAVFGVVRLAQVNMELARVEATFSGLSPGKHGWSINEFGDLTRGAESTGKVYNPPDYEADKALGDLGTLEAGDNGEAHFSGSKEKLRVVDLIGRSVALYATEDRSDPGIAAAVIARSAGVGENYKKLCTCDGVTIWESS

SEQ ID NO: 8095 - DNA, 1760 bp, Panicum virgatum
  misc_feature: Ceres CLONE 1988346
  misc_feature: Encodes the peptide sequence at SEQ ID NO. 8096
accatcggcatatttaaggccacggctcctacaccatcaaaaaaaaaccttctcaagccaaaggccaccgcatactacaatggcttcagctgcaaagcagagcaagaagctgcgcatccttgtgatgcccttcttcgccaccagccacatcctccccttgacagaccttgccttccacctcgccgcagttaggccggacgatgtcgaggtcgtcgtcgccgtaaccccggcaaacgcccccattgttcggtcagcccttgcaaggcgtgagccgagccatgccagcgtcgacgtcgccacctacgccttcccagcggtggacggcctcccaccaggggtcgagaacatgtccaccgtctcagccgcggactcatggcggctcgagatagcagccactgatgaggcgctgctcaggccggctcaggagagtctcatcagggagagctcccctgacgccatcgtcagcgacctgcacttcttccggtggaacgctggtactgccgccgaacttgggatcccctgtgttcttttcaatgtcgtgggtattttctcgacgctagctacgtggcgccttgccttaagcggcaatgttaaggacacccctgctggtagttcggtgaccattcctcagatccccggtccagaaataagtatgccagttaccgagctatcagagtttttgaggaacccaccggtatttgacccgagcgcaggtgctcacttcatgatgttgcttaagagttgtggctttatctccaacactttctttgatcttgagcatgagtactgtgagagccacgagcacagcggctatgtgaagcgaacctactgtgttggcccgctttcactgcccatgtcaccaccagcaagagccggtgctgctggcagatcagcttgcctggattggctggacacaaagcctgcccactccgttgtatacctgtgcttcggcagcctgacaaacttttcggaggctcaacttgatgagctagccctcgggctagaagcctctggtgtgccgttcttgtgggttgtcagggttaaaacatgggaaccaccggtagggtggaaagatcgtgttgggagcagaggcatggttttcaagggttgggcaccacaaaccgacatactccagcacccagcgctgggggctttcgtgacgcaatgcgggtggaactccgtcctggagacaattgcggtcggcgtgcctgttctgacatggccaatggtgtacgagcagttccttactgagaggtttgtgactcatgtgctacaaatcggggagcgcctgtggccggagggcgctgggcggcgtagcacgaggtatgcagagcatgatgtgatccctgctaaggacattgcgcaatctattgccaagttcatggagcatggaggtgctgcggaagccgcgaggaggagggcaatggaactctctccaaaggctcatgcggctattgcagaaggcggaacctctagccgtgatctgcatcagcttattgatgattttatagcagcaagagggcctacaacgtcatgaatacattgagaatccaggtggaacgcacggattaatttcatgaagaggggggaggtggctacctatagatgccacatggtgtttcaagaataaaagttgttgtcccgcaaccggttcactgcaaaatgtgtctgcgagcagacatctcagagatgatatgtatttgtaattttaataaactagttgaatgcccatgcattgctaaaaaaaaaaaaaaaaaaaa

SEQ ID NO: 8096 - protein, 485 aa, Panicum virgatum
  misc_feature: Ceres CLONE 1988346
  misc_feature (2)..(125): Pfam Name: UDPGT Pfam Description: UDP-glucoronosyl and UDP-glucosyl transferase
MASAAKQSKKLRILVMPFFATSHILPLTDLAFHLAAVRPDDVEVVVAVTPANAPIVRSALARREPSHASVDVATYAFPAVDGLPPGVENMSTVSAADSWRLEIAATDEALLRPAQESLIRESSPDAIVSDLHFFRWNAGTAAELGIPCVLFNVVGIFSTLATWRLALSGNVKDTPAGSSVTIPQIPGPEISMPVTELSEFLRNPPVFDPSAGAHFMMLLKSCGFISNTFFDLEHEYCESHEHSGYVKRTYCVGPLSLPMSPPARAGAAGRSACLDWLDTKPAHSVVYLCFGSLTNFSEAQLDELALGLEASGVPFLWVVRVKTWEPPVGWKDRVGSRGMVFKGWAPQTDILQHPALGAFVTQCGWNSVLETIAVGVPVLTWPMVYEQFLTERFVTHVLQIGERLWPEGAGRRSTRYAEHDVIPAKDIAQSIAKFMEHGGAAEAARRRAMELSPKAHAAIAEGGTSSRDLHQLIDDFIAARGPTTS

SEQ ID NO: 8097 - DNA, 1336 bp, Panicum virgatum
  misc_feature: Ceres CLONE 1988393
  misc_feature: Encodes the peptide sequence at SEQ ID NO. 8098
cccttccccccttgtctcggactctctctcctcccttgctcttccttccctggcggcggcgccgactgcgagatcggcggcgacattccgtcacgtcttcgcccagtccttttccggcgccgagcatccaccaggagacttcagggggtttcgcaacaatgtcctggtgcacgattgagtctgaccctggtgttttcaccgagttgattcagcaaatgcaagtgaaaagtgtgcaggtggaagaactttactctcttgacgtggactctcttagtgaactgcggccagtatacgggctaatttttctcttcaagtggatacctggggaaaaggatgaacggcctgttgtcagagatcctaatccaaaccttttctttgctcaacaagtcatcaataatgcatgtgctactcaagctattctctcagttctcatgaatcgcccagaaattgacataggtccagaactatctcaactgaaggaattcacaggagctttcacacctgatctgaagggcttagctatcagcaacagcgaatctattcggacagctcataacagttttgcaaggccagagccattcatttccgatgagcagagagcagcgactaaggatgatgatgtgtaccatttcataagttatttaccttttgaaggtgtcctctatgagctggatgggctgaaggaagggcctgtgaaccttgggcagtgcgatggttctgatgaccttgattggctacggatggtgcagccagttattcaagaaaggattgagcgctattcacagagtgagattcggttcaatctcatggcaatcataaagaataggaaagaggtgtacagtgctgagctggaggaactggagaagaggagggagcaaattttgcaggagatgaacaatacttccgccacagaatccttgaacaactcgcttacagaggtgatatcagcaattgagacagtcagcgagaagatcatcatagaagaagagaagttcaagaagtggaagacggagaacatccggaggaagcacaactatatcccgttcctgttcaacctgttgaagttgctcgcagaaaagcagcagctaaaacctctggtcgagaaggccaagcagcaaaagtcatcaagcgctagcactagatgatggtgaaatgtcataggccggtagactgatgtatcaggtgccaagggttagagaaatcattgctaaggttatagaccatcttgctcgctgtggtgtgttgtcaactgcgccagttttggtgagcacgcacgttgtggaaacggtcaaattggttgtttattttgtcagtttaaaaaaaaaaaaaaaaaaaa

SEQ ID NO: 8098 - protein, 328 aa, Panicum virgatum
  misc_feature: Ceres CLONE 1988393
  misc_feature (1)..(207): Pfam Name: Peptidase_C12 Pfam Description: Ubiquitin carboxyl-terminal hydrolase, family 1
  misc_feature (3)..(323): SWISSPROT Homolog: EC 3.4.19.12 Ubiquitin carboxyl-terminal hydrolase isozyme L5
MSWCTIESDPGVFTELIQQMQVKSVQVEELYSLDVDSLSELRPVYGLIFLFKWIPGEKDERPVVRDPNPNLFFAQQVINNACATQAILSVLMNRPEIDIGPELSQLKEFTGAFTPDLKGLAISNSESIRTAHNSFARPEPFISDEQRAATKDDDVYHFISYLPFEGVLYELDGLKEGPVNLGQCDGSDDLDWLRMVQPVIQERIERYSQSEIRFNLMAIIKNRKEVYSAELEELEKRREQILQEMNNTSATESLNNSLTEVISAIETVSEKIIIEEEKFKKWKTENIRRKHNYIPFLFNLLKLLAEKQQLKPLVEKAKQQKSSSASTR

SEQ ID NO: 8099 - DNA, 1363 bp, Panicum virgatum
  misc_feature: Ceres CLONE 1988512
  misc_feature: Encodes the peptide sequence at SEQ ID NO. 8100
acgaaggggggcgaccggtatgtctcctccgtcctagcgtcctttttccccgctcgctgttgccctgccgccattcccgatcgatcgagagggagtgcgtcggagaggagaggcccagccgcggtcggagatgggaggcgcggctgcggggaccaagtggatccaccacatcaagcgcctcagcgcgaccaaggtgtcggcggaggtggtggaaatggggcagagccgggtcatcgacgcctccctcacgctcatccgcgagcgggcaaagctcaaggcagagttgctgcgtgctctgggtggtgtgaaagcttcagcttcacttttaggggttcctcttggtcacaactcatcctttctacaaggccctgcatttgctcctccacgcataagggaggccatttggtgtggaagcacaaactctagcacagaagaaggcaaagaattgaatgatcctcgggtgctaactgatgttggtgatgtccccattcaagagatccgtgactgtggtgtcgaagatgatagattgatgcatgtaattagtgagtctgtcaaaacagtgatagaggaggagcctcttcgaccattggtgttaggaggcgatcactcaatatcctatccagtggttagagctgtgtctgaaaagcttggtggacctgttgacattcttcatcttgacgcacatccagatatctatgattgtttcgaaggaaacacttattcacatgcctcttcatttgccagaataatggaaggtggttatgccaggagacttctacaggttggattaagatcgattacgaaagaaggacgtgaccaagggaagagatttggtgtggaacagtatgagatgcggaccttctcaaaggaccgcgagaagcttgagaatctgaaacttggggaaggcgtaaaaggagtgtatatctcagttgatgtggactgccttgacccggcgtttgctcctggtgtctcccacattgagcccgggggtctctcatttcgcgacgtgctcaacatcctccagaatctgcagggcgatgttgttggcgctgatgtggtggagttcaacccgcagcgcgacacagtggatgggatgacagctatggttcccgcgaagctggtccgggagctcactgctaaaatctccaagtgaaccaatgactttttttttgaataaaagtgaaccaatgactgaaagtggattgtgctagctatcggtcttcgctactgtggatgagccatggaggatttgacatgtgacatgtgacaaggatatgtaaattaggttgcatgtaatactggaaagcttcccccatctaaaaaaataatttaaaagttctctcaaaaaaaaaaaaaaaaaaaa

SEQ ID NO: 8100 - protein, 340 aa, Panicum virgatum
  misc_feature: Ceres CLONE 1988512
  misc_feature (2)..(281): Pfam Name: Arginase Pfam Description: Arginase family
  misc_feature (2)..(274): Pfam Name: Arginase Pfam Description: Arginase family
  misc_feature (3)..(281): Pfam Name: Arginase Pfam Description: Arginase family
  misc_feature (1)..(281): Pfam Name: Arginase Pfam Description: Arginase family
  misc_feature (7)..(340): SWISSPROT Homolog: EC 3.5.3.1 Arginase
MGGAAAGTKWIHHIKRLSATKVSAEVVEMGQSRVIDASLTLIRERAKLKAELLRALGGVKASASLLGVPLGHNSSFLQGPAFAPPRIREAIWCGSTNSSTEEGKELNDPRVLTDVGDVPIQEIRDCGVEDDRLMHVISESVKTVIEEEPLRPLVLGGDHSISYPVVRAVSEKLGGPVDILHLDAHPDIYDCFEGNTYSHASSFARIMEGGYARRLLQVGLRSITKEGRDQGKRFGVEQYEMRTFSKDREKLENLKLGEGVKGVYISVDVDCLDPAFAPGVSHIEPGGLSFRDVLNILQNLQGDVVGADVVEFNPQRDTVDGMTAMVPAKLVRELTAKISK

SEQ ID NO: 8101 - DNA, 1606 bp, Panicum virgatum
  misc_feature: Ceres CLONE 1988535
  misc_feature: Encodes the peptide sequence at SEQ ID NO. 8102
aaactcaggtagctcatccgcacttaggatcgcagtcgcagcccaagagcgagcgagagagagagagagagagagagccatggccaagcctcacatcctcgtgctgccgctgcagttccagggccacgtcacccccctcatggagctctcccaccgcttggtcgaccacggcttcgaggtcacgttcgtcaacaccgaagtacctcacgcgcgggtcgtcggcgcgctgcaggcggcgggcggcgcggcgacgctggccggcatccacctagcgtccatcccggacgggctggaagatggggaccgcatggacgtcggcaagatcgccgactcctacgaccggcacattccggggcacctggagcggctcatcgccgaaatggaggcgtccgggaggcccaaggtgaagtggatcgtctgcgacgtgtacatgttgtcgtccttcctcgtcgccaaaaagtttggcatccgcgtggccgcagtctgggcgacggcggcggcgtgcttagccattagtacgaagatccccaagctgatagaggatgggctcgtcaacgacaagggttctccagagcgtgatgagatggtccagtttgcccccggaattccgccggtccacacgtcgcagctgccgtggatcaatgtcatcccgctcgagtggcaaaggtccttattcgatctgtacaagcagaccgagaggctcagcgccctcgtcgagatggtggtgtgcaactctttcagtgagctcgaggccggcgcgttcacgctcctgcccaacgtcctgcccatcgggcccctgacctccgacagggagctccagaagcccgtcgggcagttgctgccggaggacacccggtgcctcccgtggctcgatgcccagcccgacgggtccgtcgtgtacgtggcgttcggcagctcgaccttcttcgacccgcgccagttccgagagctcgcggaggggctgcagctcaccggccggccgttcctctgggtggtgcgcacggacttcaccaccggcgacgtgagcaaggcgtggttcgacgagttcaaggcccgcatcgcgggcgcgggaatggtggtcagctggtgcccccagcagaaggtcttggcgcaccgcgcggtggcgtgcttcgtgtcgcactgcggctggaactcgatcatggagggtgtcaggaacggcgtgccgttcctgggctggccctacttcgccgaccagttcctggaccggaactacgtcaccgacgtgtggcggaccggcctggccgtgtcgcccggcgcggacggggtcgtgaccaaggaggagctgaggagcaaggtggagcaggtcatcggcgacgacgagatcagggagcgggcgcggctgctcagggacgcggccggccgggccatcggcgaggggggagcctcgtacgagaacttccgaaagttcgtggatctgctgcgtgaatgagagtcgtcgccggcgctctctgcacgccaagggaatcccgtgctcgctcgcagatgagcttgtagctgtggtgtgctgctgttctgattgggcaaggacccttgtttaataatcagaaattcagaataatgtttccaaaaaaaaaaaaaaaaaaaa

SEQ ID NO: 8102 - protein, 456 aa, Panicum virgatum
  misc_feature: Ceres CLONE 1988535
  misc_feature (1)..(166): Pfam Name: UDPGT Pfam Description: UDP-glucoronosyl and UDP-glucosyl transferase
MAKPHILVLPLQFQGHVTPLMELSHRLVDHGFEVTFVNTEVPHARVVGALQAAGGAATLAGIHLASIPDGLEDGDRMDVGKIADSYDRHIPGHLERLIAEMEASGRPKVKWIVCDVYMLSSFLVAKKFGIRVAAVWATAAACLAISTKIPKLIEDGLVNDKGSPERDEMVQFAPGIPPVHTSQLPWINVIPLEWQRSLFDLYKQTERLSALVEMVVCNSFSELEAGAFTLLPNVLPIGPLTSDRELQKPVGQLLPEDTRCLPWLDAQPDGSVVYVAFGSSTFFDPRQFRELAEGLQLTGRPFLWVVRTDFTTGDVSKAWFDEFKARIAGAGMVVSWCPQQKVLAHRAVACFVSHCGWNSIMEGVRNGVPFLGWPYFADQFLDRNYVTDVWRTGLAVSPGADGVVTKEELRSKVEQVIGDDEIRERARLLRDAAGRAIGEGGASYENFRKFVDLLRE

SEQ ID NO: 8103 - DNA, 1360 bp, Panicum virgatum
  misc_feature: Ceres CLONE 1988538
  misc_feature: Encodes the peptide sequence at SEQ ID NO. 8104
atccatccatccctccctctcggcagtcggcactcgccttctgctcttcgtagtcgtatagaacaccacttgccttggtttcaaaaaaagaaaaagaaaaaaaaagaacaccacttgcctcgacctctccagcgccggccacacctcgcggggaaccggaaagcttgttgcgcagctgccacagccgccggctgggaagaggcgaggtctctactgctccgtgggagcacaaaagcttggcgcgcgatgatgtcgtcggtgccggtgccggagatgttcgccgtggaccagcacctcgcgccgcagcagccggcggcggtggagcaggagcagctctgctacgtgcactgcaagtgctgcgacaccatcctcgcggtgggcgtgccgtgcagcagcctgttcaagacggtcaccgtgcggtgcggccactgcggcaacttgctctccgtcaacctccggggcctcctgctgccgacggcggcagccgccaccaaccagatccccttcggcggcggccagcagcaggctctcctctcccccacctccccgcacggcctacttgacgagatgatgctgccgttccaacaagcgccgagcctgccgagtgctgaaccggcgagcgcctgcgtgagcaccatcaccagcatcaacaacagctgcggcggcggcaacaacgacgcgccggtcatgttgtccatggcgccgccgccgcaggtgaaacctgcaccgcaggagccgcagctgctgcccaagagcacggcgtcagggaataaatcttcagagaagcggcagagagttccttctgcatacaaccgattcatcaaagatgagatccagcgcatcaaggccagcaatccggacatcacccacagggaggctttcagcgcagctgccaagaattgggcccatttcccacagatccatttcggtctcatgccggatcagggcctgaagaagacctctatccaaagtcaggagggaggtgaatacatgcttttcaaggatggtctctatgcagctgcggcggcagcggcagccgccgccgcagcatctaccatgggcattgctcccttttgaccttcgaccggcgggaaatgatctacctttgtgcttctgctttcatcatatgctagggttctgcctcggaccctcggtccctcgatatcccggcatcccgctgctagtttaagtactagctctaattaatgtttactctctagaggatctcgaaatgtatctcagtaaccgtatctatgtgttgttctcttttttctgggaagatgatgctgccgtgcgtatgttgcctctcatatatattatatggacataattctagccggaaaaaaaaaaaaaaaaaaaa

SEQ ID NO: 8104 - protein, 276 aa, Panicum virgatum
  misc_feature: Ceres CLONE 1988538
  misc_feature: The sequence is a functional homolog of  SEQ ID NO 1151 in the  10/666,642 US patent application
  misc_feature: Useful for making plants with modulated growth and phenotype characteristics
MMSSVPVPEMFAVDQHLAPQQPAAVEQEQLCYVHCKCCDTILAVGVPCSSLFKTVTVRCGHCGNLLSVNLRGLLLPTAAAATNQIPFGGGQQQALLSPTSPHGLLDEMMLPFQQAPSLPSAEPASACVSTITSINNSCGGGNNDAPVMLSMAPPPQVKPAPQEPQLLPKSTASGNKSSEKRQRVPSAYNRFIKDEIQRIKASNPDITHREAFSAAAKNWAHFPQIHFGLMPDQGLKKTSIQSQEGGEYMLFKDGLYAAAAAAAAAAAASTMGIAPF

SEQ ID NO: 8105 - DNA, 1388 bp, Panicum virgatum
  misc_feature: Ceres CLONE 1988541
  misc_feature: Encodes the peptide sequence at SEQ ID NO. 8106
aagcaagcgaccaccaagaacgcgagcagccagcgcagtgatcacaagggccggcaggcagcagctcagctctagtatgccactgcccatggcggcccccgcgatggctccagcggcgccctccttccccaggctgaggatgccgccgccgcccgcgatcatcacgctcccggacgccgcggtcccggtgccgccgccgccgctctcggtcgtgggcaggcagcgcgtcgcggccaagagcaaggccgtcgtggtgctgggcgccacggggaccggcaagtcgcgcctcgccatcgacctcgccctgcgcttcggcggcgaggtcatcaactccgataaaatgcagctgtacgccggcctggacgtggccaccaacaaggtggcgccccacgagtgcgcgggggtgccgcaccacctgctcggcgtcgcgcacccggacgccgagttcacggccgcggacttccgccgcgaggccgcgcgcgctgcggccggggtcgccgcgcggggtcgcgtccccatcatcgcgggagggtccaactcgtacgtcgaggagctcgtggagggcgcccgccgcgcgttccgggagcgcttcgactgctgcttcctctgggtggacgcgcagctccccgtgctgcacgacttcgtcgcccgccgcgtcgacgagatgtgccggcgggggctcgtcgaggaggtggcagcggcgttcgacccccgccgcaccgattactccaggggcatctggcgcgccatcggcgtgccggagctcgacgcctacctccgctcgcgcggcctcgagcacgtcgacgacgacgagcgcgcgcgcatgctcgccgcggccgtcgacgagatcaaggccaacacgtcccgcctcgccttccgccagcgcggcaagatccagcggctcgcgcgcatgtggcgcgtccgccgcgtcgacgccacggaagtgttcctgaagcgcggccacgccgccgacgaggcctggcagcggctcgtcgccgcgccatgcatcgacgccgtccggtccttcctgcttgaagaccaagaatacagtagcatggtcaccgccgccaaagcctccatctttgcctccacggccgccgccgtcgcagccgcggttgcctaacacatggaacgctgccgggccggagcacacgaccatcttgatgccattggcgtcgtcgcagatcgagctcatcagctcaggaaaggtagcaagaccggaatggctgcatgctctgctgcggtcaagctcgcggtgaccgggcagagtagccgcctgttcatacttcatatatagttgaccgaccctgttccggggggggggggggagtaattgttttctcccccattttctctgtaattttgtacggcgatgatcggttgagtgc

SEQ ID NO: 8106 - protein, 348 aa, Panicum virgatum
  misc_feature: Ceres CLONE 1988541
  misc_feature (1)..(190): Pfam Name: IPPT Pfam Description: IPP transferase
MPLPMAAPAMAPAAPSFPRLRMPPPPAIITLPDAAVPVPPPPLSVVGRQRVAAKSKAVVVLGATGTGKSRLAIDLALRFGGEVINSDKMQLYAGLDVATNKVAPHECAGVPHHLLGVAHPDAEFTAADFRREAARAAAGVAARGRVPIIAGGSNSYVEELVEGARRAFRERFDCCFLWVDAQLPVLHDFVARRVDEMCRRGLVEEVAAAFDPRRTDYSRGIWRAIGVPELDAYLRSRGLEHVDDDERARMLAAAVDEIKANTSRLAFRQRGKIQRLARMWRVRRVDATEVFLKRGHAADEAWQRLVAAPCIDAVRSFLLEDQEYSSMVTAAKASIFASTAAAVAAAVA

SEQ ID NO: 8107 - DNA, 1535 bp, Panicum virgatum
  misc_feature: Ceres CLONE 1988553
  misc_feature: Encodes the peptide sequence at SEQ ID NO. 8108
aaacgcctgcctggtcgcaatccctccctctccccccactttcttcttctccgtcgtcctctcctcttataagaagcagccagccgccttgcttgtcgcttggccctcctccacctcctcgttccgcccccgccccatcaccgccgcgccgcctatacaacagggagaggtcgagaggaggatcgatcgatccagacacccagctcgccgtcgtcgaccagaaccagccagccaccgccaggatgaagggcggcgacgtgagcagcattagcccgctcgtctccttcgtcctcggcgccgccatggccaccgtatgcgtcctcttcttcatgtccgccagccccacacgccgcctcgcagacatctccgccttcacctccggaaacgccaccaacgacgacctacgcctcgcctcctcctcctcctccgacaacggcgtggccgacggcaacgccgaggtcaccgcaacccccgcgccggcgccggctccggtgcaggcgccgtcgccttggggcgaccttgaggaggtgctgcggcgtgccgcgaccaaggatcggacggtgatcatgacgcagatcaacgcggcgtggacgcgcccgggctccctgctggacctcttcttcgagagcttccgcaccggggagggcggcgtggcgcggctgctggagcacctggtgatcgtgaccatggacccggccgcgtaccagggctgccaggccgtgcaccgccactgctacttcctccgcacctccaacggcgtcgactaccgctccgagaagatgttcatgagcaaggactacctcgagatgatgtggggacgcaaccgattccagcagacagtcctcgagctcggatacaacttcctattcacggacgttgacgtgatgtggttccgtgacccgttccggcacatctccatggcggcggacatcgccatctcgagcgacgtgtacatgggcgacccctacagcctgcgcaacttccccaacggcggcttcctcttcgtgcggtcgtcggccaagaccatcgacttctaccacgcgtggcagcaggggcggtggcgcttcttcgggaagcacgagcaggatgtgttcaacctcatcaagcacgacatggccgccaagctcgacctcgccatccagttcctcgacaccacctacatcagcggcttctgccagctcagcaaggacctcaacaagatctgcacgctccacgccaactgctgcgtcggcctcggcgccaagctccacgacctccggggggtcctcgacgtctggaggaactacaccgccggcacgccccaggaccgacgcgccggaaagttccagtggaagctcccgggaatctgcatccactgatcgatcgtcctttgctagctagcagagctatactatatagctaggtccgatggtgatccatcatattcgttttcgatggtcgagatcggccgcgccggctgcctgccaggctgcttgttgcattattgtccattctttcgctgctgcttctttcttcaaaaaaaaaaaaaaaaaaaa

SEQ ID NO: 8108 - protein, 371 aa, Panicum virgatum
  misc_feature: Ceres CLONE 1988553
  misc_feature: Great-hit functional homolog of the protein sequence given in SEQ ID NO 9753
  misc_feature: Useful for making plants with modulated biomass
  misc_feature: The plant is abnormally small.
MKGGDVSSISPLVSFVLGAAMATVCVLFFMSASPTRRLADISAFTSGNATNDDLRLASSSSSDNGVADGNAEVTATPAPAPAPVQAPSPWGDLEEVLRRAATKDRTVIMTQINAAWTRPGSLLDLFFESFRTGEGGVARLLEHLVIVTMDPAAYQGCQAVHRHCYFLRTSNGVDYRSEKMFMSKDYLEMMWGRNRFQQTVLELGYNFLFTDVDVMWFRDPFRHISMAADIAISSDVYMGDPYSLRNFPNGGFLFVRSSAKTIDFYHAWQQGRWRFFGKHEQDVFNLIKHDMAAKLDLAIQFLDTTYISGFCQLSKDLNKICTLHANCCVGLGAKLHDLRGVLDVWRNYTAGTPQDRRAGKFQWKLPGICIH

SEQ ID NO: 8109 - DNA, 1229 bp, Panicum virgatum
  misc_feature: Ceres CLONE 1988578
  misc_feature: Encodes the peptide sequence at SEQ ID NO. 8110
ttccccatttcctcaagcttcctgctcattaagcattatagtccccgggtcgcctccgcttcctttcatctaagtccttgttctcccctctccttcttacattcaggtcctcgtagttcttttcctgaagaaactcttgctcccagcccccttaggttactcggattctagttcaccggtccctcgtctcgtctctagatccgggcacctcgccggccgaccccatgtttacctacccgttcctctgacgatccccatcgttcgatgaagactcgcgtgctccgccgccgccgctcccactccttctccgttgccttcctgtactggttctacgtcttctcatgaactcatcgccctctcccaagaacaccagcctctaccgagttgattagatctctttctttcttagtttcttgtctctcttgaattcttttgtcctagtttccaaagaaaagtccgttttttgaactgggtttgattgagaagaagaagatccacgtcccgaccatgtcgtcccgccggagctcgagcccggatagccacaccgatggcagcggcgggttcgccgccgacgagcgcaagcgcaagaggatgctctcgaacagggagtctgcgcgccggtcccgcgcgcggaagcagcagcggctggaggagctggtcgccgaggtggcccgcctccaggccgagaacgcgcaggtgcaggcgcggatcgccaccttcgaccgcgagctgagcaaggtggacggcgagaacgccgtgctgcgcgctcgccacggcgagctggcggggagactggaggcgctcggcggcgtgctggaggtgttccagatggccggcgcccccgtcgacattccggagatccccgacccgctgctccgcccgtggcagccgccgttcccgctgcagcccatcgccgctgacgccttccagtactgagccggcgtcattgacaagagctatcctgaactgaagatatggccgtgccactactagcttttactagtactacaagattgctagctatgtcctccgctgctagtttgtgtggttgtggctgccttctgatatttatcacagtaatttgcgtgtggttgtggctgccacaattcatgttccgttttatggtatttgtcacaataatttgtgtgtggttgtaattttatcatgtattgacatgtgttcccatggagcaagatgttgtggatttgtaaaaaaaaaaaaaaaaaaaa

SEQ ID NO: 8110 - protein, 142 aa, Panicum virgatum
  misc_feature: Ceres CLONE 1988578
  misc_feature: Great-hit functional homolog of the protein sequence given in SEQ ID NO 9444
  misc_feature (2)..(65): Pfam Name: bZIP_1 Pfam Description: bZIP transcription factor
  misc_feature (3)..(55): Pfam Name: bZIP_2 Pfam Description: Basic region leucine zipper
  misc_feature: Useful for making plants with altered Lignin content
MSSRRSSSPDSHTDGSGGFAADERKRKRMLSNRESARRSRARKQQRLEELVAEVARLQAENAQVQARIATFDRELSKVDGENAVLRARHGELAGRLEALGGVLEVFQMAGAPVDIPEIPDPLLRPWQPPFPLQPIAADAFQY

SEQ ID NO: 8111 - DNA, 1751 bp, Panicum virgatum
  misc_feature: Ceres CLONE 1988648
  misc_feature: Encodes the peptide sequence at SEQ ID NO. 8112
acacacacacacacacaacaatccgtcgtcctcttcttcgccagcaccaccgaagcacgctgcctccccggaggagctgctgcagcagcctcagccgcagcagccgccggagcttttggcctcagatgatatagccgagcatctaaatgagggcagcgagaacagcagcagcagcagcatcaataagcctttgaggctggatgatcccgtttcggagagctcgagctcggcggaggagagggctgcaagggagaaacctcctaaggatgactctaatgttatcaactccactttcttggtggaggaactgatagggctccagattcctgatgagatcgagcatgagaattctgtgccatcaggcactggttcatcacagatggcgggtgcagcatcacacccaccgccaccgccagctccacctccaaaaccatcatctaggaataatgggttgcggagaatggggtctggaagttcaaacagtgtgcggattggatcttcaagaaggccagtagcttggccaccagtggcagcccggacatctacttcaggttctcgcccttcttcgcctaggtcactggttgatggtgaaggatacaacagtgcagatgaacagggtccctgttacgcctcgagttatgatgattcggaaagggaccgcatgtttgagcatgacctaaggcgggtgaaagggttggaaatcagaaagatggcggaagacggtaactgtctattcagagcagttgctgatcaagtttatggagatgcggaagcttatgatatggctaggcagatgtgtgttgattatatggaaagggaacgggatcatttctctcagttcattactgaaagttttacattatactgtaagaggaaaaggagagataaggtatatggcaacaatgttgagatccaggcatttgcagagatgtacaatcgccccattcacatatattcctacagtacagagcccattaacattttccaaggaagctataacacagacgttcctccgattaggttaagttaccatcatggtaatcattataattcagtggttgatccccgtcgacagacagttggggcaggccttggatttagctccctcagagggaccaataatgttgacagggaccaggtgaaggctgctataagggctcagcaagatcagcagattgagaatgcacttttggccgaagggagattctactctgatttggagttgacagaaagggaaatagaacggatggtgatggaggcctcaagggcagagtatctggctgaggagaaaaagcttaacatcagagaatcatcaacatcaggggcagaaccatcatcttctgctgcaattagcgggtcgtctcgttcggctacagcagtagatagagggagtgatgaatgctttgtgctcccagacaccgtgctgactcgcagcatgcagctgctcctggcaatgggcttcagttacatccaggtcatggaggcctacagcatattcggcgaggatgtggactcgatgatctgctacctggtggagaccggaggccctggagcctccgcaggcagtagcaaccgccgtaaaggaaaggctgctgagtgatgtgcgcaccttccttgatgtgaatgtgatggatcggaattgttgggcataagtcataccggataatgacagccgtgtgagttgagatgtcggtgtacctgctaccttatgggtgataaataaatggaactcgcaagttgcgacttacatc

SEQ ID NO: 8112 - protein, 406 aa, Panicum virgatum
  misc_feature: Ceres CLONE 1988648
  misc_feature (1)..(112): Pfam Name: OTU Pfam Description: OTU-like cysteine protease
MAGAASHPPPPPAPPPKPSSRNNGLRRMGSGSSNSVRIGSSRRPVAWPPVAARTSTSGSRPSSPRSLVDGEGYNSADEQGPCYASSYDDSERDRMFEHDLRRVKGLEIRKMAEDGNCLFRAVADQVYGDAEAYDMARQMCVDYMERERDHFSQFITESFTLYCKRKRRDKVYGNNVEIQAFAEMYNRPIHIYSYSTEPINIFQGSYNTDVPPIRLSYHHGNHYNSVVDPRRQTVGAGLGFSSLRGTNNVDRDQVKAAIRAQQDQQIENALLAEGRFYSDLELTEREIERMVMEASRAEYLAEEKKLNIRESSTSGAEPSSSAAISGSSRSATAVDRGSDECFVLPDTVLTRSMQLLLAMGFSYIQVMEAYSIFGEDVDSMICYLVETGGPGASAGSSNRRKGKAAE

SEQ ID NO: 8113 - DNA, 1889 bp, Panicum virgatum
  misc_feature: Ceres CLONE 1988715
  misc_feature: Encodes the peptide sequence at SEQ ID NO. 8114
acttccggctgccgccgctttcgccgccccagctcgtgcgctcccaccactccgcgctccccacccggctccgctcgccactcgcgaccgcggccgaacgaaccctccacccgattccttacccctgcgtcctctccccctccgctgcttcgcctccagccgagagctcccgtcccgagggtttcaggccgcttggcccctagcgccgcgtcgccttcccgggccgccgcttttaggtgcgacctcctcatctcgtccagacgcggggcgggatcgctgggttttcctcccttcccctcggagatcgcatctctggcccgctggatccgatgagatgcgggagcggcctcgcgctccgagctcctagcaggcatggctgaagccgcggcggcgtactcgtcctcgcccggatcctccgccccgcgccgcttccatggcgccggcgtcgtcagggacgcgctcccgtacggtggcctcgccgccccgccccctccgctgccgtttcagcagctgccgccgccggtggcgcagcaggcgcagggcgcgggagggggagggggagggggagggggagggggaggcgggggcgggggcggagggaagattagccccgcggtgctcttcatcatcgtgattctcgccgtggtgttcttcatctccggcctgctccacctcctcgtgcgcgtcctcatgaagaagcagcaccgccgcggcggccgagggggccccgcgtcttcgtcgtcggcggcggcgcggggggacgccggcggggcggacgcggcgctgcagcgacagctgcagcagctgttccacctccacgactccggcctggaccagtccttcatcgacgcgctgcccgtcttcgcctaccgggagatcgtcgtgggcggcggcggcgacggcgacaaggagccgttcgactgcgcggtgtgcctgtgcgagttcgacgccgaggaccggctccgcctgctgccgctgtgcgggcacgccttccacctcaactgcatcgatacgtggctgctctccaactccacctgcccgctctgccgcggggtgctcttcgccccggggctcatgggcgacgacgaccccatgttcgatttcgaggagaggctggaggaagggaggctgtcagaggattgcgacgacgggtttggaattggattgcctgggcagaaggcttcagggttggcgcagacgccagcagatgagaagagggtgttccccgtgaggctggggaagttcaagaatgtcggaacacagggtgccgtgcaaggtggcaatgccaatgccaaccccagtgtgttgagtagggatcaaggggagagcagcagcagcagcctcgatggaaggagatgcttctccatgggcacctatcagtatgttcttggtacttctgagctccgggtagctctccaacctggccgggttaggaacggcgctggtggtgcaatgaggggaagacctgctggtctaagttcgatcaatgctgatattatggaggggaagaagatctgcgcgaggaacaaaggggaaagtttctccgtgtcaaagatttggcaatggtctaatctgaagggcaagctacctgctggttcggatgaatgttcggatgctgggagccttccatggatgaagagaggagccacggatgctctagtgaagtcactgctgcccacttcagggtcctgaaatcctttgtattttgtgagtatttgaagagttttgccttcgtttagctttgaggctcaggtaggagcatcgtaaattttgaattcatgcaactaggccatggattcatgatattcccgccttcatccttctgtggagcatagtgattgatatgtacaggaaattctaatgattgagtctgcactctctgattaagc

SEQ ID NO: 8114 - protein, 439 aa, Panicum virgatum
  misc_feature: Ceres CLONE 1988715
  misc_feature (1)..(42): Pfam Name: zf-C3HC4 Pfam Description: Zinc finger, C3HC4 type (RING finger)
MAEAAAAYSSSPGSSAPRRFHGAGVVRDALPYGGLAAPPPPLPFQQLPPPVAQQAQGAGGGGGGGGGGGGGGGGGGKISPAVLFIIVILAVVFFISGLLHLLVRVLMKKQHRRGGRGGPASSSSAAARGDAGGADAALQRQLQQLFHLHDSGLDQSFIDALPVFAYREIVVGGGGDGDKEPFDCAVCLCEFDAEDRLRLLPLCGHAFHLNCIDTWLLSNSTCPLCRGVLFAPGLMGDDDPMFDFEERLEEGRLSEDCDDGFGIGLPGQKASGLAQTPADEKRVFPVRLGKFKNVGTQGAVQGGNANANPSVLSRDQGESSSSSLDGRRCFSMGTYQYVLGTSELRVALQPGRVRNGAGGAMRGRPAGLSSINADIMEGKKICARNKGESFSVSKIWQWSNLKGKLPAGSDECSDAGSLPWMKRGATDALVKSLLPTSGS

SEQ ID NO: 8115 - DNA, 1517 bp, Panicum virgatum
  misc_feature: Ceres CLONE 1988749
  misc_feature: Encodes the peptide sequence at SEQ ID NO. 8116
atcccacatggagcggtcgccaactcccatcgatcctgatgacatccggccttaaccactggatcacctttccaagcttagattagatagattcgttcggttacagttacggactcgtacgtagtatattgtgttacggctacgggcttggagtctataaattgcaccacggacgcccagtttttctcacagcagctagcatttgcattcacattcagagtcgttgttactcggggaagatcggagttgtttcgagagctggaaatggcaccggctttgtctttcccgatcatcgacatggggcggctcgccggggaggagaggccggcggccatggacatgctgcgcgatgcgtgtgagaagtggggcttctttcagattctgaaccatggaatctcgacggagttgatggacgaggtggagcggctgaccaaggaccactacaagcgggtgcgcgagcagctgttcctcgagttcgcgagcagggcgcttcaggacggcggcggcggcggcgcgcgcggcgtcaaggcggagaacctggactgggagagcaccttcttcgtgcgccacctcccggagtccaacctcgccgagctccccgacctcgacgacgggtaccggcgcgcgatgaggcggttcgccggcgagctggaggcgctggcggagcggctgctggacctgctgtgcgagaatctcgggttggagaagggctacctcgcgcgcgccttccgcgggcccagcaagggctccccgaccttcgccaccaaggtcagcagctacccgccgtgcccgcgcccggacctcgtgagcggcctgcgcgcgcacaccgacgccggcggcatcatcctgctgttccaggacgaccgcgtcgccgggctgcagctgctcaaggacggcgcgtgggtggacgtgccgcccacgcgccactccatcgtggtgaacctgggcgaccagctggaggtgatcacaaacggcaggtacaagagcgtggtgcaccgggtggtggcgcagcccgacgggaaccggatgtccatcgcgtccttctacaaccccggcggcgacgccgtcatcttcccggcgccggcgctggtgaaggccgaggaggccgcggcggcgtaccccaggttcgtgttcgaggactacatgaagctgtacgtgcggagcaagttcgaggccaaggagccgcggttcgaggccttcaagtcagacggagagctccaactgcatcatcgccatcgcgtaactacccggcagggtatgccggagtcgggagtcctatacgtgtcactagcgtaacaatgtgttcggcatcctcgctgtgtcgtttgttcgctgttgctctgctctcgaccagcatgtgttgtagttgtgcccgtaaaagcccgttttagcgagcccccttgtgcggtttctgcctgtgttctcaagttgcaggacagaaatttatcttattttgtcttttcgaagatattagaaaaatgccacgccgttggtgccaaaaaaaaaaaaaaaaaaaa

SEQ ID NO: 8116 - protein, 343 aa, Panicum virgatum
  misc_feature: Ceres CLONE 1988749
  misc_feature (1)..(101): Pfam Name: 2OG-FeII_Oxy Pfam Description: 2OG-Fe(II) oxygenase superfamily
  misc_feature (1)..(314): SWISSPROT Homolog: EC 1.14.17.4 1-aminocyclopropane-1-carboxylate oxidase 1
MAPALSFPIIDMGRLAGEERPAAMDMLRDACEKWGFFQILNHGISTELMDEVERLTKDHYKRVREQLFLEFASRALQDGGGGGARGVKAENLDWESTFFVRHLPESNLAELPDLDDGYRRAMRRFAGELEALAERLLDLLCENLGLEKGYLARAFRGPSKGSPTFATKVSSYPPCPRPDLVSGLRAHTDAGGIILLFQDDRVAGLQLLKDGAWVDVPPTRHSIVVNLGDQLEVITNGRYKSVVHRVVAQPDGNRMSIASFYNPGGDAVIFPAPALVKAEEAAAAYPRFVFEDYMKLYVRSKFEAKEPRFEAFKSDGELQLHHRHRVTTRQGMPESGVLYVSLA

SEQ ID NO: 8117 - DNA, 1365 bp, Panicum virgatum
  misc_feature: Ceres CLONE 1988776
  misc_feature: Encodes the peptide sequence at SEQ ID NO. 8118
aaaagagttccttctttttaatcccaggtcccaggccaggctctccccaccggcgatagggagagacgacgccacaagaaaacaacaagaaatccgccgcggaattccggattaaaataaggctttctttttattcttctgcgctgttctcttgtgaggaggagaggagagagggctgcgctgggcagcaaatgcttagctcaggacatcagttttgagacgcagaggagtactgtggcagaaccatctgaattatcccggctcaagtgcgctggccatcaccataaaggcaacaccgacacaaatgcacttcaaacggaacaattcttggtctgtcgggtgtgttagattggaagttcaaacgataacttgctttaaggttcaagagcaaacgaagacatggagagggaagtcatggcctcctacgaaaccaagaaaaactgcgaagttagggcatttgagagttcatacgagatggcaacagatctggcagagtttatttcacaaatttctgaaatttctgttaaggaaagaggatactttgctattgctctctccggagggcctcttaccagacatatgcggaagctctgtgaagtaccatacaacaagacccttgattggtctaaatggtacgtcttatgggctgaagaacgtgcagtagcaaagaaccattcagaaagtaactacaaattaacaaaggaagaatttctctccaaggtgcctattcttaatggtcatgtctactccatcaacgacaacgcaacggtggaagaggcagcaactgactatgaatttgtcatcaggcagctggtcaagattcgaacagttggtgtctcggagagcaacgactgtcccaaatttgacctcattcttctgaacattggtcctgatggtcacgtagcctcattgttccccaatcatccagctcttgagctgaaagatgactgggtcacctacgtcaccgactctccagagcctccgcctgagaggattaccttcactcttcccgtgataaactcggcgtcgaacatcgccattgttgccactggagaagacaaggcaaaagctgtgtcttttgccatttccgactgtaacgaaggcctaggtgcgacatcagtacctgctaggatggttcagccaacggacgggaagttggtatggtttctggatgaggcggctgcctcatctcttgaggctgggaatgatgcttacgagcaccagtactgagagtcagacaagcgtcgaagctggacatccttttttttttttttggctgtgaatgaagaactcatgtagttgatgggttactttggacggaagaagttttgggctgggattttctaaaaaaaaaaaaaaaaaaaa

SEQ ID NO: 8118 - protein, 276 aa, Panicum virgatum
  misc_feature: Ceres CLONE 1988776
  misc_feature (1)..(238): Pfam Name: Glucosamine_iso Pfam Description: Glucosamine-6-phosphate isomerases/ 6-phosphogluconolactonase
MEREVMASYETKKNCEVRAFESSYEMATDLAEFISQISEISVKERGYFAIALSGGPLTRHMRKLCEVPYNKTLDWSKWYVLWAEERAVAKNHSESNYKLTKEEFLSKVPILNGHVYSINDNATVEEAATDYEFVIRQLVKIRTVGVSESNDCPKFDLILLNIGPDGHVASLFPNHPALELKDDWVTYVTDSPEPPPERITFTLPVINSASNIAIVATGEDKAKAVSFAISDCNEGLGATSVPARMVQPTDGKLVWFLDEAAASSLEAGNDAYEHQY

SEQ ID NO: 8119 - DNA, 1697 bp, Panicum virgatum
  misc_feature: Ceres CLONE 1988829
  misc_feature: Encodes the peptide sequence at SEQ ID NO. 8120
acgcgtcgacctcgcagcactcgcagtctctcgcatcacgagctacctccacctccaattaatccgccagctagaggcctgccactctatccttcatcttgctgcttgaaccagcgctatccgggaggggactacggggatggaagcgtactcggcgatgatggggtcgccgcccaccaaagccattgccgtggacaagctcagctgcgagatcttctccctgctcgagaccaagttcctcttcggcgccgccaatgggtgcctgtcctccggcaccgggacgccggcgcgggcgttcctcgacggcgggcgcgtgcgggtgctggccatcgacggctgcggcgcgggcgccgaggacgcgctcctggccgccgcggcgctcgccaggctcgaggccgggctgcgggagcaagccggggaccccgacgcgcgcgtcgccgacttcttcgacctggccgcgggcgccggcgcgggcggcgtgctggccgccatgctgttcctcaggggccccgacgggcggccgcggtactcggcccaggaggcgttcgcgttcgtcgccggcagcgtcgggaggaaggacggctggggcggccggcgcgggcggtgggcgaagctcctccgcggctcccggagcggcgaccgggcgctccggcgcgtgttcggcgacgcgacgctcagggacaccgtggcgccgctgctcgtgccgtgctgcgacctcgccacggccgcgccgttcgtgttctcgcgcgccgacgccgtcgagagcgacggcttcgacttccgcctcctcgacgtctgcgccgccacctgcgccgcggacggcgagcccgtcgccgtgaggtccgtggacggccgcacggccatcgcagcggcgtccgcgggagtggcggccatgggcaacccggccgcggcagccatcacgcacgtgctccacaacaagcaggagtttcccctggccaccggcgtcgaggacctcctcgtcctctccatcggctccggcgcctccgccaccgcctccgacgggtcgagaacgccgatgccgacacggtcgccgtcgccgcgggaggtggcgcgcgtcaccgccgagggcgtcgccgacatggtggacgaatcagtggccatggcgttcgggcacgcgtgcggaagcaactacgtgcgcctccaggccggcaaggcgccggtcccgctccacgcggagacggcggccgctgccgcgggagttatgcttgcgcagcggaacgtggagtcggtcctcttctgcgggcggaggttatcggaacggacgaacgccgagaaggtggacgcgctggcgacggagctggtgaaggagcgggagcgccggaggcgcagcccgctcccgaacgtggccatcaaggaggtggccgcgccgcggctgtcatcggcgacaaccgcgtcgtcggggaccgcgacggcaaggaccgcatcgacgatgccgtcgccggcgtcgtgggattctcggcggtcgttgagttgattaggccgtgatgcgatgaggatccttgtgtacatgcatgtcacaaacaagggtagagtagtgacgtgtgttcttttggataatgagccaccgacgtgtggggcgcatgttcttttgggagtcggcacacgaatgtgtctttgtctacgataccgttcgactccaaatattctttttcttaaaaaagaaagaaaccacgcag

SEQ ID NO: 8120 - protein, 451 aa, Panicum virgatum
  misc_feature: Ceres CLONE 1988829
  misc_feature (1)..(199): Pfam Name: Patatin Pfam Description: Patatin-like phospholipase
MEAYSAMMGSPPTKAIAVDKLSCEIFSLLETKFLFGAANGCLSSGTGTPARAFLDGGRVRVLAIDGCGAGAEDALLAAAALARLEAGLREQAGDPDARVADFFDLAAGAGAGGVLAAMLFLRGPDGRPRYSAQEAFAFVAGSVGRKDGWGGRRGRWAKLLRGSRSGDRALRRVFGDATLRDTVAPLLVPCCDLATAAPFVFSRADAVESDGFDFRLLDVCAATCAADGEPVAVRSVDGRTAIAAASAGVAAMGNPAAAAITHVLHNKQEFPLATGVEDLLVLSIGSGASATASDGSRTPMPTRSPSPREVARVTAEGVADMVDESVAMAFGHACGSNYVRLQAGKAPVPLHAETAAAAAGVMLAQRNVESVLFCGRRLSERTNAEKVDALATELVKERERRRRSPLPNVAIKEVAAPRLSSATTASSGTATARTASTMPSPASWDSRRSLS

SEQ ID NO: 8121 - DNA, 2020 bp, Panicum virgatum
  misc_feature: Ceres CLONE 1989145
  misc_feature: Encodes the peptide sequence at SEQ ID NO. 8122
gtcgcagagcagatgctggccgtcgcatccagaacccgatacaaatcggccaccaccatcctctcccctgctatgccattcctcctcaccaccgctaccgccaccagcaccaccagcccccgccctctcttcccctcctcccctcgccgccaaaaccctaccaccccccacctccgccccccgcctccagcccgccgcctccccggattccccgccgccgagccgggcgcccccttcctcccccacccgccgaggcgaggcatggcgtcgctggcggccgcggccgccgccgcggaggtgacgcacctcacgcagcgcgacgcggcggagatcgacgagcacctcatgggcccgctcgggttcatagtcgaccagctcatggagctcgctgggttgagcgtcgcggcggccgttgcggaggtttacaagttgagtgaagaacatacaagcgtccttatcatctgtggtccagggaataatggcggtgatggtctggtagctgctcgtcatctttatcactttgcatataggccctctgtttgctaccctaagcgtacgcccaagcctctgtattctggccttgttactcagcttgaatcacagtcgatcccattcataccggctgaagacctacctcatgacttatcaagggaatttgatattattgttgatgcaatgtttggtttctcgttccatggaatacctagaccaccctttgatgatcttatccaaaggcttgtttcattgagtgttattagaaattcagataaaaaaccagcaattgtttctgttgatattccttctggatggcatgttgaagagggagatgttgatggaggagggattaaacctgatatgctggtgtcactgactgccccgaagctctgtgcaaaaaagttcactggcccgcaccattttcttgggggtaggtttgttcccccacctattttgagcaaatatggacttaagcttcctccataccctggcacatcgatgtgcgtgagaattggaaaagctccatctgttgacatttcatctctcagggagaactatatttccccagaacttcttgagagtcaagtgatgcctgatccatttgatcagttccttagatggtttgatgaagcagtcacggctggcctgcgtgagcccaatgctatggctttaacaactgtcaacaaggagggaaaaccttcttcaagaatggttcttttaaagggtgttgataagcagagatttgtttggtacacaaattatggcagcccggaggcgcatgacttatctgaaaatcctaacgcagcactccttttctattggaatgagatgaaccgtcaggtaagagttgaaggatcagttgagaagcttccagaagaagaatcagagaaatatttccacagccgcccacgaggaagtcagcttggtgccatagtcagcaagcagagtaccttcatagctggaagggaggtccttcaacaggtgtacaaggaattggagcacaaatattctgatggtagcttgatcccaaaacctgaatactggggcggctacagattgacaccaacactttttgagttctggcaaggccaacagtctcggttgcatgaccggctacaatactcacagcgagaagtagatgggagtacagcgtggcacatcgagaggttttccccttgactgttaacatgccagtgctttggttataggcttcatcttatcaccagcattcaaatcttctccagctgcaagatgtgcaaattgccccatgatgtgagcattgcgattaggtcccgtgtttgagagccagaagctctgtttacatgccagcttcatggttaggtcccttggttatcatggtgaactgaatgagtggatgtgctttataaagccagccattctttattttacccctttcattttgttttttctttcgtaaataccaggtatgcaaatgtcatctaccgtcatcgtattgtttgtaacggtcagcatggagctgatgatgatgaataaagctggcgtc

SEQ ID NO: 8122 - protein, 553 aa, Panicum virgatum
  misc_feature: Ceres CLONE 1989145
  misc_feature (1)..(87): Pfam Name: Pyridox_oxidase Pfam Description: Pyridoxamine 5'-phosphate oxidase
  misc_feature (340)..(553): SWISSPROT Homolog: EC 1.4.3.5 Pyridoxamine 5'-phosphate oxidase
MLAVASRTRYKSATTILSPAMPFLLTTATATSTTSPRPLFPSSPRRQNPTTPHLRPPPPARRLPGFPAAEPGAPFLPHPPRRGMASLAAAAAAAEVTHLTQRDAAEIDEHLMGPLGFIVDQLMELAGLSVAAAVAEVYKLSEEHTSVLIICGPGNNGGDGLVAARHLYHFAYRPSVCYPKRTPKPLYSGLVTQLESQSIPFIPAEDLPHDLSREFDIIVDAMFGFSFHGIPRPPFDDLIQRLVSLSVIRNSDKKPAIVSVDIPSGWHVEEGDVDGGGIKPDMLVSLTAPKLCAKKFTGPHHFLGGRFVPPPILSKYGLKLPPYPGTSMCVRIGKAPSVDISSLRENYISPELLESQVMPDPFDQFLRWFDEAVTAGLREPNAMALTTVNKEGKPSSRMVLLKGVDKQRFVWYTNYGSPEAHDLSENPNAALLFYWNEMNRQVRVEGSVEKLPEEESEKYFHSRPRGSQLGAIVSKQSTFIAGREVLQQVYKELEHKYSDGSLIPKPEYWGGYRLTPTLFEFWQGQQSRLHDRLQYSQREVDGSTAWHIERFSP

SEQ ID NO: 8123 - DNA, 1360 bp, Panicum virgatum
  misc_feature: Ceres CLONE 1989171
  misc_feature: Encodes the peptide sequence at SEQ ID NO. 8124
gtcaacttccccatttcccatcccaatcactagaggctagacggattagctgcagggggccttgcctctaaccaccgctgcctgcttcagcccagatctccctccccgccgcgcgatggccgcctcccccgtcgcgcctccgccggccgcggcggacgacgagatcgtctacgagtcgatgccctgcatccgcatctacaagaaccgcgtggagcgctacttcggctccgagttcgtcgccgcctccaccgacgccgccaccggcgtcgcgtccagggacgtggtcatctcccccaaagtctccgcgcgcctctacctcccgcgcctcgagggcggggccgccaagctccccgtcctcgtctactaccacggcggcggcttctgcctcggctccgccttcaaccccaccttccacgcctacttcaacagcttcgcggcgctcgccggcgtcctcgtcgtctccgtcgagtaccgcctcgcgcccgagcaccccgtccccgccgcctacgccgactccagggaggccctcgcctgggtcgtctcccacctcgccggtcccgccaaggacccgtgggtcgcgggccacgccgacttcgcccgcctctacctcggcggcgagagcgcgggctccaacatcgcgcaccacatggcgatgcgcgtcgccgcggaggggctgccccacggcgcccagatccggggcctcgtcatgatccacccctacttcctgggcaccgacaaggtgccctccgacgacctcgaccccgtggcgcgcgagagcctgggctccctgtggcgcgtcatgtgcccggccaccaccggcgaggacgacctgctcatcaaccccttcgtggacggcgcgccgccgctggcgtccctggcgtgcggccgcgtgctcgtgtgcgtcggcgagcgcgacgtgctccgcgaccgcggccgcgcctactacgaccggctcagggccagcggctggcaaggcgaggccgcgatctggcaggcgcccaacaagggccacacgttccacctcctggagccgagctgcgacgaggccgtcgcgcaggacaaggtcatcagcgacttcctcaaccgctgactcgcctcagctcaccgccggcagtggcgtatacgcggcaatcggattgaataactgcagcttcgtcgccgatgaatgctgctagtctatttcagattcagaaattgtgtctctgtcattgcaagggggattgccattgtgttgtattgctttgggaattagtggatgctgatacagtcatacagataaattatacttgttggacgcacagaaattgttgaaatattgactggatcttcgattatacttgaaaaaaaaaaaaaaaaaaaa

SEQ ID NO: 8124 - protein, 324 aa, Panicum virgatum
  misc_feature: Ceres CLONE 1989171
  misc_feature (1)..(223): Pfam Name: Abhydrolase_3 Pfam Description: alpha/beta hydrolase fold
MAASPVAPPPAAADDEIVYESMPCIRIYKNRVERYFGSEFVAASTDAATGVASRDVVISPKVSARLYLPRLEGGAAKLPVLVYYHGGGFCLGSAFNPTFHAYFNSFAALAGVLVVSVEYRLAPEHPVPAAYADSREALAWVVSHLAGPAKDPWVAGHADFARLYLGGESAGSNIAHHMAMRVAAEGLPHGAQIRGLVMIHPYFLGTDKVPSDDLDPVARESLGSLWRVMCPATTGEDDLLINPFVDGAPPLASLACGRVLVCVGERDVLRDRGRAYYDRLRASGWQGEAAIWQAPNKGHTFHLLEPSCDEAVAQDKVISDFLNR

SEQ ID NO: 8125 - DNA, 1923 bp, Panicum virgatum
  misc_feature: Ceres CLONE 1989220
  misc_feature: Encodes the peptide sequence at SEQ ID NO. 8126
cacccacccaccaataccagcggcagtaaattccgatcagctgctgcggaggctcgaggccctccctcctcgccccccgcacccgtctcctcctcctagggtttgccctcacctcgccggcgcgtcgcctcgcctcgccattgccgcgggtgctcgcgcggggcgttccgccgctcggggcccgccgaatcgagcctcgccggagctgttcgcgctgattcgtgcgggtttttttggctttttgcggctcggcctacgggaggctccgggtgggaagggtttgacgcttgtggggggtttggatcgagggccctgagctgcgtgtccgcaatgccgggctggtcgggcggcgattgctagggttttctcggcggatttcgcgggggagagctgaggtctgcttcgggcgcgggagctgtctgcaatccgccgcgtgccttggcccgaattcggtgtttccccagcaatgcctcgccgatttgagctccctctgaggtcctgaagggcgaaggggttgccgggtgggttgtgattgcgaggagtcggtggctcgggtgcaatgtccggggctggcgcgagggggcggctgtcgccggcgtcaggcggcgctggggactccgagccgcggtccgtggggagcaggacgcgctcggtgtctgctactcgcgggcggaagccgtcgccgaggcccgggagggatgtgactgcggccgcggcggcagcggaggagaagaagccggctggcgtgcccacattgctgccctcgctcagcgcgcccgcggggatgcggcggcaggagctgctgctgcgctcgggtctgtcccttgacgcgtcctgctcctcggacgcgtccacggactcgttctgcagccgggcgtccacggggcggattgggaggccgtcgtttggggcgaggaagaagaagaccctctctcagaccgattacaaggctgtttccatgctggaaagggatggtggattggcttcccagactgatgctgctggtgtgaagaggaggtgcgcctgggtgacagcaaatactgatccctgttatgctgcgtttcatgatgaagagtggggagttccagtacatgatgacaagaagttgtttgagttgctagtgctgtcaggtgcattagctgaacttacatggccagcaattctgaacaagagagccatgttcagggaagttttcatggattttgacccagtattggtctcaaaattaagtgagaagaaaattattgcacctggaagtcctagcagttccttgttgtctgaacagaaactgcgtggtgttattgaaaatgcacgccaaatactcaagattgtagaggaatttggatcgtttgataaatactgttggggcttcgtgaaccacaaacctatattgagccggttcaggtactctcgtcaagtgcccgtcaaaacatcaaaagcagatgccataagtaaagatctggttcggaggggtttccgcagcgttggcccaacagtcgtgtataccttcatgcaagtctcaggcatgaccaacgaccacctcatctcctgctaccgatttactgaatgtgtggcggcctctgctggtgctgctaaacctactgatggaagcgaagcgagttcaagtgacagcagccatgccacgacggagctgaagatgaacgggacaaatggactggctgctgatatcgaactctccaggactatagatgagctcagcatttcatagtggttattaggaggggtgctggagcgaggtggtcttggcttgtgtattctgtgtgctgtagttgtaggtgtgattcgacgttctttacccatagtttaccacttgtcaatgtagggtagaacaatcgtagtcttgggcgtcaggacaattgaaccgacagcagtgtcatgatgcaaaaaaaaaaaaaaaaaaaa

SEQ ID NO: 8126 - protein, 389 aa, Panicum virgatum
  misc_feature: Ceres CLONE 1989220
  misc_feature (1)..(181): Pfam Name: Adenine_glyco Pfam Description: Methyladenine glycosylase
MSGAGARGRLSPASGGAGDSEPRSVGSRTRSVSATRGRKPSPRPGRDVTAAAAAAEEKKPAGVPTLLPSLSAPAGMRRQELLLRSGLSLDASCSSDASTDSFCSRASTGRIGRPSFGARKKKTLSQTDYKAVSMLERDGGLASQTDAAGVKRRCAWVTANTDPCYAAFHDEEWGVPVHDDKKLFELLVLSGALAELTWPAILNKRAMFREVFMDFDPVLVSKLSEKKIIAPGSPSSSLLSEQKLRGVIENARQILKIVEEFGSFDKYCWGFVNHKPILSRFRYSRQVPVKTSKADAISKDLVRRGFRSVGPTVVYTFMQVSGMTNDHLISCYRFTECVAASAGAAKPTDGSEASSSDSSHATTELKMNGTNGLAADIELSRTIDELSIS

SEQ ID NO: 8127 - DNA, 1222 bp, Panicum virgatum
  misc_feature: Ceres CLONE 1989352
  misc_feature: Encodes the peptide sequence at SEQ ID NO. 8128
aagagggggaatttttagcccgtacagtagcggcccttcttccagtcttgcacgccgccgcgcagttcgccgtagtcgccgggcgatggattccggcagcagagaggtcgccttcgactgcagctccttccggctgtacatggacggccgcgtcgaccgtgtcccccaccgcagggaaaccacgcccgccggcttcgacgccgccacgggcgtcgactccaaggacgtcgtcatcgacgccgccacgggcgccaccgcgcggctctacctgccgccgcctctcgaggggggtgcgacgacgaccaagctcccggtcctcgtcttcttccacggcggctacttcatcgtcgggtcggccgcggagcccatgtaccaccgctacgtcaactccctggtcgccagggcacgcgtcgtcgccgtctccgtcgagtaccgcctcgcgcccgagcacccgctcccggccgcctacgacgactcctgggccgcgctcgggtgggcggtgtcccgcgcggacccgtggctctccgaccacggcgacctcggccgcgtcttcctggttggcgtcagcgccggcggcaacatcgtccacaacatggccctcgccgtgggcgcgagcggcctgccggccgccgaaccagcgcgcgtagagggcgtgatcgagctccacccttccttctccggtgagcacaagacggaggtagaggacgaagtgttctttcaagctaacaataacaggtggaagatcatcttccccggcgcgaggaacggcgtggaagatccaaggattaacccgacggcggacggcgcgccgagcctgacgaagctggctggccagaggctgctcgtgtgcacggcgtcggaggacccgagggcgccgagggcacgggactactgcgacgcggtgcgggccagcggctggcgcggggaggcggagtggttcgagtcggaaggcgagggccacggcttcttcgtcctcaacccccgcaccagcacggcggctgctctgatggatcgagtggttggtttccttgctggccattgaccgaccagcgacctcaacctcaaatgtttgtcgctgcttgctactacctacagtatgtgtgtgttgttggaatatcatcgtcgccatcgatgcagaaacgaatggagcgaaacctgcttccatttagaaggacgaagcaaccattgttaggggccgtttagttcccaaaaattttcaccc

SEQ ID NO: 8128 - protein, 318 aa, Panicum virgatum
  misc_feature: Ceres CLONE 1989352
  misc_feature (1)..(219): Pfam Name: Abhydrolase_3 Pfam Description: alpha/beta hydrolase fold
MDSGSREVAFDCSSFRLYMDGRVDRVPHRRETTPAGFDAATGVDSKDVVIDAATGATARLYLPPPLEGGATTTKLPVLVFFHGGYFIVGSAAEPMYHRYVNSLVARARVVAVSVEYRLAPEHPLPAAYDDSWAALGWAVSRADPWLSDHGDLGRVFLVGVSAGGNIVHNMALAVGASGLPAAEPARVEGVIELHPSFSGEHKTEVEDEVFFQANNNRWKIIFPGARNGVEDPRINPTADGAPSLTKLAGQRLLVCTASEDPRAPRARDYCDAVRASGWRGEAEWFESEGEGHGFFVLNPRTSTAAALMDRVVGFLAGH

SEQ ID NO: 8129 - DNA, 1182 bp, Panicum virgatum
  misc_feature: Ceres CLONE 1989369
  misc_feature: Encodes the peptide sequence at SEQ ID NO. 8130
gaccgcgaagcaaaagatccagcagaaagccagcacagaggccccgtgatccggcggaaggcgcgagccatggagatcgccacggtggacctccgctgcgtggagcccggcgggccggggtgggaggccgcccgcgccgcggtggccgcgtccatggcggcgcacggcttcgtcgtcgtcgcgcacggcgcgctcggcccggacctccgccgggcgctgttcgccggcgccctgccggagctcttcgcgctcccgctcgaggccaagaagcgcaccgtgtccaccaaggggcagttcaggggctacatcggccagcggcccggcatgaactgggagagcctccgcgtcggggagcccaccgacgccgccagcgtccgcgccttcgccgacctcctctggccggagggcaacccggagttctgcgagacgatcgtgtcgttcgccaaggacatgctgaagctggaggagatggtggagacgctggtcctggagggcctcggcgtccgtggggagagcgtccgcgcccacttggacatgctcgggcacggcatccggatgtcgcactacggcgcgccgccggacacggagacggccatgtccatgcagccgcactacgacgacagcatggtcaccacgatcgtgcagcacgaggtggaaggcctggaggtgcacgtcggggacgggcgctgggccgccgtccctgccgagcccggcaccttcgccttcgtcgccggcgagcagctcagggtcgccacgaacgggcgcgtgccggcgtgcctccaccgcgtgcggacgccgagcaaccgcgagcgcttctcggtgctgttcggccgccggcagaaagacggcgtcgcggtgcgcgcgctggaggacctcgtcgacacggagcacccgctgctgtacagccccctgaggcacgaggagtactccaagtggcgttactcggaggaaggggggctcaagtttgaggatccactcaaggtgttctgtggtgtggacaaagtcggagccatcgtttgatggaaagcttgacatgccagcttgtcaatccgttcggaagtcgccattgcgatttgtgaatgtgctctactgttattcagtgctccgtatgtgacataattaaatgacggtttggtttaagctgcatacactgattctatagaaaaaaaaaaaaaaaaaaaa

SEQ ID NO: 8130 - protein, 316 aa, Panicum virgatum
  misc_feature: Ceres CLONE 1989369
  misc_feature (3)..(95): Pfam Name: 2OG-FeII_Oxy Pfam Description: 2OG-Fe(II) oxygenase superfamily
MEIATVDLRCVEPGGPGWEAARAAVAASMAAHGFVVVAHGALGPDLRRALFAGALPELFALPLEAKKRTVSTKGQFRGYIGQRPGMNWESLRVGEPTDAASVRAFADLLWPEGNPEFCETIVSFAKDMLKLEEMVETLVLEGLGVRGESVRAHLDMLGHGIRMSHYGAPPDTETAMSMQPHYDDSMVTTIVQHEVEGLEVHVGDGRWAAVPAEPGTFAFVAGEQLRVATNGRVPACLHRVRTPSNRERFSVLFGRRQKDGVAVRALEDLVDTEHPLLYSPLRHEEYSKWRYSEEGGLKFEDPLKVFCGVDKVGAIV

SEQ ID NO: 8131 - DNA, 1940 bp, Panicum virgatum
  misc_feature: Ceres CLONE 1989446
  misc_feature: Encodes the peptide sequence at SEQ ID NO. 8132
aggagagtctctcgactccctcccataagtttgaccaacccgccgcacccaaccagctccccatggttctgggttcctggctccctcctcctcctacctgcccccggttcttggcgacggagcgccgctggatggtgacgacctccgccgccgccgccgacgacgcctgttgctcctccgatccggctctcctcttttgactagagtctccctttgaattcaaaaacgatcgagctttctggaagttggtcgacaatggatcacagtcaccacatccataaccaatctgctgcaaacctctgccaccagtttggttcagacaatccattgcttggcatggggattcagcagtcatttgcaccattcacctcgccatttggtgcttcctcatcgaccaatattccccacatggattggaacccagctaccatgctagataacctcaccttcatcgaggagaagatacagcaagtgaaggatgtaattcggacaatggtggacaatggcagccagctaccatgttgtccaggggatctcgcccagcagcagcaggtggtcaatgcagacctgacatgcctcatcgttcagctcatctctactgccgggagcctcctcccatcactgaagaactcgtcctttctgagccaccccccagctggacacacaggcatcgttaaccatgttgggtcgagctcaagctttgttcctaacgtgactaccatttctgaagagaacgaggaaatgtgtagcccgcaggactacgaagaacttttcaagggtttcactgatggcgcgatggaaggagacattgaaattgacaatgttcttgctggggagcaggatgcaaaggatggcgatgaaggtggtgatgctggcatggatggagagagcttaccgctaggctcttatgagttactgcagctggagaaggatgagatattggccccacacacgcacttctgctccatctgtggaaagggtttcaagagggatgcgaatctgcgaatgcatatgagaggccacggtgatgagtacaagagccctgctgcactagccaagccacctagagatgcaagcgcagaacacgaagtggtgaagaggtactcttgcccatttgtaggctgcaagcggaacaagctgcacaaaaacttccagcccctcaagacgatcctgtgcgtaaagaatcactacaagaggagccactgtgagaagagctacacctgcagccggtgccacacgaagaagttctcggtcatggccgacctcaagacgcacgagaagcattgcggccgcgagaagtggctgtgctcctgtggaacaagtttttcaaggaaggacaagcttttcgcacatgtagctctgtttcaaggccatacaccagcattgccagcagaggaggcaaagacttcttcagaccagatcggtgacttagggagccatcaggaaccagcgaaactcccaagctccacgggcagcagcttcatgtggggtaccttctccggcagtgacagtgtgctggatatcaaaggatttgatggctgcagcgatgacttcctgtcgacagcaaactttggttccttcaatttcagtttcgggccagctgatggatttacaggagagccttctggcggttcgttcccgatgatgccttctgagcacttccagaatgctcagaagaaggggaagaaataaacatagatagtctcaggcagcttcagatatctcatcgcattgatcttgggtagcttcagatgcaccaccatctctgctggctgtttgcatcatttccactgttgtataacatcgccgttgcttccatggctttgtactcgatcggctggggagttcttgttttcctagcctgttgtatcctatgcagtactcttattattctttagtctattgagcttccttcttgcctcaaaaaaaaaaaaaaaaaa

SEQ ID NO: 8132 - protein, 478 aa, Panicum virgatum
  misc_feature: Ceres CLONE 1989446
  misc_feature (1)..(23): Pfam Name: zf-C2H2 Pfam Description: Zinc finger, C2H2 type
MDHSHHIHNQSAANLCHQFGSDNPLLGMGIQQSFAPFTSPFGASSSTNIPHMDWNPATMLDNLTFIEEKIQQVKDVIRTMVDNGSQLPCCPGDLAQQQQVVNADLTCLIVQLISTAGSLLPSLKNSSFLSHPPAGHTGIVNHVGSSSSFVPNVTTISEENEEMCSPQDYEELFKGFTDGAMEGDIEIDNVLAGEQDAKDGDEGGDAGMDGESLPLGSYELLQLEKDEILAPHTHFCSICGKGFKRDANLRMHMRGHGDEYKSPAALAKPPRDASAEHEVVKRYSCPFVGCKRNKLHKNFQPLKTILCVKNHYKRSHCEKSYTCSRCHTKKFSVMADLKTHEKHCGREKWLCSCGTSFSRKDKLFAHVALFQGHTPALPAEEAKTSSDQIGDLGSHQEPAKLPSSTGSSFMWGTFSGSDSVLDIKGFDGCSDDFLSTANFGSFNFSFGPADGFTGEPSGGSFPMMPSEHFQNAQKKGKK

SEQ ID NO: 8133 - DNA, 1895 bp, Panicum virgatum
  misc_feature: Ceres CLONE 1989494
  misc_feature: Encodes the peptide sequence at SEQ ID NO. 8134
gaaccaaggccggccagacgcccaacccccaaaacctctccccgctctccgctcgtgggtgctccccgtctctctctctctctcctcccgccctcgcccgcgtgcaggaaggttgacccccgtcggccaccggcgagcccggtaagagtaaaatggatgggagcactaaagggggtgggcattctgatgcattaagaaactacaccctgggaagaacattaggtattggtacatttggaaaagtgaagattgcagagcataagcttacaggacatagagttgctataaagatcattaactgccggcaaatgagaaatatggaaatggaagagaaagcaaatagagaaatcaagatattgaagttgttcattcacccccatatcatccggctttatgaggtcatttacacacctatggatatatatgttgtgatggaatattgtaagtatggtgagctgttcgattacattgttgagaaaggcagattacaggaagatgaagctcggcgaatcttccagcagatcatatctggtgttgaatactgccacagaaacatggttgtccatcgtgacctaaagcctgaaaatctgttacttgattcgaagtataatgtaaaacttgcggactttggcttaagcaatgtaatgcatgatggtcattttttgaagactagctgtgggagtccaaactatgctgctccagaggtaatatctggtagattgtatgctggacctgaggttgatgtatggagttgtggagttatcctttatgcacttctttgtggaacacttccatttgatgatgagaatattccaaacctgttcaaaaagatcaagggaggtatctacactcttccgagtcatttatctgctttggccagggatttgatcccaagaatgcttgttgtcgagcctatgaagagaatcacaattcgtgaaattcgagagcatcaatggttccagtttcgccttcctcgttacttggcagtgcctccaccagacacggcacagcaagccaaaatgattgatgaggatacacttcgagatgttgttaatatgggatttaacaaggacaatgtgtgtgagtcactgtgcagccgacttcaaaatgaggcaactgttgcgtattatttattattggacaatcggtttagagcaaccagtggctatctcggggcagattatcaagaatcaatggataggaatctaaatcagctggcgttgtccgaatcaactagttctggtacgaggaattatgttccaggaagcagcgatcctcatagcagcggtttgcagacacattatcctgttgaaagaaaatgggcgcttggacttcagtctcgggcccaccctcgtgaaataatgattgaggtcctgaaagcactccaagaattaaatgtcagctggaagaagaatggacactacaatatgaaatgcagatggtgtcctgggttttctcaagtccatgatatgttagatgccagcaacagctttcttggtgactctaccatcattgataatgatgatgcaaatggaaagctacctgctgtgatcaaatttgaaatccagctttacaagacgagggatgaaaaatacctcctcgatatgcagagagttactggacctcagctcctcttcctggacttttgtgcggccttccttaccaagcttagagttctatagtgctgtctatgttcagagcggcgaataactaaacatagggctctaccgtgtgactttttacactgtagtaatgaataaacagcaccatgtaaataggaatctttgcacctttttcttgtctttggacagcgaaacgtgttgtttgagtgactggtcttgtgcttcgcccaaaggttggctgttaacttgttataaaaaaaaaaaaaaaaaaaa

SEQ ID NO: 8134 - protein, 509 aa, Panicum virgatum
  misc_feature: Ceres CLONE 1989494
  misc_feature (1)..(509): SWISSPROT Homolog: EC 2.7.11.1 Carbon catabolite derepressing protein kinase
  misc_feature (1)..(509): SWISSPROT Homolog: EC 2.7.11.1 SNF1-related protein kinase catalytic subunit alpha KIN10
MDGSTKGGGHSDALRNYTLGRTLGIGTFGKVKIAEHKLTGHRVAIKIINCRQMRNMEMEEKANREIKILKLFIHPHIIRLYEVIYTPMDIYVVMEYCKYGELFDYIVEKGRLQEDEARRIFQQIISGVEYCHRNMVVHRDLKPENLLLDSKYNVKLADFGLSNVMHDGHFLKTSCGSPNYAAPEVISGRLYAGPEVDVWSCGVILYALLCGTLPFDDENIPNLFKKIKGGIYTLPSHLSALARDLIPRMLVVEPMKRITIREIREHQWFQFRLPRYLAVPPPDTAQQAKMIDEDTLRDVVNMGFNKDNVCESLCSRLQNEATVAYYLLLDNRFRATSGYLGADYQESMDRNLNQLALSESTSSGTRNYVPGSSDPHSSGLQTHYPVERKWALGLQSRAHPREIMIEVLKALQELNVSWKKNGHYNMKCRWCPGFSQVHDMLDASNSFLGDSTIIDNDDANGKLPAVIKFEIQLYKTRDEKYLLDMQRVTGPQLLFLDFCAAFLTKLRVL

SEQ ID NO: 8135 - DNA, 1326 bp, Panicum virgatum
  misc_feature: Ceres CLONE 1989529
  misc_feature: Encodes the peptide sequence at SEQ ID NO. 8136
atcgccgccatgccgcatctggccgccgccgacgctttcctcattctcgagttcatcgccggcaaccgccgcattccccacggcatactagccgccctcctcgccctcctaccctcctccttttcgccccgcacctccccgcgcctccgcaaagctctagtgctccgcgccctccacgccgccctccacgccgaagatgcctcctgttccttcaccctcctcggcaaagcgcggagggtcctcgccgacccctacgcctccgcctgcttcccaaaccagctttcttttgcagacaaccaggaggacgacggggctagggccgcagccgcggtggccgatctcaagcgcttcctcgaccacgagtgggccaacctcccaccctccatgcttgagcttgccgccgatcgcctcgccggacacaggtccctccaaacgtgggccgccgccgaccatgccaatcgtacaaagcttcgcctgctcgttggggagtccacagagcgtgagattttagccaagcttatgcaagatgcatcagcttctcatccacctatcctgccggaagtttctgataacgcaaacgatgctaatgaagctgatggtgctcaacaaaaccatgcggcttatcactctaagcaaagcaatgaagctgaccgtgctcaagaatgcatggctgcgcatcaaaatgtgtcaatgaaaggagcacagggggtccaacttccagagaagtctgtccctgcgtctaataagcccagtcttatggagagacatcccaatgcaagtatttttgagtggaatggcttgggttactatgatgaagacaggctagtagggaagcgtaagctacccccttttgagaggaaaccacatccttcccctgcatttgcacataagatgagaaagaagtggagtgagatagaggaaaaaaccttgttggaaggggtggagaagtatggcaaaggcaattggaaagatatcaaaatggcttaccctgacgtctttgaagagagatcaacggtagatctgaaggataagttcagaaatatggaaaggcaccatgaataaacttgaggcctggtggtgttgtgcttctctgctctgtagatactagtataatatgatggcggcagtatgcaaatgaaaacccatgtaaggtggcgtgcagacattttttttctgtgtttatttggagtgtccgaagggagagtctccagcactgggcatcttctctcatctccattcctagggtttagggtacatcccattaccagtgtaggtgagtaattttgtgaaaaaaattaccctccacaaaaaaaaaaaaaaaaaaaa

SEQ ID NO: 8136 - protein, 350 aa, Panicum virgatum
  misc_feature: Ceres CLONE 1989529
  misc_feature (1)..(51): Pfam Name: Myb_DNA-binding Pfam Description: Myb-like DNA-binding domain
MPHLAAADAFLILEFIAGNRRIPHGILAALLALLPSSFSPRTSPRLRKALVLRALHAALHAEDASCSFTLLGKARRVLADPYASACFPNQLSFADNQEDDGARAAAAVADLKRFLDHEWANLPPSMLELAADRLAGHRSLQTWAAADHANRTKLRLLVGESTEREILAKLMQDASASHPPILPEVSDNANDANEADGAQQNHAAYHSKQSNEADRAQECMAAHQNVSMKGAQGVQLPEKSVPASNKPSLMERHPNASIFEWNGLGYYDEDRLVGKRKLPPFERKPHPSPAFAHKMRKKWSEIEEKTLLEGVEKYGKGNWKDIKMAYPDVFEERSTVDLKDKFRNMERHHE

SEQ ID NO: 8137 - DNA, 1442 bp, Panicum virgatum
  misc_feature: Ceres CLONE 1989790
  misc_feature: Encodes the peptide sequence at SEQ ID NO. 8138
aaagcctcgcctttttcctctccctcgtcttccctcgctcgcctcccctctccaaatcccccctccctccctcggccctcgccttccactccacattcttcctgctctgcagctagctgcttttggttgggcatcggaaatggcaatcgacgacgaatcgccgccactcagggtcaacaccagaggcggcgccatgggaggaggggagtgcggcggggcggagagccagcggtggccgccgtggctcaagccgctgctggggacgagcttcttcggtcaatgcaagctgcacgcggacgcgcacaagagcgagtgcaacatgtactgcctcgactgcatgaacggcgctctctgctcccagtgcctcgcctaccaccgcgaacaccacgccatccagatacggaggtcctcctaccacgacgtgatccgggtgtcggagattcagaaggtgctggacatcaccggcgtgcagacgtacatcatcaacagcgcgcgcgtggtgttcctgaacgagcgcccgcagccgaggcccggcaagggcgtcaccaacacctgcgaggtctgcgagcgcagcctcctcgacaccttccgcttctgctccctcgggtgcaagatcgtcggcacctccggcgagttccgcatccggaagaagcacgccgccatcaggaggaagaagaggccgcagcacaaggtcggcgcggcggcggcgtcggactcggagggcgactcgtccacgagcacgagcggcgggagcgacaagagcagcgtggtgcagagcttcaccccgtcgaccccgccggcgaccgccaacagcttccgcgccgggaagcggcgcaagggcgtgccgcaccggtcgccgttcggcagcctcatggtggagttctagagcagcagcagcgccaagccaatgccaccctcgccaagaaccatgggcacatcactgtagcatacgcgcccctacatactatccatagctgtcggatcgaccgatctgcataccttagccagccaaaaggagctagtaagcaataacgaagggccccattgcacgcctgcgcttctggacgaggaggccggtgctaggcggttactttcatggtagttttactctttactgtgctatagtaccaacggtttgggtttggtgccagcctccgaaaggaaacgaggtggttgtagcagttactctcctccgtctcgtcatcagtcactactggagtaagttttgcaagtttttactatagggagtaagtttctctagcttatcagtgcttgatatagtagtggtagctgactagctgtaaatatacatactctatatactgtcacagatggggaatggttaggagtgtagctccggtgttcatattcgtgtgtaataaaaaaggataagaatggcgctcctggatagccttcagtgtgaaaaaaaaaaaaaaaaaaaa

SEQ ID NO: 8138 - protein, 248 aa, Panicum virgatum
  misc_feature: Ceres CLONE 1989790
  misc_feature (1)..(112): Pfam Name: PLATZ Pfam Description: PLATZ transcription factor
MAIDDESPPLRVNTRGGAMGGGECGGAESQRWPPWLKPLLGTSFFGQCKLHADAHKSECNMYCLDCMNGALCSQCLAYHREHHAIQIRRSSYHDVIRVSEIQKVLDITGVQTYIINSARVVFLNERPQPRPGKGVTNTCEVCERSLLDTFRFCSLGCKIVGTSGEFRIRKKHAAIRRKKRPQHKVGAAAASDSEGDSSTSTSGGSDKSSVVQSFTPSTPPATANSFRAGKRRKGVPHRSPFGSLMVEF

SEQ ID NO: 8139 - DNA, 1307 bp, Panicum virgatum
  misc_feature: Ceres CLONE 1989796
  misc_feature: Encodes the peptide sequence at SEQ ID NO. 8140
atcggtgccagttgccagcccacactgcctcccgccaccgctagccctccgtccttttttaatgctgctcctctctctgcagtctgcactcacagtcacagactcacagtcgcacagcgggcacgaacaggccgacgaaatggcgctcgccgccgccgccgtcctcttgctgatccctggccttctcctcacggcgatggcggccacgccgtaccctcacggtgacccgctcctcagcgcgtccaagaggtacgagggcagctccgacctggtggacctccgctaccacatgggccccgtcctctccgccgcgccgctccacctctacgtgctctggtacggccgctgggaccccgcgcaccaggcgcccctccgcgacttcctcctctccctctccgacccgtccccgccgccgccctccgtcgccgcctggtgggccaccgccgcgctctacgccgaccagaccctcgccaacgtcacccgccgcgtcgcgctcgcggccgaggccgcagacgcgtccgcctcgctcggccgctccctctcccgcctcgacatccagcgggtgctcgccgcagccgtcgccgcgggccgcctccccgccgacgcccgcggcggcgcgtacctcgtgctcaccgcgcccggcgtcggcgtccaggacttctgccgcgccgtctgcggcttccactacttcaccttcccctcgctcgtggggcacacgctcccctacgcctgggtcggccacagcggcggccgctgcgccgacgtctgcgcgtacccgttcgcgctgccggcctacatgtcccggggcggcatggcggcgctgcgcccgcccaacggcgacgcgggcgtcgacggcatggtcagcgtcatcgcgcacgagctggccgagctcgccaccaacccgctcgtcaacgcatggtacgcaggggaggaccccaccgcgcccaccgagatcgccgacctctgcgagggggtgtacgggacgggcggcggcggcgggtatgccgggagggtggcggtggacgcgcaggggaggagctggaatgtcaacggcaggaacgggaggaagttcttggtgcagtggctgtggagcccagaggccaaagcctgcgtggggcccaatgccagtgagtaggctgtgtttagccaacgccgctagcatgtagactagattactactagtggaaaagtagcataatttttgggaatttgtatcgtattttttcggtttattatatgtatgaaagctactttctccgtccaaaaaaatataaatctcgtttcccgaaaaaaaaaaaaaaaaaaaa

SEQ ID NO: 8140 - protein, 357 aa, Panicum virgatum
  misc_feature: Ceres CLONE 1989796
  misc_feature: Great-hit functional homolog of the protein sequence given in SEQ ID NO 9659
  misc_feature: Useful for biocontainment applications
  misc_feature: The plant produces a reduced number of seeds.
MLLLSLQSALTVTDSQSHSGHEQADEMALAAAAVLLLIPGLLLTAMAATPYPHGDPLLSASKRYEGSSDLVDLRYHMGPVLSAAPLHLYVLWYGRWDPAHQAPLRDFLLSLSDPSPPPPSVAAWWATAALYADQTLANVTRRVALAAEAADASASLGRSLSRLDIQRVLAAAVAAGRLPADARGGAYLVLTAPGVGVQDFCRAVCGFHYFTFPSLVGHTLPYAWVGHSGGRCADVCAYPFALPAYMSRGGMAALRPPNGDAGVDGMVSVIAHELAELATNPLVNAWYAGEDPTAPTEIADLCEGVYGTGGGGGYAGRVAVDAQGRSWNVNGRNGRKFLVQWLWSPEAKACVGPNASE

SEQ ID NO: 8141 - DNA, 1225 bp, Panicum virgatum
  misc_feature: Ceres CLONE 1989833
  misc_feature: Encodes the peptide sequence at SEQ ID NO. 8142
gaccagcatctaaacacagagcttcttgtctgtctgcccagttctagcaaccaacgagctagtagctagtaaggtcgacgacgatggcgtccctgatcgccggctcgtccatccgtgcactgacgatcatgaccttctccctcctcgtctcgtacggttcgtgcgctaggtcgccgccggtgaactttaacgcctccgccctcaccgccgaccccaactgggaggccgccagagccacctggtacggcgcgcccaccggcgccggccccgacgacaacggcggcgcctgcgggttcaagaacgtgaacctgccgccgttctcggccatgacgtcgtgcggcaacgagccgctgttcaaggacggcaagggctgcggctcctgctaccagataagatgtaccaaccaccctgcgtgctccggcaacccggagacggtgatcatcaccgacatgaactactaccccgtcgccaagtaccacttcgacctcagcggcacggccttcggcgccatggccaagcccggccgcaacgacgagctccgccacgccggcatcatcgacatccagttcaagagggtgccctgcgactaccccgggcagaaggtgaccttccacgtcgaggagggctccaaccccgtctacttcgccgtgctcgtcgagttcgaggacggcgacggcgacgcggtgcaggtggacctcatggaggccggctccgggtcgtggacgccgatgcgcgagtcgtggggatccatctggaggctggactcgaaccaccggctgcaggcgcccttctcgctgcgcgtcaccaacgagtccggcaagcagctggtggccagcaacgtcatcccggccaactgggtgcccaacacctactaccgctccatcgtccagttctagcaaccaacgacgatcgtctctgctgctgctgggcacgggagtggatacgatgatagttcgagatcattattagcacggtactgtatcgtttgcatgggattgatgatgtgccttcttaattagtagttattgattaattaggtgtggtgtttgtgtgcgtgagtgtgagtgtgtctctgtgtcggagatttgacgactgggaaatggaggaggcaaagtttgcatgtgttcccgcccattgtcaatgctttgtaccagtgtgatcgagaatataaattattaacagtactttgtgtgttattatatagcaaaaaaaaaaaaaaaaaaaa

SEQ ID NO: 8142 - protein, 270 aa, Panicum virgatum
  misc_feature: Ceres CLONE 1989833
  misc_feature: Great-hit functional homolog of the protein sequence encoded by LOCUS At1g65680
  misc_feature: Useful for making plants with altered cell wall content and/or composition
MASLIAGSSIRALTIMTFSLLVSYGSCARSPPVNFNASALTADPNWEAARATWYGAPTGAGPDDNGGACGFKNVNLPPFSAMTSCGNEPLFKDGKGCGSCYQIRCTNHPACSGNPETVIITDMNYYPVAKYHFDLSGTAFGAMAKPGRNDELRHAGIIDIQFKRVPCDYPGQKVTFHVEEGSNPVYFAVLVEFEDGDGDAVQVDLMEAGSGSWTPMRESWGSIWRLDSNHRLQAPFSLRVTNESGKQLVASNVIPANWVPNTYYRSIVQF

SEQ ID NO: 8143 - DNA, 1415 bp, Panicum virgatum
  misc_feature: Ceres CLONE 1989848
  misc_feature: Encodes the peptide sequence at SEQ ID NO. 8144
agaggggaggaagcaagcaaatggcggcggagatggtgggcctaggaggagcgctcgccgcggcccagcaccaactcctcttcctcctcctgctctgcttcctcgcagggggcgcccgcgcctccccggccaccgacgcgctgcgccacgcctccccccgcgctgccgccggtggcctttgccagcagctgctcctgccgcagggttacccgtgcaccgagcacaccgttcaaacggatgatggcttccttttgtctattcaacatattcagcatggaaaaaatggagtagcagataatgctggacctccagtttttcttcagcatggtctttttcagggtggagacacgtggttcataaactccaatgaacagtcgcttggatatatccttgctgataatggttttgatgtttggattggaaatgtccgtggtacacattggagtaaaggccattctactctctctgttcatgacaagcttttctgggattggagttggcaagaccttgctgaatatgaccttttggcaatgctaagctatgtatatacagtttcacagtctaaaattttatacgtgggacattcacagggaactattatgggtctggctgcatttacaaatcctaaaatagtaaagatgattagctctgctgcacttctttgcccaatttcttaccttgatcacatcagtgctagttttgttcttagagcggttgccatgcatcttgatcagatgcttattactatgggtatccatcagttgaacttctggagcgaaatgggtgtacaaatattagatgctttgtgcgatgctgaacgtttggactgcaacgaaatgttgtcttcaataacaggtcaaaactgttgcttcaattcatcacggattgactattatttggagtatgaaccccatccatcgtcaacaaaaaatctgcgtcatcttttccagatgattaggaaaggcacatttgcaaagtacgactatggatgggtgggtaacctagcacgctatggccagctgcaccctcccccattccatctaagcagcattccggaatcactgccattatggatgggatatggaggtcttgatgcacttgccgatgttacagatgttgaacgcactatcaaacagttgaggtccacaccagaactattatacattggtgactatggtcacattgatttcatcatgagcgtgagggcaaaggacgatgtttatgtcgacttaatgaggtttctcagggcccagcagggactgcacagcagctattaggacgcacgcctttacatctttacactatgacagtacgaccatgtaaatatgtatatatgcgcttgtaccaacggcaagcccaaacaatcaattaaattgctcgtgtatacttatcgttaaaaaaaaaaaaaaaaaaaa

SEQ ID NO: 8144 - protein, 418 aa, Panicum virgatum
  misc_feature: Ceres CLONE 1989848
  misc_feature (1)..(272): Pfam Name: Abhydrolase_1 Pfam Description: alpha/beta hydrolase fold
  misc_feature (23)..(411): SWISSPROT Homolog: EC 3.1.1.3 Triacylglycerol lipase 1 precursor
MAAEMVGLGGALAAAQHQLLFLLLLCFLAGGARASPATDALRHASPRAAAGGLCQQLLLPQGYPCTEHTVQTDDGFLLSIQHIQHGKNGVADNAGPPVFLQHGLFQGGDTWFINSNEQSLGYILADNGFDVWIGNVRGTHWSKGHSTLSVHDKLFWDWSWQDLAEYDLLAMLSYVYTVSQSKILYVGHSQGTIMGLAAFTNPKIVKMISSAALLCPISYLDHISASFVLRAVAMHLDQMLITMGIHQLNFWSEMGVQILDALCDAERLDCNEMLSSITGQNCCFNSSRIDYYLEYEPHPSSTKNLRHLFQMIRKGTFAKYDYGWVGNLARYGQLHPPPFHLSSIPESLPLWMGYGGLDALADVTDVERTIKQLRSTPELLYIGDYGHIDFIMSVRAKDDVYVDLMRFLRAQQGLHSSY

SEQ ID NO: 8145 - DNA, 1773 bp, Panicum virgatum
  misc_feature: Ceres CLONE 1989872
  misc_feature: Encodes the peptide sequence at SEQ ID NO. 8146
acctctcctcactcgagctcacgccaccaagaatctttcactcttctctcttcttccccctcctctcctgacctccctccctcctcccctttctctctcttcttgagagtgaagcggaggagcatcgcggctgggcgagcgagtgatggcatggggagcttgcattgctgctctgcccctgctgcttctgcttcttcttcttgctgccgcggcagcaggtggtaatggcggcgtgcattgcctggaggaggggagccggagcaggagagccttgcaggggaggcaccaccacctgaggtcaagagcagtgggtggcgccacggtgctcgagctgcggcaccacagcttcagctcggcgccgagcaagagccgggaggaggaggccgacgccctcctgtcctccgacgccgcgcgcgtcgcgtcgctgcaacggcgcatcgagaactacaggctgatcgggtcgtcggcagcggcggcggcggcgtccaataataaggcgcaggttcccgtcacctccggcgcgaagctccggacgctcaactacgtggccaccgtcgggctgggcggcggcgaggccacggtgatcgtggacacggctagcgagctgacctgggtgcagtgcgcgccgtgcgactcgtgccacgaccagcaggagcccctcttcgacccgtcctcgtcgccgtcctacgccgcggtgccgtgcgactcgccctcctgcgacgcgctgcgggtggccacgggcatgtcggggcccccgtcccccgcgtgcggcggcgccgccggccggcccgcctgcagctacacgctcagctaccgcgacggctcctactcccgcggcgtcctggcgcgcgacaaactgagcctcgccggcgaggccatcgacggcttcgttttcggctgcggcagcagcaaccagggcgcgccgttcggcggcgcctccggcctcatggcgctcggccggagccagctctcgctcgtctcccagaccgcggaccagttcggcggcgtcttctcctactgcctgccgctcagggactccggctcgtcgggctcgctggtgctcggcgacgactcgtcggtgtaccggaactcgaccccgatcgcgtacacccccatggtgtccgaccctctgcaggggccgttctacttcctcaacctcaccgggatcacggtcggcggccgggaggtgggctccccgggcttcccggccggcaaggtgatcgtcgactccgggaccgtgatcaccagcctcgcgccgtccatctacagcgccgtgagggccgagttcctgagccagctgggtgagtactcgccggcgccggccttctccatcctcgacacctgcttcaacatgacggggtccggggaggtgcaggtgcccagcctgaggctcgtgttcgacggcggcgtggaggtggaggtggactcgggcggcgtgctgtacctggtcagcagcgacgcctcccaggtgtgcctggccatggccgccctgaggtccgagtacgagacctccatcatcggcaactaccagcagaagaacctgagggtcatcttcgacaccgcggcgtctcaggttgggttcgcgcaggagacctgtgggtacatttgactctgactgggatggatggggggctagctacatatgtgaatatctttatacttgcagatttgtttcgagattacctctggtgattggcaaatggtaatacagtatttggttgctggcaaatgtacaagcattcatcattgcttcaaaaaaaaaaaaaaaaaaaa

SEQ ID NO: 8146 - protein, 487 aa, Panicum virgatum
  misc_feature: Ceres CLONE 1989872
  misc_feature (1)..(343): Pfam Name: Asp Pfam Description: Eukaryotic aspartyl protease
MAWGACIAALPLLLLLLLLAAAAAGGNGGVHCLEEGSRSRRALQGRHHHLRSRAVGGATVLELRHHSFSSAPSKSREEEADALLSSDAARVASLQRRIENYRLIGSSAAAAAASNNKAQVPVTSGAKLRTLNYVATVGLGGGEATVIVDTASELTWVQCAPCDSCHDQQEPLFDPSSSPSYAAVPCDSPSCDALRVATGMSGPPSPACGGAAGRPACSYTLSYRDGSYSRGVLARDKLSLAGEAIDGFVFGCGSSNQGAPFGGASGLMALGRSQLSLVSQTADQFGGVFSYCLPLRDSGSSGSLVLGDDSSVYRNSTPIAYTPMVSDPLQGPFYFLNLTGITVGGREVGSPGFPAGKVIVDSGTVITSLAPSIYSAVRAEFLSQLGEYSPAPAFSILDTCFNMTGSGEVQVPSLRLVFDGGVEVEVDSGGVLYLVSSDASQVCLAMAALRSEYETSIIGNYQQKNLRVIFDTAASQVGFAQETCGYI

SEQ ID NO: 8147 - DNA, 1229 bp, Panicum virgatum
  misc_feature: Ceres CLONE 1989883
  misc_feature: Encodes the peptide sequence at SEQ ID NO. 8148
aaacctgtgagccgccgccgtatcacgggcggttaccgccacctcagctcgctacctccgccgctccgcatcctcctccctccttcgtcctcagggagggtcatcgacggccgccgcaaccagatctccgacgatcctcctcctcctgctgctaatacataccgaggagtcaggaataatggagctcagcgctggcactgccatctaccctctgcaccgctgcaaaaccatacacctggtgaggcatgcccagggtgttcacaatgtcgaaggcgacaaggatcacagtgcctacatgaaaccagagttctttgatgcttgcgtcactcctttgggctggaaccaggtcgactgtctacgagagcatgtgaaaaaaagtggacttgcagaaaagattgagcttgttatttgttcccctttactgaggactatgcagactgcagtgggtgtttttggtggtgagaattatactaatggaataagtgcacctccactaatggtggaaaatgctgcagacagtggacgtccggcaatctcaaatttgaactgcccaccatttcttgctgtcgagacctgcagggagcgcttgggtgccaatccttgtgacaagaggaggagcatcacagagtatcgtactctgtttcctgccattgacttttcactgatagagaatgatgaagatgttctttgggtaccggatgtcagagaaacctttgagtcactaggggagaggggcaggaagtttatcgactggttatggacaagagaagagaaagagatagccattgtcacccatagtggtttgttgtggcataccttacgtatggacagcaaagagtgtcatcctactgtaaggcatgaagtgagcaagtactttgcaaattgtgagctccggtcgttggtgctggttgataggagcatgcttggatcagattcccccagttacaactaccctggcaagatcccagatggtgttgatctgcctagcgatgtcgctgacaagaagcaacttgaggaggaagctcaagagagaactgagcctgtctgaggctcgtttcgtgttttaccctgattccttgattcttttgtgaacccatcttgacacctccctagttgcattcagtggaagctaaacacctgcatattggactgaccatttgttattacgtatgtttcctctgaagttcactgaaatgaaatgttcttttcaaaaaaaaaaaaaaaaaaaa

SEQ ID NO: 8148 - protein, 289 aa, Panicum virgatum
  misc_feature: Ceres CLONE 1989883
  misc_feature (1)..(197): Pfam Name: PGAM Pfam Description: Phosphoglycerate mutase family
MELSAGTAIYPLHRCKTIHLVRHAQGVHNVEGDKDHSAYMKPEFFDACVTPLGWNQVDCLREHVKKSGLAEKIELVICSPLLRTMQTAVGVFGGENYTNGISAPPLMVENAADSGRPAISNLNCPPFLAVETCRERLGANPCDKRRSITEYRTLFPAIDFSLIENDEDVLWVPDVRETFESLGERGRKFIDWLWTREEKEIAIVTHSGLLWHTLRMDSKECHPTVRHEVSKYFANCELRSLVLVDRSMLGSDSPSYNYPGKIPDGVDLPSDVADKKQLEEEAQERTEPV

SEQ ID NO: 8149 - DNA, 1292 bp, Panicum virgatum
  misc_feature: Ceres CLONE 1989931
  misc_feature: Encodes the peptide sequence at SEQ ID NO. 8150
cccccagatcggccccaattccaaacccgcctcggcgctccccgctgctccagccatggcaatcggcaccgagccgcgccgcagcgaggacaaggcttcaacccagtcaaatgatgagaagaggtgggtcttgtctgattttgaagttggcaaaccacttgggaggggcaagtttggccatgtttatttggccagagaaaagaggagtaatcagattgttgctttgaaagttcttttcaagagccagctcaaacagtctcaggtcgaacatcagctgcgccgtgaagtggagattcaaagtcatcttcgccatcctaatattcttcgcctttatggatatttctatgatcagactcgtgtttacctgatcttggaatatgctgccaagggagaactttataaggagttgacaagatgcaagcatttttctgagaggcgctctgcaacttatattgcatcactcgcaagagctcttatctaccttcatgggaagcatgtcatccatagggacattaaaccagagaatcttttgattggagcacagggcgagctgaaaattgcagactttgggtggtctgtccacaccttcaaccgaaggcggacaatgtgtggaactctagattacctgcctcctgaaatggttgagaagacagagcatgactaccatgttgatatctggagcttgggtatactgtgctatgaatttctttatggggtcccaccttttgaagccaaagagcattcagagacataccgaaggatagtgaaagttgacctgaagtttccgttgaaaccattcgtttcgcctgctgcaaaggacctcatttctcagatgcttgtaaagaactcggcacaccggctccctcttcacaaagttcttgagcacccgtggattgtccagaacgctgacccctccggcgtgtacagagggtagaacactgcactggcggatcactgcagcgccctccactccccaattcgaggggagttgggattatttacttgtttgtgaaaggcttcggccctgccactagagcttctatggccctagctttcccacccaccccgagttgtagacatcttgtagtgctgtgtagctcaacggaaattccaagcaatgtggattagagtgtgtatgtgtcatggggccgtgatctcatacggcaaatgccctgtactattgtagcatttcctgttgaacaatcttcttactcgtccatatgaatatcgattctgaaaatttaacatccgatgcgagagtccagttggttcaaaaaaaaaaaaaaaaaaaa

SEQ ID NO: 8150 - protein, 292 aa, Panicum virgatum
  misc_feature: Ceres CLONE 1989931
  misc_feature (1)..(291): SWISSPROT Homolog: EC 2.7.11.1 Serine/threonine-protein kinase Aurora-1
  misc_feature (21)..(292): SWISSPROT Homolog: EC 2.7.11.1 Serine/threonine-protein kinase Aurora-2
MAIGTEPRRSEDKASTQSNDEKRWVLSDFEVGKPLGRGKFGHVYLAREKRSNQIVALKVLFKSQLKQSQVEHQLRREVEIQSHLRHPNILRLYGYFYDQTRVYLILEYAAKGELYKELTRCKHFSERRSATYIASLARALIYLHGKHVIHRDIKPENLLIGAQGELKIADFGWSVHTFNRRRTMCGTLDYLPPEMVEKTEHDYHVDIWSLGILCYEFLYGVPPFEAKEHSETYRRIVKVDLKFPLKPFVSPAAKDLISQMLVKNSAHRLPLHKVLEHPWIVQNADPSGVYRG

SEQ ID NO: 8151 - DNA, 1842 bp, Panicum virgatum
  misc_feature: Ceres CLONE 1990003
  misc_feature: Encodes the peptide sequence at SEQ ID NO. 8152
aacattatcgctgttgggcgttggccttttaggtaggagccacacccacaagacaacgacgctagcagtgcatggaatggcggccatggatctccacttcgtgatgatgccgctaatggcgcagggccacgtgctccccatggtcgacctggcgcgcctcatcgccgagcaaggcgcgcgcgtcaccgtggtgctgacgcccgtgaacgccgcgcgcaacaggaccgtcctggacaacgtcgcacgggcggggctcgccgtcgatgtcgccgagatacccttcccgggggccgcggtgggcctgcccgagggcttcgagagcctcgacatggtgacggacatatccctcggcatccgtttctaccaagcctgggatctgctcgccgagccgctcgaggcgtacctccggtcgctgcccagtcgcccggactgcctcgtcgccgacgcgtgtggctcgtggacggtgggggtcacgcggcggctcggcgtcccgcggctgatcctccccgtcacgtccgcggtctatctcctcgccacgcacaacctggtcacacacggtacgtacgaccgcgctgccgacgacttcgagccgttcgaggtgccggacttcccggtgcgcgtggttgtcaaccgggcggcgtcgctcggcttgccgcacatggagaagaaccagcgggagatgatcgaagccgtggccaccgccagcggcgtattcatcaacacgtgcacggacttggagggcgcgttcattgagcgctacgcggaggcgatcagctgcaaggtatgggcagtcggcccgctctgcctcctcaacaccgacgccgccgccggcacgatggcgggtagggaaaaccgtgcggccatggatgccgagcaaatcgcgtcctggatcgacgcgcggccaccggcgtctgtgctctacgtaaacttcggtagcatggcccgcctgtttccgccgcaggttgccaagctcgccgccggcctggaatcatcccgccggccgttcatctgggtagtcaaagagacagagactgtcggcatcgacgctgagtatgaggcccgtgtcaaggaccggggcctgatcatctgcgggtgggcgccacagatgacgatcctgtcgcacccatccgtgggtgccttcctgacgcactgcgggtggaactcagtggtggaggctgtctcccacggcctgccgctgctgacctggccacactttcatgaccagttcctgatcgaggcgctggtcgttgacgtgctaggagtcggtgtccgtgttggcgtggaggtgccaaccacgcacatagggctcgtgaagcccgggcagctgctggaggtgcaggccgggagggaccccgtggagagggcggtggccgaggtgatggacgaggggctagccggcgcagcgcgtcgggctagggcgaaggagcttggggataaggtgagggccacggctgaggacgggtcgcgggacactaacgtcaagaacatgatcggccatgtcatggagcttgtgtgcaagagcgaggagaagaagatggatgacgcaaattaaacggcaagctccgagtggtgtaagagtaaagtcccttgaattacgcaaataaatatacttcagaattaatgtattcagcaaacttttacattcaaacttggtaaactagggaggtgtccggcgcaaatagtgcgggtagctagtattttcattatatatatattattacttttatttaaattttgatgcatctagttttttcgaatatgttattgtgattgtttttctagctggcccaaattgagatatcatctatgcattttctcatctaaaaaaaaaaaaaaaaaaaa

SEQ ID NO: 8152 - protein, 491 aa, Panicum virgatum
  misc_feature: Ceres CLONE 1990003
  misc_feature (1)..(127): Pfam Name: UDPGT Pfam Description: UDP-glucoronosyl and UDP-glucosyl transferase
MAAMDLHFVMMPLMAQGHVLPMVDLARLIAEQGARVTVVLTPVNAARNRTVLDNVARAGLAVDVAEIPFPGAAVGLPEGFESLDMVTDISLGIRFYQAWDLLAEPLEAYLRSLPSRPDCLVADACGSWTVGVTRRLGVPRLILPVTSAVYLLATHNLVTHGTYDRAADDFEPFEVPDFPVRVVVNRAASLGLPHMEKNQREMIEAVATASGVFINTCTDLEGAFIERYAEAISCKVWAVGPLCLLNTDAAAGTMAGRENRAAMDAEQIASWIDARPPASVLYVNFGSMARLFPPQVAKLAAGLESSRRPFIWVVKETETVGIDAEYEARVKDRGLIICGWAPQMTILSHPSVGAFLTHCGWNSVVEAVSHGLPLLTWPHFHDQFLIEALVVDVLGVGVRVGVEVPTTHIGLVKPGQLLEVQAGRDPVERAVAEVMDEGLAGAARRARAKELGDKVRATAEDGSRDTNVKNMIGHVMELVCKSEEKKMDDAN

SEQ ID NO: 8153 - DNA, 1598 bp, Panicum virgatum
  misc_feature: Ceres CLONE 1990071
  misc_feature: Encodes the peptide sequence at SEQ ID NO. 8154
gccttcgcctacctctcgacgcccaaccccaaaaagaaaaattctcctcgcggagaaaggtcgcgtgccgtctcgcccacaggttggcggcgggcttcgcgtcgaggcgcggccggttggttctggatcggatctgcgcggattggaattgggttgacccggtgggtttggtggcacagggtctgcgcgcctctgttacggaggatttgggctcgcctgtgggtattttccctttaattatttgcagatcatttgcggtggtttgttttctaggctggcactggcaggcgagacctcaacctttgtgaacagcggagggggtgaatcagtgaaggatagcgagtccgtccgcgtggttgatgaacaaactttggtggttgccggcggatgtgggagtgggttcatcctggcgccgccgggtgcacgccgcggcgtgcgtggctgcttgcttgtcgcagggctcttccatccctgcgtcacatgcgagcttcgtgccaattcgtgaagcaggcgagagatgtttgctgataaggtctcctgtggcccttgtgtagggggtggatgaagcggcgagcttcctttccgtgctcggcgtgggtarccttgattgtggccagaggtttcgtgctggccatggcaaggtctattgcttggacgtgtggataaaggtttgactgcctgaattggctgtgtgcatctacctgattgcagttccgggcactgattgcttcgcctgtatgctgctggttgcctgccttgtgctgctactacatatgcaatctgtggagcaaccaaaaagaccttggcttcatgctatgattgtgtcaagcaattgactaaccacgcccatctgttgcaatggcacacgagagctggaaacaggaatctgaggagactggagtccatgcacctgaggccccaattctgtgcataaacaactgtggtttyttcggcagcagcatgacgaacaatatgtgctcgaagtgctmcagggacttcatcaaattgwtggaaggccctgtggttgagaagaaggtgatcacggtggcatcttcttctgcggcaccaatggagacagcaaagcaagatgatgtgcctgcagctgctgccactgaagctgtgacggagaagcaagcagagcaggagcccccaaagccgcccagcaaccggtgccttacctgccgcaagaaggttgggctgactggcttcctctgccgctgcgggggccccttttgctccatgcaccgctacactgactcccaccagtgcaccttcgactacaagaaggtggcacgggagcagattgccaagcaaaatccagttgtgatggcagagaagattaacaagatatgatgcatagtcatgtgaagggatcactaaattcatgcctgggttcactccaaatgataggttccttcaggcggtggtctgggtctgggttagagtggtagctggtctcaattgtgtctatccccctttatcatggtttcattctctcgattgtgtaataatgtaaatatattcaaactgtaatttaatcctattgcttcctactacgattgatgggtttgatgggtttatcgctgatcatggctttc

SEQ ID NO: 8154 - protein, 164 aa, Panicum virgatum
  misc_feature: Ceres CLONE 1990071
  misc_feature: Great-hit functional homolog of the protein sequence given in SEQ ID NO 9336
  misc_feature (1)..(40): Pfam Name: zf-AN1 Pfam Description: AN1-like Zinc finger
  misc_feature: Useful for making plants with modulated nitrogen use efficiency
  misc_feature (44)..(44): Xaa is any aa, unknown, or other
  misc_feature (51)..(51): Xaa is any aa, unknown, or other
MAHESWKQESEETGVHAPEAPILCINNCGFFGSSMTNNMCSKCXRDFIKLXEGPVVEKKVITVASSSAAPMETAKQDDVPAAAATEAVTEKQAEQEPPKPPSNRCLTCRKKVGLTGFLCRCGGPFCSMHRYTDSHQCTFDYKKVAREQIAKQNPVVMAEKINKI

SEQ ID NO: 8155 - DNA, 1412 bp, Panicum virgatum
  misc_feature: Ceres CLONE 1990316
  misc_feature: Encodes the peptide sequence at SEQ ID NO. 8156
atgtacctttcgcagtttcgcgagtccagccgccgtcgctcacctcagtcagcagtcacctcctcttcccactccggcgccgccgcaccggccgcccttctcctggctccaccatccatccccccccccgccctcctccttgtgaatctagggtccaatgagcaacctcgcgtgacgcccgctccaccggagtaagatggcttcgccggcgggcctacgccccgccgcgccgccggcgatacccggcgccgctgcggtggcggcgtgcgccgccatggccgcgtcctacgtcgctgtcctctacgccccgacggtcgtcctccgcctcccgcccccgacctcgcttcgttccttcctccaccgccgcttcgcctgcgccgcggtcgcctcgaccgcctccgcgctcgccaccgcggcgctcctacgcgtctggagcctaagcgacttcgctgatatgctcgcggtgttcggcattaggaaggatcacttgcttcaggcagtgctgattccacttctccttacatccctagtgtatgctgggtcgttcatcaatagactgtggcttcttgcgagcttgcgcagcggagatggtgatgaggtggggattggctgcaccaagaggcttgtgctgcggatccaagccgcccttgatgatgtaatggtttggcggaactatgtagtggcacctattaccgaggagcttgtgtttagggcatgcatgataccacttcttctgtgtggtgggttcaaaatgtctacaattattttttttagcccagtcttcttcagtctagcacacttgaaccatttgttcgaactacaacagcagggatgcaattttatgagatctctactgattgtaggtgtccagttaggctacacagtaatctttgggtggtatgcagcatttttgttcattcgaacagggaatctgttatctcctattgttgctcacgtcttttgcaatatgatgggtttgcctgttttctcatcaccacgaacaaaaggagtggcatcggtagcatttctggctggttcaatatgcttcttttggctccttttccctgtaacaagtcctgaactgtacaacactaggttagatcgatgcagatgctggcatggtttttgcaattggaaatagcgcagaactagatggagaacaatggattctgagcctaacttgaaggtactaaccattgaaatcctcagcttacagcagccactgccgtcagatttcccatttcataattccatatgggtgttgtaaaacatttttgtagatatttttcccttgtgggctaagaatttagacttgtaaaaaaattgcatctcatcacttgttaaatacgtactgaccaggaagtccccgagtcagaccccttttcagagcggaaaaaaaaaaaaaaaaaaaa

SEQ ID NO: 8156 - protein, 314 aa, Panicum virgatum
  misc_feature: Ceres CLONE 1990316
  misc_feature (1)..(111): Pfam Name: Abi Pfam Description: CAAX amino terminal protease family
MASPAGLRPAAPPAIPGAAAVAACAAMAASYVAVLYAPTVVLRLPPPTSLRSFLHRRFACAAVASTASALATAALLRVWSLSDFADMLAVFGIRKDHLLQAVLIPLLLTSLVYAGSFINRLWLLASLRSGDGDEVGIGCTKRLVLRIQAALDDVMVWRNYVVAPITEELVFRACMIPLLLCGGFKMSTIIFFSPVFFSLAHLNHLFELQQQGCNFMRSLLIVGVQLGYTVIFGWYAAFLFIRTGNLLSPIVAHVFCNMMGLPVFSSPRTKGVASVAFLAGSICFFWLLFPVTSPELYNTRLDRCRCWHGFCNWK

SEQ ID NO: 8157 - DNA, 1783 bp, Panicum virgatum
  misc_feature: Ceres CLONE 1990520
  misc_feature: Encodes the peptide sequence at SEQ ID NO. 8158
aaccaatcgtctccttccccagctatatatatgagacacagcaggcctgcgctaatctgtaggcacaagcacaacgaactcggttagctagcaggctcaacgcacgcagcaatggctgttgtttcgccactgctgctacttgcgctcctggccggtggttcttctctgattatcccggcggcagcggccaatggcgaagacgacggatacacgtttgtagcattgagctcgctaaagcccaaggatggcgcctgcttcgggcacagggtgaatcctcctgcccagaacggcacgtgggtcccgacgagtctcatgtacggcccctgctcggggtcggggtccgccaccgcctcgccatctttggccgaggttctccggcaggaccagctccgcgtcgacgacatcctgagaagggtgtccggcaatgcctccgacgagaagccaaaccgacgagcgaatagcaagtggtcacctatgacccatgccagcaaagtcggcgggagccttggcagaggaagtcaggatagcattgatcccgcggcgaccggcggcggcgggccgccgtcggggccgccgtcgaggctgcctggagttttccagacgctggtagtggacacggcgagcgacgtgccgtgggtgcagtgcgtgccctgccccgtgccgccgtgccacccgcagacggacaccgtcttcgacccaaccaggtcgggctcctacgcgcccatcccctgcacctcccccgcctgcacgcagctcggcccctacgccaatggctgcgtcaacaaccagtgccagtaccgcgtcgcctaccccgacggctcctcctcgtcgggcacctacagcaccgacctgcttaccttcaaccccaccaccgccgtccccggcttccagttcgggtgcagccactccgagcagggcagcggcagcttcgacaacaccaccgccgggatcctggcgctcggccgcggcccggaggcgctcgtgtcccagaccaaggccacctacggaagcgtcttctcctactgcaacccgccgacgccgggctacgtcggcttcttcgtgctcggcgcccccaacagggtggcctccaggtacgtgctgacgcccatgctcagctaccctcaggcgcccaccttctaccgcgtccagctccgcgccatcaccgtcaacggccagcgcctcgccggcgtgccgcccgccgtcctcgccccgggcaccgtgctcgactcccgcaccgccatcacccgcctgccgccaacggcgtaccaggcgctgcacgccgccttcaggagctccatggccatgtaccgctcggccccgccccagggcagcctcgacacctgctacgacttcactggcgtcgtcaccatcaggctgccaagaatcgcgctcgtcttcgacaggaacgccgtcgtcgagctcgacccctcggggatcctcttccacgactgcctcgctttcatccccaacaccaacgacctgcagcccgccatcctcggcaacgtccagcagcagaccatcgaggtgctctatgacatcgacggcgccgccgtcgggttccgcggcgacgcgtgctagctgatgattgatgaacgccgccacactgccagtgcatttgtattatctaataaataaacccaagatttccatgttgcaatccggcttgtaagcccatgcacgcaggattgtgagcgagctgaagctgagtgcgttttgtttgtttgtttgtgagtcaatgtcaagtagtacgtgttctctgtgatcaatgcattattgtttaacc

SEQ ID NO: 8158 - protein, 488 aa, Panicum virgatum
  misc_feature: Ceres CLONE 1990520
  misc_feature (11)..(334): Pfam Name: Asp Pfam Description: Eukaryotic aspartyl protease
MAVVSPLLLLALLAGGSSLIIPAAAANGEDDGYTFVALSSLKPKDGACFGHRVNPPAQNGTWVPTSLMYGPCSGSGSATASPSLAEVLRQDQLRVDDILRRVSGNASDEKPNRRANSKWSPMTHASKVGGSLGRGSQDSIDPAATGGGGPPSGPPSRLPGVFQTLVVDTASDVPWVQCVPCPVPPCHPQTDTVFDPTRSGSYAPIPCTSPACTQLGPYANGCVNNQCQYRVAYPDGSSSSGTYSTDLLTFNPTTAVPGFQFGCSHSEQGSGSFDNTTAGILALGRGPEALVSQTKATYGSVFSYCNPPTPGYVGFFVLGAPNRVASRYVLTPMLSYPQAPTFYRVQLRAITVNGQRLAGVPPAVLAPGTVLDSRTAITRLPPTAYQALHAAFRSSMAMYRSAPPQGSLDTCYDFTGVVTIRLPRIALVFDRNAVVELDPSGILFHDCLAFIPNTNDLQPAILGNVQQQTIEVLYDIDGAAVGFRGDAC

SEQ ID NO: 8159 - DNA, 1707 bp, Panicum virgatum
  misc_feature: Ceres CLONE 1990594
  misc_feature: Encodes the peptide sequence at SEQ ID NO. 8160
acgagccgtagcatcaatccagtgaccaagtcgccaaccaggcaaccaggaccagcgcggcgcccgccatggccgtcgtcgccccggcgcaagcctcctccggctccaccaccggcgcgcctcacgtgctggtcgtcccgtaccccgcgcagggccacatgcagccgctcctgcatctcgcctcgctcctcgccgctcggggcctccgcctcaccgttgtcgtcgccacgcccgcaacggcccgcctcctcgcgccgctcctcgccgagcacccttcctcggtgcggccgctcgcgttcccttccgccgccgaccacgacacctcgggcccaagctctgtcggcgcatacttccacgcgtacgccgcggcgctccgcggccccctcggcgagtggctgcggtcccgagccgcccgtccagactccggcgacggccgcgtcgtggcggtgatctcggacttcttctgcgggtggacgcagccgctcgcggcggaggcgggcgtgccgcggctcgtgttcgcgccgtccggcctgctcgcaatcgccgccacgcactcgctgttccggcgcacgccgaggccaccggaaggcgatgcggggcgcgggtatgccgtctcgttccctgctctgcccggcgcgccggccttcccgtggcggcaggtctcgcggatgtacaggacctacgcggagggcggcggtggcgagcactccgaggcgatcaaggacaactacctctggaacctggagagcgcggcgttcgtgtgcaacacctgccaccccatcgaggggaagtacctggacgctcagccgctcgaggacctggccggcaagcgcgtctgggcagtggggccggtggcgccgccgccggacagcgcaggcggcgaaggcgaccccgccagagacgtcaccgcgtggctcgacgcgttcccggactcgtcggtggcgtacgtgagcttcgggaccatgatggtgccgccgccgccgcacgcggcggtgctcgcgtccgcgctggagcggagcggcacgccgttcgtctgggccgccgcggcgaccaccctcccggacgggttcgaggaccggacggccgcggctggcacgggggtggtgctccgcgggtgggcgccgcaggtggccgcgctccggcaccgcgcggtgggctgcttcgtgacgcactgcgggtggaactcggtgatggagtccggcgccgccggcgtgccgatgctggcgtggccgatggccgccgaccagttcttcaacgcgcggctggtcgtggaggaggcgcgcgtggccgtggccgcgagctggggcggcttcggcggcgtcccggacgcgaaggacctcgcgcgcgcgttgaccgaggtcgtcggggaggccggcgccggcatgagggcacgcgccaaggagctcgctttgatggtggcggaggcggtaggcgaaggcggcagctcgcggcgggagctggatgggctggtggagaagctacgggaacttggaagtttgggataagacaaggcaccatgatcgaagtcgaagtcaaagatcaagctcaaactctctgctcaagccaaacaagaaacaaaataagttcggcaaaaagtgtttttactcctgaatcatgtttaacatgctccttatgtaccctgctgctgcatttcagttcggttgaactcagtattcagaacatattgaaaaaaaaaaaaaaaaaaaa

SEQ ID NO: 8160 - protein, 478 aa, Panicum virgatum
  misc_feature: Ceres CLONE 1990594
  misc_feature (1)..(117): Pfam Name: UDPGT Pfam Description: UDP-glucoronosyl and UDP-glucosyl transferase
MAVVAPAQASSGSTTGAPHVLVVPYPAQGHMQPLLHLASLLAARGLRLTVVVATPATARLLAPLLAEHPSSVRPLAFPSAADHDTSGPSSVGAYFHAYAAALRGPLGEWLRSRAARPDSGDGRVVAVISDFFCGWTQPLAAEAGVPRLVFAPSGLLAIAATHSLFRRTPRPPEGDAGRGYAVSFPALPGAPAFPWRQVSRMYRTYAEGGGGEHSEAIKDNYLWNLESAAFVCNTCHPIEGKYLDAQPLEDLAGKRVWAVGPVAPPPDSAGGEGDPARDVTAWLDAFPDSSVAYVSFGTMMVPPPPHAAVLASALERSGTPFVWAAAATTLPDGFEDRTAAAGTGVVLRGWAPQVAALRHRAVGCFVTHCGWNSVMESGAAGVPMLAWPMAADQFFNARLVVEEARVAVAASWGGFGGVPDAKDLARALTEVVGEAGAGMRARAKELALMVAEAVGEGGSSRRELDGLVEKLRELGSLG

SEQ ID NO: 8161 - DNA, 1872 bp, Panicum virgatum
  misc_feature: Ceres CLONE 1990606
  misc_feature: Encodes the peptide sequence at SEQ ID NO. 8162
aaaagaaagagaaaataaaaggaagggaaggccgaagccaaaacaaggtaggcggcttcccgacgaaacctcccgttcctccgcgacccctccgccgccgtccgatctcccccacatcgccgccggtaccgcctcctccctcctcctccttatcttcttcctcctctgccttgtgcgcctccccttcctccccccatccaatcattgctcgagcgctccccccctgcgaatccgcaccagctcggcttaagcttcacctcgctgatttggtgctttgctgattaggtgctctgtcaatcaggtgctttgctcttttttttttccttcttcttcttccctctcggtgctttgtttggttcttgccttcgtcgcctcgttttcttctcgagttctcttcgattggattctgagcggttggtgtcttcgtcttgcagtccaatcctgtcgggagagcaggcggttcaagcggttgcccccaacaattcgggggttccgggatctcggttcctgatcggtaggtgggcgggcgggcgtcggatccagcggccgtcatcatggttgtcgatacggtcagcgcgagcacctcaattattgcgccccacctgttcgaccagaggtccaggggcccccaccgccccctccgccggacgttccatgtcgtcgcctgccgccccctggccaccgccttcgcgggccgccgcctcgtggcccgggtcaacaggcagccgtcgccgcggctcgcggactggccggtcaaggcgctggccatgggggtgaccaaggaggccagcccgcgcagggagtaccggggcatccccggggacggcggcgacatgggggatgctggggtcaccaacccggccccatcctggcccccgcggaacagggcggatgaccccaagctgcacaaccccctgctccgcctcgagcggatgggctgcgggtggctcggcgtcgtcttcgagtgggagggggtcatcgtcgaggatgatgccgaattggaaaggcaggcatggttgaccctggcacaggaggaggggaagtcgccgcctccggctttcctgttgaggagagtcgaagggatgaagaacgagcaggcgatttctgaggttctctgctggtcccgggacccctcggagctcaggcgattggcctcacgaaaggaggagatgcacagcagccttcgaggtggctctttgtaccagatgaggaacggttcgcgggagttcatgagcacgctggccaattacaagatccctatcgctgtggccaccacacgcccacggaaggttattgaagaagccatcgaagctgttggcgcgcggaatttctttgatgctgtcgtggcagcggaggatgtctatcgggggaagcctgaccctgaaatgtttctgtacgctgctcagctcctaagcctcatcccggagaggtgcatcgtgttcgggaactccaactccgcagtggaagccgctcatgatgctcgaatgaagtgtgtcgcggtcgcaagcaagcacagaatctatgagcttagcgctgcagatcttgtggtgaagcaactggatgagctatctgttgttgacttgaagaacctcactgacattgagtctccagagtttggcatggaacctgaaccagagatggaggaagaagcatccacaccatcatcatcagtgggtgtagatttattctggtaagaggccagattgtacatttgattgattcctctcctgcacagcatgtattattgtcaactgttgtagcgatcaggaagaagggcttatcatccttctaattagtagaatgtgatatgtaaaaatgttgtttagagctcacacactgtatatatactcagaaaaaaaaaaaaaaaaaaaa

SEQ ID NO: 8162 - protein, 379 aa, Panicum virgatum
  misc_feature: Ceres CLONE 1990606
  misc_feature (1)..(189): Pfam Name: Hydrolase Pfam Description: haloacid dehalogenase-like hydrolase
MVVDTVSASTSIIAPHLFDQRSRGPHRPLRRTFHVVACRPLATAFAGRRLVARVNRQPSPRLADWPVKALAMGVTKEASPRREYRGIPGDGGDMGDAGVTNPAPSWPPRNRADDPKLHNPLLRLERMGCGWLGVVFEWEGVIVEDDAELERQAWLTLAQEEGKSPPPAFLLRRVEGMKNEQAISEVLCWSRDPSELRRLASRKEEMHSSLRGGSLYQMRNGSREFMSTLANYKIPIAVATTRPRKVIEEAIEAVGARNFFDAVVAAEDVYRGKPDPEMFLYAAQLLSLIPERCIVFGNSNSAVEAAHDARMKCVAVASKHRIYELSAADLVVKQLDELSVVDLKNLTDIESPEFGMEPEPEMEEEASTPSSSVGVDLFW

SEQ ID NO: 8163 - DNA, 2009 bp, Panicum virgatum
  misc_feature: Ceres CLONE 1990617
  misc_feature: Encodes the peptide sequence at SEQ ID NO. 8164
actcgacgccaactgggcgcgcaccactccctgaaccctaaacccccgggctcggctcttcacctccggcagaccggcctccgggtaaccgccgcaactgcaactacgcatcgcccctcttgtccggcgtcctcgcctccgtcgttgtcatctccatccctccggaccagcaagacgcggagatctactcgtccggagtttggattgacttcttcctttcgttgtttgtcgcggattcggttgtttgggtcgcggagtatcaacccaggttccgatttggtgattgaagcttcgtttctccatggcgcttcggttcgagatattaggaagattcaatcgtgcccgtgcagctcgcttaactctgccccactttacttgccaaacaccactttttatgcctgttggaactcaaggtacaataaagggcttgacaactgaccaactggaggatataggttgccagattatacttggaaacacatatcatcttgaactacgtccaggttctcaacttattgacgacttgggtggccttcacaaatttatgaattggaaaagggcattgctgactgactctggtggtttccaaatggtttcgttgctgcatttggctgatattactgaggaaggagttacatttcagtcacctgttgatgggaagcccatgctcttgacacctgaggaatctatccatattcagaacaatattggagctgatataatcatggctcttgatgatgttgtgaagaccacaattactggcccaaggatagaagaagctatgtaccgcacccttcgttggattgacaggtgcatagctgctcacaagaaacctgatgtccagaacttatttgggattgtgcaaggaggattggatccagttctcagagatatctgtgtgaagggcttggttgagcggaatcttcctggatatgcaattggtggtcttgctggtggtgaagacaaggactcgttttggcgtgttgttgcccagtgcactgcaggattgcctgaaaataaaccacgatatgttatgggtgttggctatccactcgatattgtagtctgcagtgctttgggtgcagacatgtatgactgtgtttatccaacacgaactgctcgctttgggaccgcccttgttcctgagggtgtcctgaagttgaaacaaaatgcaatggcaactgatgaacggccaattgatcctacctgttcatgcatggtctgcaaaaagtatacacgtgcttacttacattgccttgtaacaaaagatgctatgggttctcaactgctgtcctatcacaatttatcatttatgatgcggttgagtagagacctccacatgtcaattcttgacggacgatttccagaattcgtgcgaggattcttgagggtgcagtttccaaagggagacgttccgcagtgggtccgtaacgcgatggaggtcgctggcattgacatatctgagtgctgcgcttcggccaagtgtcatgtgccaagcatccaggagcaacctttaaccgttccagacgacgcaaatggagttgtgcagcagaattgaagccgctccctgcgtctaaagattaagcacggcaggctttttttcgcgaagaaggtttcctgtcgacatacaatcaagtagggtctcacagtctcaactctcaaccgattcagcatagaattttccaatagtatgctgaagctcacccacaggtttttggtagcatttctgagggcgtcgtgtgcgcgtgtgtttagaaaagaaaaaaacagcaggggcatgcaatttgctgcaccatgctcctggaggcctaggttatacgccgtccagatgagtggatgggaaaaaaattacctgtcattgggtccttggcacgcagtcgccgttaaaagggactcttagtgttgcgttgcggtcagatgaaagaagcttgtaaaagcgtcggtcgccttacgctgaaacatttgttgttgtgacgaatgaaatggtaatccttgcaacgttttccagc

SEQ ID NO: 8164 - protein, 418 aa, Panicum virgatum
  misc_feature: Ceres CLONE 1990617
  misc_feature (1)..(237): Pfam Name: TGT Pfam Description: Queuine tRNA-ribosyltransferase
  misc_feature (12)..(386): SWISSPROT Homolog: EC 2.4.2.29 Queuine tRNA-ribosyltransferase
MALRFEILGRFNRARAARLTLPHFTCQTPLFMPVGTQGTIKGLTTDQLEDIGCQIILGNTYHLELRPGSQLIDDLGGLHKFMNWKRALLTDSGGFQMVSLLHLADITEEGVTFQSPVDGKPMLLTPEESIHIQNNIGADIIMALDDVVKTTITGPRIEEAMYRTLRWIDRCIAAHKKPDVQNLFGIVQGGLDPVLRDICVKGLVERNLPGYAIGGLAGGEDKDSFWRVVAQCTAGLPENKPRYVMGVGYPLDIVVCSALGADMYDCVYPTRTARFGTALVPEGVLKLKQNAMATDERPIDPTCSCMVCKKYTRAYLHCLVTKDAMGSQLLSYHNLSFMMRLSRDLHMSILDGRFPEFVRGFLRVQFPKGDVPQWVRNAMEVAGIDISECCASAKCHVPSIQEQPLTVPDDANGVVQQN

SEQ ID NO: 8165 - DNA, 1918 bp, Panicum virgatum
  misc_feature: Ceres CLONE 1990695
  misc_feature: Encodes the peptide sequence at SEQ ID NO. 8166
ggaattaggcaaaatagacctgtaacttcgggagaaaggtcgccagcgaaggctggccgcagtgaagaggtccaggcgactgtttatcaaaaacacagggctctgcaaaatcgtaagatgaagtatagggcctgacacctgcccggtgctggaaggttaagaggagatgttaactccttacatgcagcaccgaaagaaaagtctacttccttttttcttgtgaacacacggtgctcataaacacgtacttgtgcacataaacaaattaaacacaccaacgatagagaaattttaaagattgactgaagcaccttattgtcgtgtgtgtcgtagaaatggagttcgtttgcaaccaacgatgccccttgctcatggattttaatttttagatcggcacttcggcagtatcaagattatttttacacatctaactttgtaggcgtctacaattttctttttctttttttttgcagatttcccgcaccggaacagctcggggctccacctgatactgcaccacccgcagagcccctgctcaccggcgccgctcccgtccgacctccccttctccaccgtcctcaccctcgacgatgcgcgcgccgcccacctcgcctcgcgcctcgccaccactaatgacgcgccgccgcgccgcccgacgtcgctccgcaagaaggccgccggcggccgcttcgacgactccctggccacggtgccgctctcgccgggcgcgtccataggcgtggggaactacatcacccagctgggcctcggcacgccggccacctcctacgccatggtcgtcgacacgggctcgtcgctcacctggttgcagtgctctccctgcgtggtgtcgtgccaccgccaggccggcccgctctacgaccccagggcgtccagcacctacgccaccgtgccgtgctcggcgtcgcagtgcgacgagctccaggccgccacgctcaacccgtccgcctgctccgtctccaacgtctgcatctaccaggccagctacggcgacagctccttctccgtcggctacctcagcacggacaccgtctccttcggctccagcagattccccggcttctactacggctgcggccaggacaacgaggggctcttcggccgctcggcggggctcatcggcctcgcccgcaacaagctctcgctgctctcccagctcgcgcccagcctcggcgactccttctcctactgcctcccgacgtcggcgtcgacggggtacctcaccatcgggtcctacaacccggggcagtactcgtacacgcccatggcgtcgagctccctcgacgactcgctctacttcgtcaccctatccgggatgtcggtcgccggcagcccgctcgcggtctcgccgtcggagtacagcagcctgccgacgatcatcgactcaggcacggtgatcacgcgcctgccgacgagcgcgtactcggtgctgagcaaggcggtggccgcggccgtgggcggggcagcgcgcgcgccggcgttctccatcctggacacgtgcttcgtgggtcaggtgtcgaagctgcgcgtgccaaccgtgggcatggcgttcgcgggcggcgcgacgctgaagctgccggcgaggaacgtgctcatcgacgtggacgactccaccacgtgcctggcgttcgcgccctcggacagcacggccatcatcggcaacacgcagcagcagacgttcagcgtcgtctacgacgtcgcgcggtccaggatcggcttcgcggccggaggctgcagctgaagggtgaacactacacggcacggcacgcgtggatgtgagagatgccatggcatggtcagctcaggcttggtaattaattggaaatgcatacaagtgtaaatttcaagttgatgaaggttattgtgttacaagttagaaaaaaaaaaaaaaaaaaaa

SEQ ID NO: 8166 - protein, 322 aa, Panicum virgatum
  misc_feature: Ceres CLONE 1990695
  misc_feature (17)..(337): Pfam Name: Asp Pfam Description: Eukaryotic aspartyl protease
  misc_feature (11)..(329): Pfam Name: Asp Pfam Description: Eukaryotic aspartyl protease
  misc_feature (17)..(335): Pfam Name: Asp Pfam Description: Eukaryotic aspartyl protease
MVVDTGSSLTWLQCSPCVVSCHRQAGPLYDPRASSTYATVPCSASQCDELQAATLNPSACSVSNVCIYQASYGDSSFSVGYLSTDTVSFGSSRFPGFYYGCGQDNEGLFGRSAGLIGLARNKLSLLSQLAPSLGDSFSYCLPTSASTGYLTIGSYNPGQYSYTPMASSSLDDSLYFVTLSGMSVAGSPLAVSPSEYSSLPTIIDSGTVITRLPTSAYSVLSKAVAAAVGGAARAPAFSILDTCFVGQVSKLRVPTVGMAFAGGATLKLPARNVLIDVDDSTTCLAFAPSDSTAIIGNTQQQTFSVVYDVARSRIGFAAGGCS

SEQ ID NO: 8167 - DNA, 1797 bp, Panicum virgatum
  misc_feature: Ceres CLONE 1990803
  misc_feature: Encodes the peptide sequence at SEQ ID NO. 8168
aagcacttcgcacgcttcagtcactcgctaccacgcaaacttccccacgctcgctatagacccgacttgcgccttccccgtccaccgactgcagcagccacgccgttaggctcccctcgttccacacgccaactttccgatcagcacacgacacccgtcgattcgggccctgcgccgagccccgtttctgtgcccgccgcactccgcttggtcgccagctgcgcgcgctgacagctgcacgacgccctcggcctcctgacacgacagcggcgccccgagccacaacctcccctccgaccaccgccatgctccgccgcaccctcgcggctgcgctcgccgccaccggcctggtgcacgcccagaaggccgcccccggccagaattgcccaaaggactcgccatgctgcggcctgtatatggactgcggcgtgggcgcctactgcgtccagggctgcgaccccgtgcactcgcactcgctcgaggcctgcgtgcccaacccgcagtgcaagaagggtacctacaagttcgactcgctcaacgacgtccagaccatcgacaagtacctgggcgatgactccaagatcaattgggtctcgcagggcaagcccgtcctgtacaacgatgctgtccttctgaccatggccgagggcaccgtcggcaccctgctctcctccgccttctacgtctggtacggcaaggtctgcgcccagatgacgacgtctcagggccagggtgttgtcacggccttcatcctcatgtccgacgctaaggacgaaatcgactatgagtgggtgggcgttgacgtcaacacggcccagtccaacttctacttccagggcatcaccaactacaataacggcaagaacctgcccgtgtccaataccgtcaccagtgtacacaattactgtatcgactggacgcccgatcagctcaagtggactgtcgacggcgacgtcaagcgcactttgaacaagaaggacacctggaacgagacatccaagaactaccactatcctcagacgccctcccgtattatgctgtccctgtggcccgccggtctgccatccaacgaggagggcaccattgagtgggctggcggtgagattgactggaactccaagtacatgcagaacggctactactacgccatggtgaaggaagtcaccgtcgactgctacgacccgcccgccagcgccaagggtaacggcggcaagacctacatctacaaggaccgcgccgccgtcgaaggcagcgttgagctttccgacaagcacgttgttctcggttcgctgtatgccactggcgaggaccccgatgagggtgccgagacggccacctccaaaggcgcgaagcccaccaaagccgtgaatgtcgtccccggcggcgttatcggtggtagtggccgcggcgagggcgtcgagaccagcgccctggccactgtgaccgatgccaatggccagccgcagcagacgggcggcaacgacggcggcaacggtggaaacaacggcaacaacggcaacaacggcggcggcgaccggtccttcaaccagggcggcggcaacgacgagggcgcgggctccatcaccaaggtcggcggtggtgctatcgccttcgccattggactcctcggcctcgtcgctctatgatctgaccgccttgctgatacgcgcaagtcgagaatttttgcttcttggattggtttggattgaggcgctgtcgaatcacgattgtctaattgggtcgtacatattaccgctatataccatgcttagcagccaaaaaaaaaaaaaaaaaaaa

SEQ ID NO: 8168 - protein, 446 aa, Panicum virgatum
  misc_feature: Ceres CLONE 1990803
  misc_feature (1)..(176): Pfam Name: Glyco_hydro_16 Pfam Description: Glycosyl hydrolases family 16
MLRRTLAAALAATGLVHAQKAAPGQNCPKDSPCCGLYMDCGVGAYCVQGCDPVHSHSLEACVPNPQCKKGTYKFDSLNDVQTIDKYLGDDSKINWVSQGKPVLYNDAVLLTMAEGTVGTLLSSAFYVWYGKVCAQMTTSQGQGVVTAFILMSDAKDEIDYEWVGVDVNTAQSNFYFQGITNYNNGKNLPVSNTVTSVHNYCIDWTPDQLKWTVDGDVKRTLNKKDTWNETSKNYHYPQTPSRIMLSLWPAGLPSNEEGTIEWAGGEIDWNSKYMQNGYYYAMVKEVTVDCYDPPASAKGNGGKTYIYKDRAAVEGSVELSDKHVVLGSLYATGEDPDEGAETATSKGAKPTKAVNVVPGGVIGGSGRGEGVETSALATVTDANGQPQQTGGNDGGNGGNNGNNGNNGGGDRSFNQGGGNDEGAGSITKVGGGAIAFAIGLLGLVAL

SEQ ID NO: 8169 - DNA, 1740 bp, Panicum virgatum
  misc_feature: Ceres CLONE 1990830
  misc_feature: Encodes the peptide sequence at SEQ ID NO. 8170
aattaattaaatcagaaatagtttgaaaacatctggagtgcgcatctctaaaaatggaaggaactgacgctgacaaagcccttgagttcaagacacaaggaaatgaagcttttaagaagaaagaatacgtaaaagctattgaagcctacacaaaggctattgatttgaatcccgctgatgcatctttctatgctaatagagctgcttgctatctcggcctgaagaagtacgccaagtgtattgaagattgcgatgcaactttgaatattgaccctaacttcactaaggcttggttgagaaaaggaagaagcagcttctgtctcggcaaacttgaagaagctagaagatacatcgaaaaagcaatagaacttgatccaaaggataaaaccttcaaggatgagctaaatgaagttgttcatgtcgaaagaatgatggctagcgctaaacaagaaatcgcaaacgagaaatatactggcgctttgatggaaataaagcaaattttgaaaatatgcccagatctcattgaagccaaaatcaaatatatcgagctcctcattaaaatgggaaatgttgaaaatgccattcaacttagtggagaatatttccatgatcttactggaaacccggattttctctacatcagaggtctagctctgtgctacaacggtcaagtagaccttgccaagaaaacctggatggaagctatgagactcgatcccgataatacaacttgcaggcttgctcttaaaagaatgaatcgtcaagaagaagctaaagagaagggaaatgctgcttttaaatctgcaaactatgaagcagctgttactcactacacagaaggtatcgagcaagatccattcaacaaaaatattgtgagcactctctatgctaatagggctgctgccaacttaaagctaaagcgtcataaagaagctatttctgactgcgataaagctattgaaataaatgatggttatgccaaggcctacctccgaagaggagacatcagaatggaaattggagaatatgaagaagccagcagagactttaacaaggctcatcaattagatccaagccttggagcaagacagagaattagagatgctgacttggaagctaagaaggctgccagaaaagattattataagatcttaggcgttgagaaaacagccggagatgacgaaattaaaaaggcttatagaaaaatggccttgaagtggcatcctgacaaggctggcaatgaggaagagcagaaaaaaattgcagaacaaaaattcaaagacatcaatgaagcctattcagttttgagtgatgctcaaaaaagacaaagatatgactctggagccgatttagaaggtgactttggaggcttcgacggaggaggtattgatcccaatatcatcttcagaagcttcttcggcggcggaggcggtggcttcggcggtggagatgatttcggaggttttggaggattcccaggcttcggcggtggcggcggaggcagaaagaatggaggtttcagctacacctttaagatgggttaaagcatttatcgaaagaacctgtttgtttaaaagtgttgttttgtggtagagcttgttattgagtttaattcgcaattttttaagaggcctcctttttaaaagactgcttgaataatgaaattatatgattatcaactatgttgcttaaaccttttcttaaaagcaagtccgaacttaaaaaaaaaaaaaaaaaaaa

SEQ ID NO: 8170 - protein, 496 aa, Panicum virgatum
  misc_feature: Ceres CLONE 1990830
  misc_feature (1)..(68): Pfam Name: DnaJ Pfam Description: DnaJ domain
MEGTDADKALEFKTQGNEAFKKKEYVKAIEAYTKAIDLNPADASFYANRAACYLGLKKYAKCIEDCDATLNIDPNFTKAWLRKGRSSFCLGKLEEARRYIEKAIELDPKDKTFKDELNEVVHVERMMASAKQEIANEKYTGALMEIKQILKICPDLIEAKIKYIELLIKMGNVENAIQLSGEYFHDLTGNPDFLYIRGLALCYNGQVDLAKKTWMEAMRLDPDNTTCRLALKRMNRQEEAKEKGNAAFKSANYEAAVTHYTEGIEQDPFNKNIVSTLYANRAAANLKLKRHKEAISDCDKAIEINDGYAKAYLRRGDIRMEIGEYEEASRDFNKAHQLDPSLGARQRIRDADLEAKKAARKDYYKILGVEKTAGDDEIKKAYRKMALKWHPDKAGNEEEQKKIAEQKFKDINEAYSVLSDAQKRQRYDSGADLEGDFGGFDGGGIDPNIIFRSFFGGGGGGFGGGDDFGGFGGFPGFGGGGGGRKNGGFSYTFKMG

SEQ ID NO: 8171 - DNA, 1871 bp, Panicum virgatum
  misc_feature: Ceres CLONE 1990940
  misc_feature: Encodes the peptide sequence at SEQ ID NO. 8172
aggagaataataattgcagtttaaaaaagggggatgcggctgcttaccatttcctggatcagtttgggggaagatgctatctttatcttccagttcatttttttaacatatcagtattcatgttcttccctgtcaatttggcgcgattagtttcctaaggaaaggtgacatctgttctacacttgatccatgtggatgcagtaccaagtgctttgagtggtagtgtcttaccggatcagttgaggtacaagcgccatggggctccttggtatgatgggagattcgtttgggtgctcagctaccggtgagcgactcgtctccgccgcaagggatggagacattcaagaggctagagccctcttggagctcaacccccgccttgcccggtactcaacatttgggatccggaactcgccactccattactcggctgcgaagggtcaccatgagactgctctgatgcaagcttgtctatatggtcactggaaagttgtacagattctagttcttttcaaagctaatattcacaggagagattgttttagtggcgcgacagctattcattttgccgccctgaaaggtcatactcggtgcattcggcttcttgtggctgattacgtgccgagcttgtcagagttttggaacgttatgcatggaaagtccagagatgaagcaaaaaaggatgtctttgatgcagtatctctccggaggctaattaatggaaagtcggatggtggcgtcaccccgcttcacttggcagcccttcatggccatgctgagagtgtgcagttgctattagatcttggagcttcggtgtctgaggtcacagtcagtgatggttcaactattgacctcattggttcaggtagcactcctctccattatgcggcatgtggtggaagtgctgtctgctgccaactgctcattgcagcaggagcgaacatcggagctgaaaatgctaatgggttgactcctcgagatgtggctcgttcgtggcacaaaaatagtgttgaaggcatcctaagcaaacagccagaaggccgaatatgcattcttccttcaccatatctgtgtctaccattgatgagcattgtcaaaattgctcgtgagtgcggatggagaaagacttctgcctcctccacatgtcaggatccatgtgtcatatgtatggaggtggaatgcacggtggctgcagaaggctgcggccatgagttctgcaccaaatgcgcactctatttgtgttcaaccacaagcagctcaacatccatccgtggcaatcctggctccgtatcatgccctttgtgccgtcatgccattgtctctttcaggaagctcacaagtaccactccaataaaggagcttccatggacaagcacatcactagctctatgtgcggcaggcgcaagcactggttccaatcatgccagctccttgcatcgtcggcctgacacgcatcgattgcgctcctcctcggttcagttgggatgctcctcttttagatccattggctctgggaaactgtcgtcattgaagttgaactgcacaggagctgaagaggcggtgccttgcctcatcagttgtctccggccagatgtgcagcggtcctcatcgtacagggaaagaattagaagatattcagagttttgatagcagccctctgttggttctctgcctcccttcctgcgagtttttggggtttggccgttcaaacttgtttagtgtctgtccatgtttctctttgcttctgtgtttcttgtcatgtaatatgcagcagtctcgtgctgaagatctgtttgtgtacatgactcgttcatctacttatatgtgaagtatataccatctccgttttacaaaaaaaaaaaaaaaaaaaa

SEQ ID NO: 8172 - protein, 463 aa, Panicum virgatum
  misc_feature: Ceres CLONE 1990940
  misc_feature (1)..(50): Pfam Name: zf-C3HC4 Pfam Description: Zinc finger, C3HC4 type (RING finger)
MGLLGMMGDSFGCSATGERLVSAARDGDIQEARALLELNPRLARYSTFGIRNSPLHYSAAKGHHETALMQACLYGHWKVVQILVLFKANIHRRDCFSGATAIHFAALKGHTRCIRLLVADYVPSLSEFWNVMHGKSRDEAKKDVFDAVSLRRLINGKSDGGVTPLHLAALHGHAESVQLLLDLGASVSEVTVSDGSTIDLIGSGSTPLHYAACGGSAVCCQLLIAAGANIGAENANGLTPRDVARSWHKNSVEGILSKQPEGRICILPSPYLCLPLMSIVKIARECGWRKTSASSTCQDPCVICMEVECTVAAEGCGHEFCTKCALYLCSTTSSSTSIRGNPGSVSCPLCRHAIVSFRKLTSTTPIKELPWTSTSLALCAAGASTGSNHASSLHRRPDTHRLRSSSVQLGCSSFRSIGSGKLSSLKLNCTGAEEAVPCLISCLRPDVQRSSSYRERIRRYSEF

SEQ ID NO: 8173 - DNA, 1734 bp, Panicum virgatum
  misc_feature: Ceres CLONE 1991008
  misc_feature: Encodes the peptide sequence at SEQ ID NO. 8174
gctacatctcgaaccaaagcctggacctcataggcaacgaaagcgaaggatcgatctccaccgatcccgctgatttcttgaaatctcagctcccaaagccgcgatttttattttcccctttccggttggacagctgctgcggctggaggcattgttggcgaccggagctgcaaccatcgatcctttgcttgaggtaatggagcattttggatttgttcctgccactttctggtaagagggccgttttcctcccgtgccctctgctccctctccctcagtcttcgccgaccctccctgcgccccctctttctcgcgctccggcaaggcgcggcggtcgtcgctctccacgtccctccgcacccgccgcttgccaccccctccccgaccaaggatctgcaccgccgccgctcctgcccttcccccgaccggagcagcgccgcctgcctctcccttgctgtgcgccgttgcgtccccattttggcaatcaggagctattgtctataaaggcctcagttcagatcattatcaagcatgtctctcctttcaaagttacgtttgatcaccgtggacgtgactggcacgcttatcgcttacaaaggacatcttggggattactactgtatggcagctaagtcagctgggatgccatgtcctgactataaccgtgtgcatgagggcttcaaggttgcatacactgagatggcaagacagtacccatgctttggatttgcagcaaagatgccgaacattgaatggtggaggacatgtgttaagaattcgtttgttaaggctggctatgattatgatgaggagacatttgagaaaatcttcaggcgcatttattctgcttttggctcctcggccccatactcagcatttcctgatgcactgcccttcctgaggtgggcgcgggtgaagggactcacagttgggattgtcagcaatgcagagtaccgctacaaagatgtaatcttgccagccttagggttgaatcagggctcggaatgggactttggggtgttttcaggcattgttggtgtcgagaagccagatccaagaatttacaagatagcgctggagatggcaggaaatattgcgccagaagaagcactccacataggtgacagcatgcggaaggactacacccctgcgaggagcgttgggatgcatgcgctgctcctggaccggttcaagacggccgacgctgagagctggaggcagtctggcgcgacagtgctccctgacctggttgccactcaagagtggctcaccaagaaccagaatgaggaaccgaagcacgagacagtagcagctcaagtgctgaacagaatgtctgaaaagctaaagatgggagcgtaaagcccacagagagttcctttttatgcgccggttgtgaactgaagataggtgatggttcttgactactggctagtgtaattagcctaagctgctggctgttgtaatgcctactggggcttatgctgattgctgaatatgactagcaaatcagtgtcatgactgtctactgatgaagacttcctggttccgatttccacctatgtggatcaataaagaagaggaaatggatttcacatgtgcgacgagttttttccgtttttaacatatgtgaaagggcattttgatttctgtatcttgtgcttccaatatgaattaattaataataatgaaagatagtatagaagggcattttgataaaaaaaaaaaaaaaaaaaa

SEQ ID NO: 8174 - protein, 275 aa, Panicum virgatum
  misc_feature: Ceres CLONE 1991008
  misc_feature (1)..(214): Pfam Name: Hydrolase Pfam Description: haloacid dehalogenase-like hydrolase
MSLLSKLRLITVDVTGTLIAYKGHLGDYYCMAAKSAGMPCPDYNRVHEGFKVAYTEMARQYPCFGFAAKMPNIEWWRTCVKNSFVKAGYDYDEETFEKIFRRIYSAFGSSAPYSAFPDALPFLRWARVKGLTVGIVSNAEYRYKDVILPALGLNQGSEWDFGVFSGIVGVEKPDPRIYKIALEMAGNIAPEEALHIGDSMRKDYTPARSVGMHALLLDRFKTADAESWRQSGATVLPDLVATQEWLTKNQNEEPKHETVAAQVLNRMSEKLKMGA

SEQ ID NO: 8175 - DNA, 1825 bp, Panicum virgatum
  misc_feature: Ceres CLONE 1991009
  misc_feature: Encodes the peptide sequence at SEQ ID NO. 8176
agcgagacgagacgagacgagacggagacgtaacctcgtctcccccacatggcctgggcgcgcctcgccgcccgctgccgtctccgcccgggcgccgcctccgccgtcggccgaggcccacacgccccgccgcctccgcagccgcaggcgggacacgcggcccctgccgcgccgccgctccggcgggacctccgcgtcccccaactccactccgccgccgccgcgtcctcggcgccgcacgcgcggctgctcggcgaccggtggcagcgcctgggcgccgcgaggaggtggctcgccagcgaagcccccgcggcgccggcgccggcgggggaggcgcctgagctggtggaagttccgctggcgcagactggggaaggcatcgccgagtgcgagctgctgcgctggttcgtcaccgagggtgaccaagtagatgaattccaaccactctgtgaagtacagagtgacaaagctactattgagataacaagtcgtttcaaaggaaaagtacatcagattcactttggcccaggtgacatagttaaggttggtgaaactttactgaaaatgattgtgggtgacagccaaattgtatctccagatagcatatttccatccgctgataagtcacttggagtagagtctgcggttccttcaagtgaaggcaatgttcctagtggaacactctctacaccagctgttaggcatctagcaaagcagtatgggatcaacataaatgaaatcgttggaacagggaaagatggtagggttttgaaagaagatgtgttgaactatgctgttaacaagggtctttgcaaagaacaatcatcatcgttggaagagaacattggtcaagttgagttactggaggaaaggaaatcattatccgacatgcccttgtatgaagataagaaaattcttctcaggggttaccagagagcaatggtcaaatcaatgagcctggctgcaaaagttccacattttcattatctggaggaaataaattgtgattctcttgtgcaactgaagaccagatttcaaaatgagaacaaagataacactatcaagcacactttccttccattcctcataaagtcactttctatggccctgagtaaatatcctatgttgaacagctctttcattgaggaaaccaatgaagttgtgttgaaaggatcccataacattgggatagcaatggctacagcacacggtttagtcgtgccaaacatcaagaaagtgcagtcactgtcaatattggagatcacaaaggaattggtgcggttgcatgagatggcatcacacaacaggctaagcactgcagatattgaaggtggcaccataacacttagcaacataggcgccattggtggcaagttcggctctccacttctgaacctgcctgaagttgccatcattgccctggggcgcattcagaaacttcctcgctttgatgatgacgaaaatgtttacccttcatccataatcaatgttactgttggagcagatcaccgagttgttgatggggccatggttgcaagattctgcaatgagtggaagggcctcgtggagaagccagagctgctcttgctgcatatgcgatgatccagtaagatacctgatgcgaggggattgcccagaatttgtaaagatgggctgaaatggaggcattccggcatcgcagcttcacaccgtaagcctatataggcagtcactcacgtatgtatacaaataagacgtcgcctgcaaatagtggactcgcatcatgtatatgaccgtacacctttgcaataaaacgggggattttcaaaaaaaaaaaaaaaaaaaa

SEQ ID NO: 8176 - protein, 517 aa, Panicum virgatum
  misc_feature: Ceres CLONE 1991009
  misc_feature (2)..(232): Pfam Name: 2-oxoacid_dh Pfam Description: 2- oxoacid dehydrogenases acyltransferase (catalytic domain)
MAWARLAARCRLRPGAASAVGRGPHAPPPPQPQAGHAAPAAPPLRRDLRVPQLHSAAAASSAPHARLLGDRWQRLGAARRWLASEAPAAPAPAGEAPELVEVPLAQTGEGIAECELLRWFVTEGDQVDEFQPLCEVQSDKATIEITSRFKGKVHQIHFGPGDIVKVGETLLKMIVGDSQIVSPDSIFPSADKSLGVESAVPSSEGNVPSGTLSTPAVRHLAKQYGININEIVGTGKDGRVLKEDVLNYAVNKGLCKEQSSSLEENIGQVELLEERKSLSDMPLYEDKKILLRGYQRAMVKSMSLAAKVPHFHYLEEINCDSLVQLKTRFQNENKDNTIKHTFLPFLIKSLSMALSKYPMLNSSFIEETNEVVLKGSHNIGIAMATAHGLVVPNIKKVQSLSILEITKELVRLHEMASHNRLSTADIEGGTITLSNIGAIGGKFGSPLLNLPEVAIIALGRIQKLPRFDDDENVYPSSIINVTVGADHRVVDGAMVARFCNEWKGLVEKPELLLLHMR

SEQ ID NO: 8177 - DNA, 1656 bp, Panicum virgatum
  misc_feature: Ceres CLONE 1991044
  misc_feature: Encodes the peptide sequence at SEQ ID NO. 8178
gtacttccagctttgcatcggcgacttacattttccacatgacgaagatcaccgtgcagtcgtccaaggccgttaaacccgactacggcggcggcgacactccggccaccgccttcgtcccgctcaccgtgttcgacctcatcagcttcgacgactacatgttcggcgtccacgccttccacccgccgtccccgcccaccgccgccctcgaggcggggctcgcccgggcgctggccgagtaccgcgagtgggccggccggctgcgcgcggaccccgccaccggccgccgcggcatcctgctcaacgacgcgggcgtccagttcgtggaggcggcggcggccgacggcaccacgctcgcgagcgtcatgccgctgctgcagcccacgcccgaggtccggcgcctccacccgagcgccggcggcggcggcggcgacgacggcgccggggagctgatgctggtccaggtgacgaggttcgcgtgcggctccctcgtcgtgggccacgccatgcaccacgccgtcggcgacggcttcgccatcagccggttcctggtcgcgtggggccaggccacccgcggcgtcgccatcgaccccgtcccggtgcatgatcggacgtccttcttcgtgccccgcgacccgccgcgggtcgagttccagcaccgcggcgccgagttcaagaagccacgcgagaggaaagacgacgacgcgcgcagaagcatcgacagcggcgccggcgacgaggtgttggtccggcacgtgcgcttcagccgcgagttcatctccgagctcaagtcccgggcgtccgctggcgcgccccgaccctacagcacggcgcagtgcctggcggcgcacctctggcggtgcgtgaccagggcgcggggcctcggcggcggcggcggcggcggcggcggccgcgtcacggccctgcacctcgccgtgaacggacgggcgcggatgccgcgggtgccggaggcgtacacgggcaacctcgtgctctgggcgcacccggccaccacggcgcgggacctgctggcggggcccctcggccgcgccgccgagctcgtccgcgcggaggccgcccgcgtcgacgacgcctacttccggtcgttcatcgacttcgcgagctccggggccgtggaggaggaggggctcgtgccgccgctggccgacccggaggccgcggcgctgggcggcgacgtcgcggtgtactgcctgctgcgggtcccgttctacgacgtggacttcggcggcggccggcagttcttctacacgccggggtactacccggcggagggcgtcgtctacatcctgccgccgtccccgttgggcgacgggagcgtggaagcgcacgtgtctctcttcagccgcgccatggagaccttcaaggcctgctgcttctcgattgagcaccacgaagcacttcaggatcagtaattaaattaataatataccgatggcctctgcatgcttattagcatcatgtcggccatttgcttcattattattattaccagggctgtagcccgggtcctggtctaaaaaatcagggtgtgtttagttggtgaaaaaatttaggttttggtattgtagcatatttcgttgttacttgataaataatgtctaattatgaattaattaaaaaaaaaaaaaaaaaaaa

SEQ ID NO: 8178 - protein, 464 aa, Panicum virgatum
  misc_feature: Ceres CLONE 1991044
  misc_feature (2)..(438): Pfam Name: Transferase Pfam Description: Transferase family
MTKITVQSSKAVKPDYGGGDTPATAFVPLTVFDLISFDDYMFGVHAFHPPSPPTAALEAGLARALAEYREWAGRLRADPATGRRGILLNDAGVQFVEAAAADGTTLASVMPLLQPTPEVRRLHPSAGGGGGDDGAGELMLVQVTRFACGSLVVGHAMHHAVGDGFAISRFLVAWGQATRGVAIDPVPVHDRTSFFVPRDPPRVEFQHRGAEFKKPRERKDDDARRSIDSGAGDEVLVRHVRFSREFISELKSRASAGAPRPYSTAQCLAAHLWRCVTRARGLGGGGGGGGGRVTALHLAVNGRARMPRVPEAYTGNLVLWAHPATTARDLLAGPLGRAAELVRAEAARVDDAYFRSFIDFASSGAVEEEGLVPPLADPEAAALGGDVAVYCLLRVPFYDVDFGGGRQFFYTPGYYPAEGVVYILPPSPLGDGSVEAHVSLFSRAMETFKACCFSIEHHEALQDQ

SEQ ID NO: 8179 - DNA, 1376 bp, Panicum virgatum
  misc_feature: Ceres CLONE 1991076
  misc_feature: Encodes the peptide sequence at SEQ ID NO. 8180
aggcccagccgcagcgaccgatcgcttcagccccacgccgcggtggccatggcggaggctcccactcccacgacgccggcgcgaaagccgaagccgccgatgtcgcgcctcatgcggctctccctcacggtcgtggaccgcgtcaccgacgccacccgccgcgccgacggcacgctgaaccgcctcgcgctgtccctgctggacccgcgcgtcccggccatctcctccccgtgccgcggcgtcgcgtcccgggacgtcgtcctcgaccgcgccacccgcctccacgcgcgcctcttccacccggcggcagcgaaggccggcgcggcgcggccgctccccgtgatcgtcttcttccacggcggcgggttcgcgttcctctccgcggcgtccccggcctacgacgcggcttgccgccgcatcgcgcggtacgcctccgcggcggtgctctccgtcgactaccgccgcgccccgaagcaccggttcccggcgccctacgacgacggcctcgccgcgctccgcttcctcgacgatcccaagaaccacccgccgctcccgctcccgctggatgtcgcccgctgctacgtcgccggcgacagcgccggcggcaacatcgcgcaccacgtggcccgccgctacgccgccgacgcggcgtccttcaggagcgtccgcctcaggggcctcgtcgccatccagcccttcttcggcggcgaggaacgcaccgactccgagctccggctcgacggcgccgcgcccatcgtgtccatcgaccgcaccgactggatgtggcgcgcgttcctgccgcccggcgccgaccgcacccacgaggccgccaacttcgcgcacccggccgccgcggccgggctcgagtccccggcgttcccgcccgtgctgctcgccgtcggcggcttcgacccgctgcaggactggcagcgccggtacgccgagacgctcacgggcatgggcaaggacgtgcacgtggccgagtacccggacgccatccacgcgttctacctcttccccgtgttcgacgacgcccgggacttgatcatacgcatcgccgagttcgtcgccgagagcgcgccggcggcggcggcgagtgaccaaccgtgacgggtgctcgccgtcgccgtcgttgtcaagtggtgtgtgtcgtggagtgtttggtccgagtgtctggttgcgtcgtggcgtttgcatgggaggatagggccaggtgtggttgcgtgggtgaaagagagtagaaaatgtgtgtgattttgtaataatatatgtttactctggcaagtttggtatacatgatgggtgtgatgagtgatgtaaattaatttatttactaatccagtcggtgatttcgtgaaaaaaaaaaaaaaaaaaaa

SEQ ID NO: 8180 - protein, 353 aa, Panicum virgatum
  misc_feature: Ceres CLONE 1991076
  misc_feature (1)..(227): Pfam Name: Abhydrolase_3 Pfam Description: alpha/beta hydrolase fold
MAEAPTPTTPARKPKPPMSRLMRLSLTVVDRVTDATRRADGTLNRLALSLLDPRVPAISSPCRGVASRDVVLDRATRLHARLFHPAAAKAGAARPLPVIVFFHGGGFAFLSAASPAYDAACRRIARYASAAVLSVDYRRAPKHRFPAPYDDGLAALRFLDDPKNHPPLPLPLDVARCYVAGDSAGGNIAHHVARRYAADAASFRSVRLRGLVAIQPFFGGEERTDSELRLDGAAPIVSIDRTDWMWRAFLPPGADRTHEAANFAHPAAAAGLESPAFPPVLLAVGGFDPLQDWQRRYAETLTGMGKDVHVAEYPDAIHAFYLFPVFDDARDLIIRIAEFVAESAPAAAASDQP

SEQ ID NO: 8181 - DNA, 2034 bp, Panicum virgatum
  misc_feature: Ceres CLONE 1991135
  misc_feature: Encodes the peptide sequence at SEQ ID NO. 8182
acgtcaatccgctaattattcttgtctgtctcaagcagcgatttccctccaagttcaccgtcatcagactggtcttgcacaaggaccacgaagctcaacttcaaccggaacccgatctctttcttcttccctccagctttccgacagagaacacagcagaaatggcggcacaagcgattaagagcgccctgcccacgcacctcaagcccggcaacaacaacggcgacgaggccgagttcgccaagaggcatcatggcaagacacgatcccacatggccttcgagaatacctcgaccaacatcgccgccgcccagatgcgcaatgcgctcacaaatttggccgagactgtgaaggacccggagcagaagaagctgttcgaaactgagatggacaacttcttctcgctcttccgccggtacctgaacgacaaggccaagggcaacgaggtctcgtgggaccgcattgccccccctgccgagggccaagtcgtcgactacgaggatctcgccaactccgagtcggtcagcttcctcaacaagctggccgtgctgaagctgaacggtggcctgggtacctctatgggctgcgtcggccccaagtccgtcgtcgaagtccgtgacggcatgtccttcctcgacatgtcggtccgccaggtcgagtacctcaaccgcacatacggctccaacgtgcccatcgtgctcatgaactcgttcaacacggacgaggacaccgccgccatcatcaagaagtacgaaggccacaatgtcgacattctcacgttcaaccagtcccgttaccccagaatttacaaggactcactcctccccgtgcccaagtcgttcgactcggccctccacgactggtacccgcccggacacggtgacgtgttcgagtcgctgtacaactcaggcattctcgacaagctcctggcccgcggcatcgagatcatcttcctctccaacgccgacaacctgggcgccgtcgtcgacctccgcatcctgcagcacatggtggagagcgaggccgagtacatcatggagctgaccaacaagaccaaggccgacgtcaagggcggcaccattatcgactacgagggcagcgtgcggctgcttgagatcgcgcaggtgcccaaggagcacgtcaacgagttcaagtcgatcaagaagttcaagtacttcaacaccaacaacatctggatgaacctcaaggccatcaagcgcgtcgtcgagaacgacgagctcgagatggagatcatccccaacggcaagaccatccccggcgacaagaagggcgagtccgacatcagcatcctgcagctcgagacggccgtcggcgccgccatcaagcacttcaagaacgcccacggcgtcaacgtgccccgccgccgcttcctgcccgtcaagacgtgctccgacctcatgctcgtcaagtcggacctgtacactgtgaagcacggccagctgcagatgagcgccaaccgcttcggcgacgcgcccctcatcaagctcggcagcgactttaagaaggtctcggacttccagaagcgcatcccctccatccccaagatcattgagcttgaccatctgacgattaccggcgccgtcaacctcggccgcggcgtcacgctcaagggcaccgtcatcattgttgctaccgagggccagaccatcgacatcccgccgggatccatcctggagaatgttgttgtgcagggtagcttgcgcttgctggagcattaagagtatgcgtcgcgttgggctggttttcattgatgggcatggatgggtggtatggctggccttgttgcgttttccgtcgccgtgacgcgtgagatacaattttgcggcccttttctttgcatatgcttttgatgggagggaaaaacggagggttaatttatggcttggtttgctcgcctcggctctgaaaccagagtgaaaagaggcgggggactggaagccacctgacaccgatagacgttttgtagttgagcattttatgggcgatttaaagcaaaaaaaaaaaaaaaaaaaa

SEQ ID NO: 8182 - protein, 525 aa, Panicum virgatum
  misc_feature: Ceres CLONE 1991135
  misc_feature (1)..(414): Pfam Name: UDPGP Pfam Description: UTP--glucose-1-phosphate uridylyltransferase
  misc_feature (1)..(416): Pfam Name: UDPGP Pfam Description: UTP--glucose-1-phosphate uridylyltransferase
  misc_feature (1)..(415): Pfam Name: UDPGP Pfam Description: UTP--glucose-1-phosphate uridylyltransferase
  misc_feature (1)..(413): Pfam Name: UDPGP Pfam Description: UTP--glucose-1-phosphate uridylyltransferase
  misc_feature (29)..(525): SWISSPROT Homolog: EC 2.7.7.9 UTP--glucose-1-phosphate uridylyltransferase
  misc_feature (75)..(525): SWISSPROT Homolog: EC 2.7.7.9 UTP--glucose-1-phosphate uridylyltransferase 2
MAAQAIKSALPTHLKPGNNNGDEAEFAKRHHGKTRSHMAFENTSTNIAAAQMRNALTNLAETVKDPEQKKLFETEMDNFFSLFRRYLNDKAKGNEVSWDRIAPPAEGQVVDYEDLANSESVSFLNKLAVLKLNGGLGTSMGCVGPKSVVEVRDGMSFLDMSVRQVEYLNRTYGSNVPIVLMNSFNTDEDTAAIIKKYEGHNVDILTFNQSRYPRIYKDSLLPVPKSFDSALHDWYPPGHGDVFESLYNSGILDKLLARGIEIIFLSNADNLGAVVDLRILQHMVESEAEYIMELTNKTKADVKGGTIIDYEGSVRLLEIAQVPKEHVNEFKSIKKFKYFNTNNIWMNLKAIKRVVENDELEMEIIPNGKTIPGDKKGESDISILQLETAVGAAIKHFKNAHGVNVPRRRFLPVKTCSDLMLVKSDLYTVKHGQLQMSANRFGDAPLIKLGSDFKKVSDFQKRIPSIPKIIELDHLTITGAVNLGRGVTLKGTVIIVATEGQTIDIPPGSILENVVVQGSLRLLEH

SEQ ID NO: 8183 - DNA, 1802 bp, Panicum virgatum
  misc_feature: Ceres CLONE 1991173
  misc_feature: Encodes the peptide sequence at SEQ ID NO. 8184
atgtcgtacccaacactgatattaagcttacctttctcttcgttccttggctgccaaagtgagacggcaactccactccacaccatggcggctgattcccaccggtgcaccagcgccgccgccgagctggagggcacgctcctcatctccggcagcctcttcccatacttcctcctcgtcgcccttgaggccggcgggccactcagggccgccgtcctgttcgccgtgtaccctctcgccgcgctgctcggcgccgccttcacggacgacctccctctcctcgccatgacgttcctgtccaccgccggcctcggcgtcggcgacgtggcggcggtggcgagggccacgcttcccaggttcttcctggcggacctccggcgcagcgcgttccgggccctagcgcgccacgccggcgagaggtacgtcgtgacgcgcctgccgaggctcctggcggagccgttcgtcagggagtacctcggcgccgacgtccgcgtcgccggcatggagctccgggtggtcgggaggcggttctccgggaccgtggcctcgccgggcgtcgaggctggcgctgaccggtgcctgggagctctggcggccgttctcgggcgcgaccggatcgtcgacgtcgggctgtgctccggcgcgtccggcggcgaccggcagccggcgttcttgcagctgtgccatgagcgccgcgtggtgtccacgccggagaaggcggcggcgacgccgctgccgcggagcgagtacccccggccgctggtcttccacgacggccgcctcgtccgccggcccgagccgctcgcgtgcctcgccgtcttcctgtgggtcccgctcggcgtggtcctgtccgtgacgcgcctcctcctcggcttcctcccccacggcgccggcctcctcctcgccgcggtcaccggcttccggataagaggcgagctcggcggagcggcggggccggcggcgagccgccggcgtggcacattgttcgcgtgcaaccaccagacgctgatggacccggtgatcctctcgacggtgcttcgccggaaggtgaccgccgtgacgtacagcctgtccggcttctcggagctgatcgcgccgatcccgacggtccggctgacgcgcgaccgcggccgggacagccggatcatgcagtcggagctggcgcgcggcgacctggtggtctgcccggagggcacgacgtgccgggagccgtacctgctgcggttcagcccgctgttcgcggagatcgccggcgaggtcacgccgacggccgtccgcgccggcggcgccatgttccacggctcgacggtgcgggggcacaagtggctggactcggtcttcttcctcatgaacccggcgccgtggtacgagatccggctcctggcgccggtggccaccggtggaggcggcgacgcgtcgagccgcgacgtggcgaacggcgtccagcgcatgatcggcgacgagctcgggttcgagtgcaccgggctgacgcgcagggacaagtaccggatgatcgccggccacgacggcgtcgacgcgaggtcggcggcggcggcggcgtcgtagtggagctcgcaagcggtgtgtcacgcacgcaacgcatgcagggcatcgcggaacgcgtgttgtttgtggaacttggaagcaggggctacattttactctccatttgttgtgaactttcaaatttgtaatcgtgttgggtgatactttcagttacaaaaacaaaacagggtagttcccaatcccaattgtatatttttgggtaaagaaatatagaatacaatcaagagttccacctt

SEQ ID NO: 8184 - protein, 493 aa, Panicum virgatum
  misc_feature: Ceres CLONE 1991173
  misc_feature (1)..(120): Pfam Name: Acyltransferase Pfam Description: Acyltransferase
MAADSHRCTSAAAELEGTLLISGSLFPYFLLVALEAGGPLRAAVLFAVYPLAALLGAAFTDDLPLLAMTFLSTAGLGVGDVAAVARATLPRFFLADLRRSAFRALARHAGERYVVTRLPRLLAEPFVREYLGADVRVAGMELRVVGRRFSGTVASPGVEAGADRCLGALAAVLGRDRIVDVGLCSGASGGDRQPAFLQLCHERRVVSTPEKAAATPLPRSEYPRPLVFHDGRLVRRPEPLACLAVFLWVPLGVVLSVTRLLLGFLPHGAGLLLAAVTGFRIRGELGGAAGPAASRRRGTLFACNHQTLMDPVILSTVLRRKVTAVTYSLSGFSELIAPIPTVRLTRDRGRDSRIMQSELARGDLVVCPEGTTCREPYLLRFSPLFAEIAGEVTPTAVRAGGAMFHGSTVRGHKWLDSVFFLMNPAPWYEIRLLAPVATGGGGDASSRDVANGVQRMIGDELGFECTGLTRRDKYRMIAGHDGVDARSAAAAAS

SEQ ID NO: 8185 - DNA, 1714 bp, Panicum virgatum
  misc_feature: Ceres CLONE 1991187
  misc_feature: Encodes the peptide sequence at SEQ ID NO. 8186
acttccaaaaaattcagttcagttcacttcacttcagaagcagcagctagcagctagagaagaaaaggagcgcgctcccacgcatccacaagctcatcagcgccatgcaggccacaaccatcaagaagcttctcctcctcttcgtcgccacgttcatgctgatcatctcccacgcatcatccctgcgcttccagtacatcaactctcacaacttcaccacgaaaacgagcgcgagcgcgacgtcgtcgtcctctgctgctgctcaccgcagccgcaacccttcgctcgccttggtgcaccgcgacgcgatcaccggcgcgacgtacccctcgcgccgccacgcggtggtcgaccgcgtcgcccgagacaatgcgcgcgccgagtacctcgtgaggcgcctgtccccgacggacttgggctccgaggtggtgtccggcctcgacgagggaagcggcgagtacttcgtccgcgtcggcgtcggctcgccgcccacggagcagtacctcgtggtggactccggcagcgacgtcatctgggttcagtgcaagccgtgcctgcagtgctacgcgcaggccgacccgctgttcgaccccgcctcgtcgaccaccttctccggcgtgtcgtgcgggtcggccatctgccggatgctctccagctccgggtgcggcgacgcggggaggtgccggtacgaggtctcctacggggacgggtcgtacaccgagggcgtgctcgcgctcgagacgctcacgttcggaggcacggcggtggagggcgtcgccatcggctgcggccaccgcaaccgcggcctcttcgtcggcgcggcggggctgctgggcctcggctggggccccatgtcgctcgtcgggcagctcagcggcgcggccggtggcgcgttcagctactgcctcgcgagccgcggcgccgggtccagcgccgacgccgggtcgctgatcctcgggcggagcgaggcggtgccggagggcgccgtgtgggtgccgctggtgcgcaacccgcaggcgccgagcttctactacgtgggcctgtcggggatcggcgtcggggacgagcggctcccgctggaggccgggctgttccagctgagcgacgtcggcgccggcggcgtggtgatggacacgggcacggcggtgacgcggctgccgcaggaggcgtacgcggcgctgcgggacgcgttcgcgggcgccgtgggcgcgctcccgcgcgcgccggccatgtcgctgctggacacgtgctacgacctgagcgggtacacgagcgtgcgggtgcccaccgtgtccttgtacttcgacgagggcgcgacgctgacgctgccggcgaggaacctgctggtggaggtggacggcgggatatactgcctggcgttcgcgccgtcgtcgtcggggctctccatcctggggaacgttcagcaggaagggatccagatcaccgtcgactcggccaacggcttcattggcttcgggcccaacacgtgctagattggtgttggtgttccccctgccatactgccatccagctactgcaagcttactttatgtactgtatgcagggttttcaatttcgtttgacaaaaaatttcggactgggccgaaatcagcgaatttcgcgaaatttcggcagaaatttatttttagattatttttaaaaatacttttaaatatatttaaattattatttccaaaaaaaaaaaaaaaaaaaa

SEQ ID NO: 8186 - protein, 462 aa, Panicum virgatum
  misc_feature: Ceres CLONE 1991187
  misc_feature (1)..(343): Pfam Name: Asp Pfam Description: Eukaryotic aspartyl protease
MQATTIKKLLLLFVATFMLIISHASSLRFQYINSHNFTTKTSASATSSSSAAAHRSRNPSLALVHRDAITGATYPSRRHAVVDRVARDNARAEYLVRRLSPTDLGSEVVSGLDEGSGEYFVRVGVGSPPTEQYLVVDSGSDVIWVQCKPCLQCYAQADPLFDPASSTTFSGVSCGSAICRMLSSSGCGDAGRCRYEVSYGDGSYTEGVLALETLTFGGTAVEGVAIGCGHRNRGLFVGAAGLLGLGWGPMSLVGQLSGAAGGAFSYCLASRGAGSSADAGSLILGRSEAVPEGAVWVPLVRNPQAPSFYYVGLSGIGVGDERLPLEAGLFQLSDVGAGGVVMDTGTAVTRLPQEAYAALRDAFAGAVGALPRAPAMSLLDTCYDLSGYTSVRVPTVSLYFDEGATLTLPARNLLVEVDGGIYCLAFAPSSSGLSILGNVQQEGIQITVDSANGFIGFGPNTC

SEQ ID NO: 8187 - DNA, 1859 bp, Panicum virgatum
  misc_feature: Ceres CLONE 1991193
  misc_feature: Encodes the peptide sequence at SEQ ID NO. 8188
acacgagcgctcgtctcgtcgcacccgaaatccggcgccgccgccgccgccgccgcccagagccccatcccgcctccccggcggcactcctcggctaggcgggttccgagcgccgcgccgcggcccctcgtggttctgcgggcgcggggtgcgattccagcgaagggatcgggctgttgcctggtcggcggggacggggaggagtcattcgccctgcctcctgcaataattatttgctgcgcgcaggcgcaggtcggtttcgaattcgccattcgccctgccggcgaccaataaccgatggccccgcgcgccgcgctccccctcttcctccacgccgcgctcgcgctgctgctgctggtggcggcctgctccgcggcccccggcgtcttccaggtgcgccgcaggttcccggccggggggaggcgccgccgcgctccgcgcccacgacgggcgccggcacggccggctcctcgcggctgccgacctcccgctcggcggcctcggcctccccaccgacaccgggctctacttcacggagatcaagctcgggacgccgcccgagcgttactacgtgcaggtcgacaccggcagcgacatcctctgggtgaattgcatcacctgcgaccgatgcccccgcaagagcggcctcgggctagacctgacgctctacgatcccaaggcgtcctcgagcgggagcccggtctcgtgcgaccaagggttctgcgaggccacctacaggggcaagctgccggggtgcagcgccaatgtgccctgcgagtacagcgtcgtgtatggtgacggcagctcgacgacggggttcttcgtcaccgatgtgctgcagttcgaccaggtgaccgggaatgggcagacacagcctgggaacgccagcgtcacatttgggtgcggtgctcagcaaggtggagatttgggaagttcaaatcaagccctcgatggaattcttggttttggccaagcaaatacatcaatgctatcacagctagctgctgctggtaaagttaagaagatatttgctcattgcttggataccataaatggaggtggaatttttgctattggaaatgtggtgcagccaaatgtaaaaacaacaccattgatagctgacatgccgcactacaatgtgaaccttgaatcaattgatgttggtggtactacattacagctaccagctcgtgttttcgaaacacgagagaaaaaaggtaccataattgacagtggtacaaccttgacataccttccagaattggttttccaagaagtaatatttgcggtatttaagaagcatcaagatataaaattccacaatgttcaagattttatgtgtttccaatactctggaagtgttgatgatggtttcccaactatcaccttccattttgaggacgatctcgcactgcatgtctatccacatgagtactttttcccaaatgggaatgacatatactgcgtgggatttcaaaatggtgcattacaatcaaaggatggaaaggacattgtgcttttgggagatcttgttctttcaaacaagttagttgtctatgacttggaaaatcaagtcatcgggtggaccgtctacaactgttcatcgagcattaacattaaggatgacaagacaggcgcaacatataccgtcaattcacacaatatctcctccggatggagattccactggcacaagtccgtggttctgttgttggtaacagttttatgcagctatttaatatgctaactctgttgtacaacacgaacacggacccactgatggaaattcatttgattcatattcttttcacgaaagaaaaggaaatgtaggcccttagactgttgttgtctgaccacgg

SEQ ID NO: 8188 - protein, 253 aa, Panicum virgatum
  misc_feature: Ceres CLONE 1991193
  misc_feature (155)..(357): Pfam Name: Asp Pfam Description: Eukaryotic aspartyl protease
MLSQLAAAGKVKKIFAHCLDTINGGGIFAIGNVVQPNVKTTPLIADMPHYNVNLESIDVGGTTLQLPARVFETREKKGTIIDSGTTLTYLPELVFQEVIFAVFKKHQDIKFHNVQDFMCFQYSGSVDDGFPTITFHFEDDLALHVYPHEYFFPNGNDIYCVGFQNGALQSKDGKDIVLLGDLVLSNKLVVYDLENQVIGWTVYNCSSSINIKDDKTGATYTVNSHNISSGWRFHWHKSVVLLLVTVLCSYLIC

SEQ ID NO: 8189 - DNA, 2036 bp, Panicum virgatum
  misc_feature: Ceres CLONE 1991201
  misc_feature: Encodes the peptide sequence at SEQ ID NO. 8190
gcccccggtttccgccctcttcactctgcctctcgcctccgatggctcgcccccgccgcctcctctgaccccgccccgccccgccttctccccggagggcgccgcggggatctcgccggagatggcgccgcctccgcccccgcccccgccaccgccggcgggggagcaccagccgcagctccacggggtggtcatcatctcgctcccgcccccggaccagccctccaagggcaagaccatcacggccttcacctacagcgacgaccccggcgcgccgcccccgccgcaggagccggcgatggggtacccggtgggggcggggggcaggaggcggtccaggcgggcgctctcgccgcggcgggtggccgcgatgttgctcgtgctgggcgcgctcgcggtggcggcctactactgcttctactcggacgtggccgtgcagttcctcggcatggagcaggaggaggcgcacaaggagcggaacgagaccaggtccttcctgctgccgctctaccccaaggcgctccagggccgcgcgctgcgggagttcggggacgtcaagctcgccgccaagagggtcgacgacggcgggaggaaggcggccaacaagatggaggtcgggaaggcggttacggcggggagcaacaacacggctttgctcccgatgaagggcaatgtcttccccgatggccagtattatacatctatctttgtcggcaatccgccaagaccgtactttcttgatgttgatactggaagtgacttgacatggatccagtgtgatgcaccatgtacaaactgcgcgaaaggacctcatcctttatacaagccaacaaaagaaaagatagtccctcccagggattcgttatgccaagagttgcaaggagaacagaactactgtgaaacctgcaagcaatgtgactatgaaattgaatatgcagaccaaagctcttcaatgggtgtccttgcaagggatgatatgcatctgatcgcaaccaatggtggaagggaaaagctcgattttgtctttgggtgtgcatatgatcagcaaggccagcttctgtcttcaccagcgaagactgatgggatccttggacttagcagcgcagcaataagccttcccagtcagctagctagccacggcattatttccaacatttttggtcattgtatcactagagagcaaggtggtggaggttatatgtttctgggtgatgattatgcacctagatggggaatgacatggacttctattcgaagtggcccagataacttatatcacacagaggccaacaatgtaaaatatggagatcagcagcttagtgtgcgtgagaaggcaggaaactcagttgaagtgatttttgacagtggtagctcgtacacatacctcccaaatgaaatatacgaaaatctcattgcagctatcaaatatgcctccccaggttttgttcaagataactcagatcggacattgcccttatgctggaaagctgattttcctgtgaggtatctggaagatgtcaagcagttcttcaagcctttgagccttcattttggcaaaaaatggcttttcatgtctaaaacattcactatttctcccgaggatttcttgatcatcagtgataaaggaaatgtctgtttcgggcttctcaatggaacagaaatcaatcacgggtcaactataatagtcggagatgtttcactgcgtggcaagttagttgtgtatgacaatcaacggaggcagattggctggacaaattcagactgcaccaagccacaaacacaaaagggttttcccttcttcctctgatgggcacggctcggctcacaataaatctgtctgatgtatagtggacaccattagaatgctgttatgtacactacatcctccagggaactgtcattagtcccaccgtatgttgttgtaatacttgtgtataatatgtatatactgtgtgtattttatgtatgtactgtctcctctacagggggattttataggcattatgaacatttactatctaaagtggttagtgtac

SEQ ID NO: 8190 - protein, 561 aa, Panicum virgatum
  misc_feature: Ceres CLONE 1991201
  misc_feature (1)..(357): Pfam Name: Asp Pfam Description: Eukaryotic aspartyl protease
  misc_feature (1)..(357): Pfam Name: Asp Pfam Description: Eukaryotic aspartyl protease
MAPPPPPPPPPPAGEHQPQLHGVVIISLPPPDQPSKGKTITAFTYSDDPGAPPPPQEPAMGYPVGAGGRRRSRRALSPRRVAAMLLVLGALAVAAYYCFYSDVAVQFLGMEQEEAHKERNETRSFLLPLYPKALQGRALREFGDVKLAAKRVDDGGRKAANKMEVGKAVTAGSNNTALLPMKGNVFPDGQYYTSIFVGNPPRPYFLDVDTGSDLTWIQCDAPCTNCAKGPHPLYKPTKEKIVPPRDSLCQELQGEQNYCETCKQCDYEIEYADQSSSMGVLARDDMHLIATNGGREKLDFVFGCAYDQQGQLLSSPAKTDGILGLSSAAISLPSQLASHGIISNIFGHCITREQGGGGYMFLGDDYAPRWGMTWTSIRSGPDNLYHTEANNVKYGDQQLSVREKAGNSVEVIFDSGSSYTYLPNEIYENLIAAIKYASPGFVQDNSDRTLPLCWKADFPVRYLEDVKQFFKPLSLHFGKKWLFMSKTFTISPEDFLIISDKGNVCFGLLNGTEINHGSTIIVGDVSLRGKLVVYDNQRRQIGWTNSDCTKPQTQKGFPFFL

SEQ ID NO: 8191 - DNA, 1722 bp, Panicum virgatum
  misc_feature: Ceres CLONE 1991319
  misc_feature: Encodes the peptide sequence at SEQ ID NO. 8192
gcagccagccagctgggccgagcgcccgaggcctcacccgactcctgctgcgattctgccagcaaaagaagtagagaaaccaaccaatccaaaggcaatttttttcttcaaaaaaaaaggcaatcacgggagacccacccatcgcgtccgccctggcccacgccatggagcagccgggcgccggcgccgccgacgccgtggcgatggatccgtccccgtccccgtccatggcggcgccgcaagcgccgccggtggtcgagtggcccgagggcggcgcgctgacgcgggactgggtggcggggctggcgtccacgctggactggtgctcgcgccacctccccgcggaccgcctcccggcggtgctcccgccggcgctcgtccagcggctggtcctggccgcggccgccatcctgcaccgcgagcccaacctcgtgcgcgtggacccgcggcccgggcagtccgtcgtcgtcgtcggggacgtccacggccagctccacgacgtcatcttcctgctccgcgacgcggggttcccctcggaggagcgggtcttcgtcttcaacggggactacgtcgaccgcggcgcctgggggctcgagaccctcctcctgctcctcgcttggaaggtgttacttccgaattgcgtttttcttctcagagggaatcatgaatccaagtattgcacttcggtttatggtttcgaaaaggaggtaatgactaaatataaagatcaaggccctcaggtttatcggaagttcttaagatgttttgaggaccttcctctagcaacaataatagcaggatgtgtgtacaccgcccatggtgggatcttccgtgggacgattgtgttaccatcaaagagatcaaaaaaggcaaagaaaggtcgcaaaaacaaggcagattttactgttgatacaatgtccattaggcttggatccctggatgagttattgaaggcaaggagaactgttcttgaccctccttgggagggtcaaaatttgatccccggagatgtgctttggtccgacccttccttgcagatgggtctttcaccgaatcaagaaagaggcatcggcttgctttggggtccagatatcactcagcagtttctgcgtacaaataatttgaagttaatcatcaggtcacatgaaggtccagatgctagagacaagcggcatgatctattaagaattgataaaggatatacaatcgaccatgatgtagaatgcgggaaacttatcactctcttcagtgctcctgactacccgcaatttcaggcttcagaggagcgatacaacaactgcggagcatatattgtccttcatccaccagattttgctagccctgttttccatagctttgaagctgtcaagcctcgacctccggcgcatccgttttatgattttgaagaggtgattgactcagatgaagagttgaatctagacgccatggacagtggcacatcaagccaatgatgatgccttctcgccttgtatcattgtatctatgatgccaactgtcacggtgtcaccagagaagcatgccatcaattttttgttgtaaatgatgctaacgtagtgacgttgcaggtaatggcatagccgtcatgtgtgtcaatctgatttgtaggttcagattgggttgatctgcatctaaaaggcagtgacccagaaatacgacatttagcgattgagtgcgtgaaaatcagacggttgcaaggatcgc

SEQ ID NO: 8192 - protein, 435 aa, Panicum virgatum
  misc_feature: Ceres CLONE 1991319
  misc_feature (1)..(234): Pfam Name: Metallophos Pfam Description: Calcineurin-like phosphoesterase
MEQPGAGAADAVAMDPSPSPSMAAPQAPPVVEWPEGGALTRDWVAGLASTLDWCSRHLPADRLPAVLPPALVQRLVLAAAAILHREPNLVRVDPRPGQSVVVVGDVHGQLHDVIFLLRDAGFPSEERVFVFNGDYVDRGAWGLETLLLLLAWKVLLPNCVFLLRGNHESKYCTSVYGFEKEVMTKYKDQGPQVYRKFLRCFEDLPLATIIAGCVYTAHGGIFRGTIVLPSKRSKKAKKGRKNKADFTVDTMSIRLGSLDELLKARRTVLDPPWEGQNLIPGDVLWSDPSLQMGLSPNQERGIGLLWGPDITQQFLRTNNLKLIIRSHEGPDARDKRHDLLRIDKGYTIDHDVECGKLITLFSAPDYPQFQASEERYNNCGAYIVLHPPDFASPVFHSFEAVKPRPPAHPFYDFEEVIDSDEELNLDAMDSGTSSQ

SEQ ID NO: 8193 - DNA, 1731 bp, Panicum virgatum
  misc_feature: Ceres CLONE 1991398
  misc_feature: Encodes the peptide sequence at SEQ ID NO. 8194
acggagggaggagcccacaagacaagagatctgcccgctgcccctcgcgttcccctccctccccagcgtcgtcgtccacccccccccccaacccccccaaccaaatccccccaaaccctaccgccgatccgggcccagatcgccatggccgcccccaacagcaacgatgccgccagcgccagcggcgccgcacccgccggcgaggaggacacctccatcgaggcgctggcacggcgcgtgcaggagcatatgaccctcgcctccaaccccaccgcccgccgccacaagttctgggagactcagcccgtcggccagttccgcgacgccgccgacgcgtcgctcccggatggccccatcgagccgcccacgccgctctccgaggtgcgcgccgacccctacccgctccccgccgccttcgagtggctcacctgcgatctcgacgatgacgcgctcctcgccgacctctactcgctgctcgcccacaactacgtcgaggacgacgagaacatgttccgcttcaactactccccggccttcctccgctgggcgctcaagccgccctccttcttccgcgcctggcacatcggcgtccgtgccaaggagtccaagaggctcgtcgccttcatctcgggcgtccccgcgcgcatccgcgcccgcgatgacgtcgtccgcatggccgagatcaacttcctctgcgtccacaagaagcttcgatccaaacgcctcgcacccgtcctcatccgcgaggtcacccgccgcgtccaccaggagaacatctggcaggctgcatacaccgcaggggtcgtcctcccgacccccatcaccacctgccgctactggcaccgatccctcaaccccaagaagctcattgatgttgggttttctcgccttggtccgcgcatgaccatgagccgcactgtccgtctctacaagctgcctgatgcgccgctcacccctggattccgccggatggagctgcgggatgttgctgctgtcacaaggctgctgagggcctaccttgcaaagtttgtggtggcgccggatttcgatgaggtggatgtggagcactggctgctgccccaggaggatgtggttgacagctaccttgttgagagccctgagacgcatgaggtcacagatttctgcagcttttacacgctgccgtcatctgtgctgaacaatgctaactatgcgacgctcaaggctgcatactcgtattacaatgtttccaccaaaaccccattgcagcagctgatgaacgatgcgctgattgttgccaagcagaagaactatgatgttttcaatgctcttgatgtcatggagaacgagtcattcctcaaggagctcaagtttggtcctggagatgggcagctccactattacctctacaactaccggattcgcaatggcatcaagccttcggagcttggccttgtactgctataggcagtccagtcaggacagtcctcagtttacacctgtacttccacagcaggttgttcactgtgcaattcggtggtttctcattttgtttattggggtagtgattctccttgatatgattgccatggccattgatgggagtccaagatgatttgcgaggagtcttgaattagaaatcattttcttcatttaagattattgtttcccattagtgacattttgtgtgcgtggtccaaaatatgtatgatggcactgagtttaccaagaaattttgatagaacttgtgac

SEQ ID NO: 8194 - protein, 433 aa, Panicum virgatum
  misc_feature: Ceres CLONE 1991398
  misc_feature: Great-hit functional homolog of the protein sequence given in SEQ ID NO 9389
  misc_feature (15)..(433): SWISSPROT Homolog: EC 2.3.1.97 Glycylpeptide N-tetradecanoyltransferase 1
  misc_feature (43)..(432): SWISSPROT Homolog: EC 2.3.1.97 Glycylpeptide N-tetradecanoyltransferase 2
  misc_feature: Useful for making plants with altered alkaloid content
MAAPNSNDAASASGAAPAGEEDTSIEALARRVQEHMTLASNPTARRHKFWETQPVGQFRDAADASLPDGPIEPPTPLSEVRADPYPLPAAFEWLTCDLDDDALLADLYSLLAHNYVEDDENMFRFNYSPAFLRWALKPPSFFRAWHIGVRAKESKRLVAFISGVPARIRARDDVVRMAEINFLCVHKKLRSKRLAPVLIREVTRRVHQENIWQAAYTAGVVLPTPITTCRYWHRSLNPKKLIDVGFSRLGPRMTMSRTVRLYKLPDAPLTPGFRRMELRDVAAVTRLLRAYLAKFVVAPDFDEVDVEHWLLPQEDVVDSYLVESPETHEVTDFCSFYTLPSSVLNNANYATLKAAYSYYNVSTKTPLQQLMNDALIVAKQKNYDVFNALDVMENESFLKELKFGPGDGQLHYYLYNYRIRNGIKPSELGLVLL

SEQ ID NO: 8195 - DNA, 1815 bp, Panicum virgatum
  misc_feature: Ceres CLONE 1991537
  misc_feature: Encodes the peptide sequence at SEQ ID NO. 8196
aatacacacgcatcagactcatttatcaaacccaacccaattcgaccacgcttccgccgcaccttctcccctaccgcctccgatggccacgacgacgacgacggcgacggtgacggcgcgggcggccaacgccaacttcgtagcgacaccagcggctccgcatcctcggcccgtcgtgccacccgctccccgggccccctccaccttgggtcccgtcaagtcggaggcccctccggccccctcgtccactacctccgccgccgccgccgcatccggaccggaggatccatcctacatcatcaccatcccgagttattcagcgtggttctcgttcgactccatccacgacactgagcgccgcctcctgccggagttcttcgagggggaggccgctgcggcgtccggatgccggggcccgggcgcgtacaagtactaccgcgacagtctgatacggaggttccgggcgcggccgggtcgacggctcacgctcacggagtccaggcggggactggtcggcgacgtcggctccatccgccgcgtattcgacttccttgaggaatgggggctcatcaactacggtgctttgccgtcaggctcaaagcaggcgaaagagaagagggaagaggctgcaccacattcgatttcttctggggcaacagcacccaggaagctttgtaccgggtgccgcattgtgtgcgggcttgcttactttgcctgcgacaaggcagatataagtctctgtgctagatgctttttccgtaataacttccggccaggtctgactgctgcaaacttcaacaaagttgaaattactgaagattcaaagtctgattggacagacaaagaaactcttcacttgcttgaggctgtcttgcattatggtgaagactggaagaaggtgtctgaacatgttggtagtcgatcagaaaaagactgcattgcaagattcatccgtctaccttttggagaacaattcatgggacccaaggaggatagaatggggtttgaaaatgatgatgatgatactactgatgaacctggaacagatgtctcaaaacggctacgcctcagtccactggcagatgcaagcaatccgattttggctcaggttgcattcttatcggccattgtgggttctgatgctgcctcagctgctgctcaagcagctatttctgcacaatcccgtattgatctaaatgatgaagagattgattcttcaataaatagcaccagggaagaaggcaatgatttgctgaaagaggctgccgctaatgcaagggcacaacttgaaaaagaaaggaacggcatagagcaatctttatccgatatagtggacgtccagatgaaggaaatccaagataaaatatgccgtttcgagcataaggagatgctgatggataaagagcgacagcagcttcgctgccttagggatttgcttttcacagatcaactggcgatcatgcaacatcaacgcaagccccaagctgtagccgcagagagcaaatatgacgaggagccaaaacccatgattaacataagttgattcaaatagagggttttttatcgaaactggaaatggttcctcagcctgactggaacgacagttgtgagaattggacataggtctgcaccatttagctaacttatttcccccttcggttgcctgactctagttgtatgttcaatccatgtgcgttcgcctcagatgttataggaagcaagggcgatgacaattctttacaatctagctaatgagaatgattgatttcctttcctcaaatcttattgcacaaaagaagacctaaagtagcacgg

SEQ ID NO: 8196 - protein, 486 aa, Panicum virgatum
  misc_feature: Ceres CLONE 1991537
  misc_feature (1)..(46): Pfam Name: Myb_DNA-binding Pfam Description: Myb-like DNA-binding domain
MATTTTTATVTARAANANFVATPAAPHPRPVVPPAPRAPSTLGPVKSEAPPAPSSTTSAAAAASGPEDPSYIITIPSYSAWFSFDSIHDTERRLLPEFFEGEAAAASGCRGPGAYKYYRDSLIRRFRARPGRRLTLTESRRGLVGDVGSIRRVFDFLEEWGLINYGALPSGSKQAKEKREEAAPHSISSGATAPRKLCTGCRIVCGLAYFACDKADISLCARCFFRNNFRPGLTAANFNKVEITEDSKSDWTDKETLHLLEAVLHYGEDWKKVSEHVGSRSEKDCIARFIRLPFGEQFMGPKEDRMGFENDDDDTTDEPGTDVSKRLRLSPLADASNPILAQVAFLSAIVGSDAASAAAQAAISAQSRIDLNDEEIDSSINSTREEGNDLLKEAAANARAQLEKERNGIEQSLSDIVDVQMKEIQDKICRFEHKEMLMDKERQQLRCLRDLLFTDQLAIMQHQRKPQAVAAESKYDEEPKPMINIS

SEQ ID NO: 8197 - DNA, 1593 bp, Panicum virgatum
  misc_feature: Ceres CLONE 1991932
  misc_feature: Encodes the peptide sequence at SEQ ID NO. 8198
atagcagagcctcagccaaactcagctagctagcagccaaaacagaggcgtaactgaggcgatcggtcgagttcattgatcaccaagtggcaggtaggtgcggccatggcgtcgtcgtcgccgtcgccgatgcttggaagcattgccaacaggtggcgcgagctccagggcgcgggctcgtgggccggcctgctcgacccgctcgacatcgacctgcgcgcgaacatcatcgcctacggcgagctcacgcaggccacctacgacgggttcaaccaggagaagcgctctcccaactgcggcgcctgcgtgttcggctacgcggacctgctggcgagctcgggcgccgccgcggcggggagctacgccgtcaccaagttcatctacgccacctcggcgctgcccgtgcccgaggcgttcctggtcctcccgctgccggagctgctgccggagtcgtggagcagggagtccaactggatggggtacgtcgccgtcgccacggacgacggcgtcgcggcgctggggaggcgcgacatcctcgtcgcgtggcgcgggacgatgcggagcctcgagtgggtcaacgacttcgacttcacgcccgtgtccgccgcgccggtgctgggctccgcggcggcggcgaacccggccgccatggtgcacaggggattcctgtccgtgtacaggtccagcgacccggattccaagtacaaccagtccagcgccagagatcaggttcttgaggaggtcagccggctaatggcgctgcacaaggacgaggtgaccagcatcaccgtcgtggggcacagcctgggcgcgtcgctggccacgctcaacgccgtggacctcgccgccaacggcgtgaacgcgcccgccgactcctcccagccgccgtgccccgtgacggccttcgtgtacgcgagcccgcgcgtcggggacggcaacttcaagagcgccttcgcctcgttcccggacctgcgggcgctgcacgtgaagaacgccggcgacgtagtgccgctgtacccgccgctggggtacgtggacgtggccgtgccgctgcccatcgacacggggcggtcgccgtacctgcgccagcccgggacgatcccgacgcggcacaacctcgagtgctacctgcacggcgtggccggggagcagggcagcggcggcgggttcaagctggaggtggaccgcgacgtggcgctggcgaacaagggggaggacgcgctcaagagcaagtaccccgtgcccgccgactggtgggtcaccaagaacaagtgcatggtcaagggcgccgacggccactgggcgcttcaggacttcgagcagatttgatcagcatcagacattcagactggtgcgctcgtgctcgcacgcacccttgtgtctttcgtatctctcgtctatgaataacgagtgacaacaatacaatacgggtttgaactggtagcttgttgtcttgttgtgtctcgatcgcctcttcctaccggcctgaccggaggtcgatcaggatttattcaggcttcgtccggagtcggtaaacaattctcggttgagtgccaatgtgccgtggtgtgataaaaaaaaaaaaaaaaaaaa

SEQ ID NO: 8198 - protein, 407 aa, Panicum virgatum
  misc_feature: Ceres CLONE 1991932
  misc_feature (1)..(169): Pfam Name: Lipase_3 Pfam Description: Lipase (class 3)
MASSSPSPMLGSIANRWRELQGAGSWAGLLDPLDIDLRANIIAYGELTQATYDGFNQEKRSPNCGACVFGYADLLASSGAAAAGSYAVTKFIYATSALPVPEAFLVLPLPELLPESWSRESNWMGYVAVATDDGVAALGRRDILVAWRGTMRSLEWVNDFDFTPVSAAPVLGSAAAANPAAMVHRGFLSVYRSSDPDSKYNQSSARDQVLEEVSRLMALHKDEVTSITVVGHSLGASLATLNAVDLAANGVNAPADSSQPPCPVTAFVYASPRVGDGNFKSAFASFPDLRALHVKNAGDVVPLYPPLGYVDVAVPLPIDTGRSPYLRQPGTIPTRHNLECYLHGVAGEQGSGGGFKLEVDRDVALANKGEDALKSKYPVPADWWVTKNKCMVKGADGHWALQDFEQI

SEQ ID NO: 8199 - DNA, 1641 bp, Panicum virgatum
  misc_feature: Ceres CLONE 1992039
  misc_feature: Encodes the peptide sequence at SEQ ID NO. 8200
atagtcatatgccaattctaaatggacgtctctcacaaagactacctcatctcagccttccaccaagtccttggcgtggtcacactcctcgtttgcctcctcaccgaggtctccatcttcgcctccgaccgccatggggcaatgtacctcgtccctctatgctcaatcctcctcctttacggccatcgccggcatgctggcaccactagcatcagcctggtagacttctccgggctgaaaccaccacgacggctgcgaacacccatcccaaagttcatcgagcacatcaaactcgggggctgcttcgaagacgatggcgtcgagttcatgtccaaagctgttgtggcgtcgggcatgggcgacgagacctacttcccgccgtcgctgcacctgattcctccggacgcgacgcacggcaacgccgtgcaggaggcgcgcatgctgctgctcccgacgctcgacgagctattcggcaggaccggcgtgccgcccgccgccgtgggggcgctcatcgtcaactgcagcgggttctgcccggcgccctccctggcggcgatggtcgccaaccactaccacatgcccagcgacgtcaagacgttcaacatctccggcatgggctgctctgcgggcgtcgtcggcgtcgacgtcgcggggaacatcctcatcacccatccgaccatcgcgtacgccgtcgtggccagcacggaggtgatcacggtcgggtggtacaacgggagagaccacagcaagctgctcctcaactgcacgttccgcaacggctgctccgccgtgctgctagcgaggagcggcgggcgcggaatggcggctcctatgccgccgcccaagtaccggctcctccgcctggtgcgcacgaacctcatcgccaacgacgacggctaccactccggctaccgcgaggaagacgacgagggcatcaccggcttcaacgtggcgcgaggcgtcggcggcgcgttcgaggaggtcctgcgcgcgcacctcgcctcgctgggcatgtccgtcctgccgtggcgggagaagctgcgttacgcgacggggtttgtgctgtcccggctccacaaaacaccagcaggttaccagcagctggtccccaacttcggcgcggcggccgagcacttctgcctgccgacgacgtgggcgccgatgatccggaggctcgggcaggggatcgggctgggagagaagcagatggaggcggcgctcatgacctaccaccggttcgggaaccagtcggcggcgtcgctgtggtaccagctcgcctaccacgaggccaaggggttggtccggaagggagacaaggtgtggcagctcggcgtggggactggtctgaaggtgaacagtgcggtatgggagcgtgtggctgccgacgaggacgacctcgccggtgtcgggcgagatgggaagagtgcacggccggcggaacggcgggggccgtggatggactgcatccacaggtaccctgtttgggactgaaacttgcaactctggtggtgatggtcacagttatttgtttcttttatttgccaatgatggcacacatatagtcttggtgttccacaatgttattccaaaatatgccacaataatatccttcttaattgacaaaaaaaaaaaaaaaaaaaa

SEQ ID NO: 8200 - protein, 489 aa, Panicum virgatum
  misc_feature: Ceres CLONE 1992039
  misc_feature (1)..(293): Pfam Name: FAE1_CUT1_RppA Pfam Description: FAE1/Type III polyketide synthase-like protein
MDVSHKDYLISAFHQVLGVVTLLVCLLTEVSIFASDRHGAMYLVPLCSILLLYGHRRHAGTTSISLVDFSGLKPPRRLRTPIPKFIEHIKLGGCFEDDGVEFMSKAVVASGMGDETYFPPSLHLIPPDATHGNAVQEARMLLLPTLDELFGRTGVPPAAVGALIVNCSGFCPAPSLAAMVANHYHMPSDVKTFNISGMGCSAGVVGVDVAGNILITHPTIAYAVVASTEVITVGWYNGRDHSKLLLNCTFRNGCSAVLLARSGGRGMAAPMPPPKYRLLRLVRTNLIANDDGYHSGYREEDDEGITGFNVARGVGGAFEEVLRAHLASLGMSVLPWREKLRYATGFVLSRLHKTPAGYQQLVPNFGAAAEHFCLPTTWAPMIRRLGQGIGLGEKQMEAALMTYHRFGNQSAASLWYQLAYHEAKGLVRKGDKVWQLGVGTGLKVNSAVWERVAADEDDLAGVGRDGKSARPAERRGPWMDCIHRYPVWD

SEQ ID NO: 8201 - DNA, 1581 bp, Panicum virgatum
  misc_feature: Ceres CLONE 1992045
  misc_feature: Encodes the peptide sequence at SEQ ID NO. 8202
agacttgagtcctaaatgcccttcttcctcgacccctcaacctccaggcgtcagtaggcaacacgcagacgcaggcagcatggtgaacgaagccagcaaagagcacggcggccacgaggtgaccgtcacggtggcgccggcgctgccgatgcaggggtaccgcctggcgctgtccaacctggacctcctcctgccgccgctcgacgtcagcctcttcttctgctacctccacccggcgcccgccgcggccgcgctcaaggaggcgctggccaagacgctggtggcgtactacccgctggccggggaggtggtggccaacgccgacggcgagccggagctgctgtgcaacggccgcggcgtcgacttcacggtggcgaccgcggccggcgccgagctgcgggaggtccggctcggcgccgtggacgagggcgttgagaagctggtgcccgccaagaaggccggcagcgttgtggcagttaaggtgaccaagttcgggtgcggcggcgccgtcgtcggctgcaccttcgaccaccgcgtctgcgacgcctactccttcaacatgttcctcgtcgcgtgggccgcggccgcccggggcagccccgcgccgccggccccgtccttccgccgctccctcgtcgccccgcgcgacccgccgccgcgcgcgccgtccaccgacgccatcatcgaccgcctgttctgcccccgcagcgccgcgccgcccccacctgctgtcgtcgcgagctccgtcaaccggatctaccgcgtgtccgccgcggacatcaccgcgctgaaggcgtcggcggggccggggcgcacgaagctggaggcgttcacggcgcacctgtgggggctctgctccagggcggcctccccgcgccagagccagtgctgcatgggcgtggtcgtggacgggcgcgcccgcatgtcccccgacggcgccatgagggggtacttcggcaacgtgctcaccatcccctacggcgtcatcggctcggaggacctccgccgcatggccctcgccgacgtggcggacgacgtgcaccggtgggtggcggaggccgccaccggcgagcacttccggggcctcgtggactgggtggaggcgctgcggcctaagccggcggcggcgagggcgtacctgggaggcaccggcgggagcgaggcgatggcgtgcgtcgtgtcgtccgggatgagcttcccggtgggcaaggcggacttcgggacggggctccccgtgttcgcgtcgtaccacttcccgtggcccgccggcgccgggtacgtgatgccgatgccgagcgcgcgcggggacggcgactgggtggtgtacgtgcacgtggcgccggagctggccaaggtgatggaggaggagcccaccgtgttccaggccctggagaacagctacgtgttccagtgacgtgggtaaacgacctgtgatgctaatgtgtgccatggatatctgcctccatcagtgtaatctgtagactgcagtgcggtgccacgaatttgtgccggtggtaagcaagtatgcttctgaaaaataatatttgctaaattatgtcggaaaaaaaaaaaaaaaaaaaa

SEQ ID NO: 8202 - protein, 444 aa, Panicum virgatum
  misc_feature: Ceres CLONE 1992045
  misc_feature (7)..(436): Pfam Name: Transferase Pfam Description: Transferase family
  misc_feature (10)..(437): Pfam Name: Transferase Pfam Description: Transferase family
MVNEASKEHGGHEVTVTVAPALPMQGYRLALSNLDLLLPPLDVSLFFCYLHPAPAAAALKEALAKTLVAYYPLAGEVVANADGEPELLCNGRGVDFTVATAAGAELREVRLGAVDEGVEKLVPAKKAGSVVAVKVTKFGCGGAVVGCTFDHRVCDAYSFNMFLVAWAAAARGSPAPPAPSFRRSLVAPRDPPPRAPSTDAIIDRLFCPRSAAPPPPAVVASSVNRIYRVSAADITALKASAGPGRTKLEAFTAHLWGLCSRAASPRQSQCCMGVVVDGRARMSPDGAMRGYFGNVLTIPYGVIGSEDLRRMALADVADDVHRWVAEAATGEHFRGLVDWVEALRPKPAAARAYLGGTGGSEAMACVVSSGMSFPVGKADFGTGLPVFASYHFPWPAGAGYVMPMPSARGDGDWVVYVHVAPELAKVMEEEPTVFQALENSYVFQ

SEQ ID NO: 8203 - DNA, 2090 bp, Panicum virgatum
  misc_feature: Ceres CLONE 1992094
  misc_feature: Encodes the peptide sequence at SEQ ID NO. 8204
tcctgccgcatacaccgcatcgacccaccaccacaccagccgccaccgcaagggaattgaagccacacccagatttcctctcctctcctcgccggcctccacgcactgaccgcccgcggccccccgcgcgccgcgccagtccagccaccaccttcttcgtgccgccgccgagctcgccctcagtcgccgctgcgcccttcttctctccgtcctcggccgtccggatctgaactggcctctcaataacaaggaaacaccttagggaatgcagaaagatgtgcttgcatgttaaagagctacctagtgagggacttggcagggtagccgcccatatttcttctttgccgcctcttgatgacattggggctcatcaacacgcacagcttctgctccttgtgcttccgcacaatggggttcgatgtggcagctcagccatcttcttagagaaccacctcgggggagacggttgaagtcttcaaaggcaattgcaggcttcttgttagtccattgcaactattggatcagtgcggccttttgtgtgcatatagtatacattcggcgcgatgacagagcagaaaggaaatgttttgatgcagaagtatgagatgggaaagatgcttggacaagggacctttgccaaggtctaccatgcccgtaacacaaagacttttgaaagcgttgcgataaaggtgattgataaggagaaggttatgaaggttggcctcatcgatcagatcaagcgggaaatctctgtcatgaagctcgtgaggcatccaaacattgtccaattatatgaggttatggctacaaaaaccaagatatactttgtgttggagcgtgtgagtggtggagaattgttcaataaagttcagcggggacgtctcaaggaggatgctgctcgcaagtacttccaacagctgatttgcgcggtggacttttgccatagcaggggtgtctatcatcgagatttgaagccagagaaccttctgcttgatgagaatagcaatctaaaggtgtcggatttcggtctaagtgcacttgctgactgcaaaagacaagatggtctgctgcacacaacctgtggcacacctgcttatgtcgcacctgaagtgatcaatagaaaaggttatgacggtgcaaaagctgatatctggtcttgcggggtcatcctctttgtgctactggctgggtatctcccattccatgataaaaacttgatggatatgtataagaagattgggaaagcggagttcaagtgcccaagttggttctctactgatgttcgaaagcttttgctaaggattcttgatcctaaccccagtacaaggatctcaacggaaaaaatcatggagaatccatggttcaggaagggtctagatgcaaagctactcaggtataacttgaaaacaaaggatgccccacctgtggacatgaatgcagattttgattccatgggcaccatcccagctacagagggcaagcagcaagaagcaaggaagcccaccaacatgaacgcatttgatataatatccctatcagctggtttggacctgtcaggaatgtttgaagaatctgacaagaagagagagtccaagttcacgtccaccaagacaagctcaacgattatatcaaagattgaggatattgcaaagaacttgagattgaagctcacaaagaaggatgatggtttattgaagatggaaggtgccaagcctggaaggaaaggggtgatgggcatcgatgctgagatatttgaggttagcccgaatttccatcttgtggagataaagaagacaaacggtgatactctagagtaccagaaggttttcaaccaagagatgaggccagcgctagcggacatagtatgggcttggcaaggtgagcagccgaagcagcagcaacagacgtcatgttaaatattgtaacaagtgcaacgtttctcgaggcaatttccagcattcatgtagtatttgtttttaccattatgtgttttgtttttgtacccccttgtattaccaatataaacatctgtgtaggactatcttctaagacaattttatctcaaagctaaacaagtatcgtctcatttt

SEQ ID NO: 8204 - protein, 450 aa, Panicum virgatum
  misc_feature: Ceres CLONE 1992094
  misc_feature (12)..(440): SWISSPROT Homolog: EC 2.7.11.1 CIPK-like protein 1
  misc_feature (3)..(437): SWISSPROT Homolog: EC 2.7.11.1 CBL-interacting serine/threonine-protein kinase 15
MTEQKGNVLMQKYEMGKMLGQGTFAKVYHARNTKTFESVAIKVIDKEKVMKVGLIDQIKREISVMKLVRHPNIVQLYEVMATKTKIYFVLERVSGGELFNKVQRGRLKEDAARKYFQQLICAVDFCHSRGVYHRDLKPENLLLDENSNLKVSDFGLSALADCKRQDGLLHTTCGTPAYVAPEVINRKGYDGAKADIWSCGVILFVLLAGYLPFHDKNLMDMYKKIGKAEFKCPSWFSTDVRKLLLRILDPNPSTRISTEKIMENPWFRKGLDAKLLRYNLKTKDAPPVDMNADFDSMGTIPATEGKQQEARKPTNMNAFDIISLSAGLDLSGMFEESDKKRESKFTSTKTSSTIISKIEDIAKNLRLKLTKKDDGLLKMEGAKPGRKGVMGIDAEIFEVSPNFHLVEIKKTNGDTLEYQKVFNQEMRPALADIVWAWQGEQPKQQQQTSC

SEQ ID NO: 8205 - DNA, 1964 bp, Panicum virgatum
  misc_feature: Ceres CLONE 1992107
  misc_feature: Encodes the peptide sequence at SEQ ID NO. 8206
gttccgttcccgttccgccgccgggttcggtgcccgccgctgctcggctcggcgttgccctcgtgggcgtggccgcgccgcgccgcgcccgtggtttgctggcttcgcggccaagagtcatgtgcgcaatgtgggtcggagagagaaatctactccgcaatttacacgaccccccgtttcttgtccacctatatctgggggtttagcccgcttatttaggcggttagttggttcttgtactcctcctcctcttctcctcccacctcacttctcatctttgatcttgtgatttcggcgaggagatttgttttccaccaggtcggtgcaaaacccctaggtcctttatcaactggattccctgttcgcttgttgccttgtcccgtgttctcccccacaaaataaaagattgcttgtttcttctggtgcgctctcgatggattgctgattttcttggggctttgtctgctctgttcttcagcagagttgagagggaagagaccgatcggtaaggaaggagggagggagggccatgggggtgtggtgctccaaggagaaccagtccggggggcggcagccgcacgactgcaaccacaatcacagtaacggtgccgcgactgcgagtaaagggggcaagaatcggtacgccaagatcggcgacgattaccacaccctggagcaggttaccgatgcccttgcgcatgctggtctagagtcttcaaatctgattgttgggattgatttcacaaagagcaacgagtggacaggcagaatgtcatacaacaaccggagcttgcacgcgatgggaaacactccaaacccatatgagcaggctatttctatcataggaagaacccttgcacgctttgatgaagataacctgataccatgctttggatttggcgatacaactactcatgatcagtcagtatttagcttctatcgtgataaccaaccttgtgatggcttcgagcaagcacttgctcggtacagggaactcattccgcaacttaatctggctggtccaacttcatttgcaccaataattgagactgcaattggaattgttgatagcagtggtggccagtatcatgtcctgcttataatagcagatggacaggttacacgcagcgttgaaacaggcagtgggcagttgagcccacaggaaaggcagaccatagatgccattgtgaaggctagtgactaccctctttcaattgtgcttgttggagttggtgatgggccatgggacatgatgaggcaattcgatgataacataccttctcgggcatttgacaattttcagtttgtgaacttcacacagatcatgtcaagacctatacccacaagcaaaaaggaggcagaatttgctctttcagcattgatggagatcccagaacagttcaaggcagcaatgagtcttcagcttcttggcaaacgaaggggatttccaaaccgaccagtgttgcctccgcctgtgaacgatcgccaacaatactctggatgttcagcagtcaaacatacccaatctactagctatggagcagcaccgaaaaccccactggcgcctcaaaccccatcagcgcctcgacaggacagcgatataggcgatccacagacctgtccaatctgctggaaccaagccaaggaccttgcttttgggtgcggccatcagacgtgctctgactgcgcaaaggacctgaaggtgtgcccgatgtgccaaaaggcgatctccgtgaggctgaagctctactgaagccctcgagaagctcatcatatatgcaatcaccagcttgatgtgatcagatactaggaggttttgcaaccaaattggtagcagtgaaagctgtgaatatatacaggggtccctatatatgggcgatggttaatcttaattaatacctgtgcctggttatagcagcatgaatgcagtttgtttttttttagaaaaaaaaaaaaaaaaaaaa

SEQ ID NO: 8206 - protein, 407 aa, Panicum virgatum
  misc_feature: Ceres CLONE 1992107
  misc_feature (1)..(33): Pfam Name: zf-C3HC4 Pfam Description: Zinc finger, C3HC4 type (RING finger)
MGVWCSKENQSGGRQPHDCNHNHSNGAATASKGGKNRYAKIGDDYHTLEQVTDALAHAGLESSNLIVGIDFTKSNEWTGRMSYNNRSLHAMGNTPNPYEQAISIIGRTLARFDEDNLIPCFGFGDTTTHDQSVFSFYRDNQPCDGFEQALARYRELIPQLNLAGPTSFAPIIETAIGIVDSSGGQYHVLLIIADGQVTRSVETGSGQLSPQERQTIDAIVKASDYPLSIVLVGVGDGPWDMMRQFDDNIPSRAFDNFQFVNFTQIMSRPIPTSKKEAEFALSALMEIPEQFKAAMSLQLLGKRRGFPNRPVLPPPVNDRQQYSGCSAVKHTQSTSYGAAPKTPLAPQTPSAPRQDSDIGDPQTCPICWNQAKDLAFGCGHQTCSDCAKDLKVCPMCQKAISVRLKLY

SEQ ID NO: 8207 - DNA, 2070 bp, Panicum virgatum
  misc_feature: Ceres CLONE 1992125
  misc_feature: Encodes the peptide sequence at SEQ ID NO. 8208
ttcctacgcccctttctactaccaactgctacacccagttcctgtcctgctctttctcaatctttctccttgttatggtctatttgctgttcatccagcgcttgccactctaatttcctcttgtccaaagcaaaaaggttgttgctttgctggcgtactactagttttccattttctgtggcctctcatcagtcagcaattcagcacctgatactgctagtattcagctccttgcataaacttgctgcggggaaatgtccaagactgagagcagaaagctgtccgatgactatgaagttgctgatgtccttggccgaggagggttctcgattgtgaggaagggtgtgagcaagtcgggagggaagacccaggttgccataaagaccttgcgcaggcttggcccggccatgatgggggcctcacagcaagggtcaaagagtagccttccaatgtggaagcaggtatccatctccgatgctctgctcaccaacgagattctcgttatgaggaggatagtggagagcgtcgcgccacatcccaacgtcatcggcctgcatgacgtgtatgaggacgcgcatggcgtgcacctgatcctcgagctctgctctggtggtgagctgtttgataggatcgttggtcgcgcccggtactcggagtttgatgccgccgctgtcgttcgccagattgctagggggctggaggctcttcataaggcaaacatcatacacagggacttgaagccagagaactgcttgttctctgaaaagaatgaagattccacgctgaagatcatggattttggtttgagttctgttgaagattttagtgacccgattgtgactctgtttgggtctatagattatgtttcaccagaagcgctctcaaggcaggatgtttcggctgcaagtgatatgtggtctgttggggtcattttgtatatccttttatctggatgcccaccatttcatgctgcaaccaatcgagaaaagcagcaaaggatcctgcaaggcgaattcagttttcaggatcatacatggaaaactatatcttcatcagctaaagatctgatttccagtcttctttctgttgaaccttacaagaggccaacagcaagtgatcttctgcggcacccttgggtgataggagactgcgcaaagcaagatctcatggatgcagaggtcgtctcaaaactgcagaagttcaatgctagaaggaaattgcgggcagcagccattgccagtgtccttagcagcaaggtggcattgaggacaaaaacgctgaggaaccttttaggaacccatgaccttagctcagaagagctagacaatctgcgggttaattttgcacgaatatgcgctgacggagagaacgccacactggcagagtttgagcaggttctaaaggcgatgaaaatggaccctctgatccctctagccccacgcgtgtttgacctgtttgacaacaaccgtgatggcacagtcgacatgagggagatcctttgtggactatctagcctgaggaactctcgcggcggcgacgcactccagctctgcttccagatgtatgatgccgaccggtcaggctgcatcagcaaggaagagctggcggcgatgctgagagcgctgccagaggagtgcctccccactgacatcacggagcctgggaagctggatgagatattcgacgagatggatgccaatggtgatggcaaggtgaccttggatgagttcaaggccgcgatgcagaaggacagctccctccaggacgttgtcctctcctccctacggccggggcagtagagcgacactgtaatctgtcattagccagcctcctgctgagaacgtgcttttacttctttcttcgtctttttcgattgtatcaggtcaagtagttttgatgaaaaggggagggagggagtaatagattgagataaactactatcaatgaacagaacagagatgatgcaaaacgtcttgctacttcttttttacatgtttgccataaaggcgcatgcggaatgcatcatcagaacaatgctttggtttgggtaggcacatacggttacctttt

SEQ ID NO: 8208 - protein, 514 aa, Panicum virgatum
  misc_feature: Ceres CLONE 1992125
  misc_feature (1)..(511): SWISSPROT Homolog: EC 2.7.11.17 Calcium and calcium/calmodulin-dependent serine/ threonine-protein kinase
  misc_feature (6)..(512): SWISSPROT Homolog: EC 2.7.11.17 Calcium and calcium/calmodulin-dependent serine/ threonine-protein kinase DMI-3
MSKTESRKLSDDYEVADVLGRGGFSIVRKGVSKSGGKTQVAIKTLRRLGPAMMGASQQGSKSSLPMWKQVSISDALLTNEILVMRRIVESVAPHPNVIGLHDVYEDAHGVHLILELCSGGELFDRIVGRARYSEFDAAAVVRQIARGLEALHKANIIHRDLKPENCLFSEKNEDSTLKIMDFGLSSVEDFSDPIVTLFGSIDYVSPEALSRQDVSAASDMWSVGVILYILLSGCPPFHAATNREKQQRILQGEFSFQDHTWKTISSSAKDLISSLLSVEPYKRPTASDLLRHPWVIGDCAKQDLMDAEVVSKLQKFNARRKLRAAAIASVLSSKVALRTKTLRNLLGTHDLSSEELDNLRVNFARICADGENATLAEFEQVLKAMKMDPLIPLAPRVFDLFDNNRDGTVDMREILCGLSSLRNSRGGDALQLCFQMYDADRSGCISKEELAAMLRALPEECLPTDITEPGKLDEIFDEMDANGDGKVTLDEFKAAMQKDSSLQDVVLSSLRPGQ

SEQ ID NO: 8209 - DNA, 1509 bp, Panicum virgatum
  misc_feature: Ceres CLONE 1992141
  misc_feature: Encodes the peptide sequence at SEQ ID NO. 8210
actcaccgcctccaaacacggtgacctcgccgcgaacaaacagcccatctcgctatcgctcagctgaactgctcggctttagctacgctccaagtcactccgccacgctcctaccggccgccatggctctgcaggccgccgctctcctcccttgcactctctccgtccccaagaagggccacctcgccgccgtggtgaaggacacggctttcctcaccgttcaccagaagagcacccagaagccgcgtgttccgtcgctttcggtgcgggcgcaggccgtggcgacggcgcccgtggccaccccgggggccagcaccagcacgtcggccaacaagaagacgctgcggcagggggtggtggtgatcacgggcgcgtcctcggggctgggcctggcggcggccaaggcgctggcggagacgggcaagtggcacgtcgtcatggcgtgccgcgacttcctcaaggcggccaaggcggccaagggcgccggcatggcggagggcagctacaccatcatgcacctggacctggcctccctcgacagcgtccgccagttcgtcgacaacttccgccgcgccggcatgccgctcgacgccctcgtctgcaacgccgccatctaccgccccacggcgcggacgccgacgttcacggcggacgggtacgagatgagcgtgggcgtcaaccacctgggccacttcctcctcgcgcgcctcctcctcgacgacctccgcaagtccgactacccgtcgcggcggctcgtcatcctcggctccatcaccggcaacaccaacacgctggccgggaacatcccgcccaaggccgggctgggcgacctccgcggcctcgccggcggcctgcgcggccagaacgggtccgccatgatcgacggctccgagagcttcgacggcgccaaggcgtacaaggacagcaagatctgcaacatgctcaccatgcaggagctgcaccggcgctaccacgaggagacgggcatcaccttcgcgtcgctctaccccggctgcatcgccaccacggggctcttccgcgagcacatcccgctcttccgcctgctcttcccgccgttccagaagttcatcaccaaggggttcgtgtcggaggcggagtccggcaagaggctggcgcaggtggtcagcgaccccagcctcaccaagtcgggggtctactggagctggaacaaggactcggcctccttcgagaaccagctctcgcaggaggccagcgatccggagaaggccaggaagctctgggagatcagcgagaagctcgtcggcctagcctgaccaccaggagcttgctgacacttgtatcgagcagatgagcttttgcttcgttgtttcatgtgtaccattagcaaccattttgtttattaggagctggtgatgacagtcggaggagcctgtaattgatcgatcatgcaccatgcacaattgtttttttctcacaaagtattatggaataaaacgacaggcttagtaaaaaaaaaaaaaaaaaaaa

SEQ ID NO: 8210 - protein, 390 aa, Panicum virgatum
  misc_feature: Ceres CLONE 1992141
  misc_feature (1)..(129): Pfam Name: adh_short Pfam Description: short chain dehydrogenase
  misc_feature (1)..(390): SWISSPROT Homolog: EC 1.3.1.33 Protochlorophyllide reductase A, chloroplast precursor
MALQAAALLPCTLSVPKKGHLAAVVKDTAFLTVHQKSTQKPRVPSLSVRAQAVATAPVATPGASTSTSANKKTLRQGVVVITGASSGLGLAAAKALAETGKWHVVMACRDFLKAAKAAKGAGMAEGSYTIMHLDLASLDSVRQFVDNFRRAGMPLDALVCNAAIYRPTARTPTFTADGYEMSVGVNHLGHFLLARLLLDDLRKSDYPSRRLVILGSITGNTNTLAGNIPPKAGLGDLRGLAGGLRGQNGSAMIDGSESFDGAKAYKDSKICNMLTMQELHRRYHEETGITFASLYPGCIATTGLFREHIPLFRLLFPPFQKFITKGFVSEAESGKRLAQVVSDPSLTKSGVYWSWNKDSASFENQLSQEASDPEKARKLWEISEKLVGLA

SEQ ID NO: 8211 - DNA, 2064 bp, Panicum virgatum
  misc_feature: Ceres CLONE 1992155
  misc_feature: Encodes the peptide sequence at SEQ ID NO. 8212
aagaggttggacaggtttgatgcgtcttgttctctgtactacctcctcagccaggcttcagcaatgcgagggaggatcctaaactggcgtgctggaaacgcggggatcgagcgtttccaacaagccaaacttgcacaaacctcgctagctcaagcactcggtacgtcttcacctccggagcagctcacccgcacggatgcggcggcggagctcggcagctcctgcgcacgccgcacacggtggcgaagctcgaccgtgtgcctccgcttggccactcctccctccgctcggccgcgtgcctccctctcggtcccacaccgtgcagctccgcgcctcccccgcccgcacacttcaacgctttctatgccccgctggtttcgcccctcacaccctcctatgcgcgagaaatatggcatgctcctcggcggcgcccaagttcacggtgcgcaggcgaccggcggtgctggtggcgccggcggcccctacgcctcgtgagctgaagcacctctcggatatcgatcagcaggaccttttgaggttccaagtccccgtcatccagttctaccggaggaacgagtccatgggcggcaaggaccccgtgcgggttatacgggaggctctcaccaaatcccttgtgccctactacccgttcgctggacggctccgggagcaccatggatggaagctcgccgtcgactgcaccggtgagggggttatgttcgtcgaggccgacgctgatgttggccttgagcactttggtgatcccctactgccacccttcccgtgcctcgaggagctcatctttgacgtccccggctcctctgccatcctcaacactcccctcctgctcttccaggtgacgcgactcgcctgtggaggattcatccttgcggtccgactgaaccacaccatggctgacgcactgggcctgacgcagttcttgggtgcggtggcagagcttgcgcggggagcgcagtctccgtccgtgctgccggtgtggaaacgggacctgctggaggggcgcaaccagcaacagacggcgctggtgcacgacaagtcggacgaagtgtcgggcaggagtagtgacgacgctgacaccaaggccagtaataccatgcttccgttaatagataacgcggcgctccgcgtccgctccttcttctttggtccccgagagatcgccgctatccgagcacagctcccgccagaccttcagaagcgcgccacaaagttcgacaccatcgccggctggatttggaagttccgcacggtggcgctagccccggaccccgacgaggtgatgcagctgatggtggtcgtcaacgcccgcggccgcaccaccgcagaggtcggcatccccatcggctactatgggaacgcgatggcggccccggccgccatatcgacggccagggagctctgcacgaaccccctgagttacaccgttgagctggtgaggaaggcgaaaaaccaggtggacatggagtacatgcggtcaacggccgacctcatcgcgctgcgcgggggccaaagtccgcccatcaccgcgggcatgtattatctgactgacgaaaccaaggccaggtttcacgacctcgacttcggatggggcaagccagtctatgcggggccggcggaagctgtcccctcgccctttcccttgctgattagcttcctcttagcctccaagaacgccaacggggaggacgccatcgtggtgccgatctgcctgcctggccctgctatggataggtcataggttggtggaagagatgagcaactgcacccatcagccgatgtgatcccccgctgctgcaccggctagcctcacgtattcccagtcaagaggtcagcgctctcaaaaattcgccgtattggctggctggctacgaccgaaaggaaattaaacttcatctcgtcgcatactcgcatgtggatggaatgcagtggtacgctactatatggttgtctcaagtgttctatttgttctactccgtgttctcaataaaatgtaaatgaatcgttcatcagttaataattgcacgcgtgtttgttgcatactat

SEQ ID NO: 8212 - protein, 520 aa, Panicum virgatum
  misc_feature: Ceres CLONE 1992155
  misc_feature (1)..(431): Pfam Name: Transferase Pfam Description: Transferase family
MRRRSSAAPAHAAHGGEARPCASAWPLLPPLGRVPPSRSHTVQLRASPARTLQRFLCPAGFAPHTLLCARNMACSSAAPKFTVRRRPAVLVAPAAPTPRELKHLSDIDQQDLLRFQVPVIQFYRRNESMGGKDPVRVIREALTKSLVPYYPFAGRLREHHGWKLAVDCTGEGVMFVEADADVGLEHFGDPLLPPFPCLEELIFDVPGSSAILNTPLLLFQVTRLACGGFILAVRLNHTMADALGLTQFLGAVAELARGAQSPSVLPVWKRDLLEGRNQQQTALVHDKSDEVSGRSSDDADTKASNTMLPLIDNAALRVRSFFFGPREIAAIRAQLPPDLQKRATKFDTIAGWIWKFRTVALAPDPDEVMQLMVVVNARGRTTAEVGIPIGYYGNAMAAPAAISTARELCTNPLSYTVELVRKAKNQVDMEYMRSTADLIALRGGQSPPITAGMYYLTDETKARFHDLDFGWGKPVYAGPAEAVPSPFPLLISFLLASKNANGEDAIVVPICLPGPAMDRS

SEQ ID NO: 8213 - DNA, 1641 bp, Panicum virgatum
  misc_feature: Ceres CLONE 1992165
  misc_feature: Encodes the peptide sequence at SEQ ID NO. 8214
ggcactcctcagttgagttaccatataccagacgctagcgaagtagcgatggatatgggcgatccctcccttgtggtggcggccgtcgccgtggccttatcccttgtgttccttgtcgtagcggcgagggccagcaggaagccaggcaagctgccgctgccccccgggtcgatgggcctgccggtgatcgggcagagcctgggcttcctccgcgcgctgcgctccaacacagcagagcagtggattcaggagcgcgtggagcggtacgggccggtgtccaagctgaggctcttcggcacccgcacggtgatgctcaccgggcccgcggccaacaagttcgtcttcaccagcgcgtcgctggggacggagcagccccagtcgacgcggcggatagtcggggagaggcagatcctggagctcatgggcgccgaccacaagcgcgtccgcggcgcgctgctcgagttcctcaagccggacatgctgcggctatacgtgggcaagatcgacggcgaggtgcggcgccacctcgacgagtactgggccggccgggccaccgtcacggtgatgccgctgatgaagaggctcacgttcgacatcatctccctgctgctcttcggcctggagcgaggcgccgtccgggaagccctcttcgacgacttcgagcacgtcttggatggcgtgtggtccgtccccctggacctacccttcacggcgtaccgccggagcctcagggccagcgccagtgctcgccgggtgatcgccgggatcacgcgggagaccaaggccaagctggagcggggcgaggcctcccggagcagcgacctcgtcgcgtgcctgctcagcttgaccgccggcagcggcgcgcggctgctgagcgatcaggaggtcgtggacaacgccatggcctccatgatcgccggccacgacacgtcctccatccttctcgccttcctcatccgccagctcgccgacgatcctgacacgctctccgccatggtccacgagcacgagcagatcgccaagagcaagggcgacggcgacaccctgacctgggaggacctgtctaacatgaagttcacgtggcgcgccgcgcaggagatgctccggctggtgcccccgatcttcggcaccttcaggacagcgctcaaagacatcgagttcaacggctacctcatccccaaagggtggaaggtgctctggacggcgcccgccacgcacatggacgggagcatctaccccgagccggccaaattcaacccgtcccgcttcgagaacccgacggcgccgccttgctccttcgtcgccttcggcggcggcccgaggatctgcgtcggcatggagttcgccaggatcgagacgctggtggccatgcattacctggtgaggcgcttcagctggaagctctgctgcaaggagaacaccttcgtcaggaacatccagccgtggccgctgcacggcctgcccgtacaacttgagcaaaaggcagcaaaatcgccatgattcatcacatcatatacgatcgaccgtgacgatacaataatatactccaacttcaaagatacctagcgatgttgattcgtcaccacagatccaaatgaataaatttatatcttgtctcctcaaaaaaaaaaaaaaaaaaaa

SEQ ID NO: 8214 - protein, 483 aa, Panicum virgatum
  misc_feature: Ceres CLONE 1992165
  misc_feature: Great-hit functional homolog of the protein sequence encoded by LOCUS At5g36140
  misc_feature: Useful for making plants with modulated oxidative stress sensitivity
MDMGDPSLVVAAVAVALSLVFLVVAARASRKPGKLPLPPGSMGLPVIGQSLGFLRALRSNTAEQWIQERVERYGPVSKLRLFGTRTVMLTGPAANKFVFTSASLGTEQPQSTRRIVGERQILELMGADHKRVRGALLEFLKPDMLRLYVGKIDGEVRRHLDEYWAGRATVTVMPLMKRLTFDIISLLLFGLERGAVREALFDDFEHVLDGVWSVPLDLPFTAYRRSLRASASARRVIAGITRETKAKLERGEASRSSDLVACLLSLTAGSGARLLSDQEVVDNAMASMIAGHDTSSILLAFLIRQLADDPDTLSAMVHEHEQIAKSKGDGDTLTWEDLSNMKFTWRAAQEMLRLVPPIFGTFRTALKDIEFNGYLIPKGWKVLWTAPATHMDGSIYPEPAKFNPSRFENPTAPPCSFVAFGGGPRICVGMEFARIETLVAMHYLVRRFSWKLCCKENTFVRNIQPWPLHGLPVQLEQKAAKSP

SEQ ID NO: 8215 - DNA, 1258 bp, Panicum virgatum
  misc_feature: Ceres CLONE 1992261
  misc_feature: Encodes the peptide sequence at SEQ ID NO. 8216
gcgcgcgctctcgtcatctggtgctcccgttggtttctctgcccggtgttgctctcggccccacgatggcggtggcttgcttcaaccccatgctctcgccgctcatccccgcgccgccgggtgggcgcggaagagcggcgttcctgcgggtgcgtgcggccttcctcgcgccgctcgcgtgcggcgcggtggtgggtcgcggcaggtggcggctcgcggcggcggccgatccgcaggccgtgcaggagcagccggcgcggacggaagtgtccggcgagaccggcgccgcgggggcctccgaggcgtcctccaagctggttctggtcgttgggggaaccggcggcgttgggcagttggttgtagcatcattgctgagcaggaagatcaagtcaagattgctcctcagagatcctgaaaaggcagagtctctatttggcaagcaggatgagagtgtgctgcgggtttacaaaggggacacaagaaatcctaatgatttggatccacaaatgtttgagggagttacacatgtgatatgttgcactggaactacagcatttccgtcaaagcgctgggatggagataacactccagaacgtgtagactgggatggcatccgaaatcttgttagcgcccttccacggacaatcaagaggctggttttcgtgtcatccatcggtgttacaaaatacaatgaaataccttggagtatcatgaatctctttggtgtgctcaagtacaagaagatggcagaggactttgtccgcaattccgggataccattcaccattatcaggcctggaagattgactgatgggccctacacttcgtatgatcttaatacacttcttaaagctacagctggagagcgacgagcagtagtcataggcaaaggtgacaagcttgtgggggaagttagcagactggtggtggcagaggcctgcatccaagctttagatattgaatccacagaaggacagatatacgagattaattcagtgaagggcgaaggacctgggacggaccccgagaagtggaaggagctattcagttctgtccaatcaacgtagtggcacccggtgaatctctattatacatacactgtatactagtatactgtagcgtgcgtaattccgtagaagcagcacatgtaatcccattggccattgagcattattatagccaccgtggacagagatttgtatcatcaatcaactgcgagtagcaaagaatatctggtcaaaaaaaaaaaaaaaaaaaa

SEQ ID NO: 8216 - protein, 333 aa, Panicum virgatum
  misc_feature: Ceres CLONE 1992261
  misc_feature (1)..(225): Pfam Name: Epimerase Pfam Description: NAD dependent epimerase/dehydratase family
MAVACFNPMLSPLIPAPPGGRGRAAFLRVRAAFLAPLACGAVVGRGRWRLAAAADPQAVQEQPARTEVSGETGAAGASEASSKLVLVVGGTGGVGQLVVASLLSRKIKSRLLLRDPEKAESLFGKQDESVLRVYKGDTRNPNDLDPQMFEGVTHVICCTGTTAFPSKRWDGDNTPERVDWDGIRNLVSALPRTIKRLVFVSSIGVTKYNEIPWSIMNLFGVLKYKKMAEDFVRNSGIPFTIIRPGRLTDGPYTSYDLNTLLKATAGERRAVVIGKGDKLVGEVSRLVVAEACIQALDIESTEGQIYEINSVKGEGPGTDPEKWKELFSSVQST

SEQ ID NO: 8217 - DNA, 1586 bp, Panicum virgatum
  misc_feature: Ceres CLONE 1992285
  misc_feature: Encodes the peptide sequence at SEQ ID NO. 8218
ggcacaaaccaaaacttgtctcgtcatccacatccgcaaactcccttcccgcacaaaaccgagcagagagggaagagagagatggaggaataaagcggagagggagagccgagccggagatcaaaaggagcaaggaaagccgatagcttgtgtgtggagagagagagagagagagagagagaggtgtgcgcccccgatccccatggcctctgctcctcctgctatataagacccgggggctcctctgcttcccaatccacccatcctggtctcatgcttcggtccacgcccccgcccagcccctccagcggcagcggcacctcggcggcgccggcgtccggctccgacgccaagatggtcggcggcggcggcggcgcggcgggcagcggcgcgccgagcggggccaagctgctgcagatcctcaacgtgcgggtggtgggcagcggcgagcgcgtggtggtgctgtcccacggcttcgggacggaccagtcggcgtggagccgcgtgctcccctacctcacccgcgaccaccgcgtggtgctctacgacctcgtctgcgccggcagcgtgaacccggagcacttcgacttccgccgctacgacacgctcgactcgtacgtcgacgacctgctcgccatcctcgacgcgctccgcatcccgcgctgcgccttcgtcggccactccgtctccgccatgatcggcatcctcgcctccatccgccgccccgagctcttcgccaagctcatcctcatcggcgcctcgcccaggttcctgaacgacaacgactaccacggcgggttcgacctgccggagatccagcaggtgttcgacgccatggcggccaactactcggcgtgggcgacggggtacgcgccgctggcggtgggcgcggacgtgccggcggcggtgcaggagttcagccgcaccctcttcaacatgcgcccggacatctccctccacgtctgccgcacggtgttcaacacggacctccgcggcgtgctgggcatggtgcgcgccccctgcgtggtggtgcagaccacccgcgacgtctccgtcccggcctccgtcgccgcctacctcaaggcccacctcggcggccgcaccactgtcgagttcctccagaccgagggccacctcccgcacctcagcgcccccggcctcctcgcccaggtgctccgccgcgcgctcgcccggttctagcgacgcggcgatcggtatttttaccgcctcgatttttaccctttgccaagaatcaaaaatggcgcgacccgcgcctctgctgctgtgtgtgtgccatgactgtagtctgtagtagaacttgttctggtgcccgaattttttttaactttttactggagcagtcgtactggtactccgcatcttgccttcttctcctgcaccgccactgcacctgtaccgagggacagataagcgggccttctggcgccacgtggcgggtactcgagacggtgcacgagttccttccagcttcttaagccttgtcccatctgcaatgagattgggatctactgacctgattaagcggataatggtatcgattggttgaaaaaaaaaaaaaaaaaaaa

SEQ ID NO: 8218 - protein, 308 aa, Panicum virgatum
  misc_feature: Ceres CLONE 1992285
  misc_feature (1)..(218): Pfam Name: Abhydrolase_1 Pfam Description: alpha/beta hydrolase fold
MLRSTPPPSPSSGSGTSAAPASGSDAKMVGGGGGAAGSGAPSGAKLLQILNVRVVGSGERVVVLSHGFGTDQSAWSRVLPYLTRDHRVVLYDLVCAGSVNPEHFDFRRYDTLDSYVDDLLAILDALRIPRCAFVGHSVSAMIGILASIRRPELFAKLILIGASPRFLNDNDYHGGFDLPEIQQVFDAMAANYSAWATGYAPLAVGADVPAAVQEFSRTLFNMRPDISLHVCRTVFNTDLRGVLGMVRAPCVVVQTTRDVSVPASVAAYLKAHLGGRTTVEFLQTEGHLPHLSAPGLLAQVLRRALARF

SEQ ID NO: 8219 - DNA, 1813 bp, Panicum virgatum
  misc_feature: Ceres CLONE 1992293
  misc_feature: Encodes the peptide sequence at SEQ ID NO. 8220
gccacattccgtcggtactagctagcaggcagcaagatccaggcaccgtctttctgctgcggcggcaggcttgccaggcgccagagatctctcgggtcccgtgccaatgcagctcttccaaggtaccatgccagcaggcagcagagagacctcgccgaccgagttctttcgttgctagctcttgccgtcgccgctcggcccagccgcctctcttctctctcccacttcagttcctcctctgaagctgacggctatgctgcgcccgtgattcgcaggggagaagccggcccatgacttcctctcgcttcacaccggaggcggctcgtcctcgccggtgcagcactccgcccaagggtacaatacgggggtgctcacttcgctcaagcctctcaagctgggcaagcggcgccgcggcgccggcggcggtggcggagcgatcggcatggcaccgtcgggtctggaggcggactcggcggagcatctcctgccgggcggcgtcgggacgttcagcatcaggcaggcgccgtcgactgcccagccgagggggcaacccgctggccacggcgtcgtcgccacgggcgcgttcgcgcccgtgctccatggctccaggacggaggccacgcacggagcggaatctggagccagggctcacagtgggcctgcctcaatgtggcaagattcgggcgccgatcaaagatccagagcgacgagaggggaggggagaagcagcggcagcagcggtgatcaggggcccagcacgccgagatcgaagcattctgccaccgagcagcggaggaggaccaagataaatgacagacttgaaatacttcgtgaacttctgccacatggcgaccagaagagggacaaagcgtctttccttctcgaggttatcgaatacataaggtttttgcaagagaaagtccaaaagtacgagtcagcccacccacaaaagaatcacgaggattcctccatgccatgggcaaaactttactacagatcatgctggaaaaacacagggaacattactcaagtccaaggaggatcgtcagcccccacacaggctatgaacaaagagcagtactgttccactaaaactacagtggcacctactctcttcagcacacatagtgctggagaaactagtatagacgagatttcctcccaaaaggcaacaagcacgccacaaaactgggcagatgacagcacacctagcaaacagccaccatggttgagcatgtcaacctctgattcaggcaacaaaacactaagcaagaaagagaaacagactcttcacgaggatactcgtagtctttctaatgcttactctcaagggttactaaacaggttgacacaagcactaaaaagttcgggagtagacccatctcaagctagtatatcagttgagatcaatatggacaaaagagcaacagaacctagcaatacacatggcaatttgaaggacaatgaatgtgaagaaacaatccacgtgaccaagaagcttcggtgctgacacaagccagatctctacctcaaactagaaaagtcacatatccccaagtccagaccaggactgaacagaagcaaaccacaattgatgcaattctttaacttatattgcaatcacatttactgacctaggcttccattcgaatgtagtagaggaagctgcttagggagggaagtcagaagccttcccgattcattcattcctcatttgtaaatgcaattcagattgtaaaacggtgtacatgtattaatttctcaaaatttgtcaacaaatatggtggtacactaaaaaaaaaaaaaaaaaaaa

SEQ ID NO: 8220 - protein, 355 aa, Panicum virgatum
  misc_feature: Ceres CLONE 1992293
  misc_feature (1)..(51): Pfam Name: HLH Pfam Description: Helix-loop-helix DNA-binding domain
MAPSGLEADSAEHLLPGGVGTFSIRQAPSTAQPRGQPAGHGVVATGAFAPVLHGSRTEATHGAESGARAHSGPASMWQDSGADQRSRATRGEGRSSGSSGDQGPSTPRSKHSATEQRRRTKINDRLEILRELLPHGDQKRDKASFLLEVIEYIRFLQEKVQKYESAHPQKNHEDSSMPWAKLYYRSCWKNTGNITQVQGGSSAPTQAMNKEQYCSTKTTVAPTLFSTHSAGETSIDEISSQKATSTPQNWADDSTPSKQPPWLSMSTSDSGNKTLSKKEKQTLHEDTRSLSNAYSQGLLNRLTQALKSSGVDPSQASISVEINMDKRATEPSNTHGNLKDNECEETIHVTKKLRC

SEQ ID NO: 8221 - DNA, 1924 bp, Panicum virgatum
  misc_feature: Ceres CLONE 1992318
  misc_feature: Encodes the peptide sequence at SEQ ID NO. 8222
actactcatcacagcagccatccatccatccatctcccctagcttcctcctccatcctctcgctggttacttccacccaatccatccctctccttccttctcgtgcgcgttgacggcgtcgtcctctgctactcctactaaacgcacagcagggagctagctagagaggagaactcactcactccaggactacagctaactcgccgagatcatatcaccggcaacgatggcggcggcggcaaaaagccgggtggtgtgggtgaacgggccgatcgtggtgggtgccgggccggcgggcctatcggtggcggcgtgcctgcgggcccgcggcgtcccatccgtggtcctggaccgggccgattgcgtggcctccctatggcagcgccggacctacgaccgcctccgcctccacctgccgcgccacttctgcgagctcccagggatgccctttcccgaccactacccagagtacccctcaaagaagcagttcgtcgactacctcgaggcctacgcggcgcaggccggcgtcgagccccggttcaaccaatcggtgacctccgcccgctacgacgccgcggccgggctctggagggtcgttgctgaggacgttgtcgtcgccggcgacgccgcgacagagtacatcggccggtggctcgtcgtggccaccggcgagaacgccgagtgcgtcgtgccggagttcgagggcgccgaggagtttggtgggccagtttcgcatgtctccgagtacaagtccggcaaggactaccgcggcaagcgggtgcttgttgttgggtgtggcaactccggcatggaggtctgccttgacctctgcgaccacaatgccctcgcctccatggtcgtcagggactcggtgcacgtcctgccgcgggagatattcggcgtcgcgacgttctcggtggccgtcttcctgctccggttcctgccgcagtggctggtggacaggatcctcgtgctcctggcgcggctcatcctcggcaacctcgagaagctcggaatccggcgcccggtggggggcccgctggagctcaagaacaccaggggcaggacgccggtgctcgacatcggcgcgctcgccaagatcaggtcaggggagatcgaggtcgtgccggggatcaggaggttcttccgcggtggcgccgagcttgaagatggccgccgcgtcgccgcggacgcggtcatcctcgccaccggctaccacagcaacgtgcctcagtggctcaagggaaccgacttcttcacccaggaagggtacccaagggtgccgttcccagacggctggaagggtgagtcagggctctactctgttggattcaccaggaggggcctctccggcgtcgcctccgacgccgtcaaggttgcgcaggatatagccatggcatgggagcagcaaacatccacattatgatggacaaacttacaatcattaaccgctgatggacctgctaacttcacatatcttgtcatcgaatcggtgcatgtccaataaagctcgacgcagtttggccaagcattgtccaggcacaagttcagagacacaggcgaccatcttggggcagagaagttcagggttgaaaccataaaccaagaaacagaggagaaaattcagcggatccagtggtgccagaacacaaagttaaagagtgtcatggatgatgctccttcgttcaacgatggcgaggaggccagactgcgcgcatcaagtagcaaagcccagattttgctgtacccatgggccctgatatatgtacagagttttatgtagtaaagttgtgtatagtgctacttatagtggttggtagagtgttaggggttgacatgcatgtgtactaccttgatgtttatgtatggagttgacaatgagaatgacctattctatttaagctaaaaaaaaaaaaaaaaaaaa

SEQ ID NO: 8222 - protein, 399 aa, Panicum virgatum
  misc_feature: Ceres CLONE 1992318
  misc_feature (1)..(36): Pfam Name: DAO Pfam Description: FAD dependent oxidoreductase
  misc_feature (1)..(35): Pfam Name: FMO-like Pfam Description: Flavin-binding monooxygenase-like
MAAAAKSRVVWVNGPIVVGAGPAGLSVAACLRARGVPSVVLDRADCVASLWQRRTYDRLRLHLPRHFCELPGMPFPDHYPEYPSKKQFVDYLEAYAAQAGVEPRFNQSVTSARYDAAAGLWRVVAEDVVVAGDAATEYIGRWLVVATGENAECVVPEFEGAEEFGGPVSHVSEYKSGKDYRGKRVLVVGCGNSGMEVCLDLCDHNALASMVVRDSVHVLPREIFGVATFSVAVFLLRFLPQWLVDRILVLLARLILGNLEKLGIRRPVGGPLELKNTRGRTPVLDIGALAKIRSGEIEVVPGIRRFFRGGAELEDGRRVAADAVILATGYHSNVPQWLKGTDFFTQEGYPRVPFPDGWKGESGLYSVGFTRRGLSGVASDAVKVAQDIAMAWEQQTSTL

SEQ ID NO: 8223 - DNA, 1693 bp, Panicum virgatum
  misc_feature: Ceres CLONE 1992321
  misc_feature: Encodes the peptide sequence at SEQ ID NO. 8224
aactcacatctcagtagctgatcaacctagcaacgaacagcacgccatggcctctgctccgaagcttctgctcctcctcctgtgtagttatcacactctagttgctcaagcaggaggtgatagcagttacaagcttctgtccattagctctctcaagtctgactccgtctgttccgagcccaaagcgactccatcgtcgacgggcgtcacggtgcctttgcaccaccggcacggcccatgctcaccggcgccctccaagaagatgccagccttggaggagatgctccggcgtgaccagctccgagctgcctacatccaacggaagtactccgccgccaagggcggctccggcgatgtccagcagtcggacgccaccgtgccgaccacgctgggcacgtccctgaacacgttggagtacgtgatcaccgtaggcatcggctcgccggccgtgacccagaccatgctcatcgacaccggcagcgacgtgtcgtgggtgcagtgcaaaccgtgctcgcagtgccactccctggcggacccgctcttcaaccccagctcgtccagcacctactccccgttctcttgcagctctgccacctgcgcgcagctcggccaggaggggaacggctgctcgagttcccagtgccagtacattgtcacctacggcgacggctcgagcaccaccggcacctacagctccgacacgctggcgctgggctccaacaccgtcaggaacttccagttcgggtgcagccaggtggagtcgggcttaaatgaccaaaccgccgggctcatggggctcggcggcggcgcgcaatcgctcgcgtcgcagacggcggggacattcggcagggccttctcctactgcctcccgccaaatccgggctcctccgggttcctcacgctcggcgctggagcgtccggcttcgtcaagacgccgatgctcaggagcagccaggtccccacgttctacggcgtccgccttcaggcgatcagggtgggagggaggcagctcagcatacccgcctcggtcttctccgccgggacggtcatggactccggcacggtcatcacgcgcttgccgcggacggcctactcggcgctgtcgtcggcgttcaaggccgggatgaaggagtacccgtcggcgccgcccagcggcatcttcgacacgtgcttcgacttcaggggccagtccagcatcagcataccgaccatccagctggtgttctccggcggcgcggtggtcgacctcgccgcagaagggatcatcctgagcagctgcctcgccttcgctggcaacagtgacgacagctccctcggcatcatcggcaacgtgcagcagcggacgttcgaggtgctgtacgacgttggcgggggcgctgtgggcttcaaggccggggcgtgctgatgatcgccgcgcacaagaacattatattattaacactacggggaggaagcaaggcaggaggcttctctcagaggtgtttgtggctgcgaggtaacagacatgaagtgggggcaaaccatcaactattcaactatagtactccgatttgaattatttttgcgattgcgacgtgatgcaagtgtgcaaactaccaaccaaaagataagtgtaattttctcctgatattatatgaatataaagattaataatatactatgttgcttttctcaaaaaaaaaaaaaaaaaaaa

SEQ ID NO: 8224 - protein, 452 aa, Panicum virgatum
  misc_feature: Ceres CLONE 1992321
  misc_feature (1)..(336): Pfam Name: Asp Pfam Description: Eukaryotic aspartyl protease
MASAPKLLLLLLCSYHTLVAQAGGDSSYKLLSISSLKSDSVCSEPKATPSSTGVTVPLHHRHGPCSPAPSKKMPALEEMLRRDQLRAAYIQRKYSAAKGGSGDVQQSDATVPTTLGTSLNTLEYVITVGIGSPAVTQTMLIDTGSDVSWVQCKPCSQCHSLADPLFNPSSSSTYSPFSCSSATCAQLGQEGNGCSSSQCQYIVTYGDGSSTTGTYSSDTLALGSNTVRNFQFGCSQVESGLNDQTAGLMGLGGGAQSLASQTAGTFGRAFSYCLPPNPGSSGFLTLGAGASGFVKTPMLRSSQVPTFYGVRLQAIRVGGRQLSIPASVFSAGTVMDSGTVITRLPRTAYSALSSAFKAGMKEYPSAPPSGIFDTCFDFRGQSSISIPTIQLVFSGGAVVDLAAEGIILSSCLAFAGNSDDSSLGIIGNVQQRTFEVLYDVGGGAVGFKAGAC

SEQ ID NO: 8225 - DNA, 1167 bp, Panicum virgatum
  misc_feature: Ceres CLONE 1992360
  misc_feature: Encodes the peptide sequence at SEQ ID NO. 8226
cgccggcagtagccactgatacgggcacactgtcttcgatcgagctctgttttgttttccccttctcctgcgaccattcgccgccatgaggctccgcctccgcctccgcggcgtgctgctggtcctggcgctcctcctggcggccaccgccgtggtgccggtgctcctcctgggcgacgccgacgacggggccgcggcgcgcgttgcgccggcgccgccgttcaactcgtcgcgcgtgaaggccgtctcgtggcagccgaggatcttcgtgtacaggggcttcctctccgacgccgagtgcaaccacctcgtggagctcgggaagaagaaggtccagcgctcgatggtggccgacaacgactccggcaagagcgtcatgagcgaggtgcgcaccagctccggcaccttcctcgacaagcgccaggacccggtggtaaccaggattgaagagaggattgcggcatggacgtttcttcctgaagagaacgccgagaacattcagatcctccgttacgagcagggtcagaagtacgagccgcacttcgattacttccacgacaaggtgaaccaggcccggggaggccaccgctacgccaccgtgctcatgtacctgtccaccgtcgacaagggaggcgagaccgtcttccccaacgccaagggttgggagtctcagcccaaggatgacactttctctgactgtgcacggaaaggactggcagtgaaaccggtgaaaggtgacgcggtgctcttcttcagcctccacgtcaatggagtgccggacccgctcagcctccatgggagctgcccggtcatcgaaggcgagaaatggtctgcgccaaagtggatccatgtcaggtcctacgagaattccccagtcctggcgacggagactgaaggatgcaccgacaagagtgagcattgcgcgcaatgggctgcagcgggcgaatgcgggaagaacccggtgtacatggtaggcaccgaggggttgcctggtcagtgccggaagagctgcaatgtctgtgattcataggctgttttacacttctttcgaaattcagtattgcaatcactttctggaactatacttgatgtgtacataactagagaaagttttcttcagataaaatgaggcagtattttagttttcaaaaaaaaaaaaaaaaaaaa

SEQ ID NO: 8226 - protein, 314 aa, Panicum virgatum
  misc_feature: Ceres CLONE 1992360
  misc_feature (1)..(123): Pfam Name: 2OG-FeII_Oxy Pfam Description: 2OG-Fe(II) oxygenase superfamily
MRLRLRLRGVLLVLALLLAATAVVPVLLLGDADDGAAARVAPAPPFNSSRVKAVSWQPRIFVYRGFLSDAECNHLVELGKKKVQRSMVADNDSGKSVMSEVRTSSGTFLDKRQDPVVTRIEERIAAWTFLPEENAENIQILRYEQGQKYEPHFDYFHDKVNQARGGHRYATVLMYLSTVDKGGETVFPNAKGWESQPKDDTFSDCARKGLAVKPVKGDAVLFFSLHVNGVPDPLSLHGSCPVIEGEKWSAPKWIHVRSYENSPVLATETEGCTDKSEHCAQWAAAGECGKNPVYMVGTEGLPGQCRKSCNVCDS

SEQ ID NO: 8227 - DNA, 1827 bp, Panicum virgatum
  misc_feature: Ceres CLONE 1992385
  misc_feature: Encodes the peptide sequence at SEQ ID NO. 8228
aaaagcacgatgcccatgccgtccgccggataaacaccggtcgcttgcttgctttttcctgccgctacgtgccggcgccgcgccataataacagagcaacagcgagcaaccagcaattcaattctcctccgcaacctcccacctcccctccgcctccttccccttggacgataaccccaacgcaagcgagcgggcggcaccgagcgagcgagccagccagccatggagaaggcgatcgaccggcagcgggtcctcctcgcccacctcgtcccctcctcctcgtcctcgcggccgcagctggaggcgtcggcgtgcgcggccggggacagcaccgcgtaccagaggacctcctccttcggagatgatgttgtcgtcgtcgctgcataccggacgccgatatgcaaggccaagcgagggggtttcaaggacacgtacccagaggacctccttactgttgttctcaaggctgttctggacaacactaaaatcaatccaggtgacattggtgacattgtggttgggacggtgctaggtccaggttcgcagcgagcaaatgagtgcagaatggctgctttctatgctggattccctgaaactgttcctgtgagaactgtcaaccgacaatgctcatctgggttacaggcagtagctgatgtcgccgccgctataaaggctggtttctatgacatagggattggtgctggtttggaatccatgtcgataaattccattgcttgggaaggacaagtaaacccaaaaataagtacattccagaaatcacaggattgtcttctgcccatgggaattacttctgaaaatgttgctcatcgatatggtgtcaccaggcaagagcaagatcaggctgctgccgagtctcatagaagagctgctgcagccacggcttctggaaaatttaaggatgagatcgtccctgtgccaacaaagatcgttgatcctaaaactggagaggagaagaaagttgtgatatctgttgatgatggaattaggccaggcaccacagcatctggattggggaagcttaaaccagttttcaaaaaggacgggactacaactgcaggcaattctagtcaagtgagtgatggtgctggagctgttctcctaatgaagagatctgtagctctgaagaaaggacttcctattcttggtgttttcaggagctttgctgctgttggagtggacccagctgttatgggtgttggtcctgctgttgccattcctgctgcagtgaagtctgctggccttcagattgaagacattgatctctttgaactgaatgaggcatttgcctctcaatttgtctattgttgcaataagctgggactagaccgttccaaagtaaatgtgaatggaggtgcgattgcccttggacaccctctgggtgcaacaggtgcgcggtgtgtggctactcttctaaacgaaatgaagcgccgaggaagagactgccgatttggtgttgtaaccatgtgcatcggatctgggatgggtgcagcagctgtgtttgagcggggagacacggtggatgaactctccaacgtccgggacatccagtcacacagttttctatcaagggatgcaaagtagaattgcataaacattattatctatctcaaggcatcgatcagagtatcatcctaaagcataagccttctatgttagcaatacggaaaaccaattttttttttcacataaactatgtatacaaggaataaagggcatcatatggtatcttgttgtagccacccttagatgaaaaagggaaagaaaagggtgttgcaaccaaacagctcaatgttcggagcttgttcc

SEQ ID NO: 8228 - protein, 459 aa, Panicum virgatum
  misc_feature: Ceres CLONE 1992385
  misc_feature (1)..(448): SWISSPROT Homolog: EC 2.3.1.16 3-ketoacyl-CoA thiolase 1, peroxisomal precursor
  misc_feature (1)..(459): SWISSPROT Homolog: EC 2.3.1.16 3-ketoacyl-CoA thiolase 2, peroxisomal precursor
MEKAIDRQRVLLAHLVPSSSSSRPQLEASACAAGDSTAYQRTSSFGDDVVVVAAYRTPICKAKRGGFKDTYPEDLLTVVLKAVLDNTKINPGDIGDIVVGTVLGPGSQRANECRMAAFYAGFPETVPVRTVNRQCSSGLQAVADVAAAIKAGFYDIGIGAGLESMSINSIAWEGQVNPKISTFQKSQDCLLPMGITSENVAHRYGVTRQEQDQAAAESHRRAAAATASGKFKDEIVPVPTKIVDPKTGEEKKVVISVDDGIRPGTTASGLGKLKPVFKKDGTTTAGNSSQVSDGAGAVLLMKRSVALKKGLPILGVFRSFAAVGVDPAVMGVGPAVAIPAAVKSAGLQIEDIDLFELNEAFASQFVYCCNKLGLDRSKVNVNGGAIALGHPLGATGARCVATLLNEMKRRGRDCRFGVVTMCIGSGMGAAAVFERGDTVDELSNVRDIQSHSFLSRDAK

SEQ ID NO: 8229 - DNA, 1614 bp, Panicum virgatum
  misc_feature: Ceres CLONE 1992588
  misc_feature: Encodes the peptide sequence at SEQ ID NO. 8230
aaccatctcattccttccttccttcccacctgacctgaccttcccttcctcttcccccgcacgcacgcacaaagaacagcagcttgcacctcgcaagaggaacacccagctagctgctttgttctgcttggcgtgccaccagactactaactgaagtggcggccgcgtacgtagtggctagccaagccatcgacgacggcgactctcttctggcccagcagcggcgcgcacgccatggcccaggaggacgtccacctggacgacgcgggcctggccctgggcctgtccctcggcgtcgcttctgaggcggcgaggcagagcaccggcggcaaccggctgagcagggaggcggcggcgcggccgccgccgccgtcgccgcgcgcgctggagccgtcgctgacgctgagcatgccggacgaggcgacggcgacggggtccggcggcgccggggcgcacagcgtgtcgtcgctgtcggtggcgggcgtcaagagggagcgcgtggaggaggccgacggcgagcacgcgtcgtcgacggcggcccggggcggcggcgccggcgccgaggacgacgacgacgggagcacgcggaagaagctgcggctgaccaaggagcagtccgcgctcctggaggaccgcttcaaggagcacagcaccctcaacccgaagcagaaagtcgcgctggccaagcaactcaacctgaggccacgccaggtcgaggtgtggttccaaaacagacgagcaaggaccaagctgaagcagacggaggtggactgcgagttcctcaagcgctgctgcgagtcgctcaccgaggagaaccgccgcctccagcgcgagctccaggagctccgcgcgctcaagctcgccgccccgccgccgggggcagccgcggcgccgccgttctacatgcagctgccggccgcgacgctgacgctgtgcccgtcctgcgagcgccttggtgggccggccgccgcggccaaggccgagcccgaccggcccaaggccgcggccacccaccacttcttcaaccccttcacgcactccgccgcctgctgatcatcatcgatctgcacgcgcgtgcatgatgaccggtgcgcagcagcagcaggaaacaggctgatacataccataccacaggcacgccatccacctcacgtacgtcacaagtaacataatggttggtcgatacatcctcctcaaagctattttcgtgatccgggggggttaagttagttgttccaatcagctaacccatcaatcgatcgatcaatcataggcttgatagggtagtcaaaatagccgtagcttaattattcctagcgggtactacttgatccaatccatccatgtatatttttgcgcacgcatgctgtgtgtaatccatcctgtccctctcggcctactacttgctcccttttcgacagggcacgtagctagcttcttcttaatttggtttttcttccacagcttgatgtattgataagataagtggtagtattagtatagctgtattgttactgtacatcgatcattagattgagagaggcttccagtcgatctgctatttatacatgtatataccgatgatggtgagcgtcaaaaaaaaaaaaaaaaaaa

SEQ ID NO: 8230 - protein, 272 aa, Panicum virgatum
  misc_feature: Ceres CLONE 1992588
  misc_feature (1)..(55): Pfam Name: Homeobox Pfam Description: Homeobox domain
  misc_feature: The sequence is a functional homolog of  SEQ ID NO 1674 in the  10/374,780 US patent application
  misc_feature: The sequence is a functional homolog of  SEQ ID NO 2326 in the  10/374,780 US patent application
  misc_feature: The sequence is a functional homolog of  SEQ ID NO 252 in the  10/412,699 US patent application
  misc_feature: The sequence is a functional homolog of  SEQ ID NO 542 in the  11/479,226 US patent application
  misc_feature: The sequence is a functional homolog of  SEQ ID NO 546 in the  11/479,226 US patent application
  misc_feature: The sequence is a functional homolog of  SEQ ID NO 8 in the  10/225,068 US patent application
  misc_feature: Useful for making plants with modulated growth and phenotype characteristics
MAQEDVHLDDAGLALGLSLGVASEAARQSTGGNRLSREAAARPPPPSPRALEPSLTLSMPDEATATGSGGAGAHSVSSLSVAGVKRERVEEADGEHASSTAARGGGAGAEDDDDGSTRKKLRLTKEQSALLEDRFKEHSTLNPKQKVALAKQLNLRPRQVEVWFQNRRARTKLKQTEVDCEFLKRCCESLTEENRRLQRELQELRALKLAAPPPGAAAAPPFYMQLPAATLTLCPSCERLGGPAAAAKAEPDRPKAAATHHFFNPFTHSAAC

SEQ ID NO: 8231 - DNA, 1748 bp, Panicum virgatum
  misc_feature: Ceres CLONE 1992603
  misc_feature: Encodes the peptide sequence at SEQ ID NO. 8232
attccggtcgcctctccctttcgcccacacgccgtcgtcacagcctcacactagctagctagctagctttacgcgagagccgcgaggaggaggagcacgcctagcggctaggggtagctagctagctccaccgcggcgagcgaacatgtcggcggcggtgtctcccggcgtggccggcaccgcacggagactgtctccgtctcccaagctggccggcggcgccagggacaaggacaaggacaaggaggagcctccatcgcgcgagggcgccgacaaggccaggaggaggctgctgcttccgtcggccccggccaggggcgccgcggcgtccatgctgctgcgccgtgccagcgccggcgcgcgggggagcagctacgtgcacccgtcgtcgtcgctcagcgtctcgtgcgcgtcggaggcgtccaccgagtccttgtgcagccgcgcgtcgacgggccggatcggccgccgccccgcgggcccgcccgtgggagccccgcggcggagggcgtcgggctcggccgggcctccttctgcgcgcccggcctcgtccaggaaggttgttgccagcgccgtgccaggcggcgcggccactgatgctccggcggtgctgatgctgggctcggtcaccgcgacgtcggcggggccgccgaggtgcccctgggttaccccaaacactgatccctgctacgctgccttccatgaccaagagtggggagtgccagtacatgacgacaagaaactgtttgaaatgcttactctgtccggtgcactggctgagatggcatggcctgcaattctcagcaagagggacaccttcagagaagtgttcatggacttcgaccctgtgttggtggcgaagctgaacgagagaaaattcttggcgccaagcagccctgctagctccctgctgtctgaacacaggctgcgcataatcatcgaaaacgcacgtgagttgctgaaggtcatagaggagtttggatcgttcgacagctactgctggagcttcctgagcaacaagccgatggttggcggatacaggcacacgcgggaggtgccgctgcggacggcgaaggccgacgccatcagccaggacctgatgcgtcgggggttcctcggcgtcggcccgacggtggtctacgccttcatgcaggccgtcggcatggccaacgaccacctcgtcacctgctaccgcttcgaggagtgctgcgacatcaaagacgtagtcgccggctacggtgacagttgcaagccggcagcggtgagcgagcaggaggtgagcatgctctgtgggctggtgcagtgcgtcgccctggagccgtcgagagccgccacggtgatgagcatctcatagcagccagctgaggctagctataccaaccaggtgatcgatgacgcgaagaatgagtagggattaattattattaggcgagttgattccacttaatcgtgctggtgcaatgattgcatgtgtagatattggtcgtgtttgagcgaggtgtacatggttgttgatgtgaggtttgagaaattggggtttgcttgagctgaggatgttgaaaagatgtgtaggtataggacaagaagtttcagacgacgtgttcacatttcacattacaggcatatgttgaactaaaggagtggcgtggtgtggagccggtattgatcttgtaaagttggaaagattgttctctaaccgatatgcaaagcaaaagaaagtcccttgctaaaaaaaaaaaaaaaaaaaa

SEQ ID NO: 8232 - protein, 402 aa, Panicum virgatum
  misc_feature: Ceres CLONE 1992603
  misc_feature (1)..(181): Pfam Name: Adenine_glyco Pfam Description: Methyladenine glycosylase
MSAAVSPGVAGTARRLSPSPKLAGGARDKDKDKEEPPSREGADKARRRLLLPSAPARGAAASMLLRRASAGARGSSYVHPSSSLSVSCASEASTESLCSRASTGRIGRRPAGPPVGAPRRRASGSAGPPSARPASSRKVVASAVPGGAATDAPAVLMLGSVTATSAGPPRCPWVTPNTDPCYAAFHDQEWGVPVHDDKKLFEMLTLSGALAEMAWPAILSKRDTFREVFMDFDPVLVAKLNERKFLAPSSPASSLLSEHRLRIIIENARELLKVIEEFGSFDSYCWSFLSNKPMVGGYRHTREVPLRTAKADAISQDLMRRGFLGVGPTVVYAFMQAVGMANDHLVTCYRFEECCDIKDVVAGYGDSCKPAAVSEQEVSMLCGLVQCVALEPSRAATVMSIS

SEQ ID NO: 8233 - DNA, 1764 bp, Panicum virgatum
  misc_feature: Ceres CLONE 1992656
  misc_feature: Encodes the peptide sequence at SEQ ID NO. 8234
acgctcagcaattgccatcccctacgagcacgccctcgccggagaaacgctgtcccctttcccacgattcacaacttgccatacatcatgccttccaggtcagaggtaacctgctttggtgcgggcccagcacctcttcctactgaggtaattgaggatgctgctcaggctcttgtcaacttccgggacaccggactcggcatcgccgagcattcgcaccggtcggcgatggctacaaatatcatcaacgaagccaaagccgacctggcgtcgtacctcgatatcccagacgattacgaggttctcttcctccatggcggtgggacgggcgaatttgccgctacggcttacaacttggttggcgcttgggttgcgcgcaaacacagcgagcctggtggctcagtaccggagctccaattggccgtgaaggacctcaagttggactacatcgtcactggtagctggtcgcaaaaggcagccgccgaagctgagcggctctttggcgcagagcatgtcaacattgtggccgatagccgcaagacgaatgacggcaagtttggaaaaattccagatgagagtacctggaacctcactcccggtgccgccatggtctattactgcgacaacgagacggttgacggcgtcgagttccccgggttccccaagtcccttgagccggggcctgatggaccaatcgttgtagccgacatgagctccaacattctttccaggacgatcccgatcaagaatttcgcggccatcttctttggcgcccagaaaaacctcggaacgactggtatcaccgtcgtggtcatcaacaagaaattcctaccccccacgacgtctcagccccccccgactctgatgaggcagctgggtctgcctgttccgcctcgcatcttcgagtacgagactattgccaaaaacaacagcctctacaacacactcagcatcttcgacgtgtacatcgccggtcaagttctcaagaggctgctgcgacagagtcccaaagtgcaaggacagcaagctgtagccgagcagaaggcccagctgatctacggcgccctcgaggcgcaccccgatatctatcggatcatccctgacaagtcggcgcggtcacgtatgaatatctgcttcaggatccagggcggagattcggcagagcaagccttcttgagcgaggctgctaccctggggttgacggggctgaaaggccaccgctctatcggcggcattcgcgccagtaattacaactcggttcctgtcgagggtgccgagaagcttgccaaactgattggcaccttcgcggcgaaacaggggactgcctgatgaggggtctggcgcgggacatttgatttcattcacggcgtctttgcagctccattttggaggagtcttgttgcattcacggatggacagacattcattcatcatgcttggcctgtacgcatgcagggagagccacggaatctatccttgatctcttgttgtcttctgaaggcttaggttcttttgtgttcacccgacgaaagggaggggacacaatatcgcgcaaccaaaaggggtgctgctcacccggtcggcggactgaccaccgctccgagggttttgcactgcacaggttgcgcaatggcaattatggtttcaacattcgggttgtcataaaggtggagaggcggcagtgcttcttggacatgagagacgagttgtcgaagtctactttcttgatactagtctatataatcaacgctggccactcttgcc

SEQ ID NO: 8234 - protein, 413 aa, Panicum virgatum
  misc_feature: Ceres CLONE 1992656
  misc_feature (1)..(413): Pfam Name: Aminotran_5 Pfam Description: Aminotransferase class-V
  misc_feature (1)..(413): Pfam Name: Aminotran_5 Pfam Description: Aminotransferase class-V
  misc_feature (1)..(390): Pfam Name: Aminotran_5 Pfam Description: Aminotransferase class-V
  misc_feature (1)..(409): Pfam Name: Aminotran_5 Pfam Description: Aminotransferase class-V
MPSRSEVTCFGAGPAPLPTEVIEDAAQALVNFRDTGLGIAEHSHRSAMATNIINEAKADLASYLDIPDDYEVLFLHGGGTGEFAATAYNLVGAWVARKHSEPGGSVPELQLAVKDLKLDYIVTGSWSQKAAAEAERLFGAEHVNIVADSRKTNDGKFGKIPDESTWNLTPGAAMVYYCDNETVDGVEFPGFPKSLEPGPDGPIVVADMSSNILSRTIPIKNFAAIFFGAQKNLGTTGITVVVINKKFLPPTTSQPPPTLMRQLGLPVPPRIFEYETIAKNNSLYNTLSIFDVYIAGQVLKRLLRQSPKVQGQQAVAEQKAQLIYGALEAHPDIYRIIPDKSARSRMNICFRIQGGDSAEQAFLSEAATLGLTGLKGHRSIGGIRASNYNSVPVEGAEKLAKLIGTFAAKQGTA

SEQ ID NO: 8235 - DNA, 1849 bp, Panicum virgatum
  misc_feature: Ceres CLONE 1992674
  misc_feature: Encodes the peptide sequence at SEQ ID NO. 8236
ccccgtccgtctcgctctcgcgctatcttcttccctcgccagcgcgcgcgcgggcggaggctataaataaacctcgcgggccgcggccacaacccaaatcctcctccacggattgcgcaccaagcctccgaaaatccacaagtgcatactccaagatttttcctcctctctgttcctcggcttcttcaagttctcaggccgcaagatcgcagctttgggtagcttattcctgccagccgcggtcgccggttgctgagtaggggcgcgcgcgttcggtggtcggccccggttgatcggcgcgtggagtcgaccgaagatggtggtggcagcggcggcggagcgggtggtggcggaactccgggaggcgtgcgcggcgccggcggcgcggctggacgaggtggccgcggccatggaggcggagatgcgggccggcctgcgtgaggagggcggcagcaagatcaagatgatcatctcctacgtcgacaacctccccaccgggaatgaggaggggctcttctacgccctggatctcgggggaaccaacttccgcgtcctgcgcgtgcagctcgcgggcagagagaagcgcgtcgccaagcgcgagtccaaggaggtctccatccctccccacctcatgtcaggcaacgcctcggagctgttcggcttcattgcctctgcgctggccagctccgtcgcggacgaagggcgcagtaatctgtttgaggacaagcagagggagctggggttcaccttctcgttccctgtcagacagacatcgatcgcgtccggcacgctcatcaagtggaccaaggcgttctcgatcgatgacgctgtgggcgaggatgttgtcgctgaactgcagacggccatggagaagcaaggcgtcgacatgcatgtggctgcattgatcaacgatactgtggggacactggctgccggtagatacaatgatgaggatgtcgtcatcggtgtcatattaggtactggctcgaatgccgcgtatgttgaagaggcaagtgccataccgaagtttgagggcgagctgcctaaatcaggaaacatggtgatcaatacggaatggggtaacttctcctcatcctgcctcccaatcacagaatatgatcaggcattagatgaggagagcttaaacccaggagagcagatcttcgagaagttgatttcaggaatgtaccttggcgagatcgtcaggagggtgcttcttaaaatcgcctcacagtctacactcttcggcaaagtcaaccaaactaagctcaaaacccgattcattctgaggactcctgatatctccgcaatgcaccacgatgacacgcctgatctgagaatcgtggcagacaaactggcagaaaacctcaagatcaaggacacatccttggagacaaggaagatggttgcggagatctgcgacatcgtcaccaccaggtctgcacggctggccgcggcagggatcgtcggcatcctcaggaagatcgggagggccgtccccggcgatgagcggcggtctgtcgtcgccatcgacggcggcctgtttgagcactacgccgagttcaggcagtgcctggagcgcacgctggtggagctgctgggggaggaggcgtccaggtcggtggccgtgaagctcaccaaggacgggtccggcctcggcgccgccctgatcgcggctgctcactcccagcactgaacggccgcgccactgtgcaagtcccaggctcctcctctggcactctcgatgtatttgtagcgaattcgtatgttttcgagcaaagtttgttgggattctgccaaacgaatgttcaaaacggaatgcagaagtgtcttcccgtgcttgttgttc

SEQ ID NO: 8236 - protein, 459 aa, Panicum virgatum
  misc_feature: Ceres CLONE 1992674
  misc_feature (1)..(246): Pfam Name: Hexokinase_2 Pfam Description: Hexokinase
  misc_feature (1)..(459): SWISSPROT Homolog: EC 2.7.1.1 Hexokinase-7
  misc_feature (2)..(458): SWISSPROT Homolog: EC 2.7.1.1 Hexokinase-8
MVVAAAAERVVAELREACAAPAARLDEVAAAMEAEMRAGLREEGGSKIKMIISYVDNLPTGNEEGLFYALDLGGTNFRVLRVQLAGREKRVAKRESKEVSIPPHLMSGNASELFGFIASALASSVADEGRSNLFEDKQRELGFTFSFPVRQTSIASGTLIKWTKAFSIDDAVGEDVVAELQTAMEKQGVDMHVAALINDTVGTLAAGRYNDEDVVIGVILGTGSNAAYVEEASAIPKFEGELPKSGNMVINTEWGNFSSSCLPITEYDQALDEESLNPGEQIFEKLISGMYLGEIVRRVLLKIASQSTLFGKVNQTKLKTRFILRTPDISAMHHDDTPDLRIVADKLAENLKIKDTSLETRKMVAEICDIVTTRSARLAAAGIVGILRKIGRAVPGDERRSVVAIDGGLFEHYAEFRQCLERTLVELLGEEASRSVAVKLTKDGSGLGAALIAAAHSQH

SEQ ID NO: 8237 - DNA, 1226 bp, Panicum virgatum
  misc_feature: Ceres CLONE 1992690
  misc_feature: Encodes the peptide sequence at SEQ ID NO. 8238
actcgcttttctcaaaacgcgacgctttcccttgtagcccctcggtcctctcctccccacccgacccagatctggatcgggcctccttgccgccggtcgcctcctgtctgctggcgtccggccttgtctgctgcggcgtccggccggctgccgcccgcctctctccctgctgcgcacgccgcccagctgcgccggcccacctcctgctgtgcccgcctgcttgcagcacgagcagcagagccccgccgggactgcagcagggcgccagcagaaaagccccgccgggagcgcagcagagctccgcctccctgctgtgcagccttctgctccctgctgtggcagcctggagcgaggaccccaagaagccccggcacgtccctcaagctagcaggcagcaacgccctgtccttcctcaagctagcaggcagcagcgccctgtccttcctccctgcttccaaggtgagcacaagaggctttggaaaaattagaaattggtgaaaattagtgatgtagaaattttattactactttgtgcagtagaaattatggctatatatatatattcatgctggtagaaattcctaccaatcttgcagtagaaatctagcctacatgtattcatggtactagaaattccaccaattttgcaatttatagatggaaaaaacaacaaaggttccagctacaaagaaagctttccacatccacctcaaggcaagtattatcttgttgattctgggtatcctaacagaaagggatatctagcaccatacaaaggtcaaaggtatcatgtgcctgaatggcagcatggccgccacccagtgggattgaaggaggtgttcaactatcatcatgcatcccttagaaatgtgattgagcgctcatttggagttctcaagatgaagtggcgcattctcttgaaagtacctagctttccagttaataagcagtctcagattatagttgcttgtatggctcttcataactttattagagaagctgacataaatgatgaacatttcataacctatgtggatgacattcctgacgaagacccttcagaagatgatagcctaatgggggatgatatagatatgtgtgccttccgtgatgtacttgcttcggctttggttggttgatttattattgtaatttttagtattttgtagcattttcaatggatcaaatgagagttaatttgacttcaaaaaaaaaaaaaaaaaaaa

SEQ ID NO: 8238 - protein, 172 aa, Panicum virgatum
  misc_feature: Ceres CLONE 1992690
  misc_feature (70)..(167): Pfam Name: Transposase_11 Pfam Description: Transposase DDE domain
MVLEIPPILQFIDGKNNKGSSYKESFPHPPQGKYYLVDSGYPNRKGYLAPYKGQRYHVPEWQHGRHPVGLKEVFNYHHASLRNVIERSFGVLKMKWRILLKVPSFPVNKQSQIIVACMALHNFIREADINDEHFITYVDDIPDEDPSEDDSLMGDDIDMCAFRDVLASALVG

SEQ ID NO: 8239 - DNA, 1205 bp, Panicum virgatum
  misc_feature: Ceres CLONE 1992691
  misc_feature: Encodes the peptide sequence at SEQ ID NO. 8240
acgccatccacctctgaaccggcaaccgaaaatcccctcttcccctccgtcgctccagcggccatgctcggtcttcgagcccgcgcagcggcgcagctcccgtgcccttcctcgtccccctcctccgctcccgcgaggttcgcgcgcctctccccgctcgccgccctcgcgcctctggcgtctgcaccgccgccgccgagggcgagggcctccctctccgccaggtggaagtggaacgcgccctcgcgtctcgggggaaccggcaccagctccaggcctaccacgcgggttttctgcaccgctgccagtagccctcagagagaggggaaagagttgctagtccagcatttgcttgttggtgccaaggatgtcaggcttctggtagatcttgaaaagagcatcattgctggaggggcagacttgagtgatttagctgtcgagcactccttatgcccatcaaaagaaaatggtggaatgcttgggtgggttcgaaagggacagatggttccagaattcgaggaggcagcatttagtgctcctttgaataaagttgtacggtgtaagacaaaatttggatggcatttattgcaagttcttgctgagagggatcaatgcattctgcaagacattgacccggaagagcttcacacgaaaatgcaagatcctagttttctcgaagaagctcaattgattgatgttcgggagcctgatgaagtggccaaagcttcacttccaggcttcaaagttctaccgctccgccaatttgggacctggggaccagttatgaccgatgagtttaatcctcagaaggacacttatgttctgtgccaccatggcatgcgctccatgcaggtggctaaatggctgcagtcgcagggtttcaaaaaagtttacaacgttgctggtgggatccatgcctatgcggttaaagccgactcctctgtcccaacttactagaggatcctgatcgaaatcgtgaacatgtcccaggagatttttcatatcaaagcaaagaaaaaaaacaaggcatcattctaggattttggcaatagttttgacttgtgaccaatgccagaatccagagctcaattttttttcctggcactgtgtcttagaagtttagaggccctatggacgaaatgtatacggaaattcttttgtttcaataaaaaaagagatacatagaaaaaaaaaaaaaaaaaaaa

SEQ ID NO: 8240 - protein, 297 aa, Panicum virgatum
  misc_feature: Ceres CLONE 1992691
  misc_feature (1)..(85): Pfam Name: Rotamase Pfam Description: PPIC-type PPIASE domain
MLGLRARAAAQLPCPSSSPSSAPARFARLSPLAALAPLASAPPPPRARASLSARWKWNAPSRLGGTGTSSRPTTRVFCTAASSPQREGKELLVQHLLVGAKDVRLLVDLEKSIIAGGADLSDLAVEHSLCPSKENGGMLGWVRKGQMVPEFEEAAFSAPLNKVVRCKTKFGWHLLQVLAERDQCILQDIDPEELHTKMQDPSFLEEAQLIDVREPDEVAKASLPGFKVLPLRQFGTWGPVMTDEFNPQKDTYVLCHHGMRSMQVAKWLQSQGFKKVYNVAGGIHAYAVKADSSVPTY

SEQ ID NO: 8241 - DNA, 1905 bp, Panicum virgatum
  misc_feature: Ceres CLONE 1992776
  misc_feature: Encodes the peptide sequence at SEQ ID NO. 8242
acgacttcctccattcccgccctccccgccgccaccgccgccgccaaaaccctaaaccccacacccaccgatggcggcgagccgcgcggacctcgccgacgacggcttcgcggcgccgcgcctcttctcccagggcgtctcctacacctacgacgacgtcatcttcctcccgggctacatcagcttccccgccgacgccgtcgacctctccacccgcctctcccgtcgcctgcctctctccatcccctgcgtcgcgtcccccatggacaccgtatccgaggcagccatggccgcggccatggcctcgctcggcgccgcagccgtcgtgcactgcaacaccgagaccgacgcccaggccgccatcatccgcgccgccaagtcccgccgcctccctttcgtgtcatccgtgcccttcttcgccccgtcctccgctccgacgctcaacgatttcgctggcaatgaatacgccattgtcaccgagcgcggggattcgctctccaggctcgtcggcgtcgctgttgcagccgatgcggcctctcgtgaggttcctgcccctgtctcggaatacatgcggcccgctccccgctcagcatccgcctcctttgacttcgagcaagcagccaccttccttgccgacgagggtttggattacgcccctctcgtttctgacgacggcgaggttattgacctgatcaccgccaaggatgtcgagcgcatccggagctatcccaagctaggcaagccatcgcttggatcggacgggaagttcgtagttgcggcctccattgggacccgtgaggatgacaagcgaaggctggagcagctagttaaggcgggggcaaatgctatcgtgattgatagttcgcaggggaactccatttatcagcttgacatgatcaagtatgcaaagaagatgtatccagaggtggatttgatcggaggcaatgtggtgacaattgcacaggcgcagaatttgattcaagccggtgtggatggattgcgtgttggaatgggttctggctcaatttgcactacccaggaagtttgtgctgttggaaggggacaggctacagcggtatataaggtttcatcctatgccaaggatcacaatgtaccagttattgctgatgggggaatttcaaactctggacatattgtgaaggctctgtcacttggggcatccactgttatgatgggaagctttttagccggcagtcatgaagcacctggcacttatgaatacaaggacggccgtcgagtaaaaaagtacagaggcatgggatctcttgaagcgatgacaaaggggagtgatgcaaggtaccttggtgataaactgaagctcaaagttgcgcagggagttgttggagcagtagctgacaaaggttccgttctgaggttcattccttacacaatgcaagcagttaagcaaggattccaagatcttggcgcatcctcattgcagtcagctcatgatcttttgcggtcggagactcttagattagaggtgaggaccggtgcagcccaggttgaaggaggaatccatgggctggtctcatatgagaagaaggtattctagttccataaccaaacatggaagagttggaacaagagtggttagctgcgggatatggaagctgacaatgctgttgatgatcctacctgccaatctttaagctcagcagcttcccagcaaatcctgtcgagttgggcagcaagtgtagcatctatgtagcgtgataataatccttgatcataaaaatggtcatacgaacttttaactgagccccagattttgctaagactggtatttcatgattggatctggtgatcgccgaactttttcctgccgttttgaatttatcaccatgttgcagccctctgtttgaaaaaaaaaaaaaaaaaaaa

SEQ ID NO: 8242 - protein, 501 aa, Panicum virgatum
  misc_feature: Ceres CLONE 1992776
  misc_feature (2)..(476): Pfam Name: IMPDH Pfam Description: IMP dehydrogenase / GMP reductase domain
  misc_feature (2)..(475): Pfam Name: IMPDH Pfam Description: IMP dehydrogenase / GMP reductase domain
  misc_feature (1)..(469): Pfam Name: IMPDH Pfam Description: IMP dehydrogenase / GMP reductase domain
  misc_feature (1)..(464): Pfam Name: IMPDH Pfam Description: IMP dehydrogenase / GMP reductase domain
  misc_feature (10)..(501): SWISSPROT Homolog: EC 1.1.1.205 Inosine-5'-monophosphate dehydrogenase
MAASRADLADDGFAAPRLFSQGVSYTYDDVIFLPGYISFPADAVDLSTRLSRRLPLSIPCVASPMDTVSEAAMAAAMASLGAAAVVHCNTETDAQAAIIRAAKSRRLPFVSSVPFFAPSSAPTLNDFAGNEYAIVTERGDSLSRLVGVAVAADAASREVPAPVSEYMRPAPRSASASFDFEQAATFLADEGLDYAPLVSDDGEVIDLITAKDVERIRSYPKLGKPSLGSDGKFVVAASIGTREDDKRRLEQLVKAGANAIVIDSSQGNSIYQLDMIKYAKKMYPEVDLIGGNVVTIAQAQNLIQAGVDGLRVGMGSGSICTTQEVCAVGRGQATAVYKVSSYAKDHNVPVIADGGISNSGHIVKALSLGASTVMMGSFLAGSHEAPGTYEYKDGRRVKKYRGMGSLEAMTKGSDARYLGDKLKLKVAQGVVGAVADKGSVLRFIPYTMQAVKQGFQDLGASSLQSAHDLLRSETLRLEVRTGAAQVEGGIHGLVSYEKKVF

SEQ ID NO: 8243 - DNA, 1325 bp, Panicum virgatum
  misc_feature: Ceres CLONE 1992913
  misc_feature: Encodes the peptide sequence at SEQ ID NO. 8244
acacaaacaatcgagagcaagcgcctcgccatcccgtgagctccttctcttaatttttcttcttcttcttcctcgagcagtcgccggaggtgctcagtgctctgcaatggctcgagtagttgggatcctgctcgccgttgttgcggctgcggcggcgtcgctgcttgcgccggtggcggccgaactgacgcgggtggagcacccgcctaagaccgaggggtcgctcaacatccttgccgtcggcgactgggggcggcgcgggcagtacaaccagaccctggttgccgagcagatgggagtggtgggggagaaactggacatcgacttcgtcatctccaccggcgacaacatctacgacgacggcatcgccaacaccagcgacccgctcttcaaggagtgcttcaccaacatctacaccgcccagagcctccagaagccttggtacattgtccttggcaatcatgactacaccggcaacgcgctggcgcagcaggaccctgccatccgcgaagtggacagccggtacctcgccattgccaagtccttcatcgtcaactcagaaattgcggacttcttcctcgtcgacacgtcgccgttctacctcaagtactggaacagcagcaagtacgattggagaaacgtagctcctcgcgacacctacatcgaaaccctcctcaaggatctggacgacgcgctgacgcaatccgaggcgccctggaaggtcgtcgtcggccaccaccccatcagcagcggctgcgagcatgggaacaccaccgagctccagcagctgctccggcccatcctcgaggcgcgtggtgctgacatgtacgtgaacggccatgaccactgcctgcagcacatcagcagcaggaacagtcctgtgcaatttatgacgagcggcggtgggtccaaggcatgggcaggcaagttcaagaccacctcggacaagatcgagttcatctacgacgggcaggggttcatgtcgatgcagctgagcaagacggaggcgcacctcgtcttctacgacgtcgccggcaacgtcctgcacacccatgacagcagcaagactgaagatgatgaacactagctggctagatcgcctacaagctaggccgcagacagcactgtgattggtaaatcagatcaggctattgtttattaactatttgtctggaaaaagttggtgtgtgtgcgtgtgtgtgtgttgtgtgtcgtctgtgacaatgtgaagatcgatgtgcgtggtgtggagaagagagaatggtatcttctgtggaattaataacactacttgaaattaggcttaaaaaaaaaaaaaaaaaaaa

SEQ ID NO: 8244 - protein, 326 aa, Panicum virgatum
  misc_feature: Ceres CLONE 1992913
  misc_feature (1)..(212): Pfam Name: Metallophos Pfam Description: Calcineurin-like phosphoesterase
MARVVGILLAVVAAAAASLLAPVAAELTRVEHPPKTEGSLNILAVGDWGRRGQYNQTLVAEQMGVVGEKLDIDFVISTGDNIYDDGIANTSDPLFKECFTNIYTAQSLQKPWYIVLGNHDYTGNALAQQDPAIREVDSRYLAIAKSFIVNSEIADFFLVDTSPFYLKYWNSSKYDWRNVAPRDTYIETLLKDLDDALTQSEAPWKVVVGHHPISSGCEHGNTTELQQLLRPILEARGADMYVNGHDHCLQHISSRNSPVQFMTSGGGSKAWAGKFKTTSDKIEFIYDGQGFMSMQLSKTEAHLVFYDVAGNVLHTHDSSKTEDDEH

SEQ ID NO: 8245 - DNA, 1196 bp, Panicum virgatum
  misc_feature: Ceres CLONE 1993000
  misc_feature: Encodes the peptide sequence at SEQ ID NO. 8246
atgccccatagtaccccatcttccagcagtccggagggccatagatcccacaccaccacttaacctcaaagcatcatcgtcatcgtcaaccttatctccgtcgacaccaaaaggagatctttatcctgtgatttttctgcccccaagaaaccactttgatccatcgatcgatcactagcacatacatatgcaggcatatatggagggaggccacttgggtgcttgccttcctagcttcctcgtgccggatcactacgccttccctcttcctcttccacttccactaccgagccaaccaaataagcttctccagatgccgtttgaccaggaagaggccgagaactatggcgtgatgctctcctccgaccattgtgggctataccagctgccggcactgccgttgggctgctctggcaccgcctcagccgcctgcggtgggaagcctatggctggtttcatccctagtactgatgaggtctgcacctcggtgacgaaaggttgcaacgagatcagtacaagcacatggtggaagggctcggctaccatggcggagagagggaagatgaaggtgaggaggaagatgagggagccgaggttctgtttccagactagaagcgacgtggatgtgctggatgatggctacaagtggaggaagtacgggcagaaggttgtcaagaacagcctccatccgaggagctacttccggtgcacgcacagcaactgccgcgtgaagaagcgggtggaaaggctgtcgacggactgtcgcatggtgatgaccacgtacgagggccgccacacgcactccccctgcagcgacgacgcctcctccggcgaccacaccgactgcttcagctccttctgaaccttgctatacgccgccatccgccggcagtcaagtcgatcagaggcagcagcgagatcgagcgcatcgcatacaggagcagcaaaacagtgcagcccagttgatccgcggcttcttgtagatctcgtcagttttgccggatggacacagagaactttgcagctgtgcactgtcatatgtgtgtactcatgtgtaatacgatgcgatcgctcgtcggcgaccttgcaaattaaatatgatccatgcatccattgaatgtacgcgctcatgtagacccatcaaataaattaaattaaagctgcacgttttctcccaaaaaaaaaaaaaaaaaaaa

SEQ ID NO: 8246 - protein, 224 aa, Panicum virgatum
  misc_feature: Ceres CLONE 1993000
  misc_feature: The sequence is a functional homolog of  SEQ ID NO 1017 in the  10/412,699 US patent application
  misc_feature: The sequence is a functional homolog of  SEQ ID NO 22 in the  10/374,780 US patent application
  misc_feature: The sequence is a functional homolog of  SEQ ID NO 231 in the  11/479,226 US patent application
  misc_feature: The sequence is a functional homolog of  SEQ ID NO 521 in the  10/374,780 US patent application
  misc_feature: The sequence is a functional homolog of  SEQ ID NO 858 in the  10/225,066 US patent application
  misc_feature: The sequence is a functional homolog of  SEQ ID NO 88 in the  10/412,699 US patent application
  misc_feature: Useful for making plants with modulated growth and phenotype characteristics
MQAYMEGGHLGACLPSFLVPDHYAFPLPLPLPLPSQPNKLLQMPFDQEEAENYGVMLSSDHCGLYQLPALPLGCSGTASAACGGKPMAGFIPSTDEVCTSVTKGCNEISTSTWWKGSATMAERGKMKVRRKMREPRFCFQTRSDVDVLDDGYKWRKYGQKVVKNSLHPRSYFRCTHSNCRVKKRVERLSTDCRMVMTTYEGRHTHSPCSDDASSGDHTDCFSSF

SEQ ID NO: 8247 - DNA, 1760 bp, Panicum virgatum
  misc_feature: Ceres CLONE 1993097
  misc_feature: Encodes the peptide sequence at SEQ ID NO. 8248
agtctgcccgtagcgaaaaatgtcgacggcggccgcgtcttgctctcggcatgtggtggcggtgccgtacccgggccgcggccacatcaaccccatgctcgtcgtgtgccgccagatcgccgccgccgacgccgacctcgccgtgaccgtcgtcgtcacggaggagtggcacgcgctgctggccgccgcgggggtgcccgccacgctccccgggcgcgtccgcctcgccaccatccccaacgtcatcccctccgagcgcggccgcggcgctgactccgtcggcttcatcgaggccgttaccaccaagatgggggagcccgtggagcggctgctggaccggctggcgctggagcggaggccggacgccgtcgtggtcgacacctacctgacgtggggcgtggccgccggcgcggcgcgcgggataccggtgtgctcgctgtggaccatgccggccacgttcttcctagcgctctaccacatggaccagtggccgcctgtggatggccctgaaggggaagaaggacaaagctgcaagtccttggatcaatatttgtcattcccaaccctgtcgtcagtaaaatgttctgatatcaaggtatttcgctcctgggagctgccgatgaaacgagctgcgcaagtgttctccaatgtgcgcaaagcacagtgtgtcctcttcacctccttctatgagcttgaagctggttcaatcgatggaatatcacaagtgcttccatgccccatatatacacttggtccttcaattccacatatgccacctgaaggcgagtcagacaagattctgcgtgagaaatactctgactggctggatgcccaaccgaaaaattcagtgttatacatctctttcggcagccatgtttcaatgccatcctcacagttggaagaggctgccatggggcttcaagacagcgcagtcaggttcttctgggtggcccgggacaaggccaccaccaccactctacagcagatcgccggtgacaagggcttggtggtgccatggtgtgaccaactgaaggtcctgtcccacccctcagttggcggcttcctgagccattgtgggtggaactcgacactggaggccctgttcgccggagtgcctgtgctcgcgttcccggttgcttgggatcaattggtgaatgcccggcttcttgctgatgaatggaaggtcgggatcaacttgagggaacagagaagggaggatggcattgtcagcagggccacaatctcttctgccgtgacaaagctcatggattttggcgatgatagtaggcaagaaatgagaagaagagccgcagaattgcgtgacgcttcacacagagccattcaggaaggtggatcatcaagccgttcttccaacagtctcgtgagagatctcatcgaaggaagactgaacgttgcagaaatttcacagtagttgctcacaggcagaatcgttgcagttctgcacgagtagtacgaagtagccaatgaagttgtcagttatgaggctcctctcatattggatccaggtatatttggattgagacgccacgcttgggcgcttggcactccacctagtacatctgtttgcatacgtgttgaatgctagattgaattcgaccgtgaggagctgtcattcagatgcatgtaaaataaatctcgttcttctacctgctggtataagacaatcgcttgaaaaatcgctgtagtttccccccatttctgaaggaaatatgctctttcaaaaaaaaaaaaaaaaaaaa

SEQ ID NO: 8248 - protein, 470 aa, Panicum virgatum
  misc_feature: Ceres CLONE 1993097
  misc_feature (2)..(121): Pfam Name: UDPGT Pfam Description: UDP-glucoronosyl and UDP-glucosyl transferase
MSTAAASCSRHVVAVPYPGRGHINPMLVVCRQIAAADADLAVTVVVTEEWHALLAAAGVPATLPGRVRLATIPNVIPSERGRGADSVGFIEAVTTKMGEPVERLLDRLALERRPDAVVVDTYLTWGVAAGAARGIPVCSLWTMPATFFLALYHMDQWPPVDGPEGEEGQSCKSLDQYLSFPTLSSVKCSDIKVFRSWELPMKRAAQVFSNVRKAQCVLFTSFYELEAGSIDGISQVLPCPIYTLGPSIPHMPPEGESDKILREKYSDWLDAQPKNSVLYISFGSHVSMPSSQLEEAAMGLQDSAVRFFWVARDKATTTTLQQIAGDKGLVVPWCDQLKVLSHPSVGGFLSHCGWNSTLEALFAGVPVLAFPVAWDQLVNARLLADEWKVGINLREQRREDGIVSRATISSAVTKLMDFGDDSRQEMRRRAAELRDASHRAIQEGGSSSRSSNSLVRDLIEGRLNVAEISQ

SEQ ID NO: 8249 - DNA, 1713 bp, Panicum virgatum
  misc_feature: Ceres CLONE 1993123
  misc_feature: Encodes the peptide sequence at SEQ ID NO. 8250
aaggaatcaatatccctttttctcacacaattccaaccatcatggccactcgaccccagaatattggcattaaagccattgaaatctacttcccaagtcagtgcgttgaccaggccgagctcgagaaattcgatggcgtcgcacaaggcaaatacacaattggtctgggacagacacgaatgtccttctgcgacgatcgagaggacatctattcaatcgctctcacaacccttaccagcctgatctccaaatactcgattgacctgaagaatattgggagactggaggttggcactgaaaccatgttggacaaaagcaaaagtgtgaaatcagttttgatgcaactctttgagaaatccggcaacttcaatgttgagggagtcgatgcttataatgcctgctatggtggtaccaacgcggtattcaattcagtcaactgggtcgaatcctctgcgtgggacggacgggacgccattgttgtggcaggtgacattgccctttacaagaaaggcaacgctcgcccaactggcggtgccggctgtgtcgcaatggtgatcggtcccgatgctccaattgttttcgatgcaggcctccgagggtcttacatcacccacgcctacgacttctacaagccagatcttactagcgaatacccttatgttgacggccagttctctctgagatgttacacagaggccgtcgatgcgtgctacaaagcatataactcccgcgaacaagccctcaaatcacgagcgaatggttcggtggctaatggccacgccaatggaaacggtgtgcatgaggagacggaaaaggcacccctggacagatttgactacatggcattccacgctcccacctgcaaacttgtgtccaagtcatacgctcgattgctgtacaacgacttcttggaggatccaacccatcctcaattcaaagaagtggcccccgaactacgcgatctggattatcagacctcgctaacagacaagactgtggaaaagacattcatggccttgacgaagaagcgctttgccgagcgagtgcagcctgcgatacaggtcgcgaccatgtgtggaaacatgtattgcggcagcgtttacggcggccttgttggtttgatcagcaacgttgccccgaaacaactttatggcaagcgattgggtatcttcagctacggaagtggcctggccagctcaatgttcagtctgaaggtggttggcgacaccactgaattcgtggagaagctcaacctgcaagaaagactggatgctcgcagagtcgttgcacccgaggtctacgacgagatgtgcttgcttcgagagaaggcacatctcaagaaagacttccagccagcgggcaatgttgagactctggtgagcggtacttactatttgactaacgtcgatgacatgtaccgaaggaagtatgaggtgaaagcataatgcacatgaggggttgtatcgttcctgtaccagacgctacgtttcacattccaggcgttactaatggttggtcgcaatgctagagagctcttgatagaaggacagttgcatttgcagatggtattcatgggattgccgagcatgggtgggtcactacgccaccacaacagcttgtacatagttatagagaggagatacttggtagcgtattaatcaatctgcagaagtgagcagtctgcacaaatcggaaaaaaaaaaaaaaaaaaaa

SEQ ID NO: 8250 - protein, 467 aa, Panicum virgatum
  misc_feature: Ceres CLONE 1993123
  misc_feature (1)..(282): Pfam Name: HMG_CoA_synt_C Pfam Description: Hydroxymethylglutaryl- coenzyme A synthase C terminal
  misc_feature (5)..(463): SWISSPROT Homolog: EC 2.3.3.10 Hydroxymethylglutaryl-CoA synthase, cytoplasmic
  misc_feature (6)..(240): SWISSPROT Homolog: EC 2.3.3.10 Hydroxymethylglutaryl-CoA synthase
MATRPQNIGIKAIEIYFPSQCVDQAELEKFDGVAQGKYTIGLGQTRMSFCDDREDIYSIALTTLTSLISKYSIDLKNIGRLEVGTETMLDKSKSVKSVLMQLFEKSGNFNVEGVDAYNACYGGTNAVFNSVNWVESSAWDGRDAIVVAGDIALYKKGNARPTGGAGCVAMVIGPDAPIVFDAGLRGSYITHAYDFYKPDLTSEYPYVDGQFSLRCYTEAVDACYKAYNSREQALKSRANGSVANGHANGNGVHEETEKAPLDRFDYMAFHAPTCKLVSKSYARLLYNDFLEDPTHPQFKEVAPELRDLDYQTSLTDKTVEKTFMALTKKRFAERVQPAIQVATMCGNMYCGSVYGGLVGLISNVAPKQLYGKRLGIFSYGSGLASSMFSLKVVGDTTEFVEKLNLQERLDARRVVAPEVYDEMCLLREKAHLKKDFQPAGNVETLVSGTYYLTNVDDMYRRKYEVKA

SEQ ID NO: 8251 - DNA, 1721 bp, Panicum virgatum
  misc_feature: Ceres CLONE 1993177
  misc_feature: Encodes the peptide sequence at SEQ ID NO. 8252
acccattccaccgtacccccatccgctgatccccgcagccgaaagaccctaccgcccgtattccccaaaatgccactcgcgcaatcaacccccgcgctgctgcccaacccggccctcccctcgccggggcggccgcgctcccacagggcgctcctgcgcgcccgcgccgtgcgcgcggcgccgcggccgccgagccggtggtcggtggggagctggcgggaccgcccggcgctgcagcagccggagtacccggacaaggcggagctcgatgaggtgctgcggacggtggaggcgttcccgcccatcgtcttcgccggggaggcgcgcaccctcgaggagcgactcgcggaggcggccgtgggccgggcgttcctcctccagggcggcgactgcgccgagagcttcaaggagttcaacgccaacaacatcagggataccttccgcgtccttttgcaaatgtccgtcgtgctcatgttcggaggccagatgcctatcgtcaaggtgggaagaatggcaggccagttcgcaaagccaagatcagatggttttgaggagcgggatggagtgaagttgccaagctacagaggggacaatattaatggtgatacattcgatgagaagtcaagattgccagacccacaccgcctgatacgggcgtactcacagtctgcagcgacactgaatttgctgcgggcatttgctaccggaggttatgctgcaatgcagagggtaacacagtggaaccttgacttcacacaacattgtgaacagggcgataggtacatggagttggctcaccgcgttgacgaggctttgggattcatggcagctgctggactcactttagatcaccctataatgacaacaacagaattctggacatcacatgagtgccttcttcttccctatgagcaggcgcttactcgtgaagactccaccactggcctttactatgactgctctgcccacttcctatgggttggagagcgtactcgccaacttgatggtgcccatgtggagttccttaggggtattgccaatcctcttggtatcaaggtcagtgacaagatggacccagcagaacttgtgcggttgatcgatatcttgaatcctgaaaacagggcagggagaataaccatcatcacaagaatgggatctgaaaacatgagggtgaaacttcctcacctgatacgtgctgtccgtggggctggccagatagtaacatgggtcactgacccaatgcatggtaacaccatgaaggccccttgtggactcaaaactcgctccttcgacagaattttggctgaggtgcgttccttctttgatgttcaccaacaagaagggagccacccaggaggcgtgcatctggaaatgaccggacagaatgtgacagagtgcattggtgggtcacgcactgtgacatttgatgatctgagctcacgataccacacccactgtgacccaaggctcaacgcctcacagtcgctggagatggcgttcatcatcgccgagcgccttaggaaaaggaggatcgcctcatggcctttgaacgggaaccagatgggttccattccatcaatgggtctgtaactgtgataacttcactgtcagggaccagtccagttttcttgtagttgctgtgtcaaattttgtgcatgtcctggtaaacaagacaaccttttgatttccattgtgatataaataaaatgcaagttaccttc

SEQ ID NO: 8252 - protein, 506 aa, Panicum virgatum
  misc_feature: Ceres CLONE 1993177
  misc_feature (1)..(438): Pfam Name: DAHP_synth_2 Pfam Description: Class-II DAHP synthetase family
  misc_feature (2)..(438): Pfam Name: DAHP_synth_2 Pfam Description: Class-II DAHP synthetase family
  misc_feature (2)..(437): Pfam Name: DAHP_synth_2 Pfam Description: Class-II DAHP synthetase family
  misc_feature (2)..(439): Pfam Name: DAHP_synth_2 Pfam Description: Class-II DAHP synthetase family
  misc_feature (1)..(439): Pfam Name: DAHP_synth_2 Pfam Description: Class-II DAHP synthetase family
  misc_feature (31)..(490): SWISSPROT Homolog: EC 2.5.1.54 Phospho-2-dehydro-3-deoxyheptonate aldolase 1, chloroplast precursor
  misc_feature (4)..(506): SWISSPROT Homolog: EC 2.5.1.54 Phospho-2-dehydro-3-deoxyheptonate aldolase 1, chloroplast precursor
MPLAQSTPALLPNPALPSPGRPRSHRALLRARAVRAAPRPPSRWSVGSWRDRPALQQPEYPDKAELDEVLRTVEAFPPIVFAGEARTLEERLAEAAVGRAFLLQGGDCAESFKEFNANNIRDTFRVLLQMSVVLMFGGQMPIVKVGRMAGQFAKPRSDGFEERDGVKLPSYRGDNINGDTFDEKSRLPDPHRLIRAYSQSAATLNLLRAFATGGYAAMQRVTQWNLDFTQHCEQGDRYMELAHRVDEALGFMAAAGLTLDHPIMTTTEFWTSHECLLLPYEQALTREDSTTGLYYDCSAHFLWVGERTRQLDGAHVEFLRGIANPLGIKVSDKMDPAELVRLIDILNPENRAGRITIITRMGSENMRVKLPHLIRAVRGAGQIVTWVTDPMHGNTMKAPCGLKTRSFDRILAEVRSFFDVHQQEGSHPGGVHLEMTGQNVTECIGGSRTVTFDDLSSRYHTHCDPRLNASQSLEMAFIIAERLRKRRIASWPLNGNQMGSIPSMGL

SEQ ID NO: 8253 - DNA, 1766 bp, Panicum virgatum
  misc_feature: Ceres CLONE 1993439
  misc_feature: Encodes the peptide sequence at SEQ ID NO. 8254
gcacaacccaaccggactctctcataatcataggtagagagagaagagtagagatccccagatcatcggagagaggggaggggagtgggggagcaagaattaatcattctagtctgcatcaccgaggaagcagatagagaaagagaaagatggagcaggtggccatggcggtgaaggtgttgctgagcctgtgctgcgtgggggcgtgcggcctcgccatgtacctctaccacaccctctggctcgtgccacagagggtcctcgccgagttcaggatgcagggcatcggcgggcccccgccgtcgttcccttacggcaacatcgccgacatgcgggaggccgtcgccgccgcgaaggccgcgcgcgcatcggcacgccgcgccgccgcaggcgcctgcggcggcatcaggcacgactaccggcctgcggtgctgccctactacgagaaatggaggaaagagcacggtcccatcttcacttactccatggggaacgtcgtattccttcacgtgagccggccggacgtggtccgggacatcaacctctgcgtgtcgctggacctcggcaagagctcctacctcaaggccacgcacgagccgctcttcggcgggggcatcctcaagtccaacggcgaggcctggctgcaccagaggaagatcatcgcccccgagttcttcctggacaaggtcaagggcatggtggatctcatggtcgattctgcgcaaccactgctgaagtcatgggaggagagagttgacagaaatggtgggatcacagacattaagattgatgatgacattagggcctactctgcagatgtgatctcaagaacgtgcttcggtagcagctacatcaaaggaaaagaaatctttatgaagatcagagaactccagcaggctgtgtccaagccaaatgtgctagctgaaatgactggtctaaggttctttccttcaatgaggaacaagcaggcgtgggagcttcataaagaaatccacaaacttattctagacatcgtaaaggaaagtggagaagacaggaacttactaagtgcaattcttcacagcgcaagctgcagcagggtgggcatcgccgaggcagagaactttatagtggataactgcaagagcatatattttgcaggatatgagagcacggctgtcacagctgcctggtgtctaatgctccttggactgcacccagaatggcaggaccgggtacgtgcagaagtgcatgaagtctgcagaggccggccaatagactcccaatcacttcagaaaatgaaaaatttgacaatggtgatccaggaaaccttgcgcttgtacccagcaggggcctttgtatcaaggcaggccctccagaacctgaagcttggtggtgtacatataccaaaaggtgtcaacatctacatccctgtctccacaatgcatcttgaccccaagctatgggacgctgatgtgaaagagttcaacccagagcgcttctctgatgttaaaccccagctacattcatacttgccgtttggtggtggggcacggacctgcctagggcagggatttgctatggctgagcttaaaatcctcatctctcttatcatttccaagtttgttttgaagctctcaccgcactacgagcattctccgacacttaagctcctcgtggagccagagcttggtgtggacctcaccttaacaaaagtgcagtgtctatactgactaagaggggctctgcaatttgggcacaataatattagttgtaccatgtgatgg

SEQ ID NO: 8254 - protein, 520 aa, Panicum virgatum
  misc_feature: Ceres CLONE 1993439
  misc_feature: Great-hit functional homolog of the protein sequence given in SEQ ID NO 9724
  misc_feature: Useful for making plants with modulated biomass
  misc_feature: Useful for making plants with modulated flowering time
  misc_feature: The plant flowers significantly late compared to wild-type.
  misc_feature: The plant is abnormally small.
MEQVAMAVKVLLSLCCVGACGLAMYLYHTLWLVPQRVLAEFRMQGIGGPPPSFPYGNIADMREAVAAAKAARASARRAAAGACGGIRHDYRPAVLPYYEKWRKEHGPIFTYSMGNVVFLHVSRPDVVRDINLCVSLDLGKSSYLKATHEPLFGGGILKSNGEAWLHQRKIIAPEFFLDKVKGMVDLMVDSAQPLLKSWEERVDRNGGITDIKIDDDIRAYSADVISRTCFGSSYIKGKEIFMKIRELQQAVSKPNVLAEMTGLRFFPSMRNKQAWELHKEIHKLILDIVKESGEDRNLLSAILHSASCSRVGIAEAENFIVDNCKSIYFAGYESTAVTAAWCLMLLGLHPEWQDRVRAEVHEVCRGRPIDSQSLQKMKNLTMVIQETLRLYPAGAFVSRQALQNLKLGGVHIPKGVNIYIPVSTMHLDPKLWDADVKEFNPERFSDVKPQLHSYLPFGGGARTCLGQGFAMAELKILISLIISKFVLKLSPHYEHSPTLKLLVEPELGVDLTLTKVQCLY

SEQ ID NO: 8255 - DNA, 1811 bp, Panicum virgatum
  misc_feature: Ceres CLONE 1993493
  misc_feature: Encodes the peptide sequence at SEQ ID NO. 8256
gatcgcctcccttccccttcctttctcttcttcccctcgcacccggcgcgggccgcgccagattcgaatcaaacaagccaaccaccaccagagccaagaaacgtggcaggaatcttggcgaggttcccggccggcgcgtggtgcgcagctgcggtgcggggccggggcgtccgtccatccgcccggcttgcagatagtagtaatataatggtgagcggcggcggcggcggcgcggcgctgctgggcgcgtacgagctggggcggacggtgggggagggcagcttcggcaaggtgaagcaggcgcggcaccgcggcacgggcgcgctcttcgccgtcaagatcctggaccgcgcccgggtcctctcccagcgcatcggcgaccagatacgccgggagatcgccacgctcaatctgctccgccaccccaacgtcgtccgcctgcacgaggttgctgctagcaagaccaagatttacatggtgctcgagtttgtcaacggcggcgaactgttcgacaggattgccatcaagggaaaactctcggaggaagaaggaaggaggctatttcagcagctgatcgatggtgtcagctactgccacgaaaagggcgtctatcatagagacctcaagcctgagaacgttcttgttgaccggaagggaaacatcaagatctctgattttggcctcagtgctttaccacaacatatcgggaatgatgggttgctgcatacgacctgtggtagccccaattacattgctcctgaggttctgcagaacagaggatacgatggatccttgtcagatatctggtcttgtggagtcattctttatatgatgctcgtaggataccttccatttgatgaccggaatatcgttgttctttatcagaagattttcaagggtgacactcagatcccaaagtgcctttctcctggtgcacaaaatcttctccagagaattcttgagcccaacccgatgaagcggatcacaatggctgagatcaaggcacatgaatggttccagaaggattatgttcctgcagttccattcgacaacgatgatgaagattcacagcttgacctggttcttccagtcaaggaggaaattaatccatcacctggggataagactactcatcagatcaatgcttttcagttgattggaatggcatcatcccttgacctttcagggttttttgaggaagaggacgtatcccagaggaagatcagattcacaacaacacatccacccaaggatttgtttgacaagattgaacgttctgcaagcgaaatgggcttccaagtacatagggggcacggcaagctcaaagtgacgcaaaactacactggaacaaagaattgtaaaaaccctgcttcatttcttgtctgcaccgaggtgtttgagcttggcccctctttgtacgtcgtagagctcaagaagtcccatggagaccctgcattgtacagacagctctgcgagaagatctgcagtgacctgggcgtgctgatggcgcagatcttcgggacacggccggttgtcgatgatcttgcgagcttggacagtcgatccgggacgcctttggtggcgttgtgacgaagtatgcccgctgccgtgatgtagcgtgagatctagggaagacgaagcagttcagctgcaatgcagctaggaacgagtgtactgtagataggatcaaaattcgcctgaaaatatagatgtcaaaatagtgcaggatcatcataatgtgtaaaagaagcagcagccactgacgtcaaaccgaatgtcaaatctaataaatggattgtattcggtggcat

SEQ ID NO: 8256 - protein, 460 aa, Panicum virgatum
  misc_feature: Ceres CLONE 1993493
  misc_feature (12)..(430): SWISSPROT Homolog: EC 2.7.11.1 CBL-interacting serine/threonine-protein kinase 1
MVSGGGGGAALLGAYELGRTVGEGSFGKVKQARHRGTGALFAVKILDRARVLSQRIGDQIRREIATLNLLRHPNVVRLHEVAASKTKIYMVLEFVNGGELFDRIAIKGKLSEEEGRRLFQQLIDGVSYCHEKGVYHRDLKPENVLVDRKGNIKISDFGLSALPQHIGNDGLLHTTCGSPNYIAPEVLQNRGYDGSLSDIWSCGVILYMMLVGYLPFDDRNIVVLYQKIFKGDTQIPKCLSPGAQNLLQRILEPNPMKRITMAEIKAHEWFQKDYVPAVPFDNDDEDSQLDLVLPVKEEINPSPGDKTTHQINAFQLIGMASSLDLSGFFEEEDVSQRKIRFTTTHPPKDLFDKIERSASEMGFQVHRGHGKLKVTQNYTGTKNCKNPASFLVCTEVFELGPSLYVVELKKSHGDPALYRQLCEKICSDLGVLMAQIFGTRPVVDDLASLDSRSGTPLVAL

SEQ ID NO: 8257 - DNA, 1873 bp, Panicum virgatum
  misc_feature: Ceres CLONE 1993648
  misc_feature: Encodes the peptide sequence at SEQ ID NO. 8258
agagagcatatgcctcgcaaagttcccagccccgcttgttccctcctctaatattcccctccgcccatggaatatccccggaattccaacccaaacctgttgtcttcgttttcactccctctcccgcttatatacgcaacggcaagctcgccctctcccacgccccgacgcgccattacgcagctgggccgtgcacgcttgcgcaaaccgaaggattgccgctccgttattggtctcctcctcgggtgctggcggcgggagcaatggcgattggcgggaaggagatcaaggaagacctggaggaggcgccgccactgctcctggacgaggccgcgcgcccgcgccgcgtggcgctcttcgttgagccgtcgccgttcgcctatatctctgggtataagaaccgcttccagaacttcatcaaacacttgcgtgaaatgggagatgaggtcattgttgtgaccaaccatgaaggagttcccgaagaatttcatggtgccaaggttattggctcatggagcttcccatgtcccatgtatggaaaagtcccgctttcgctggcactcagtcctagaatcatttcggaggttgcaaagttcaaacctgacattattcatgcatcttcacctggaattatggtttttggggctcttgctattgctaagcttctcagcgtgcccctagtcatgtcctaccacactcatgtcccagtatacataccaagatatacatttagctggcttgtcgagcctatgtggcaagtcataagattccttcacagagctgctgatttaaccttggtaccatctgctgctatcagcaaggattttgaaactgctcaggttatatcagctaacagaatacgcctttggaacaaaggtgttgattctgcaagtttccatcccagatttcgtagtcacgagatgcgaattaggctaagtgatggggagcctgaaaaaccactcataattcacgtcggacgttttgggcgtgagaaaaatttggattttgtgaagatggtaatggataggttgcctggagtaagaattgcatttatcggagatggaccatacaggacggagctagagaatatgtttgagggaatgccagcagtgttcaccggaatgatgcaaggcgaggagctctctcaggcatacgccagcggcgacgttttcatcatgccatcagagtctgaaacgctcggccaagtggtccttgagtccatgtcatcgggagtccccgtcgtcgcagcctgtgctggtgggatcccagacataatcccggaagatcaggacggcaagaccagcttcctcttcaccccgggcgacctggacgactgcgtgggcaaagtccagctgctgctgacgaacagggagttcagagacaacatggcgcggacggccaggtccgagatggagaaatgcgactggcgggcggcgtcgaagacgatccgcaacgagttctacgatgccgccatctggtactggcggaagaagcgtgcggatatggtgcagccgctgcagtggctggcgcagatgttcctaccggggctggaggtccgccgcatcacacagtgctgatgcctcctctcttgcagccatgatccggacatggatggaaggacagatgcatatgaattccttgtaaatttctgatatctatagtgcagtgccgataggtgagatagtttatcgttttttgtggaaatcggagtagcttggactgtgattgctgtggcatggccatcgattgcacttgtgttgtgtagtagcaaaaccaaaatcagaaatgtgctatcttgatggacattgtagattgtactgcacatgtatagatcatgatcacgccatcaatgcatgaagatgcttttaagggg

SEQ ID NO: 8258 - protein, 437 aa, Panicum virgatum
  misc_feature: Ceres CLONE 1993648
  misc_feature (1)..(164): Pfam Name: Glycos_transf_1 Pfam Description: Glycosyl transferases group 1
MAIGGKEIKEDLEEAPPLLLDEAARPRRVALFVEPSPFAYISGYKNRFQNFIKHLREMGDEVIVVTNHEGVPEEFHGAKVIGSWSFPCPMYGKVPLSLALSPRIISEVAKFKPDIIHASSPGIMVFGALAIAKLLSVPLVMSYHTHVPVYIPRYTFSWLVEPMWQVIRFLHRAADLTLVPSAAISKDFETAQVISANRIRLWNKGVDSASFHPRFRSHEMRIRLSDGEPEKPLIIHVGRFGREKNLDFVKMVMDRLPGVRIAFIGDGPYRTELENMFEGMPAVFTGMMQGEELSQAYASGDVFIMPSESETLGQVVLESMSSGVPVVAACAGGIPDIIPEDQDGKTSFLFTPGDLDDCVGKVQLLLTNREFRDNMARTARSEMEKCDWRAASKTIRNEFYDAAIWYWRKKRADMVQPLQWLAQMFLPGLEVRRITQC

SEQ ID NO: 8259 - DNA, 1808 bp, Panicum virgatum
  misc_feature: Ceres CLONE 1993766
  misc_feature: Encodes the peptide sequence at SEQ ID NO. 8260
acaacaaagtcagaacgccatactgctagctccattgaaactatgggtcttttgcacgtccccagtagtagtaggactcaaagtttttaccaccttttgctgtttcatgtgcacccgttctggatccaactctcgtacttcctcttcgtctccctcttcggtttcttgatgctaaaagccctgcccatgaaaaccagcgcagtgccaacgccctcgggcctggacctgatcttcacgtctgtgtccgcgactacagtgtcgagcatggtcgccgtcgagatggaatccttctccaactcccagctccttctcatgaccctactgatgctcctcggcggcgaggtgttcacgagcatgcttggcctccacttcacctacaccaagctcaagctcaagaagagagaagaacaatctcatgatcacgaggtcatcaatgggccaccgccggcgactagcttagagctcgctcccatgggagctcccccagctgccgtcacactagatcaaatggagacagggttcatcaagaaccaacgtgacttcacatccattgccaggttgctaatgttcatcgtgctgggctacctcgtggtggtgcacctcgccggctacacgctcgtgctagtctacctttgcgccgtcgccggcgcgagggaggtgctcatcggcaagaagatcaacccgagcaccttctccatcttcaccgtcgtctcgacgttcgccaactgcggcttcgtgccaacgaacgaggggatggtgtccttcaagtccttcccgggcatgctcctcctcgtcatgccgcacgtcctcctcgggaacacgctcttccccgtcttcctcaggctatccatcagagcgctcgcgagggtcacagggaggccacaactcggcgagctgctggtgagcggaggaccggccgccgccgcttccgccattgggtacggccacctgctgccgggcgcgcgcgcgcggttcctggcgctcacggtggcggcgttcctggcggtgcagctggtgctcttctgcgccatggagtggggctccgacgggctgcgggggctcggcgcgttccagaagctcgtggcggcgctgttcatgtcggtcaactcgcggcactccggcgagatggtcgtcgacctcggcgccgtgtcgtccgccgtcgtcgtgctctatgttgttatgatgtatctacccccttacaccacatttttgccggtggcagtggaagatcaccacgagcaaaaaagggaggagaaaagcaagaccaccagcagcagaagcgtgtggcagcagaagctgctcatgtcgccgctctcgtgcctcgccatcttcatcgtcgtcatctgcatcaccgagcggcggcagatcgccgacgacccaatcaacttcagcgtcctcaacatcgtcgtcgaggtcatcagtgcctatggcaacgtggggttcagcaccgggtacagctgcgctaggcaagtgaagcccgacggcagctgctgggacgcgtggatcggcttgtccggcaagtggagcagggaagggaagctcgcgctcatggtagtcatgttctatggcaggctcaagagcttcagcctgcatgggggtcaggcatggaagctaggctaacggttttaattagagttttttaaggtccacaatactaccatatactactgtccgaaaatgactctttaattaaaactagatcgatgcctatgtgttgttacagactttgagtgtttaacttttattatatggaatatttataatgacatataccaatagtatacacttaaaaaaaaaaaaaaaaaaaa

SEQ ID NO: 8260 - protein, 525 aa, Panicum virgatum
  misc_feature: Ceres CLONE 1993766
  misc_feature: Great-hit functional homolog of the protein sequence given in SEQ ID NO 9563
  misc_feature: Useful for making plants with modulated salt sensitivity
MGLLHVPSSSRTQSFYHLLLFHVHPFWIQLSYFLFVSLFGFLMLKALPMKTSAVPTPSGLDLIFTSVSATTVSSMVAVEMESFSNSQLLLMTLLMLLGGEVFTSMLGLHFTYTKLKLKKREEQSHDHEVINGPPPATSLELAPMGAPPAAVTLDQMETGFIKNQRDFTSIARLLMFIVLGYLVVVHLAGYTLVLVYLCAVAGAREVLIGKKINPSTFSIFTVVSTFANCGFVPTNEGMVSFKSFPGMLLLVMPHVLLGNTLFPVFLRLSIRALARVTGRPQLGELLVSGGPAAAASAIGYGHLLPGARARFLALTVAAFLAVQLVLFCAMEWGSDGLRGLGAFQKLVAALFMSVNSRHSGEMVVDLGAVSSAVVVLYVVMMYLPPYTTFLPVAVEDHHEQKREEKSKTTSSRSVWQQKLLMSPLSCLAIFIVVICITERRQIADDPINFSVLNIVVEVISAYGNVGFSTGYSCARQVKPDGSCWDAWIGLSGKWSREGKLALMVVMFYGRLKSFSLHGGQAWKLG

SEQ ID NO: 8261 - DNA, 1596 bp, Panicum virgatum
  misc_feature: Ceres CLONE 1993858
  misc_feature: Encodes the peptide sequence at SEQ ID NO. 8262
ctagcagtctagctaagctctggatcggctcgcccccgccgcggccgccgccctcatggcgtcgtaccgccccgagcatccaaatccggccgcccgacgcccgcggcccgtcgtgctcctcatgctcgccttcttcgccctccagctcctcatcttcctctccttccgcgccgtgcggccccctccagccccggcctcctcatccgccgccgccgccgacaccgcgtcggtaccggcgcgccgggatgggaatgactcgagctgcggcggcgggctggtgtacgtctacgacctccccgcggccttcaacgaggacctcctgcggatgtgcgacaagctcgcgccgatgtactcgctgtgcccctacctcgccaacgacgggctcgggctccccgcggggggtaccaacctgtcgtcgctcctgccgcgggagctgctcgggtcgtggtacgcgtccgaccagttcgcgctggagcacatcgtccaccgccgcctgctctcgcaccggtgctgcacggcggacccggcccgcgccgcggccttcttcgtgcccttctacgccgggctggccgtggggcgccacctgtgggcggccaacgccccgggcgccgacagggacagggactgcgccgcgctgctgtcgtggctccacgcgcagccgtggtaccggcgctcccgcggctgggaccacttcatcgcgctgggccgcatcacgtgggacttccgccgcacgtcggacgacgcctggggcggcagcttcctcaccatgcccggggtggccaacatcacccgcctcgtcatcgagcgcgacccctgggacgacatggacgtcggcgtcccgtacccgaccgggttccacccgcgcgccgccgccgacgtgcgcgcgtggcagaggcacgtcgcgcgccgcccgcggcccatgctcttcgccttcgccggcgcgccgcgctcggccatcaggggcgacttccgcgcgctgctgctgggggagtgccaggcggccggccccgccgcgtgcggcgcgctggactgcgccgagggcaggtgcatcaggaacaacgcgctcgtcatggagctcttcatgggcgccaggttctgcctgcagccgcgcggggacagcttcacgcgccgctccctgttcgactgcatggtggccggcgccgtccccgtgctgttctggcggcggagcgcgtaccgccagtacgggtggtacctgcccgtgggcgacgggcgcgaggcggagtggtccgtgttcatcgaccgcgagaagctccgcgcggggaacctcacggtgcgtggcgtgctggcggccatcccggagccgcgggtgcggctgatgcgggagcgcgtggtggagatgatcccgaggctggtgtacgccgcggccgacgacggggggaaggggctcggcggcggcatggacgacgccgtggacgtcatggtcgacggcatgctgcggcgtgtcgccgagcagcgcccgaggtggcgggcgacgtgatcgcagctgcagctgtgggaccaaactgatcatacgttttcacagttttttcgttttccattctgaattcttttgtgtgaagagtttcactcgcgcag

SEQ ID NO: 8262 - protein, 480 aa, Panicum virgatum
  misc_feature: Ceres CLONE 1993858
  misc_feature: Great-hit functional homolog of the protein sequence encoded by LOCUS At5g62220
  misc_feature: Useful for making plants with altered cell wall content and/or composition
MASYRPEHPNPAARRPRPVVLLMLAFFALQLLIFLSFRAVRPPPAPASSSAAAADTASVPARRDGNDSSCGGGLVYVYDLPAAFNEDLLRMCDKLAPMYSLCPYLANDGLGLPAGGTNLSSLLPRELLGSWYASDQFALEHIVHRRLLSHRCCTADPARAAAFFVPFYAGLAVGRHLWAANAPGADRDRDCAALLSWLHAQPWYRRSRGWDHFIALGRITWDFRRTSDDAWGGSFLTMPGVANITRLVIERDPWDDMDVGVPYPTGFHPRAAADVRAWQRHVARRPRPMLFAFAGAPRSAIRGDFRALLLGECQAAGPAACGALDCAEGRCIRNNALVMELFMGARFCLQPRGDSFTRRSLFDCMVAGAVPVLFWRRSAYRQYGWYLPVGDGREAEWSVFIDREKLRAGNLTVRGVLAAIPEPRVRLMRERVVEMIPRLVYAAADDGGKGLGGGMDDAVDVMVDGMLRRVAEQRPRWRAT

SEQ ID NO: 8263 - DNA, 1643 bp, Panicum virgatum
  misc_feature: Ceres CLONE 1993861
  misc_feature: Encodes the peptide sequence at SEQ ID NO. 8264
agacagtgtgtgtgtgtgtgtttcaaaaccgttggctgccgcctgggcagcatcgaaaccgctccatttcgcacctccctgaaaaagccccaagcctacaacccttcccggcggccggccggccggcggcgtggcgcacggcgcacacacagccgtgtcaagctctatagtctatagcagcaagaaacgatggcgcaaggcgcgctgcggggcccctccggctactcccgcgagccccctcgccacccctccctccgcatcaacgccaaggagccgttcaacgcggagccggcgcggcgggacctggcggcggcgtacatcacccctatcgacctcttcttcaagcgcaaccacggccccatccccgtcctcgacgacatcgacagctactacgtgaccgtcggcggcctcgcaggcgggccgaggcggctctcgctggatgacatcaggaagttgcccaagtacaatgttaccgccaccctacagtgtgctgggaacaggaggacggagatgagcaagagtaggaaggtcaggggcgttggctgggatgtttgcgctcttgggaatgcaacttggggaggagctaaattatcagatgtccttcagcttgttggcgtgccatatcatactgaaatcaccccgtctggcggaaaacatgttgagtttgttagtgttgatcagtgtccagaggaaaaaggtggcccatacaaagcgtcgattcccttgggccaggcaacaaatcctgcagcagacgtactgcttgcatatgaaatgaatggcaaggtactcaagcgtgatcatggataccctctccgcgctattgttccaggtgtcattggtgcccgttctgtcaaatggttagatagaattgacataattgaggaagagtctcagggtttcttcatgcaaaaggattataagatgttccctccttcagttgattgggataatattgtgtggtcaaccaggaagccccaaatggactacccagttcagtctgcaatatgttctttggaagacgtaggtaccgtcaaaccaggacaggtcattgttgctggatatgcattgtcaggaggtggcaggggcattgagagggttgatatttcccctgactgtggtaagagttggtttgaggcacaccggtaccaaaaacaaggtattccatatgtggctggtaacataaccagtgataagtgggcatgggtgctcttcgaggccattgtcgatgtcaaaggcgacactgagattgttgctaaagcggttgattccagtgcgaacgtgcaacctgagagcgtggaatcgatctggaacctgagagggattctgaacacatgttggcatcgtgtccgccttctggcaacacctaaccttagaagtttcatgtgatcccaccgcccatccaggcacccatatattttcatcagcttatgctgttaccaacccacaacccagcaacttagcatcgccattctggttatgatctgcactggagtaaagagagtcaagaaggcgtcaataattccatctctgtggaaatttgtgggtaacttgtttggatccaaaaataaaacccttattgtcccatggccatgtaccccctttttaggttaaagaaagttaaatcaacttcgaaatattacctc

SEQ ID NO: 8264 - protein, 398 aa, Panicum virgatum
  misc_feature: Ceres CLONE 1993861
  misc_feature (6)..(394): SWISSPROT Homolog: EC 1.8.3.1 Sulfite oxidase
MAQGALRGPSGYSREPPRHPSLRINAKEPFNAEPARRDLAAAYITPIDLFFKRNHGPIPVLDDIDSYYVTVGGLAGGPRRLSLDDIRKLPKYNVTATLQCAGNRRTEMSKSRKVRGVGWDVCALGNATWGGAKLSDVLQLVGVPYHTEITPSGGKHVEFVSVDQCPEEKGGPYKASIPLGQATNPAADVLLAYEMNGKVLKRDHGYPLRAIVPGVIGARSVKWLDRIDIIEEESQGFFMQKDYKMFPPSVDWDNIVWSTRKPQMDYPVQSAICSLEDVGTVKPGQVIVAGYALSGGGRGIERVDISPDCGKSWFEAHRYQKQGIPYVAGNITSDKWAWVLFEAIVDVKGDTEIVAKAVDSSANVQPESVESIWNLRGILNTCWHRVRLLATPNLRSFM

SEQ ID NO: 8265 - DNA, 1852 bp, Panicum virgatum
  misc_feature: Ceres CLONE 1993917
  misc_feature: Encodes the peptide sequence at SEQ ID NO. 8266
gtggcggccgacgcatctcaccgtactgactactgagcgggctcccaagcttcccaaaccatggcggcggcgaacctgctctcgcgctccctcctccccgccctaaaccctagcccgtccgcccgccggaaccgcggcagcgccgccgccgccgcctccttcccccggccccgctgtctccacggccgcctgtcctccgtgcgcgcctccgtctccacggccaccccttccccgccgccgcagcctgcggcggcggcggcggcggcggcggcggccgcgccgaagcgctgctgcaggcgcggcgccgacgggtacctgtactgcgagggggttcgggtggaggacgcgatggcggcggcggcgcggagccccttctacctctacagcaagccgcaggtcctccgcaacttcgccgcctaccgcgaggcactgcaggggctccgctccgtcgtggggtacgccgtcaaggccaacaacaacctccccgtgctgcgcctcctgcgcgagctcggctgcggcgccgtgctcgtcagtggcaacgagctccgcctcgcgctccaagcgggtttcgaaccgaccaggtgtatatttaacggaaatgggaagacattggaagatctcatgttagctgctgagagcggggtatttgtaaatgtggacagcgaatttgatttggagaatattgtcagagctgcaagggctacaggaaagagagtgcctgttttgcttagaataaatccagatgtggatccgcaggtacatccgtatgttgccactggaaataaaacatccaaattcgggatccgcaatgagaaattgcaatggtttctggactctatcaagtcatactcgaatgatatgaagttggttggtgttcattgtcatctggggtctactattacaaaggttgatatattcagagatgctgcagttcttatggtaaattttgttgatgaaattcgagcacaaggttttgagttggagtacctgaacatcggaggtggtttgggaatagattaccaccacaccgatgcagtcttgcctacacctatggatctcatcaacactgtgcgagaattagttctctctcgagatcttactcttatcattgaacctggaagatccttgattgctaatacttgctgcttcgtcaatagagtaactggtgttaaatctaacggtacaaagaattttattgttgttgatggcagcatggcagaactcatcagacctagtctgtatggagcataccagcatatcgaactggtctctcccccctctcctggtgccgaagtagctacctttgatattgtcggaccagtttgtgagtctgcagatttccttggaaaagatagggagcttccaacacctgatgagggagctggactggttgttcatgatgcaggtgcctactgcatgagcatggcttccacctacaacctgaagttgagaccgccagagtactgggtggaagaggacggttctatcgtaaagatcagacatcaagagaagcttgatgactacatgaagttctttgatggtcttccagcttagacatttatctgcaactgcgacaagcacacgttttcttgggggataattagactttcttgccaagtttattttacttgtggttgtagtggaatgtgtgactagataattaatttggtttgtttgtgtatcctccagattttctgtgatgtgcaagtcttaggcaccaaatttgtaatatactgctatttagagccagaagttattacctggataaaaaggcacagtgaataagtctgccgcccgaatgcatccaaagtcttggacgatgaatagatataagcttacgcttgcctcaaac

SEQ ID NO: 8266 - protein, 497 aa, Panicum virgatum
  misc_feature: Ceres CLONE 1993917
  misc_feature: Great-hit functional homolog of the protein sequence given in SEQ ID NO 9709
  misc_feature (1)..(227): Pfam Name: Orn_Arg_deC_N Pfam Description: Pyridoxal-dependent decarboxylase, pyridoxal binding domain
  misc_feature: Useful for making plants with modulated biomass
  misc_feature: The plant is abnormally small.
MAAANLLSRSLLPALNPSPSARRNRGSAAAAASFPRPRCLHGRLSSVRASVSTATPSPPPQPAAAAAAAAAAAPKRCCRRGADGYLYCEGVRVEDAMAAAARSPFYLYSKPQVLRNFAAYREALQGLRSVVGYAVKANNNLPVLRLLRELGCGAVLVSGNELRLALQAGFEPTRCIFNGNGKTLEDLMLAAESGVFVNVDSEFDLENIVRAARATGKRVPVLLRINPDVDPQVHPYVATGNKTSKFGIRNEKLQWFLDSIKSYSNDMKLVGVHCHLGSTITKVDIFRDAAVLMVNFVDEIRAQGFELEYLNIGGGLGIDYHHTDAVLPTPMDLINTVRELVLSRDLTLIIEPGRSLIANTCCFVNRVTGVKSNGTKNFIVVDGSMAELIRPSLYGAYQHIELVSPPSPGAEVATFDIVGPVCESADFLGKDRELPTPDEGAGLVVHDAGAYCMSMASTYNLKLRPPEYWVEEDGSIVKIRHQEKLDDYMKFFDGLPA

SEQ ID NO: 8267 - DNA, 1843 bp, Panicum virgatum
  misc_feature: Ceres CLONE 1993997
  misc_feature: Encodes the peptide sequence at SEQ ID NO. 8268
gccaaaagtgctcgccgaggccgcctttccgcggccgcactcggagagcgagcgagcgagcatattttgcctttgccgctgtgctcattccatttggagctcgaaagcttggcctacctttcttctttctttcttcctctctctttaacctgatcgccacctgcaacgaatgctctgccgttactcacgctgcctctccccgctggttgtttctgttggttagcatcggcgccgccgcctccccgccggagtacatgacctctgcgcccgtggtgcagttcgcggcggcgcccatcagaatgggggtgtacgagcggccggcgccggcgcccgtgatgggcatgtggaacagcgacccgttcaaggtcgacagcggccaggccaccagtgggtccaccgtcatggaggcggacaagttcgacactaggctagaagatgttccacaggtagcactggagccggcaagaagtacggatcaggaaacaagcaggccgccagagagggtcctgcgaagacttgcacagaacagagaggctgctcggaagagccggctgagaaaaaaggcgtacatccagcagctagagacaagccggatgaagctggcgcagctagagcaagagcttcaacgggctcgacagcagggtgcctatgcaaatgggaatttgggagacccaaatctcggattcacaggatcaatggttccaggtgttgctgcgttcgagatagactacagcaactgggtggaagagcagaacaggcacacagccgagctgaggtccgctctccaggggcagaccacggagctggagctgcgcatgctcgtcgagaccgggctcaacaactacgagcacctgttcaggatcaaggcgctggccgccaactcggacgtgttctacgtcacgtccggcgtgtggaagacccccgccgagcgcttcttcctgtggatcggcgggttccggccgtcggaagtgctcaagatcctgaggccgcagctggagccgctgacggaggcgcagctgatggccgtgggcggcctgcagcacacctcgacgcaggccgaggacgccctgtcgcagggcatggagaagctgcagcagaacctcgccgagacgctgacggccgcggccgacccgttcgggcctcccgacggctacatgctgcagatggagaccgccgtggagaagctgaaagagctcgtcggcttcgtgatccaggcggaccatctccggcagacgacgctgcagcagatgcacaagatcctgacgacgcggcaggcggcgaggggcctcctggcgctcggcgactacttccagcgcctccgcgcgctcagccatctgtgggcgacgcggccccgcgaggcgccgacgctcagccatctgtagttcgttgtatacttcccaaggtgtaaggcccgatgacgaaagacgacgacgacgacgacgaagaagtcgtggacctcgctggggttggagatgaggaacgcagaggcttcgttctcagccagcggcgccgtgccgccggtgcccgcgtctccgaggaacaggaaactggtgtgcgtttgtcgggtgatgaaagaataacggaaaaattgagggcttccgagacgtgtacagttttggtataccctgcccggaggctttctagaggccgtataattaactggtataaatgatgggttttacaagtagtgttatttacggtatatcgtgaatgaatttatatgatgtaacgatatgtaactagtatctgtccatttctcatgagtagggcacgcagtccttgtgcaaatgtattgtatggaacaagttagtccacttaagatggaaaaaaaaaaaaaaaaaaa

SEQ ID NO: 8268 - protein, 375 aa, Panicum virgatum
  misc_feature: Ceres CLONE 1993997
  misc_feature: Great-hit functional homolog of the protein sequence given in SEQ ID NO 9747
  misc_feature (5)..(45): Pfam Name: bZIP_1 Pfam Description: bZIP transcription factor
  misc_feature: The sequence is a functional homolog of  SEQ ID NO 1493 in the  10/374,780 US patent application
  misc_feature: The sequence is a functional homolog of  SEQ ID NO 1563 in the  10/412,699 US patent application
  misc_feature: The sequence is a functional homolog of  SEQ ID NO 1786 in the  10/412,699 US patent application
  misc_feature: The sequence is a functional homolog of  SEQ ID NO 2024 in the  10/374,780 US patent application
  misc_feature: The sequence is a functional homolog of  SEQ ID NO 352 in the  10/412,699 US patent application
  misc_feature: The sequence is a functional homolog of  SEQ ID NO 819 in the  11/479,226 US patent application
  misc_feature: The sequence is a functional homolog of  SEQ ID NO 928 in the  11/435,388 US patent application
  misc_feature: Useful for making plants with modulated biomass
  misc_feature: Useful for making plants with modulated flowering time
  misc_feature: The plant flowers significantly late compared to wild-type.
  misc_feature: The plant is abnormally small.
  misc_feature: Useful for making plants with modulated growth and phenotype characteristics
MTSAPVVQFAAAPIRMGVYERPAPAPVMGMWNSDPFKVDSGQATSGSTVMEADKFDTRLEDVPQVALEPARSTDQETSRPPERVLRRLAQNREAARKSRLRKKAYIQQLETSRMKLAQLEQELQRARQQGAYANGNLGDPNLGFTGSMVPGVAAFEIDYSNWVEEQNRHTAELRSALQGQTTELELRMLVETGLNNYEHLFRIKALAANSDVFYVTSGVWKTPAERFFLWIGGFRPSEVLKILRPQLEPLTEAQLMAVGGLQHTSTQAEDALSQGMEKLQQNLAETLTAAADPFGPPDGYMLQMETAVEKLKELVGFVIQADHLRQTTLQQMHKILTTRQAARGLLALGDYFQRLRALSHLWATRPREAPTLSHL

SEQ ID NO: 8269 - DNA, 1711 bp, Panicum virgatum
  misc_feature: Ceres CLONE 1994007
  misc_feature: Encodes the peptide sequence at SEQ ID NO. 8270
gtccaaatttatttcttggcacctcggatcagcatattccatctccctccccccgccccgccccccgtctccccgatcggacacgcgatcccattcccgttctctcgcccagttccagtgctacctcctggaagccgcgccgccaagccgccaaggagcagagcacgcaacagagggagccgggaaggaatggggcggcacggcgtggcccggatcggcgccgcgggggcgcccgcctgggccgccctcctcctgccgccgctgctgctcctgctgcttgcgggcgcccgcgccggccagaccagcgagtaccggcgccacctcggctccgccatcgacatgccgctcgacgccgacgtcttccgcccgccgcccggccacaatgcgcccgagcaggttcacatcacacaagggaaccatgatggcgcagccatgataatctcatgggtgacaacaagtgagcctggctcgagcactgtggtgtacgggacttcagaggacaacctcaactatactgcaaacggaaagcacagtcagtatacgttctacaactatacctcaggatacattcatcattgcacaataaaaaagctggagtttgacacaaagtattactatgctgttggaattggacaaacagtgaggaagttttggttcatgacccctccaaaaagtggcccagatgttccatatacatttggtcttataggtgacctcggtcagagcttcgactcaaatgttacgcttgctcattatgagtccaattcaaaagcgcaggcggtgctatttgttggagatctgtcatatgcagataactacccatatcatgataatgtgaggtgggatacgtgggctagatttgtggagaggaatgtcgcgtaccagccatggatctggacagctggaaatcacgagatagattttgctcctgaacttggtgaaacaaagccattcaagccatacagcaacaggtaccccacaccttacaaggcttctggtagcacggcaccttactggtattccatcaagagggcctctgcttacattattgtcttggcatcatattcatcatatggaaaatacactcctcaatacaagtggcttgaagctgagtttcccaaggtcaacaggagtgaaacaccatggttgatcgtcctcatgcacgcaccatggtacaatagctacaactatcactacatggaaggtgaaaccatgagggtgatgtatgagccgtggttcgtcaagtacaaagttgatctcgtgtttgcaggacatgtgcatgcctatgagcggacacacaggatatcaaatgtggcatacaacgttgtgaatggcctgtgcactccagttcctgatcaatctgctccagtctacatcactattggcgacggagggaaccaggagggactcgccaccaacatgtcgcagccgcagccgaggtactcggccttcagggaggcgagcttcgggcacgccatcctggacatcaagaaccggacgcacgcgtactacacgtggcaccgcaaccaggacggcagcgcggtggccgccgacgccatgtggttcaccaaccgctactgggagccgacggacgactccgctgcctcctccgagtgaggacgacgcgccgccgtcctcgtggctcctcacgatcaataagcaaagcatcccctccgttggaagaagatcggaaaaaaaaaaaaaaaaaaaa

SEQ ID NO: 8270 - protein, 475 aa, Panicum virgatum
  misc_feature: Ceres CLONE 1994007
  misc_feature (1)..(199): Pfam Name: Metallophos Pfam Description: Calcineurin-like phosphoesterase
  misc_feature (20)..(472): SWISSPROT Homolog: EC 3.1.3.2 Purple acid phosphatase precursor
  misc_feature (25)..(464): SWISSPROT Homolog: EC 3.1.3.2 Iron(III)-zinc(II) purple acid phosphatase precursor
MGRHGVARIGAAGAPAWAALLLPPLLLLLLAGARAGQTSEYRRHLGSAIDMPLDADVFRPPPGHNAPEQVHITQGNHDGAAMIISWVTTSEPGSSTVVYGTSEDNLNYTANGKHSQYTFYNYTSGYIHHCTIKKLEFDTKYYYAVGIGQTVRKFWFMTPPKSGPDVPYTFGLIGDLGQSFDSNVTLAHYESNSKAQAVLFVGDLSYADNYPYHDNVRWDTWARFVERNVAYQPWIWTAGNHEIDFAPELGETKPFKPYSNRYPTPYKASGSTAPYWYSIKRASAYIIVLASYSSYGKYTPQYKWLEAEFPKVNRSETPWLIVLMHAPWYNSYNYHYMEGETMRVMYEPWFVKYKVDLVFAGHVHAYERTHRISNVAYNVVNGLCTPVPDQSAPVYITIGDGGNQEGLATNMSQPQPRYSAFREASFGHAILDIKNRTHAYYTWHRNQDGSAVAADAMWFTNRYWEPTDDSAASSE

SEQ ID NO: 8271 - DNA, 1785 bp, Panicum virgatum
  misc_feature: Ceres CLONE 1994030
  misc_feature: Encodes the peptide sequence at SEQ ID NO. 8272
accaataaacacatacgcaccacaatcatgcatcaatcatccctcctttcgcactattagcgcattagcaacagcaggaatggcatgcgcctcagcggcgcccaagttcgcggtgcgcaggcaaccggcagtgctggtggcgccggcggccccaacgcctcgtgagctgaagcggctctcagattttgatgagcaggatggtgtgagggtccaagtccccaacctctatttctaccggaggaacaagtccatgggcagcaaggaccccgtgcgggttatacaggaggctctcgccaaagcccttgtgccctactacccgtttgctggacggctccgagagcaagatggatgcaggctcgccgtcgactgcacaggtgagggggttttgtttgttgaggccgacgctgaagttggccttgagcattttgaggatcccctactgccgcccttcccgtgccttgaggagctcatctttgacgtccccggctcttccgccatcctcaacactccccttctgctcttccaggtgacgcgactcacctgtggaggattcatccttgcggtccggctgaaccacaccatggctgacgcacaggggctgatgcagttcttgggcgccgtggcagagcttgcgcggggtgcgcaggctccgtccgtgctgccggtgtggaaacgggagctgttggaggggctcaaccagcaacagccggcgctggtgcacggcaagttgcacgaggtgtcgggcagtaacactagcaccaaggccagcagtatcatgattccgtcagataccgcggcgctgcggctccgctccttcttcttcggggcccgagagatcgctgctattcaagcccagctcccgccgcacctccagaagcgtgccacaaacttcgacacaatcgcgggctggatttggaagttccgcacgatggcgctgtccccggaccccgacgaggtgatggtgctggcggtggtcgtccatgcacgtggccgcaacaccaccgcagtcggcattcccagcggctactacggaaacgcgttcttggtcccggtcgccatgtcaacagatagggagctctgcacaaaccccctgagctacgccgttgagctggtgaagaaggcgaaaaaccaggtggacatggagtacatgcggttaacggccaacctcatcgtacttcgtagggggcaaagtccgcgcatcgccgcggtcatgtattctctgtcggacacaacaagggccaggtttgaggacctcgacttcggatggggcaagccggtgtatggtggtccggcagaagctgtcggcgtcccgtccattccctgggtggggagcttcctcttagcctccaagaacgccgacggcaaggacggcatcgtcgtaccgatgtacctgcctggccctgctatggataggttggtggaagagatgaacaaggtgctgggcccgtcagccgatgtgaccctgcaccagcctcacgtatccctgtcaagaggtcagcgctatgaataattcaccatgtgttgagtgctgactatggccaaaatgaaacttcattattgcatagtagcatgagaatagtagtattgcaccagcctcacgtatccctgtcaataagtcagcgctatggataattcaccgtgagaatagtactatattgcaccagcctcacgtatatatgctattgcataattccttcaacactagtggtatgctattgtatgtttgcgtgaggggttctatctatcctatctactgcatgttatcaaaaaaaaaaaaaaaaaaaa

SEQ ID NO: 8272 - protein, 476 aa, Panicum virgatum
  misc_feature: Ceres CLONE 1994030
  misc_feature (1)..(439): Pfam Name: Transferase Pfam Description: Transferase family
MACASAAPKFAVRRQPAVLVAPAAPTPRELKRLSDFDEQDGVRVQVPNLYFYRRNKSMGSKDPVRVIQEALAKALVPYYPFAGRLREQDGCRLAVDCTGEGVLFVEADAEVGLEHFEDPLLPPFPCLEELIFDVPGSSAILNTPLLLFQVTRLTCGGFILAVRLNHTMADAQGLMQFLGAVAELARGAQAPSVLPVWKRELLEGLNQQQPALVHGKLHEVSGSNTSTKASSIMIPSDTAALRLRSFFFGAREIAAIQAQLPPHLQKRATNFDTIAGWIWKFRTMALSPDPDEVMVLAVVVHARGRNTTAVGIPSGYYGNAFLVPVAMSTDRELCTNPLSYAVELVKKAKNQVDMEYMRLTANLIVLRRGQSPRIAAVMYSLSDTTRARFEDLDFGWGKPVYGGPAEAVGVPSIPWVGSFLLASKNADGKDGIVVPMYLPGPAMDRLVEEMNKVLGPSADVTLHQPHVSLSRGQRYE

SEQ ID NO: 8273 - DNA, 1575 bp, Panicum virgatum
  misc_feature: Ceres CLONE 1994162
  misc_feature: Encodes the peptide sequence at SEQ ID NO. 8274
tcttctcctctatacccattctctcgcttgagcacttgtggtgtctgcaccaaaagaacaagactttctaatatataatcacttctccccccactatcactcctgttcttatatacccatatcctacctattctcaaccaccaacctaaacttacaaccttcacaatggccttttgctccatttctcgaaacatcctccgtgccactcgggcccctgccattgctctccccaagaactcgcgatgcttcacagccacacccgtgcagcgtgtcattgacaccaacttgaagaagaacgttgtccgagagaaggaggttcctgtcacagtctacagtgctggccagggtactggtgataagcacacagtcaacgtccccgaggcagctgctcgagttcctagcgagcctcgtactccttctaacgaaagcgacatcgttcagccgctcacccgcaagacattcgagcagctcccccacaccatgcgcaacatgagtgtctatggcaagaccatcatcctgactggcgctgcccgtggccttggaaaccatatggctcgtgcttgtgctgaggctggcgccaagaacattgttctcttcgacgccaaccaggagcttggtgacgaagccgcagctgagcttcacgacaagactggcctacctgtctccttctttaaggtcgatgttcgcgacggtgctgccatcaacgctgctgttgacgaggttgtcgagcgctacggtgctcctgatgttctcatcaactctgccggcatcgccgactccaacatcaaggctgagacttacgaccctgccatgttccgtcgccttatcgacatcaaccttaccggctctttcctcatgtcccaggccgttggccgtgccatgatgtccgctggaaagcctggcagcatcattctcgtcgcctccatgtctggctccatcgtcaacttcccccaggagcagagctgctacaatgcctcaaaggcaggtgtcattcaactcggcaagtcccttgcggctgagtgggccaagtacgacatccgggtcaactgcatctctcccggttacatggacactgccctcaaccgagttcctgctcttgacgcccagaagaagatctggaagtccctgacaccccagaaccgactaggtaacgttgacgagctcaacggtctttgcatctacctcgcctcagactcttccaagttcatgactggctccaactgcatcatcgatggtggctacacatgctactaagcgagcagaacccttttttggacggttagcgaagaacggtttccacggataaatggctggatcgggaaggccctgaaagaggatttgattttctttgtttggagttccggaaacaattggtgacctatttttgagcattgagcaagggccaagggggaaaaaagagacgtatgatgataaaactagatcagctctggataacatagagcaggatgaatctgccgtattagacacggagcgaggagatccagagagaggatctaaacttaatagccgctggcatataatgaatgaactcaacaaaaaaaaaaaaaaaaaaaa

SEQ ID NO: 8274 - protein, 362 aa, Panicum virgatum
  misc_feature: Ceres CLONE 1994162
  misc_feature (1)..(174): Pfam Name: adh_short Pfam Description: short chain dehydrogenase
MAFCSISRNILRATRAPAIALPKNSRCFTATPVQRVIDTNLKKNVVREKEVPVTVYSAGQGTGDKHTVNVPEAAARVPSEPRTPSNESDIVQPLTRKTFEQLPHTMRNMSVYGKTIILTGAARGLGNHMARACAEAGAKNIVLFDANQELGDEAAAELHDKTGLPVSFFKVDVRDGAAINAAVDEVVERYGAPDVLINSAGIADSNIKAETYDPAMFRRLIDINLTGSFLMSQAVGRAMMSAGKPGSIILVASMSGSIVNFPQEQSCYNASKAGVIQLGKSLAAEWAKYDIRVNCISPGYMDTALNRVPALDAQKKIWKSLTPQNRLGNVDELNGLCIYLASDSSKFMTGSNCIIDGGYTCY

SEQ ID NO: 8275 - DNA, 1293 bp, Panicum virgatum
  misc_feature: Ceres CLONE 1994228
  misc_feature: Encodes the peptide sequence at SEQ ID NO. 8276
gtccgccgccgcctcgtcttccacccggcgctgacaaagaccggcgacttattgatcttaggtgagcttacctgactcactgaggtgcctatcttcttctccccctcgtcacacctcacctgacgtcatctgattggtagatattcaggtgctttgtttactccttttaatttacccttctgatctggaactgtaagcacatatcgaaggctttctaggcgtcaatcggcctattgagctcaaagcttgtgcgacatcaatcacggttcgtcatctccacaatggaatgcataatcctgccaccgtacttggaggatgacaatgatgacggcgcacacttggattcccaattgcagtatcctgtttattcttaattttccatagtgttttgtttgtcatgcttccgaggccttatttagttcccaaaaaaatttctacggtacctgtcatatcaaatgtttaaatgtaaatattcaaatgttcggacaaaatattaaatacaggtgaaaaaaataattaattatatagtctaactaattagtacgagatgaatcttttaagattaattagtttataattagatattatttatccggtaacaaaaaatgtgctctcgtaccaaaattcaaactttttcgcgaaggtgaaggctcgagggcgtcgccatggccaagaaccctaaggttttcttcgacatcctcatcggcaaggccaaggccggccgcgtcgtcatggagctcttcgccgacaaggtccccaggacggccgagaactttcgctgcctgtgcacgggcgagaagggcctgggcgcctcggggaagccgctgcactacaagggctccaccttccaccgcatcatccccagcttcatgtgccagggcggcgacttcacccgcggcaacggcaccggcggggagtccatctacggcgccaagttcgccgacgagaacttcaagctgcgccacacgggacccggcgtgctctccatggccaacgccgggcccaacaccaacggctcccagttcttcatctgcaccgcccagaccccctggctcgacggcaagcacgtcgtcttcggccaggtcgtcgacggctacggcgtcgtgcagaagatggaggccgtcggctccgggtcaggagccacggccgagccagtcctcatcgaggattgcggccagctagccgacgaatgagtgcctccctgagtcctctcatagtggagtgcgtgtcatgtagacatgatatgaatggataaataaatttgtttgttttcaaaaaaaaaaaaaaaaaaaa

SEQ ID NO: 8276 - protein, 175 aa, Panicum virgatum
  misc_feature: Ceres CLONE 1994228
  misc_feature (1)..(167): Pfam Name: Pro_isomerase Pfam Description: Cyclophilin type peptidyl- prolyl cis-trans isomerase/CLD
  misc_feature (4)..(172): SWISSPROT Homolog: EC 5.2.1.8 Peptidyl-prolyl cis-trans isomerase
  misc_feature (4)..(172): SWISSPROT Homolog: EC 5.2.1.8 Peptidyl-prolyl cis-trans isomerase CYP19-3
MAKNPKVFFDILIGKAKAGRVVMELFADKVPRTAENFRCLCTGEKGLGASGKPLHYKGSTFHRIIPSFMCQGGDFTRGNGTGGESIYGAKFADENFKLRHTGPGVLSMANAGPNTNGSQFFICTAQTPWLDGKHVVFGQVVDGYGVVQKMEAVGSGSGATAEPVLIEDCGQLADE

SEQ ID NO: 8277 - DNA, 1772 bp, Panicum virgatum
  misc_feature: Ceres CLONE 1994260
  misc_feature: Encodes the peptide sequence at SEQ ID NO. 8278
attcttctcctaagcacacgcagcacaggtctacatcagcagctgtagcttacattcccttgcaccttcgttctatcataggctcctcattcgctggtcaaggtagcagatcatcggcctccatggacatggacatgagctcagcttatccccatcactggctctccttctccctctccaacaattaccgccatggcctccttgaggccttctccaactcgtcctccgctcctccgcttggagaagagggcgtggtggaggagtcgccgaagatggaggacttcctcggcggcgtcggcggcgcgggtgcaccgccggcaaccgccgcagaggaccagcagcttgtctgcggcgagctgggtagcatcgccgccgggttcttgcgccagtacgacccggcgcccggggcggtggcggagaaccccggcgcggtgaccgtggcgatgtcgacggacgcggcggagtccgatcaggccaggcggcccgtcgagacgttcgggcagcgcacgtcgatctaccgcggcgtcaccaggcataggtggacaggcagatacgaggcgcacctgtgggacaatagctgccgccgggaaggccaaagccgcaaaggccgccaagtctacttaggaggttatgataaggaggagaaggcggcgagagcttacgacctcgccgcgctcaagtactggggtccgacgacgacgacgaacttcccggtgtccaactacgagaaggagctggaggagatgaagtcgatgacgcggcaggagttcatcgcgtcgctgcgcaggaagagcagcggcttctcgagaggtgcctccatctacagaggagtcacaaggcatcatcagcacgggcggtggcaggcgaggataggcagggtggccggaaacaaggacctgtacttgggcactttcagcactcaggaggaggcagcggaggcgtacgacatcgcggcgatcaagttccgcgggctcaacgccgtgaccaacttcgacatgagccgctacgacgtcgagagcatcctcaacagcgacctgccggtcggcggcggggcggctggccgcgcctccaagttcccgctggactcgctgccaccggcgagcgctgctgcgatgatgatcaccggggcggcgtcgcaggccatgccgccgtccgagaaggactactggtccctgctcgccctgcactaccagcagcagcaacagcagcagtttccggcctccgcgtacgaggcatacggctccggcggcgtgaacgtggacttcaccatgggcacgagcagccacagcggcagcaacaccagcagcggcgtcatgtggggtgccgccaccaccggggcaatggggcagcaggatagcagcagcaacaagcagggcaacagcggctacgccagcaccattccttatgctgctgcagctatggtgtctggatcagctggctacgagggctccaccggcaacaacggcacctgggttacgagcaacaccagcacggctccccagtactacaactatctgttcgggatggagtaggtgaactgacaaagctaagctagctgaaatcaggtggtaggcctaggaaagctaggactgacatggaactgatcacaattttggctgctacgacgtgtgcccatgtatggatgcaatgcatccttctgctattcatgatgtttcctgacgtagtactgtagcagagaactcatgtaccatcagcatttctaaattataattcaagctctcgtttttagttaaaaaaaaaaaaaaaaaaaa

SEQ ID NO: 8278 - protein, 469 aa, Panicum virgatum
  misc_feature: Ceres CLONE 1994260
  misc_feature (1)..(74): Pfam Name: AP2 Pfam Description: AP2 domain
  misc_feature: The sequence is a functional homolog of  SEQ ID NO 1014 in the  10/225,066 US patent application
  misc_feature: The sequence is a functional homolog of  SEQ ID NO 1765 in the  10/374,780 US patent application
  misc_feature: The sequence is a functional homolog of  SEQ ID NO 2496 in the  10/374,780 US patent application
  misc_feature: Useful for making plants with modulated growth and phenotype characteristics
MDMDMSSAYPHHWLSFSLSNNYRHGLLEAFSNSSSAPPLGEEGVVEESPKMEDFLGGVGGAGAPPATAAEDQQLVCGELGSIAAGFLRQYDPAPGAVAENPGAVTVAMSTDAAESDQARRPVETFGQRTSIYRGVTRHRWTGRYEAHLWDNSCRREGQSRKGRQVYLGGYDKEEKAARAYDLAALKYWGPTTTTNFPVSNYEKELEEMKSMTRQEFIASLRRKSSGFSRGASIYRGVTRHHQHGRWQARIGRVAGNKDLYLGTFSTQEEAAEAYDIAAIKFRGLNAVTNFDMSRYDVESILNSDLPVGGGAAGRASKFPLDSLPPASAAAMMITGAASQAMPPSEKDYWSLLALHYQQQQQQQFPASAYEAYGSGGVNVDFTMGTSSHSGSNTSSGVMWGAATTGAMGQQDSSSNKQGNSGYASTIPYAAAAMVSGSAGYEGSTGNNGTWVTSNTSTAPQYYNYLFGME

SEQ ID NO: 8279 - DNA, 1458 bp, Panicum virgatum
  misc_feature: Ceres CLONE 1994282
  misc_feature: Encodes the peptide sequence at SEQ ID NO. 8280
atcactcactccagtaacagcacaagcagcaccagcactgtcctgtccaccgacgctctcaaccaacactcgctactcttgtttaattatcgttattggccgctgcctctgcggctctgctttcctccctctctcttcctcttctttttttttgatggcatcttcctcttcttcttcctcccccgtaattaggagttaggaggagttaggagctggagtactagtagttatagttagttaacgctgcctgcctgcctgcctgcctgtttgctctgcacaaagttgagcggccattgctggagtggagtagagctaggctagctgcactgcagccgccgctgcaaatcaagatcaagatcaagatgccgcacgccaagacggactcggaggtgaccagcctggcgccctcgtcgccgccgcgctccccgccgcgcacgcgccccgtctactacgtccagagcccctcccgggactcccacgacggcgacaagacggccacctccgtccactccacgcccgcgctcagccccatggcctcgccgcgccactcccactcctccgtcgggagggactcctcctccagccgcttctccggccaccccaagcgatccggctccaaggcgggggacaaggcggcgggccgcaagggcgcgccgcagggcaaggggtggcaggagatcggcgtcatccaggaggaggggctcctgctggacgacgacgaagagcacaccaggatcgtgcccaaaaagtgctactacttcctcgtcttcgtgctcggcttcgtcgcgctcttctccttcttcgcgctcgtgctatggggggccagcagatcgcagaagccgcagatcgtgatgaagagcatcaagttcgacaacttcatcatccaggccggcaccgacgcgtctcaagtgcccaccgacatggccaccaccaacgccaccgtcaagttcacctaccgcaacaagggcaccttcttcggcatccacgtcacggccgaccccttccagctctcctacacccagctcacgctagcaaacggagacctccacaacttctaccagccgcgcagcagccgccgggccgtcagcgtcgccgtgctgggcgacaaggtgccgctctacggcggcggcccgacgctgacggcggcgccgcccgccggcggcaagaaggcggccaccgccaccagcgtgccgccggtgcccatggtgcttcggacgacgctgcactcgcgggcctacgtgctgggcgcgctggtgaagcccaagttcaccctggccgtcgagtgcagggtgctgatgaaccccaccaagctcaacaagccaatctcgctggacaaggcctgccactactcctcctaataaattactcttctttttttccttcttctatctgaatgtatacatacaatatttattaattatcttcattcttcgtcgtcaaaaaaaaaaaaaaaaaaaa

SEQ ID NO: 8280 - protein, 331 aa, Panicum virgatum
  misc_feature: Ceres CLONE 1994282
  misc_feature: Great-hit functional homolog of the protein sequence encoded by LOCUS At1g45688
  misc_feature: Useful for making plants with altered cell wall content and/or composition
MPHAKTDSEVTSLAPSSPPRSPPRTRPVYYVQSPSRDSHDGDKTATSVHSTPALSPMASPRHSHSSVGRDSSSSRFSGHPKRSGSKAGDKAAGRKGAPQGKGWQEIGVIQEEGLLLDDDEEHTRIVPKKCYYFLVFVLGFVALFSFFALVLWGASRSQKPQIVMKSIKFDNFIIQAGTDASQVPTDMATTNATVKFTYRNKGTFFGIHVTADPFQLSYTQLTLANGDLHNFYQPRSSRRAVSVAVLGDKVPLYGGGPTLTAAPPAGGKKAATATSVPPVPMVLRTTLHSRAYVLGALVKPKFTLAVECRVLMNPTKLNKPISLDKACHYSS

SEQ ID NO: 8281 - DNA, 1267 bp, Panicum virgatum
  misc_feature: Ceres CLONE 1994426
  misc_feature: Encodes the peptide sequence at SEQ ID NO. 8282
catgctcgagcgcctcgcgcggtcgagagcccgagcgccgcgccgccggccacacccccccgcctttggcccttttcgcttggttccggccacgcggcgccgcctccaccaccctccttcccagtctccggtgcggcgtcgagctcccccaccaccgccttccttccccgtcttcggcggctgccgcctccgaatctagccccgcagcccgccgccaacaaatctggctttgccgaagcggcaccatgatgcccccgccgccagccctccccggccgccttcctcaaccgcccgactggcggcgccctcgccgctagtctcagtcgccccctcccaccaccaccaccgggccgtccaaggccctccctccaaggccctccctgacaacccccaaacccaaaccctaacctggcgaggaggaagttgatggtggcggcggcgctcttccccgacaagctcgcacggcgatgatggtgcggtggaggatagttggatacttgtatatgggaacctacaaccttcttaggtcaattgcccagactgcaatggcagctgtgattggcgtcaccatttccgatcgttttgtaaggttcgcctcagtgatcggtatatccatgcatcctacgttcacggcgaccagcagtgtgtggcgaggtgatgtcatcttagcagaaaggtggtgccttgagcaatacaacttctctcatggtgatgtggttttgttcaggtgccccagcaatcacaaggagttgtttgtgaagaggttgattgcgcttcctggagaatggttatggctccctgggtcccttaagataactaagatccccgaagggcattgctgggttgaaggtgataatgcttcttgcagttgggattctagggcattcgggccgattcccttaggtctggttcaggggagggtgacccacatcatctggccaccctcaaagattggccaagtggagagaaagatgcctgaagggagaatgcataaagtagttaaaccatttggattgccatttattatcagatagtttttggcagtaatgtgtatggagatttgaactgtacaagttttggggacaattttgtctaaatttctttttagtcactatgctgctgttacatatatacatgtgtaagatctttttttattttatttttgagatactctagcggagaacaacaactagggccattcataaatcctgtaaatgcatagtgaattgctagagccccagtggttgcaaaaaaaaaaaaaaaaaaa

SEQ ID NO: 8282 - protein, 188 aa, Panicum virgatum
  misc_feature: Ceres CLONE 1994426
  misc_feature (1)..(43): Pfam Name: Peptidase_S24 Pfam Description: Peptidase S24-like
MMVRWRIVGYLYMGTYNLLRSIAQTAMAAVIGVTISDRFVRFASVIGISMHPTFTATSSVWRGDVILAERWCLEQYNFSHGDVVLFRCPSNHKELFVKRLIALPGEWLWLPGSLKITKIPEGHCWVEGDNASCSWDSRAFGPIPLGLVQGRVTHIIWPPSKIGQVERKMPEGRMHKVVKPFGLPFIIR

SEQ ID NO: 8283 - DNA, 1368 bp, Panicum virgatum
  misc_feature: Ceres CLONE 1994451
  misc_feature: Encodes the peptide sequence at SEQ ID NO. 8284
tagctgctctagcgacaaaccgtaccgtacgtgcctccgaccctcttcctcaaccgcacatcacatccacgccgcctttgcagagccatggcggcggctcgcaccacccgcatcagcaggccgggcggcggcgcggccgccgccgccgcggcggtggccgtgctcgtcgtctctgctcttgcggcgaggacggagtactccggacgggagggcggcgacgacccggccgggacggcgtgcgcgcggcggcccgtggtgttcgcgttcggggactccaacacggacacgggcggcgtcgcggcggggctgggctactactacccgctcccggagggccgcgccttcttccgccgcgccacagggcgcctctgcgacggccgactcgtcatcgactacctctgtgagagcctgaacatgagctacctgagcccgtacctggaggccctgggctccgacttcaccggcggcgccaacttcgccatctccggctccgccacgctcccccgcagcgcccccttctccctccacgtccaggtccagcagttcatccacttcaagcagcgatccttcgagctcgtcgcccatggtgggagcgccccggtcgacgccgatggcttccggaacgcgctctacctcatcgacatcggccagaacgacctctccgccgcgttcgggagcggggcgccctacgacgacatcatccacctcaagatcccggccttcatctcagagataaaggacgccatcatgactctctactacaacggcgccaagaacttctgggtccacggcaccggccccctgggctgcctgccccagaagctcgccgcgcccaggcccgacgacggcgacctcgactacagcggctgcctcaagaccctcaacaacggcgcctacgagttcaacaaccagctccgcgccgcctgcgacgagctcaggtcgcagctgcgtggcgccaccatcgtctacaccgacgtgctgctcgtcaagtacgacctcgtcgccaaccactccgcctacggattcgaggagccgctcatggcgtgctgcggctacggcgggccgccctacaactacaacgcgaacgtgagctgcctcggcccgggcttccgggtgtgcgaggacggcgccaagttcatcagctgggacggcgtgcactacaccgacgccgcgaacgccgtcgtcgccgccaagatcctctccggcgagttctccacgcccaagctgcccttcgcctacttctgcaaggcatgacgacgacgggcctgcgctggcagtgcactgtgtttgataccagcaagcaaagctgagcgatttattagctgagaatccgttcgcaaccaaggcaagaaatgtgacgcatttcac

SEQ ID NO: 8284 - protein, 388 aa, Panicum virgatum
  misc_feature: Ceres CLONE 1994451
  misc_feature (1)..(256): Pfam Name: Lipase_GDSL Pfam Description: GDSL-like Lipase/Acylhydrolase
MAAARTTRISRPGGGAAAAAAAVAVLVVSALAARTEYSGREGGDDPAGTACARRPVVFAFGDSNTDTGGVAAGLGYYYPLPEGRAFFRRATGRLCDGRLVIDYLCESLNMSYLSPYLEALGSDFTGGANFAISGSATLPRSAPFSLHVQVQQFIHFKQRSFELVAHGGSAPVDADGFRNALYLIDIGQNDLSAAFGSGAPYDDIIHLKIPAFISEIKDAIMTLYYNGAKNFWVHGTGPLGCLPQKLAAPRPDDGDLDYSGCLKTLNNGAYEFNNQLRAACDELRSQLRGATIVYTDVLLVKYDLVANHSAYGFEEPLMACCGYGGPPYNYNANVSCLGPGFRVCEDGAKFISWDGVHYTDAANAVVAAKILSGEFSTPKLPFAYFCKA

SEQ ID NO: 8285 - DNA, 1253 bp, Panicum virgatum
  misc_feature: Ceres CLONE 1994460
  misc_feature: Encodes the peptide sequence at SEQ ID NO. 8286
atgctttccctgccaaatgtcgctcctggtattccattctcaatacaatttggtttggcactcaaatttggctgattggttcttggattcaggattcttggcacttgtagaatacggcgccgatcttcgattttttttgttccccctcctctatccaacttggctgaagaaatacatgcattccggccatcatcttcacagtccaccaagcatgtcgccgtcgctgctgtcgaagctgcggttggtcaccgtcgacgtgacgggcaccctgatcgcctacaggggccagctcggcgactactactgcatggcggccaaatccgccgggatgccgtgcccggactacatgcgcgtgcaccagggcttcaagctcgcctacgccgagatgagccggcggcacccgtgcttcggccacgccgccgccatgcccaacgccgagtggtggaagatgtgcgtcagggactccttcgccatggccggctacgactacgacgacgacacgttcgagcggatattccggcgcatctacgccacgttcggctcctcggcgccctacacggtgttcccggacgcgcggcgcttcctgaggtggctgcggggcagggggctcgtcgtcggcgtcgtcagcaacgccgagagccggtacagggacgtcgtcctgccggcgctggggctgaaccagggctcggagtgggacttcggggtgttctcgggcatcgtcggcgtcgagaagcccgacccgaggatctacgaggcggcgctggaggcggccgggggcgtggcgccgggggaggcgctgcacatcggcgacagcctgcgcaaggactacgcccccgcgcggagcctcgggatgcacgcgctgctgctggaccggttcaggaccgccgaggcggagagctggcggcggtccggcgcgccggtgctcccggacctcgccgccgcgcgggagtggctcgccggggatgtcatcagggaggaagcggagcctgcaacggctaggtgaaaatgaaatgcccggaaggaaaggagagcattttggaaattgaaatgctctcgcctgacaattattgcaattcctgctgctacgacggtgtggaagatgcagcgagccccagagaaaatggctggctgaatgagcgagtgctcatcgctgatgtaattagcttcaatccggaggccaatggccaatgaccagcatcgtcgtgttatcaagatgagcagttcgttcagatcaaaaaaaaaaaaaaaaaaaa

SEQ ID NO: 8286 - protein, 328 aa, Panicum virgatum
  misc_feature: Ceres CLONE 1994460
  misc_feature (1)..(214): Pfam Name: Hydrolase Pfam Description: haloacid dehalogenase-like hydrolase
MSLLVFHSQYNLVWHSNLADWFLDSGFLALVEYGADLRFFLFPLLYPTWLKKYMHSGHHLHSPPSMSPSLLSKLRLVTVDVTGTLIAYRGQLGDYYCMAAKSAGMPCPDYMRVHQGFKLAYAEMSRRHPCFGHAAAMPNAEWWKMCVRDSFAMAGYDYDDDTFERIFRRIYATFGSSAPYTVFPDARRFLRWLRGRGLVVGVVSNAESRYRDVVLPALGLNQGSEWDFGVFSGIVGVEKPDPRIYEAALEAAGGVAPGEALHIGDSLRKDYAPARSLGMHALLLDRFRTAEAESWRRSGAPVLPDLAAAREWLAGDVIREEAEPATAR

SEQ ID NO: 8287 - DNA, 1315 bp, Panicum virgatum
  misc_feature: Ceres CLONE 1994467
  misc_feature: Encodes the peptide sequence at SEQ ID NO. 8288
cccggtccattccttccaggccacctctgctccgcagctctgctcactctccccctccgagcaagtcaagcttagctaagcttaagcctaaggcaaagcttaagccatgggcaaggacgacgtgatcgagagcggcgccggcggcggcgagttcgcggccaaggactacacggacccgcccccggcgccgctggtcgacgcggcggagctgtgttcctggtcgctgtaccgcgccgtgatcgccgagttcatcgcgacgctgctcttcctctacatcaccgtggccaccgtgatcgggtacaagcaccagacggacgcggcggcgtcgggtgccgacgcggcgtgcggcggcgtgggcgtgctgggcatcgcctgggccttcggcggcatgatcttcgtgctcgtctactgcaccgcgggcatctcgggcggccacatcaacccggccgtcaccttcggcctcttcctggcgcgcaaggtgtccctggtccgcgcgctgctctacatcgtggcgcagtgcctgggcgccatctgcggcgtcggcctcgtcaaggccttccagagcgcctacttcaaccgctacggcggcggcgccaactcgctcgcctccggctactcccgcggcaccgggctcggcgccgagatcatcggcaccttcgtcctcgtctacaccgtcttctccgccaccgaccccaagcgcaacgcccgcgactcccacgtcccggtgctggcgccgctccccatcgggttcgccgtgttcatggtccacctggccaccatccccgtcaccggcaccggcatcaaccccgccaggagcctcggcgccgccgtcatctacaacaaggacaagccatgggacgaccactggatcttctgggtcggccccttcgtcggcgcggccatcgcagccttctaccaccagtacatcctccgggccggcgccatcaaggccctcggctccttcaggagcaacgcgtgatgagccagccagcttagccgccggccggccgcccttttcttactgtgttgagcttgcaaaaaggctgcgtacgtgttgaagcagatggcggcgatccacgccgggggagggagaattgtgccgctggtcgtcctgcttcagccatctgcgtgcgtgaatttggcttcctagcttttcctcctgtaatcaaccatgtgtcgtgatctgcctctcgagggattctatcctctcctcacctgctagcatttggtatctctatttaattattatgtagcgacgatcaccatcatcatcagtgaaaaccttgcttctgtctaaaaaaaaaaaaaaaaaaaa

SEQ ID NO: 8288 - protein, 290 aa, Panicum virgatum
  misc_feature: Ceres CLONE 1994467
  misc_feature: Great-hit functional homolog of the protein sequence given in SEQ ID NO 9410
  misc_feature: Great-hit functional homolog of the protein sequence given in SEQ ID NO 9486
  misc_feature: Useful for making plants with modulated cold sensitivity
  misc_feature: Useful for making plants with modulated drought sensitivity
MGKDDVIESGAGGGEFAAKDYTDPPPAPLVDAAELCSWSLYRAVIAEFIATLLFLYITVATVIGYKHQTDAAASGADAACGGVGVLGIAWAFGGMIFVLVYCTAGISGGHINPAVTFGLFLARKVSLVRALLYIVAQCLGAICGVGLVKAFQSAYFNRYGGGANSLASGYSRGTGLGAEIIGTFVLVYTVFSATDPKRNARDSHVPVLAPLPIGFAVFMVHLATIPVTGTGINPARSLGAAVIYNKDKPWDDHWIFWVGPFVGAAIAAFYHQYILRAGAIKALGSFRSNA

SEQ ID NO: 8289 - DNA, 1256 bp, Panicum virgatum
  misc_feature: Ceres CLONE 1994476
  misc_feature: Encodes the peptide sequence at SEQ ID NO. 8290
ctcgcaagatcctcaatcaatcggctcccgtgtcacctgcgcgtcagatcggcgaatcgaggtaagcaggagcagcttgggaccagatccgccgccgcgtctgtagcggaaggccatggagacgccgccgcctttccaggagtccgctcactgcgacgtgtgccgctgcaccttcagcaccttccgccgccgtcatcattgccgcagctgcggaaggacgctctgtcacgagcattcttcgtaccacatggctctaccgcagtatgggatatataccgacgtcagagtctgctacaattgcttcaacaataaatcctcgagccaaggaggagctggtaatgcgggatcagctgggagcatttctggagcagctgattcattttcagggctaagtttgggtaaggaggatgcttcgtcgcctacggagaattcaacagctcagagtgcagcacctgttattgactgcaaatgtgggatgcctttgtgtatatgcgaagcaccgaaaccggaacctgcgcctgtaaagattatcagcaccattcccacctcaaccacacaatcaaacccaaaacctaagaagcctgctagcagccaacccaaggcttcagctacttctagcagcaattcaagctcattcttgaatattggcttgatgaccaacgatagcgatgataagggtctttctgactacgaagtcagtggggagggtctgagagaagcaattaaaagcggggatgttaagggtgtaaagaaacttcttagccagggagtggattctaactactgtgacaaacaaggatttacgttgctacatttggctgcattatttaaccagactgagattgcccttattctcatggaccatggagcaaatgttcaaagcaaaaatgggcaaggggaaactcctttggactgtgctccagccatgctgcagtacaaaatgcgacaacggatggaagagctcgcggcttcacagagaccacccgagtgaagagggttcaagcattttctgctagttctgcccatccctgtttgtatcaaacatggtgtcaacgaataaaccatttaaatgacagctgaaagcttcttgctggcggtgtagtatttttgggcagtatcaagcatctagaaacgttggaacgtcagtctaagatcacgtgtgtgtgaaataattcattcagctttaaactactgtatagatcatgtatccatgtctggaaacagtgaattccctccaaaaaaaaaaaaaaaaaaaa

SEQ ID NO: 8290 - protein, 291 aa, Panicum virgatum
  misc_feature: Ceres CLONE 1994476
  misc_feature: Great-hit functional homolog of the protein sequence given in SEQ ID NO 9267
  misc_feature (5)..(61): Pfam Name: FYVE Pfam Description: FYVE zinc finger
  misc_feature: Useful for making plants with altered oil content
METPPPFQESAHCDVCRCTFSTFRRRHHCRSCGRTLCHEHSSYHMALPQYGIYTDVRVCYNCFNNKSSSQGGAGNAGSAGSISGAADSFSGLSLGKEDASSPTENSTAQSAAPVIDCKCGMPLCICEAPKPEPAPVKIISTIPTSTTQSNPKPKKPASSQPKASATSSSNSSSFLNIGLMTNDSDDKGLSDYEVSGEGLREAIKSGDVKGVKKLLSQGVDSNYCDKQGFTLLHLAALFNQTEIALILMDHGANVQSKNGQGETPLDCAPAMLQYKMRQRMEELAASQRPPE

SEQ ID NO: 8291 - DNA, 1512 bp, Panicum virgatum
  misc_feature: Ceres CLONE 1994479
  misc_feature: Encodes the peptide sequence at SEQ ID NO. 8292
accaacccagagcgagcacgagcaccaaacccaaccagaaagccaggatcccccctccccaagtacctcgcaatcgccccccggccccgccccggcccgcgcgccggcgtcctcctatgctcgccggcgaggggcgcggccgccgatgcccagcccgccgaaggaacgcccgtccggccgcctcggccgcctcctcgccgcgctccgcccctcccgcgccgggcccctccccgtccagaccggcttccccacctccctcgccgacctcgtcgtcaagaaccatggccgcctcaagaagcagccttccccgtcctccaagcgcgggatgcgcggcgccgccgcttcgccttcgccgtccccttccgtttccccctcgccggcgacatccccgccgcctgcctctccgcctccgcctcccccgccggccgccgtcgccgtctcgtcgtcggatcggccgaggcccgaccttcagctggcccggcccacccgccgcgccaaaggcggcggctttggcctcgggctgggcttcctcgcgttcagcggcgtggtgtccctcgcgctcctcgtgatctggagcaagaaggtggttgctgccgtcaccgtggcctccttctcgctcttcctgctcgagtccgcgaggccttccctgggcccccggcggccgcggccggcggcgacggacgggcggctctttttggacggccgggggcgcgtctcgccgatccgggaggtggacgcggagacggcgccgtcccggcctagctgctcggacaccgacaggggaagcgaggtctccatcctcgccgtggaacaagacagcggcgccctcgacgaaccaaccagctcgaaggcgaaggccaagacgaagaagcgttcctggaagaagctgatcgctagtaaaaaattgcacaaaggccggaagggtaaggaggcggattcccttgggtctttccgcagcgacggcgacgaagctgacgcgtcggtgcgtcgtggcaatgccacggcggcggattcgcgccgtggcacggccaatcaaacggatgccgccgtggccagagagccggattctctgagggggtctcgccgcagccaggggggcatagaggtagtcgccgcgctggtagaaatcgacgcgccggcggtgaacctcgtccaggaggaagaggagagcgaagcaggaagcaggtttcctgcggctctggtcctggtcgccgtcgccctcgccggcctggtggccgggaagctccccgccgtggcgctcacggtgctctgctacgccttccttcgctcggttcggggatcgccccgcggtggcggttgcccgccggggaggcgatccgaggtcccccatgtcgtggtaactgatgtaaattagtgagcagcgagcaaaagggaaggagaaaagatgatgcgtgttggttcagtttcagactttcagttgctgtttgtgtatgcacccccgctgctgggtgggtcggaggagcattaacttaaaaaaaaaaaaaaaaaaaa

SEQ ID NO: 8292 - protein, 409 aa, Panicum virgatum
  misc_feature: Ceres CLONE 1994479
  misc_feature: The sequence is a functional homolog of  SEQ ID NO 222 in the  10/666,642 US patent application
  misc_feature: Useful for making plants with modulated growth and phenotype characteristics
MPSPPKERPSGRLGRLLAALRPSRAGPLPVQTGFPTSLADLVVKNHGRLKKQPSPSSKRGMRGAAASPSPSPSVSPSPATSPPPASPPPPPPPAAVAVSSSDRPRPDLQLARPTRRAKGGGFGLGLGFLAFSGVVSLALLVIWSKKVVAAVTVASFSLFLLESARPSLGPRRPRPAATDGRLFLDGRGRVSPIREVDAETAPSRPSCSDTDRGSEVSILAVEQDSGALDEPTSSKAKAKTKKRSWKKLIASKKLHKGRKGKEADSLGSFRSDGDEADASVRRGNATAADSRRGTANQTDAAVAREPDSLRGSRRSQGGIEVVAALVEIDAPAVNLVQEEEESEAGSRFPAALVLVAVALAGLVAGKLPAVALTVLCYAFLRSVRGSPRGGGCPPGRRSEVPHVVVTDVN

SEQ ID NO: 8293 - DNA, 1273 bp, Panicum virgatum
  misc_feature: Ceres CLONE 1994794
  misc_feature: Encodes the peptide sequence at SEQ ID NO. 8294
gggaatccgcatccggccctgcggcggcattcaattcccctggcttgcccccgccagcacgccccgcccgctgccctgatcccgcggagccggcgaggaagcccggcgccctcccgggaccgccggtgcgtgcgtccccccgctcagtcagtgttcacatgatgtatcatgctaagaatttttctgtgccctttgctccgcagagggctcagaataatgagcatgcaagtaatattggagctattggtggaaccaacataagcaaccctgctaatcctgtaggaagtgggaaacaacgtctaagatggacctcggatctccataatcgttttgtggatgccatcgcccagcttggtggaccagatagagctacacctaaaggggtgctcactgtgatgggtgtgccagggatcacaatttatcatgtaaagagccatttgcagaagtatcgccttgcaaagtatataccagaatctcctgctgaaggttccaaggacgaaaaaaaggattcaagtgattccctctctaacacggattctgcaccaggattacaaatcaatgaagcattaaagatgcaaatggaggttcaaaagcggctacatgagcagctcgaggttcaaaggcaattgcagctgagaattgaagctcaaggcaggtacttgcaaatgatcatagaggagcaacaaaagcttggtggatcattcaaagcttcagaggatgagaagctttcacattcacctccaagcttagatgagtaccctgagagcacgcagccttctcccaagaaaccaaggatagatgcgttgtcgccggattcagagcgcgatacgactcaatccgaatttgaatcccatctgattggtccatgggatcaagaaatctgcgggaaaaacctatgcggcgttgcattcccagtggaggagttcaaagtagaccctggtatgagcaagtcataagccttccttgacgggcattcgtcagagttgacctctccactagatgatctcattcgcatgtgaatatatatcatcttaacaacagaatgttgttcggatcttccggatccgcacctgatccttgcagccatggccagttgttgtcacggtagtattcatcatacaactcttgtaattatgaggatggtgttacaaagtttctagccagcatttccttagccctgagttgaaccatgtagcaagaaagaggacatgtttacacgcaatacatttgctgtgaagagggcgtgcccccggaaaaaaaaaaaaaaaaaaaa

SEQ ID NO: 8294 - protein, 265 aa, Panicum virgatum
  misc_feature: Ceres CLONE 1994794
  misc_feature (1)..(52): Pfam Name: Myb_DNA-binding Pfam Description: Myb-like DNA-binding domain
MMYHAKNFSVPFAPQRAQNNEHASNIGAIGGTNISNPANPVGSGKQRLRWTSDLHNRFVDAIAQLGGPDRATPKGVLTVMGVPGITIYHVKSHLQKYRLAKYIPESPAEGSKDEKKDSSDSLSNTDSAPGLQINEALKMQMEVQKRLHEQLEVQRQLQLRIEAQGRYLQMIIEEQQKLGGSFKASEDEKLSHSPPSLDEYPESTQPSPKKPRIDALSPDSERDTTQSEFESHLIGPWDQEICGKNLCGVAFPVEEFKVDPGMSKS

SEQ ID NO: 8295 - DNA, 1645 bp, Panicum virgatum
  misc_feature: Ceres CLONE 1994871
  misc_feature: Encodes the peptide sequence at SEQ ID NO. 8296
atcacacacctggctcaattggtaggcagacgttgcttggcggggcggccatagctagctagctgctttgcttcctcctcctgccgctgctgctctcgtttccctgcccggcgtctgctcgcccctgcaacgccctcaggtatctcgccctgcacttattccctagcctacctagcttctacagtactagctagcgcgcaggcagccagcgaccgagctgcgagctagagagagacagaggcagtgatcggagagacagatcagaggagctcgtcttctttccgtgcgacctacttggagctcacctgcagctttgaatgctcagagcctgaaagcactcgagcagccttgtcccttgctcgcaaacccttgccgccttttggtcacctcgggctgcgcgcggagcagcacctgtgctctgctctgcctgccctgtcctccgcctctcctgttcaccgctctccctcttctcggttctcgctgccctgccaggtagggagcagcctttcctcgccggtcgccgtcctcatttatgtgctcccctctgtccactgctcgcctctctccctactactctgtgctctgcttgtgtcgtgactcgtgagtgacccgtgaccgtgagctaggaggaggaggaggaaggcggcgaccatggcgtggcgcggccggctcggggaggccggggacagcggcctcgagctcagccttggcctcccggcctacttcgccaagccctcaggtttggacgccggcgaggagcccggtgacgctgctgcttttcctctccaagctggcaaagggaacaacgatgcttccaagacgagggccaggtcagcagctgctgctccggtggtggggtggccgccggtgcggtcgttcaggaggaacctggggtcctccaggcagtcgccccagtcgtcgtccgctcaacatcaggacggcggcggcggcgccaagggaggcggcgccggcgagggcgcgcgcaagggcggcctgttcgtgaaggtcaacatggacggcgtgccgatcggccggaaggtggacctcacggcgtacggcggctacgccgagctctccgccgccgtcggcaagctcttccgcggcctgctggccgcccagaaggacccgaccgccgccgcggtgggcaggcgctgcggcgagggggcggaggaggccgaggagcccgtgatcggcggcgagtacacgctggtgtacgaggacgaggagggcgaccgggtgctggtcggcgacgtcccctgggagatgttcgtggccaccgccaagaggctgcgcgtgctcaggagctccgacctgccggcctcgtcgctgagagcaggcgggggcaggaagagggctgcagccgactgctgaagctggaccatccatgctctgttctgttccgatcgccagcttggagaaaaggtcccgggtggaggagaacgggcgtggccttgcccctttttgatgtctttccgtgttgctgctaatagtaacttgctagtaagtagtatatgggagggagggaacaagccatgacggtattagggtcatgtaatgcagtagtgttaggtgttcatgaatctatcgcctttcttgcctgcttttgagtacatctcagtggtaaaaaaaatgcggaattgtatgc

SEQ ID NO: 8296 - protein, 239 aa, Panicum virgatum
  misc_feature: Ceres CLONE 1994871
  misc_feature (1)..(198): Pfam Name: AUX_IAA Pfam Description: AUX/IAA family
MAWRGRLGEAGDSGLELSLGLPAYFAKPSGLDAGEEPGDAAAFPLQAGKGNNDASKTRARSAAAAPVVGWPPVRSFRRNLGSSRQSPQSSSAQHQDGGGGAKGGGAGEGARKGGLFVKVNMDGVPIGRKVDLTAYGGYAELSAAVGKLFRGLLAAQKDPTAAAVGRRCGEGAEEAEEPVIGGEYTLVYEDEEGDRVLVGDVPWEMFVATAKRLRVLRSSDLPASSLRAGGGRKRAAADC

SEQ ID NO: 8297 - DNA, 1717 bp, Panicum virgatum
  misc_feature: Ceres CLONE 1994907
  misc_feature: Encodes the peptide sequence at SEQ ID NO. 8298
aaccccctccgccggccgccggccgccgcctagcagcgcgcctccccaaattaactgaagcaacggcggcctcgcatttccttgctacggggaagctaacccactgccggttccatgctgaagcatggcatcttgctgagcggcaagctctcaatctatcactatcacagctccgtcatcctatctatagtctattggggcggaaagggatgatgaacttgtgactggcagactgacaagtgacaactgctgccttagcggtggtcgtcctattgctacaggggcttcgacttctaccgaaggcgtcgattaccaatcctcaatatatcttataataacaggagaaaacattgatggatgaactgtgagctaagagaagaattttgagcagggagatggtgctgatcatgaatgtctctgactatgaagagctcgcaaagcagaagctgtcgaagatgttttatgacttctatgcgtcaggtgcagaagatcagcggacactcaaggagaatagggaggcattctccagaattttgtttcgaccaagggtactgattgatgtgtcccgtatcgacatgtccctgagcgttttaggctacaacatttccatgcccattatgttggctcccacagctttgcacaaactggcccatccagaaggagaggttgcttctgcccgagctgcagctgctgcaggaactattatggtttggaagattgcaccttttattgaagaagttagctcgagtggaccaggactccgtttctttcaactttcagtattcaaggacaggaactttgtgcaacagcttgtcagaagggctgaaaacgctggctataaggcaattgcaatcactgttgatgccccacggcttggtcacagggaagctgatgtcaggaacagattctccttgcctgaaaatgtgggattgaagtgctttgaaggactggatctcagcaatatggacaagaatgtttctggccttgctgcatatgtcactagccagattgacagcgctctatcttggaaggatatcaagtggctacagatgattacccggttgcctatcttagtgaaaggagtcataacagcagaagatgctcgaattgccattgaatgtggtgttgcgggtattatcatgtccaaccacgggggacgccagctagactatcttccttcaaccatcagctgcctcgaagaggttgtcagagaagccaaagggcgtgtccctgtgttccttgacggtggcatccgccgtggcactgacgtgttcaaggccttggcattgggagcctcaggagtatttattggaaggcccgtcctgttcgccctcgccgtggacggcgagcccggtgtgaggaaggcactgcagatgctgagggacgagctcgagattgccatggcgctgagcggctgcacgtcgctgaaggagatcactcgcggccacgtcagcactgaggatgacaggatcggtcgctctcggctgtagcctcgctcttgctgttggttttgtctctgtgttaatactgaaactcgcggggctgctgaacctgagcgccatgacataaatggattcagagattcagtagcgtcagacaccagcagttcttgtgttcctggtgacctggtagattcctgcgtacacgcgcaagcatgaaggggtgattgcattcttgttgttaactcgtgactggtgaattgcagatccgtttcccg

SEQ ID NO: 8298 - protein, 364 aa, Panicum virgatum
  misc_feature: Ceres CLONE 1994907
  misc_feature (1)..(344): Pfam Name: FMN_dh Pfam Description: FMN-dependent dehydrogenase
  misc_feature (4)..(357): SWISSPROT Homolog: EC 1.1.3.15 Peroxisomal (S)-2-hydroxy-acid oxidase
  misc_feature (7)..(349): SWISSPROT Homolog: EC 1.1.3.15 Peroxisomal (S)-2-hydroxy-acid oxidase
MVLIMNVSDYEELAKQKLSKMFYDFYASGAEDQRTLKENREAFSRILFRPRVLIDVSRIDMSLSVLGYNISMPIMLAPTALHKLAHPEGEVASARAAAAAGTIMVWKIAPFIEEVSSSGPGLRFFQLSVFKDRNFVQQLVRRAENAGYKAIAITVDAPRLGHREADVRNRFSLPENVGLKCFEGLDLSNMDKNVSGLAAYVTSQIDSALSWKDIKWLQMITRLPILVKGVITAEDARIAIECGVAGIIMSNHGGRQLDYLPSTISCLEEVVREAKGRVPVFLDGGIRRGTDVFKALALGASGVFIGRPVLFALAVDGEPGVRKALQMLRDELEIAMALSGCTSLKEITRGHVSTEDDRIGRSRL

SEQ ID NO: 8299 - DNA, 1834 bp, Panicum virgatum
  misc_feature: Ceres CLONE 1994977
  misc_feature: Encodes the peptide sequence at SEQ ID NO. 8300
aaagcatctatcggtcgaccggccagctccactgtttggggaagcagcaggccaggtcgatcagcgatgatggctccaccagctgtctggcttcttcttcctctcggcctcctgtgcctgtgtagctccgccgcctctcgctccggcggcgccacggcggaggccgcagccgactacgtcgtcgtggccacgagctggctcaagacgaagccggtgtgccaagggctcagggtggatgcgccggcgaaccttaccgccagcagctgggtgccgctgagccactcctatggcccgtgctcggtggcggcagcgggaagaagttggtcgccggcgccggccgacgtgctgctgcaggaccagcaccgcgcgggctacatccagaggaagctcgccggcagcaccccccaggacgacgatgacaacaactttccgccgtcggacgtcaagactggccggtcggagtccgctgccaccattccagcaaactttggtgaagccaagaaccccatgtcagagggctccgaggcggtgaccatcttcgaacctgcggcggctggcggcgccggcgggcagcggctgccgggcgtgaagcagacgatggtgctcgacaccgccagcgacgtggcgtgggtccagtgcgccccctgccccatgccgcagtgccaccctcagacggacaccctctacgacccctcgcagtcgtcgacgtacgcgccgttcgcctgcggctcccccatctgccgtcagctcggcccgtacggcaacggctgcgccgccgggtcccggcagtgccagtaccgcgtccagtaccccgacgggcggtccaccatgggcacctacatctccgacgtgctgcggctgaaccccacgtcggtgatcggcgggttccagttcgggtgcagtcacgccgtgcagggccacttccccaacgacaccgccgggatcatggcgctcggccgcggcgcgcagtcgctggcgtcgcagaccaggatcacctacggtggcgtcttctcctactgccttccgcggacgccgagctacagcggcttcttcatcctcggcgtgccccgggtcgcctcctcccggtacgtcctcacgcccatgttcgccgtcccgcaggcgccgatgctctacctcgtccgcctccgggccatcgtcgtcgccggccagaccctcgccgtgccgccggcggtgttcgcgcccggcgccgtcgtggactcgcgcacggtgatcacgcgcctcccgccgacggcgtacgcggcgctgcgctccgccttccgggccaggatggggatgtaccgcgcggcgccgcccaagaaccagctcgacacctgctacgacttcaggggggtccgccgcgtcacgctgccgaggatcacgctggtgttcgacaacagcgccgccgtggagctcgacccgtcggggatcctcttctccgactgcctcgccttcgcccccggcagcgatgaccgggcgatgggggtcatcggcaacgtccagctgcagacgtacgaggtgctctacaatgtcgccggcgaaaccatgggcttccgccgtgccgcctgctgatgccgatgagtgcacgcgccaattcaccatggatcatgatctgctgccagatacctaccacaagcctcacacaacaaacaacctacctacctacctatatatatatatgctcacctaccgtcattttgggccattgtatggtcgcgtctgaataagccgagttaactcgtgcacatgtatttgcgtggtctatattaagcttcttatacgtgcgaaatgaagcttaagaactattttctgggcataaaaaaaaaaaaaaaaaaaa

SEQ ID NO: 8300 - protein, 500 aa, Panicum virgatum
  misc_feature: Ceres CLONE 1994977
  misc_feature (7)..(334): Pfam Name: Asp Pfam Description: Eukaryotic aspartyl protease
MMAPPAVWLLLPLGLLCLCSSAASRSGGATAEAAADYVVVATSWLKTKPVCQGLRVDAPANLTASSWVPLSHSYGPCSVAAAGRSWSPAPADVLLQDQHRAGYIQRKLAGSTPQDDDDNNFPPSDVKTGRSESAATIPANFGEAKNPMSEGSEAVTIFEPAAAGGAGGQRLPGVKQTMVLDTASDVAWVQCAPCPMPQCHPQTDTLYDPSQSSTYAPFACGSPICRQLGPYGNGCAAGSRQCQYRVQYPDGRSTMGTYISDVLRLNPTSVIGGFQFGCSHAVQGHFPNDTAGIMALGRGAQSLASQTRITYGGVFSYCLPRTPSYSGFFILGVPRVASSRYVLTPMFAVPQAPMLYLVRLRAIVVAGQTLAVPPAVFAPGAVVDSRTVITRLPPTAYAALRSAFRARMGMYRAAPPKNQLDTCYDFRGVRRVTLPRITLVFDNSAAVELDPSGILFSDCLAFAPGSDDRAMGVIGNVQLQTYEVLYNVAGETMGFRRAAC

SEQ ID NO: 8301 - DNA, 1357 bp, Panicum virgatum
  misc_feature: Ceres CLONE 1995006
  misc_feature: Encodes the peptide sequence at SEQ ID NO. 8302
gttccgttctgatccgctccgtgattttttcccccttccgccgcggctgcggccgcccgtgcagcgccgccaagagccagcgccccagcgagcccccagagcggagccgagcatctggtcctactcctatcgcggcggcgcctgctcgtatacgccgccgcaggggaactgaagagccggttaatactcagcaaccgccgcctccaacttacgcgccgctgttggaggcgtataaacaaacccacgcctccacgtcccatccatctccatcccgtccatcgccactcctagctagctcctggatcgatcccaatccctacccggaaccttccattccgttctctaatttcttggccgtccgatcgatcgccggccgccttctggatcaccctcgatctcacctctcgccaaccccggcccgttcatcttctccgttttccggcgcgcgcgcattgcgtatcctacggcgggcgggcggggcggcatggatcatcaggaccacctgagccccgccccgagcgcgcgcggcgccggcggcggcgggtctggcggcgtccgctgggagccgcacgggcggttgctgacggcgtgcctggtcgcgctcaacgtcttcctcgtcctcctcgtctacgcctacttctggcgcttcttctcccgcgcgcgcggcggcgggggcgacggcggggacgccgaggcggcgtcctcctcctccgcggcctcgtcgccgccggcgtcgcccaaggcccgggaccggcgggaggtggagcgcgccatcaccgcactgcccgtcttcgtcgcgcgcccctcctccccctccggtggcggcgcggcggccgagtgcgcgatctgcatcgcggagctggcggacggcgaggagggccgcctgctgccgcggtgcgggcacaggttccacgcgcgctgcgtcgacgcctggttccgcttccacaccacctgcccgctctgccgctccaccgtcctcgtcgaagaggacgacccggcggcgcctgctgcgaccacggcgagccagccccagccgtcgcgtcgccatggggacagtacggatctgagtacggacgcggtttcggattctccggtgtgacaacctaaccggccgccggcgatcgatcagtttttttaggctttccgtggattgggagagagaggaggccaggctgctgacgcaagcagccgcacctcagttcttgcatgtttttgcattgggtggattgatcaagacatcagcttcttcgttaactactggcatttccatggtgtgtatgcatttgtgagctaaatagctgtaggtgtaaatggatgcagtacaatttgtacccgtcaaaaaaaaaaaaaaaaaaaa

SEQ ID NO: 8302 - protein, 204 aa, Panicum virgatum
  misc_feature: Ceres CLONE 1995006
  misc_feature (1)..(42): Pfam Name: zf-C3HC4 Pfam Description: Zinc finger, C3HC4 type (RING finger)
MDHQDHLSPAPSARGAGGGGSGGVRWEPHGRLLTACLVALNVFLVLLVYAYFWRFFSRARGGGGDGGDAEAASSSSAASSPPASPKARDRREVERAITALPVFVARPSSPSGGGAAAECAICIAELADGEEGRLLPRCGHRFHARCVDAWFRFHTTCPLCRSTVLVEEDDPAAPAATTASQPQPSRRHGDSTDLSTDAVSDSPV

SEQ ID NO: 8303 - DNA, 1167 bp, Panicum virgatum
  misc_feature: Ceres CLONE 1995030
  misc_feature: Encodes the peptide sequence at SEQ ID NO. 8304
gtcttctcaggagcagcagcaacccaagcaagcagcagcccatactcctcatcacctcatcctcctgcgcagtgcgcgcagctcgctagctgctagccatggctaaagagctccaagaaacctcctcctcctctgccaccaccacctcgtcgtgtaccacctcctgctgctcgtccaccgtgacggactcgtcttcctcgcccccgtcgcctgcggcggccaatgccgcgcccgcgccacggaagcggcaggcggtggaggcagaggccgaggccgaggtgggtggggaggaggaggaggaggaagagttcgcgggtaagacggcggcggcagccaagaagaggaagcggagcagcgaggggaagcacccgacgtaccgcggcgtgcggatgcgggcgtggggcaagtgggtatcggagatccgcgagccccgcaagaagtcgcgcatctggctcggtacgttccccaccgccgagatggccgcgcgcgcccacgacgtcgccgcgctcgccatcaagggccgcgccgcgcacctcaacttcccggacctggccggagtgctcccgcgcgccgcgtctgcggcgcccaaggacgtccaggccgcggccgcattggccgccgcgttcgagtcgccgtcgtcggagcccggggccggggcgacggagccgtgccacgcccaagaagagcccgcaaccaagaacgtcgccgccgcgcccgaggaggccgccgccgaggcaccggtaccaccgccggtctcccaaccggcgacgcagtcgagcagcgtagaggaggagcgccagctgttcgacctgccggacctgctcctggacatccgggacgggttcgggtgcttcccgccgatgtgggcgccgctcgccgatgtggaggaggtcaatgcggagctgcgcctcgaggagccgctgctttgggagtagcagtcagagatgcttgcgttgcaaagactaaacaaccgtagtactagcctatctcttcttcttcctctctctttttagtttactctgaagaaaagcagctacttttcctcttcttctttctactgggttaataagtataaacatatataaacgagagatataagccatgtacttataagagtaagtacctactaccagtcaattatcactgcaaaaaaaaaaaaaaaaaaaa

SEQ ID NO: 8304 - protein, 278 aa, Panicum virgatum
  misc_feature: Ceres CLONE 1995030
  misc_feature: Great-hit functional homolog of the protein sequence given in SEQ ID NO 9466
  misc_feature (1)..(64): Pfam Name: AP2 Pfam Description: AP2 domain
  misc_feature (1)..(65): Pfam Name: AP2 Pfam Description: AP2 domain
  misc_feature: Useful for making plants with altered Lignin content
  misc_feature: Useful for making plants with modulated biomass
  misc_feature: The plant is abnormally small.
MAKELQETSSSSATTTSSCTTSCCSSTVTDSSSSPPSPAAANAAPAPRKRQAVEAEAEAEVGGEEEEEEEFAGKTAAAAKKRKRSSEGKHPTYRGVRMRAWGKWVSEIREPRKKSRIWLGTFPTAEMAARAHDVAALAIKGRAAHLNFPDLAGVLPRAASAAPKDVQAAAALAAAFESPSSEPGAGATEPCHAQEEPATKNVAAAPEEAAAEAPVPPPVSQPATQSSSVEEERQLFDLPDLLLDIRDGFGCFPPMWAPLADVEEVNAELRLEEPLLWE

SEQ ID NO: 8305 - DNA, 1733 bp, Panicum virgatum
  misc_feature: Ceres CLONE 1995091
  misc_feature: Encodes the peptide sequence at SEQ ID NO. 8306
aagcctcgacgcgttccgccccgtgagccagcgccaggcgcccctctccggttgggtgcggccgggttcgggtctcgacgccgccgcagacgacccccccccccccctgcccatctcggcgggcggcgggagatcgcgaccacgagatggaaagccatagttcatcacatcctcagattgctgaagtgaaaatggacatctcaccatcagcttctggagcagcagggaacaaaatctgcagaggtgctgcctgtgatttctctgattccagtaacagctcgaaagatgccaaggagagatccgcatccatgaggaagcttataattgctgtgatcctttgcttcgtattcatgacagtggaagtggttggaggcatcaaagcaaacagtcttgcaatcttaactgatgcagctcatcttctttctgacgtggcagcttttgccatatcattattctctctttgggctgctggatgggaagcaacaccacaacagtcttacgggttctttcgtattgagattcttggtgcattggtctccattcagctcatatggctgcttgctggcatactcgtatatgaggctattgtaaggctcattaatgagagcggtgaggtgcagggctccctcatgtttgctgtatcagcttttggattgtttgtcaacatcataatggctgtactgctagggcatgatcatggacacggccatggccatggccatggacattcgcatgatcatagccatggtgattcagatgatgaccattcacaccatgaagaacaagaacagggccatgtgcatcgccacgagcacagccatggaagttctattactgtcacaacccatcaccaccaccacccaagcactggacaacatcatgatgctgaggaaccattgcttaagcatgaagccagctgtgagggcacccaatctgctgccaaaccagctaagaaacctcgccgcaatatcaatgtacacagtgcttatcttcatgtgcttggagattcaatccagagcatcggggtaatgataggtggggctatcatctggtacaagcctgagtggaagatcatcgatctcatctgcaccctcatcttctctgtggttgtactgtttaccacaatcaggatgctgcgcaacatacttgaagtactgatggagagcactccccgtgagattgatgccaccaggctcgagatggggctctgcgagatggatggtgtggttgctgtccacgagcttcatatctgggccatcacagtagggaaggtgctcctagcatgccatgtgacaatagcaagggaagccgatgccgatcagatccttgacaaggtgatcggatacatcaagacagagtacaacatcagccatgtgaccattcagattgagcgtgagtagggatataaagggtgtcttcgctggttatcttgttcatgtcagttaatactgctttttgcaccgggtaaggcatcagccactcaaccgagccataatgtgctcacaggttcatcagctttgatgctggttaatataatctattactagtctattaggtgaaggagttattcgggtggcgtagttgtcggtctgtgcattcacatggatgaatttttcggacatgttgtgagttcatcgaattgcatctgtagtgagaaataatttagcaacctgtgtcgtcacctttgtgtaagataatgtttatggcatgaaaggtatgaagttagtgagtgg

SEQ ID NO: 8306 - protein, 417 aa, Panicum virgatum
  misc_feature: Ceres CLONE 1995091
  misc_feature (1)..(361): Pfam Name: Cation_efflux Pfam Description: Cation efflux family
  misc_feature (1)..(364): Pfam Name: Cation_efflux Pfam Description: Cation efflux family
MESHSSSHPQIAEVKMDISPSASGAAGNKICRGAACDFSDSSNSSKDAKERSASMRKLIIAVILCFVFMTVEVVGGIKANSLAILTDAAHLLSDVAAFAISLFSLWAAGWEATPQQSYGFFRIEILGALVSIQLIWLLAGILVYEAIVRLINESGEVQGSLMFAVSAFGLFVNIIMAVLLGHDHGHGHGHGHGHSHDHSHGDSDDDHSHHEEQEQGHVHRHEHSHGSSITVTTHHHHHPSTGQHHDAEEPLLKHEASCEGTQSAAKPAKKPRRNINVHSAYLHVLGDSIQSIGVMIGGAIIWYKPEWKIIDLICTLIFSVVVLFTTIRMLRNILEVLMESTPREIDATRLEMGLCEMDGVVAVHELHIWAITVGKVLLACHVTIAREADADQILDKVIGYIKTEYNISHVTIQIERE

SEQ ID NO: 8307 - DNA, 1593 bp, Panicum virgatum
  misc_feature: Ceres CLONE 1995174
  misc_feature: Encodes the peptide sequence at SEQ ID NO. 8308
atcgccagctgctcctcagcaccacgaggatcggatcgatcggaggcaatggcgacggtggaggtgttgacgtcggaggtggtcgtgccagccgaggagacgccgtcgggcggcctctggctgtccaacctggacctcgccgcgcgccgcgggtacacgcccacggtgtacttcttccggtccaacggtgagccggggttcttcgccgcggacaccgtcaagggcagcctcgccagtgcgctggtcgcgttctacccgcttgccgggcgtctcggcgtcgacggcgccgggcgcgtccaggtcgactgcaccggcgagggcgcggtgttcgtgaccgcgcggtcggggtacgcgctggacgacctgatgcgcgagttcgtgccgtgccgcacgatgcgggacctgctcgtgcccgcgacgcccacgccggacccgccgtgcgcgctgctgttcgtgcaggtcacgtacctgcgctgcggcggcgtcgtgctggggcaggcgatgcaccactcggtgtgcgacgcgcggggcgccgcgcatttcttcgagacgtgggcgagcatcgcgcgcggggacgccgccgcggacgcgcccgtgccgccgtgcttcgaccacggcctgctcgcggcgcgccccggccccgcgcgcgcggtgctgtacgaccacccggagtacaagcccgacccggagccgccggtggacgccgccggcgggtccgactacgcgagcgccatcctcaccatgaccagggcgcaggtgggcgcgctcaaggcgcggtgcccgggcgcgtccacgttccgcgccgtggcggcgctggtgtggcggtgcgcgtgccgggcgcgggcgctgcccccggaggcggagacgcggctctactccatgatcgacatgcgcgcgcgcctggacccgccgttgccggcgggctacttcggcaacgcggtggtgcgcacgtcggtctccgccacggccggggaggtgctgtccaacccggtcggccacgccgcgcggcgcgcgctcgcggtgacgagccagggcggcgactacgcgcggtcgctggtggactacctggagggcgtggacgccatggacctgccccggagcggcatctcgcgggcgcacctgcgcgccatcagctggatgggcatgtcgctgcacgactccgacttcggctggggcgcgccggcgttcatggggccggcgctcatgtactacagcggcttcgtgtacgtgctgaacgcggcgggcaagggcggcggcctcgcgctcgtgctgtcgctggagcccgagaccatgccggagttcaggaaggtcttcgccgaggagctcgcgcgcctggaggttgtgtaggggtatgcacaactgcgtatattactgttgaatgttgattcatggcgttccgtggaaggttacgaacgtccatggcatattgttgtacatgcacgtgagcgagacagactgttcagttctaagatgtgaagtctttggatgccaagtcatgcgtgaatgtttgaatgtctatatgggtttcaatatatataaccaataaactgaacacatttttttttttgatactaaaaaaaaaaaaaaaaaaaa

SEQ ID NO: 8308 - protein, 432 aa, Panicum virgatum
  misc_feature: Ceres CLONE 1995174
  misc_feature (1)..(427): Pfam Name: Transferase Pfam Description: Transferase family
MATVEVLTSEVVVPAEETPSGGLWLSNLDLAARRGYTPTVYFFRSNGEPGFFAADTVKGSLASALVAFYPLAGRLGVDGAGRVQVDCTGEGAVFVTARSGYALDDLMREFVPCRTMRDLLVPATPTPDPPCALLFVQVTYLRCGGVVLGQAMHHSVCDARGAAHFFETWASIARGDAAADAPVPPCFDHGLLAARPGPARAVLYDHPEYKPDPEPPVDAAGGSDYASAILTMTRAQVGALKARCPGASTFRAVAALVWRCACRARALPPEAETRLYSMIDMRARLDPPLPAGYFGNAVVRTSVSATAGEVLSNPVGHAARRALAVTSQGGDYARSLVDYLEGVDAMDLPRSGISRAHLRAISWMGMSLHDSDFGWGAPAFMGPALMYYSGFVYVLNAAGKGGGLALVLSLEPETMPEFRKVFAEELARLEVV

SEQ ID NO: 8309 - DNA, 1817 bp, Panicum virgatum
  misc_feature: Ceres CLONE 1995298
  misc_feature: Encodes the peptide sequence at SEQ ID NO. 8310
actctctcctcagcatcccctttttcgtcttccctaccagatctccaccagccttttctgctcccgggcgtattcttttctcatctcctcttccgcccgaatagacgcctgcgctgcgtagagacgcgtccgtccatcatgaagttgcacgttttcatggccgcttttgccacctcggccctggcttctcccttcttccgccctggcgcggtgaaccacgaggacgtgcctgttatttcgtctgtcaacacgcagaccgtgcccgacaactacattgtcttcctcaaggagcacgtcagcggccgtggcgccgacgcccaccagaactggctcaagacgctcgccaacaactaccgcctcgagctccggaagcgctcggatgacaccaaggtctactctgggctcaagcacacgtatgacatcaacggcgccgttctcggctactctggccactttgatcccgagactgtcgacgagattcgccgccatcccgacgtcgcacacattgagctcgactcggtcgtctccatcctcgacagcccagagccagtcacccaggaaaactgcccctggggccttgcccggatcagccaccgcaagaagctctcctttgacaccttcagcgagtacctctacgccgagtcggctggagagggcgtcgacgtgtacgtgatcgacaccggcacctttgtcgaccacgccgactttggcggtcgcgccaagtggggcgccaccatcccccagggcgacgccgacattgacggcaacggacacggcacccatgcctcgggctccgccgtcggcaccaaatttggtgttgccaagaagtcgaacctctacgccgtcaaggtcctccgctccaacggatccggaaccatgtcggacgtgatcaagggagtcgagtgggtcgtcaaggctcacctcgaaaaggccgccgaggccaaggccggcaagatcaagggcttcaagggctccgtcgccaacatgtcgctcggaggtggcaaggccaccgccctcgaccggatcgtcaacgctgcagtcgacgccggcgtccactttgccgtcgctgccggaaacgacaatgccgacgcctgcccctactctcccgccgctgccgagaaggccgtcactgtcggtgcttccaccctcggtgacgagcgtgcctacttctccaactacggcccctgcgtcgacatctttgcccccggtcacaacatccagagcgcctgggttggcagcaagtatgcgaccaacaccatctcgggtacctcgatggcctctcctcacattgccggccttctcgccacctatcttgctctccagcctgaggccgactcgtcctactacgtagaggccatcacccccgccaagctcaaggacgctctgctgtcggttgcgaccgaggatgcccttaagaaggtgccctccgacacccccaacctgctcgcctggaacggcggtggaaactccgactttgccgacattgtttcccggggcggatacaaggccaagaagggcaaggcttctccgtcgaagccgcacggctcgattgcgtctggcgtgacggagattctcgacgaggccaagcgccagcttgaggagctcagccggactgtcgtcgagtcgctcgagtagacggggccacggagccggtctgcgactgaccaatttctaacacactacctttgagcatacgcatattctactttattcttctttcattttaccttttgttttttgtttgcatggattttttttatacttggcattattgaatgatttatttattcgacatgtaaaaaaaaaaaaaaaaaaaa

SEQ ID NO: 8310 - protein, 498 aa, Panicum virgatum
  misc_feature: Ceres CLONE 1995298
  misc_feature (1)..(283): Pfam Name: Peptidase_S8 Pfam Description: Subtilase family
  misc_feature (38)..(442): SWISSPROT Homolog: EC 3.4.21.48 Cerevisin precursor
MKLHVFMAAFATSALASPFFRPGAVNHEDVPVISSVNTQTVPDNYIVFLKEHVSGRGADAHQNWLKTLANNYRLELRKRSDDTKVYSGLKHTYDINGAVLGYSGHFDPETVDEIRRHPDVAHIELDSVVSILDSPEPVTQENCPWGLARISHRKKLSFDTFSEYLYAESAGEGVDVYVIDTGTFVDHADFGGRAKWGATIPQGDADIDGNGHGTHASGSAVGTKFGVAKKSNLYAVKVLRSNGSGTMSDVIKGVEWVVKAHLEKAAEAKAGKIKGFKGSVANMSLGGGKATALDRIVNAAVDAGVHFAVAAGNDNADACPYSPAAAEKAVTVGASTLGDERAYFSNYGPCVDIFAPGHNIQSAWVGSKYATNTISGTSMASPHIAGLLATYLALQPEADSSYYVEAITPAKLKDALLSVATEDALKKVPSDTPNLLAWNGGGNSDFADIVSRGGYKAKKGKASPSKPHGSIASGVTEILDEAKRQLEELSRTVVESLE

SEQ ID NO: 8311 - DNA, 1241 bp, Panicum virgatum
  misc_feature: Ceres CLONE 1995393
  misc_feature: Encodes the peptide sequence at SEQ ID NO. 8312
tagtcggtgtgggggcggtgctgcgtgagtgcgcgctcctccctcttccgttgggcaggaggactcctcgtcgccgcctcactactccaatctccatcgccattgccggcacaagcaaggatggcggggcgctacgacagcaaccccttcgaggaggaggacgtgaaccctttctcggaacaagcgcgtggcaagtctggcgggcagtccaactttggcggcggagcgttctacatgccgaaccccagaaacgttgctcccgcatccaattcacgtctttcgccgcttcctcctgaacccgcagacttcagtgccacagtggatataccacttgactcatcaaaggaccttaagagaagggagaaggagctgcaagcaagggaagcggagttgaacaagagggagaaggaattgaaaaggagagaggaggctgcagcacgagctggtattgtcattgaggagaaaaactggcctcctttcctgccactcatccatcatgatatcaccaatgagattccaagccaccttcaaagaatgcaatattttgcatttgcatcgtttcttgggttggtttgctgcctgttctggaatgtcatagcagttactacagcttggatcaagggggaaggtgttaagatctggttgttgtctataatctacttcatatctggtgttcctggtgcctatgttttatggtatcgccctctgtataatgccatgaggactgatagcgcattgaagtttggattgttcttcttgctttacttgttccacattcttttctgtgtgttctctgctgtggctccccctgttgtatttgagggaaaatcattggcaggaattttgccagcaattgatcttctcagcgtgaatgctttggttgggatcttctactttgttggatttggattgttctgtctcgagtcattgctcagcatctgggtcatccagcaagtgtacatgtacttccgaggcagtggaaaggcagcagagatgaagcgtgatgcgacaaggagtgccatgagagccgcattctaaatgtggcggagtacatttcagataacagtcccaagcgtatacttaccgtggataggttgtgctacaaatgaaagtatatgtttcctccaaaattatcagtaggttatcatggtgttgcaagtgacattattgactcgccatcttcttttttaacctatatagagaatgtgcagcttttatagcaaaaaaaaaaaaaaaaaaaa

SEQ ID NO: 8312 - protein, 305 aa, Panicum virgatum
  misc_feature: Ceres CLONE 1995393
  misc_feature: Great-hit functional homolog of the protein sequence given in SEQ ID NO 9429
  misc_feature: Useful for biocontainment applications
  misc_feature: The plant produces a reduced number of seeds.
MAGRYDSNPFEEEDVNPFSEQARGKSGGQSNFGGGAFYMPNPRNVAPASNSRLSPLPPEPADFSATVDIPLDSSKDLKRREKELQAREAELNKREKELKRREEAAARAGIVIEEKNWPPFLPLIHHDITNEIPSHLQRMQYFAFASFLGLVCCLFWNVIAVTTAWIKGEGVKIWLLSIIYFISGVPGAYVLWYRPLYNAMRTDSALKFGLFFLLYLFHILFCVFSAVAPPVVFEGKSLAGILPAIDLLSVNALVGIFYFVGFGLFCLESLLSIWVIQQVYMYFRGSGKAAEMKRDATRSAMRAAF

SEQ ID NO: 8313 - DNA, 1115 bp, Panicum virgatum
  misc_feature: Ceres CLONE 1995398
  misc_feature: Encodes the peptide sequence at SEQ ID NO. 8314
agcccaacgctgcaaagaggcgaggtgggagagagagagagagttctcgagctcggcgagcgccgcgcgaggagagagaagtaagatgagcggagaggcgccggccgtcggtggcggcggaggggaagcgaacggcatcccaccgaacgtcaccatctacatcaacaatctcaacgagaagatcaagctcgatgaacttaaaaagtccctcaacgctgttttttcccagtttgggaagattcttgatgtgcttgctttcaagactctgaagcataaaggccaagcatgggttgttttcgaagatgttgcatcagcaactgaggctataaagaggatgcaagactttcccttttatgacaaacctatgaaaattcaatatgccaagaccaaatcagatattgtagcaaaagctgatggcacctttgtccctcgagaaagaaggaagagggttgatgaaaaacctgaaaagaagcagaagcgcgagcagcaccatgatgctagtcaaattggcatgggtgtacatgcctaccctggtgtttatggggctcctcagctcacccagttaccggtagctggaggacagagagtcatgatgccagagattattgtaccaaacaacatcctcttcgtccaaaatctgccacacgagacaacccccatgatgctgcaaatgctcttctgccagtaccctggcttcaaggaggttcggatggttgaggcaaagcctgggatcgcttttgtggagtatggagacgaggcgcaggccaccgctgccatgacccatcttcaaggctttaagatttcaaaagagaaccagatggtcatcacttacgcgaagaagtagcgaactcgcgagctgtattgacttgattgaaatgttgtatctggagttttgcgcaattggtagatccccttggcttgttaggtagactgcatcttggatattctgttacttgtatcgcttagttgcggttatgtgccacttcagcaacagagatgaaatggaaactgccttttcttgctcatgcaatcaatgtagcgactgcttcactgaatctggtatttgtttagagaagtaatataatgctccctaacaaaaaaaaaaaaaaaaaaaa

SEQ ID NO: 8314 - protein, 252 aa, Panicum virgatum
  misc_feature: Ceres CLONE 1995398
  misc_feature: Great-hit functional homolog of the protein sequence given in SEQ ID NO 9518
  misc_feature: Useful for making plants with modulated nitrogen use efficiency
  misc_feature: Useful for making plants with modulated nitrogen use efficiency
MSGEAPAVGGGGGEANGIPPNVTIYINNLNEKIKLDELKKSLNAVFSQFGKILDVLAFKTLKHKGQAWVVFEDVASATEAIKRMQDFPFYDKPMKIQYAKTKSDIVAKADGTFVPRERRKRVDEKPEKKQKREQHHDASQIGMGVHAYPGVYGAPQLTQLPVAGGQRVMMPEIIVPNNILFVQNLPHETTPMMLQMLFCQYPGFKEVRMVEAKPGIAFVEYGDEAQATAAMTHLQGFKISKENQMVITYAKK

SEQ ID NO: 8315 - DNA, 1235 bp, Panicum virgatum
  misc_feature: Ceres CLONE 1995420
  misc_feature: Encodes the peptide sequence at SEQ ID NO. 8316
acgccgcgccggtttcaccgaagcgtctcttctcttctctttgctcgcgccagcgccagccaagccaggaggagggctcgtgtttttatagcccagccgcctgccctgcctgccgtccttggagatccagcagatcatccatcgccgtgtaaggctccgggattcgaggaggaggaggatactgcacgcacggtcggcacaagaaagagcggaaggaatggacaaggccaagacgcggtgcgagctgtgcggcggcgcggcggccgtgcactgcgccgcggactcggcgttcctctgcctgcgctgcgacgcgcgggtgcacggcgccaacttcctcgcgtcaaggcaccgccgccgccgcatcaacctcgacctcgacctcaacctcacggccgagccagccaccgagtcctcttcctcctcggcgtcctccagctcctgcgtgtccgcggcggactccgcggaatccaccgccgcggcagcagcgcctgcgagcagggggcggaggaagcagagcgcggaggcggtgctggagggctgggccaagcggatgggcttcgggcccggggccgcgcgccggcgtgccgcggcggctgcgggcgcgctccgtgcgctgggccggggcgtggccgcggcccgcgtgccgctccgcgtggccatggccgccgcgctctggtcggaaatctcatcctccgcctccgcggccagctgctgcaagggaggtaataaaggaggaggaggcgacggcgccgcgctgctgtgccggctggaggccacggcgcacgtgccggcgcggctcgtggtgaccgtggcgtcgtggatggcgaggacccggcagccagccgccgccaccgccgaggaggaggagggatgggccgagtgctcctcctgatccgatcctcctccgtctgcagggccctaccacacgatcgccggtgcaagtccgtcgctgtacaccacaaccgccagctgcctgagatagaatgtagtagcagtgatcgttcatgtggtcaacgtttgtttgttcttttcttccctgattaagcaaaagaagattaaccataaacaagctactacgtagtaaggatcatcatcatgtggttaggaggaagagggagtggcgagatgaggccccaaccgatccaaccggatgggagtgtgtaacgagccggccctcttgtcatttttttaattattaacagaattattaaaggcaaaaaaaaaaaaaaaaaaaa

SEQ ID NO: 8316 - protein, 224 aa, Panicum virgatum
  misc_feature: Ceres CLONE 1995420
  misc_feature (6)..(47): Pfam Name: zf-B_box Pfam Description: B-box zinc finger
MDKAKTRCELCGGAAAVHCAADSAFLCLRCDARVHGANFLASRHRRRRINLDLDLNLTAEPATESSSSSASSSSCVSAADSAESTAAAAAPASRGRRKQSAEAVLEGWAKRMGFGPGAARRRAAAAAGALRALGRGVAAARVPLRVAMAAALWSEISSSASAASCCKGGNKGGGGDGAALLCRLEATAHVPARLVVTVASWMARTRQPAAATAEEEEGWAECSS

SEQ ID NO: 8317 - DNA, 1386 bp, Panicum virgatum
  misc_feature: Ceres CLONE 1995551
  misc_feature: Encodes the peptide sequence at SEQ ID NO. 8318
aacatcatcgattcatttcattgccagcagcaacagcaaccaactagcagctagtgctacgacctgcaaccaagcaagcaagcaagctctctctcccattccctcctcaagcaaagcaacatccatctccctctgcttgccggcatctggtctgcagctgcagtgaccggaccgtcggagaacgaacccgtggaacccgccgagtccgtggagcctgaacccggaatcccgttcgtggtcgagtcggaagctaaccaaggtgagccggaagtggtgttcggccatttctaccccgctgatcctaatgcgggggaagagtaggctgttgctgctgtggtgatgtccttgagcaaggcatcatcatcttaattggaatcggccgcggcttcttcgatctcacccatattatcataattattgttaatccacacgtacagcgcccggccgggatggcagatgcgatcaagaatgaagttggatcatttcctcctgggaagaagataactgttgtgtttgtcataggtggccctggcagtggcaagggtactcagtgttccaagatcgtcaaacactttggcttcacccatctcagcgctggcgatcttctgcgtgaggaagctaaatatgacactgaacagggcatgatgataaagaatacgatgcatgaaggaaagctcgtgccatcagagctaatcgtcaagctactgttgaaggccatgcttcaaagtggaaatgataagttccttgttgatggatttcctcgaaatgaagagaaccgtcaagcgtatgacagcatcattagcattgaacctgagtttgtactgttcatcgactgcccaaaggaagagatggagcgtcgcattctaaaccgaaatcaggggagagatgatgacaacattgacaccgcaaggaggcgctttgaagttttccgggagtcgactatgcctgttgttcagtattatgagaaaagggggaaacttagaagggttgatggtgctaaatccgttgatgaggtttttgaagatgtgaaggccatatttgtgcagctgaacacccaggcaaaccaaggtggcaatgtgagcagtgcacagagcaatccattcaagcggttccttgacctattctgtggatgctttgggacgcaggaggcaacaaactgacccaaatgggatgattgtgtggtagtggggtgtgtgtgtgtgtgtatatatatatatatccttgctcagtcctcaaggctggagcaacatacagaaaagattcagaaaacatttgctgtggcttaagtgttgtgaaccatccattgccagagtgttatgtaaaactagaaaagaaacagttggctgaaaagagaatggccttgcgcaaaaaaaaaaaaaaaaaaaa

SEQ ID NO: 8318 - protein, 236 aa, Panicum virgatum
  misc_feature: Ceres CLONE 1995551
  misc_feature (1)..(154): Pfam Name: ADK Pfam Description: Adenylate kinase
  misc_feature (20)..(201): SWISSPROT Homolog: EC 2.7.4.3 Adenylate kinase
MADAIKNEVGSFPPGKKITVVFVIGGPGSGKGTQCSKIVKHFGFTHLSAGDLLREEAKYDTEQGMMIKNTMHEGKLVPSELIVKLLLKAMLQSGNDKFLVDGFPRNEENRQAYDSIISIEPEFVLFIDCPKEEMERRILNRNQGRDDDNIDTARRRFEVFRESTMPVVQYYEKRGKLRRVDGAKSVDEVFEDVKAIFVQLNTQANQGGNVSSAQSNPFKRFLDLFCGCFGTQEATN

SEQ ID NO: 8319 - DNA, 1662 bp, Panicum virgatum
  misc_feature: Ceres CLONE 1995643
  misc_feature: Encodes the peptide sequence at SEQ ID NO. 8320
ggtagagagagaatcgggagagaagggagggcgagcgaggccgccgccaccgacatcgcctggtaacccgtcgtccacccacccacccacattccccgaacaccacgccgctgccaccgcgcgcattctccccgatccaaccgcaccaagagggggcaaggaagaagaaaggagggagacggggataccatgtcgtcgccctcgccggcgcccgcccgcatggatctggacggcaaccccgtcgcgcccctcaccatctgcatgatcggcgcgggtggcttcatcggctcccacctctgcgagaagctcatggccgagaccgcacacgtcgtcctcgccgtcgacgtctactgcgacaagatccgccacctcgtcgaccccgcgccgccgcacctcgccggacggatctccttccaccgcctcaacatcaagaacgactccaggctcgagggactcatcaagatggccgatctgactataaacctggcggccatctgcacgcccgccgactacaacacgcggcccctcgacaccatctacagcaacttcatcgacgccctcccagtggtcaagtactgctccgagaacaacaagcgtctcatccacttctccacctgcgaggtctacggcaagaccgtcggcagcttcctccccaaagaccaccctctccgcaaggaacctgaattttatgttctaaaagaagatgagtcgccctgcatttttggtccaatcgtgaaacagcgatggtcctatgcatgtgcaaagcaacttattgagaggcttatttttgctgaaggtgcagaaaatggacttgagttcacaattgtgagacctttcaattggattggaccaaggatggacttcattcctggtgttgatggccctagtgagggtgtacctcgggttttggcctgcttcagtaacaatctgctccgccgagagcccttgaagcttgttgatgggggccagtcccaaagaacttttgtctacattaaggatgccatcgaagctgttgttttgatgattgaaaatcctgctcgagctaatggtcacatcttcaacgttgggaatcctaacaatgaagttactgttagggagttggcccaaatgatgacagaggtctatgcaaacgtctcaggagaggcaccactagatgaacccatgattgacgtgagttcgagtcagttctacggtgaaggatatgatgatagtgacaagagaatccctgacatgactataatcaacaagcagctaggttggaatccaaagacacctctcaaggatttgctggagacaacattgacatatcagcacaagacatacaaggaagctgtgaaaaggcaaatggcacaggcttcagcgtcgagttgatgtattctatccattgtactttgattgctcctctgtgctgtgtcaagtcattctttggaatcatttcattggcgagagttgttattgttcgtatgttgcaacctgagtgagtgagattattaattagttgggcgcacatttctctgctgggtagcaatactatatcatattatagctgatctgctgatgtggtgggttattaagttctggtggtttggttcctttgaccacttgaaattgatgttggcagactcagattttttccactgacaaaaaaaaaaaaaaaaaaaa

SEQ ID NO: 8320 - protein, 393 aa, Panicum virgatum
  misc_feature: Ceres CLONE 1995643
  misc_feature: Great-hit functional homolog of the protein sequence encoded by LOCUS At2g27860
  misc_feature: Great-hit functional homolog of the protein sequence given in SEQ ID NO 9632
  misc_feature (1)..(271): Pfam Name: Epimerase Pfam Description: NAD dependent epimerase/dehydratase family
  misc_feature (1)..(271): Pfam Name: Epimerase Pfam Description: NAD dependent epimerase/dehydratase family
  misc_feature (1)..(271): Pfam Name: Epimerase Pfam Description: NAD dependent epimerase/dehydratase family
  misc_feature (1)..(271): Pfam Name: Epimerase Pfam Description: NAD dependent epimerase/dehydratase family
  misc_feature: Useful for making plants with altered Lignin content
  misc_feature: Useful for making plants with altered cell wall content and/or composition
MSSPSPAPARMDLDGNPVAPLTICMIGAGGFIGSHLCEKLMAETAHVVLAVDVYCDKIRHLVDPAPPHLAGRISFHRLNIKNDSRLEGLIKMADLTINLAAICTPADYNTRPLDTIYSNFIDALPVVKYCSENNKRLIHFSTCEVYGKTVGSFLPKDHPLRKEPEFYVLKEDESPCIFGPIVKQRWSYACAKQLIERLIFAEGAENGLEFTIVRPFNWIGPRMDFIPGVDGPSEGVPRVLACFSNNLLRREPLKLVDGGQSQRTFVYIKDAIEAVVLMIENPARANGHIFNVGNPNNEVTVRELAQMMTEVYANVSGEAPLDEPMIDVSSSQFYGEGYDDSDKRIPDMTIINKQLGWNPKTPLKDLLETTLTYQHKTYKEAVKRQMAQASASS

SEQ ID NO: 8321 - DNA, 1934 bp, Panicum virgatum
  misc_feature: Ceres CLONE 1995664
  misc_feature: Encodes the peptide sequence at SEQ ID NO. 8322
gctcttcagacttcagagatcagactagcaccgtagcacgagccatgccttcctccccgcaccgccggcgcctcctcctactccccttgctcgtcgctgccgccgcgctgccggggccgctgccggcgggcgccgccacctgcaaggcgtggctggtgcagtccatccccaccgacatgccgcacctccgccgcgtccccggggtcctctccaccggagatgtactgcagtggctctcgggtaatgcaaccaagagcctggacatccttgcacagtactggcagttcttagcgcagccaaacaatccaaaatcgggggattatgggtactccgatagtgacatgaagagatttggggctgatgaggggcatcgggtttacaaggcattggagaatgctgcagatcgtaagatcaaaatcaggattgtgcaacactcaggatttgctcctgattttgacaaagagagcgccgatctcgctgcaggaagaccaaatgttcagaatgtaacctttctttttgagaagtggtggggatctggcgttttgcatgcaaaagtctggatatcggataaaaaagacgtgtatatagggtcagcaaacaacgattggaaatctcttacccaggtcaaggagcttgggatttatttttctgattgtccacaaataacaaaagctgtggaagtatattttcaaaatctttggtcgctttcagccctcaactcaactacttataccaaagtagcttgggataagcagtggcaagtttctagaaaggttccatgctggtcacatttcctacagccaaaagaaagatgcaggtcaccaataccaccttctgttgacatctcatatacagatggatatccggcacttgccaatcctgaaatgattgatgtgccacttgaaacccctgggtaccagaaatccactcaggagcactacttgagctacctttcctttgctccacctgaggtgacatttggcaaattccaagcagatgaacagggttgggttgacaccattaaatctgttaaggttgggggaattgtaagaatgaatactatggattggcttggacagtcacagtatggtactcaaacagtctactggccatcgttgtcatcagcaatctcagaggtagtgttctcaaagaatgcaactgtgaggcttctcgttgcctactggacacacttcatcccaaacacagaaaactacttgaagagccttctatactccaatatcctctgtgcatcttcaaagtataatcactgtggtggcaaggtcgagatcaaatactacatggttcctgggtacaacgagaccggacctgcaatgtcgccgggtggcgctgctacagggaaccgttaccctgacttcacccgggtgaaccatggcaagtatgctgtcagcgacgtgcgggcgaacatcggcaccagcaacctcatctgggattacttctacaccacagcgggagtgagctttggaacatacagcccatccattgtctcgcagctgcaggatatctttgatgcagattggtactctccttatacagtaccggttgaaccactggaagtgtcagcctaggatcagctcagttccagttcagcattgtcttcttcttcttttcttcctcacacatagccaataaagaaaatcagagtcccgggatggactgtggactgtggagtagcaaagaatcatccaagagggattcacacacgacaccaccaagatttttgcgcttgtttcgtgtagtctgcaaagttgtttttgcggagaataagctgtctcagtgataactgtacctccaaatgtacaaatgtaaatactttacagttccactgaaatttttgggtccgagtgactttggaaaatacaaccatttgtgaggaccagtttggtcacaattgtcaaaaaaaaaaaaaaaaaaaa

SEQ ID NO: 8322 - protein, 513 aa, Panicum virgatum
  misc_feature: Ceres CLONE 1995664
  misc_feature (1)..(28): Pfam Name: PLDc Pfam Description: Phospholipase D Active site motif
MPSSPHRRRLLLLPLLVAAAALPGPLPAGAATCKAWLVQSIPTDMPHLRRVPGVLSTGDVLQWLSGNATKSLDILAQYWQFLAQPNNPKSGDYGYSDSDMKRFGADEGHRVYKALENAADRKIKIRIVQHSGFAPDFDKESADLAAGRPNVQNVTFLFEKWWGSGVLHAKVWISDKKDVYIGSANNDWKSLTQVKELGIYFSDCPQITKAVEVYFQNLWSLSALNSTTYTKVAWDKQWQVSRKVPCWSHFLQPKERCRSPIPPSVDISYTDGYPALANPEMIDVPLETPGYQKSTQEHYLSYLSFAPPEVTFGKFQADEQGWVDTIKSVKVGGIVRMNTMDWLGQSQYGTQTVYWPSLSSAISEVVFSKNATVRLLVAYWTHFIPNTENYLKSLLYSNILCASSKYNHCGGKVEIKYYMVPGYNETGPAMSPGGAATGNRYPDFTRVNHGKYAVSDVRANIGTSNLIWDYFYTTAGVSFGTYSPSIVSQLQDIFDADWYSPYTVPVEPLEVSA

SEQ ID NO: 8323 - DNA, 1615 bp, Panicum virgatum
  misc_feature: Ceres CLONE 1995695
  misc_feature: Encodes the peptide sequence at SEQ ID NO. 8324
attcccaccggccaccgggcttcgtcctcgccgccgcctgcgccgcagccgccatgtggaggggcggcgccaccgccgcctccgccgcgagggcactccgctcgcgcctcatccctgaccccatccaccgcccggccacgtcgctcgctcctatcgcctcggcgcgtgcctcctcctccgctccctccgccgcagcagcgaacaacgtcgttgaagcagcggcggcggcggcggcggcaagggctgtatccgtttcgcagcaggccggatccgtctccgacgggctgcggcattacgggaggtgctactgggagctctccaaagctcgcctcagtgcacttgttgtggcaacttcgggggctggctatgtgcttggtagtggtaacgtcgtggacctagctggactttgttgcacatgcgctggtacaatgatggtcgcagcatctgcaaataccctcaaccaggtattcgagataaaaaatgatgctaaaatgaaaaggacaatgcggcggcccctgccatcaggtcgcattactcctgcgcatgctgccatgtgggctacgagtgttggagctgcaggaacagctttgttggcctggaaggctaatggcttggcagctgggcttgcagcatctaatcttgttctgtacgcatttgtatatactccattgaagcaaatacaccctgttaatacatcggttggagcagttgttggcgccattccaccacttctggggtgggcagcagcttcaactgaattgtcactaaatgctatgattctccctgctgcattgtactattggcaaataccccattttatggcgcttgcatacttatgtcgagatgattaccttgctggagggtaccgaatgttttcttttgccgaccctactggtaaaagaactgcgtgggtatcactcagaaattgtctgtacatgcctttggggttctttgcatacaactggggcctcacgtctgagtggtttggtcttgaagcatcactactaacgttgggccttaccattggagctctatcgtttgtgctggaaccaagcccgaaaactgcaaggagaatgttctatggaagcctgctgtatctccctgccttcatggctggacttctattacatcggttacctaatgaacaaaaggtgcagaacctgactgagaaaagcgagctcgatggagttctttatggggctgatctgcaggacgatgaaagagtgagacagaaaagtgaagacaggaagcctcctcgtgtgcaatcacgccctccggttgcctatgcttctgtggctccattccctttcttaccagttcccatatacgagtcatgaaaacttcctctgattcttcctgcagcagcggggctgtgggagcaatgtgttcatgcggttttggttccatacatgaatttcctgccgccaagggaatccttggtctatcacttgttgattatagagtaatttttgaaggagcggactctttgccgctcatctgaatgtaaaaagtgtttgatcctctttgatatgcctcgtgtaacacggttatgctgatgttcaacatgttgtttttcatcaaattgggttaaaattaataatgtgtattgaagctt

SEQ ID NO: 8324 - protein, 427 aa, Panicum virgatum
  misc_feature: Ceres CLONE 1995695
  misc_feature (1)..(268): Pfam Name: UbiA Pfam Description: UbiA prenyltransferase family
MWRGGATAASAARALRSRLIPDPIHRPATSLAPIASARASSSAPSAAAANNVVEAAAAAAAARAVSVSQQAGSVSDGLRHYGRCYWELSKARLSALVVATSGAGYVLGSGNVVDLAGLCCTCAGTMMVAASANTLNQVFEIKNDAKMKRTMRRPLPSGRITPAHAAMWATSVGAAGTALLAWKANGLAAGLAASNLVLYAFVYTPLKQIHPVNTSVGAVVGAIPPLLGWAAASTELSLNAMILPAALYYWQIPHFMALAYLCRDDYLAGGYRMFSFADPTGKRTAWVSLRNCLYMPLGFFAYNWGLTSEWFGLEASLLTLGLTIGALSFVLEPSPKTARRMFYGSLLYLPAFMAGLLLHRLPNEQKVQNLTEKSELDGVLYGADLQDDERVRQKSEDRKPPRVQSRPPVAYASVAPFPFLPVPIYES

SEQ ID NO: 8325 - DNA, 1167 bp, Panicum virgatum
  misc_feature: Ceres CLONE 1995794
  misc_feature: Encodes the peptide sequence at SEQ ID NO. 8326
atctgccaccgtcgctctggactccatcactctcccctgctctgctctgctctgccttctcccctcccccaactcgctgctggcgcggcgatctcggctcgaggtcgggtccgccgcggcgagctgctagcgatggggatgggatcgcggcggcgtgaccttctcgccgccgccgccgcggcgctgctgctgtgctgcctactccgcggcggcgcgtccggagcgccggcggcgtcgttcggggacaacttcgagatcacgggcgcggaggaccacgtcaagacctccgccgacggccagacctggtacctctacctcgacaacaagacaggcgtcgggttccagacgaaggagcgctacctcttcgggtggttcagcatgaagctcaagctcgtcggcaacgactccgccggcgtcgtcaccgcctactacatgtgctccgacgtggacgccgccccgcagcgcgacgagctggacttcgagttcctgggcaaccgcacggggcagccctacatcatccagaccaacgtgtaccacaacggcgtcggcggccgggagatgcgccactcgctctggttcttcgtggacaaggtgccgatccgggtgtacccgaacgacgcgagcaagccgggcggcaacggcttcttcccggcggccaagcccatgtacatcttctccagcatctggaacgccgacgactgggcgacgcggggcgggctggagaagacggactgggccaaggggccattcgtctcctcgtaccgggacttcgccgccgacgcctgcgcctggccggccgagtccgcctccggcgcgccggcgtgcgcggcggccaccggggacagctggtgggaccagccgcccgcgtgggcgctggacgaggcgcagcggatggacaacgcctgggtcgcccgcaacgtcctcatctacgactactgcgacgaccgcaagcgcttccccgcgccgcccgaagagtgcgcgctccggaacgccggcacctcctcgtgatgatccttgtttcttttgtgcgtgttttggttatcgattttttggggaggaaggtcggtggtcgccggaccgatggttgtcacgttgggacgaatagtcattcttttggggggaatggattcaattttgttcttgtcacaaaaaaaaaaaaaaaaaaaa

SEQ ID NO: 8326 - protein, 291 aa, Panicum virgatum
  misc_feature: Ceres CLONE 1995794
  misc_feature: Great-hit functional homolog of the protein sequence encoded by LOCUS At1g11545
  misc_feature (1)..(114): Pfam Name: Glyco_hydro_16 Pfam Description: Glycosyl hydrolases family 16
  misc_feature: Useful for making plants with altered cell wall content and/or composition
MGMGSRRRDLLAAAAAALLLCCLLRGGASGAPAASFGDNFEITGAEDHVKTSADGQTWYLYLDNKTGVGFQTKERYLFGWFSMKLKLVGNDSAGVVTAYYMCSDVDAAPQRDELDFEFLGNRTGQPYIIQTNVYHNGVGGREMRHSLWFFVDKVPIRVYPNDASKPGGNGFFPAAKPMYIFSSIWNADDWATRGGLEKTDWAKGPFVSSYRDFAADACAWPAESASGAPACAAATGDSWWDQPPAWALDEAQRMDNAWVARNVLIYDYCDDRKRFPAPPEECALRNAGTSS

SEQ ID NO: 8327 - DNA, 1560 bp, Panicum virgatum
  misc_feature: Ceres CLONE 1995956
  misc_feature: Encodes the peptide sequence at SEQ ID NO. 8328
agctagcctccgactcatctctctccctcgctctagtccccaatacctctccaacacactcgtattggttcgtgggcaacaatggcgaggagccgcccggccgtcctcttgtccctcgccgttgtggcgttggcggccacggcgctggctccggcgccggcggcggcgaccaagtacaacatcaccaagctgctggcgccgtacaagcagtactcgaggttcaacgagatgctgtccaggacgcggctggcgtacgacatcaaccggcggcagaccatcacggtgctcgccgtcgacaacgcggccatgtcggcgctggaccactactcgctgcagaccatccggcacatcctctcgctgcacgtcctcgtcgactactacggcgacaagaagctcgcccacggctccaccgccacttcctccatgtatcaggccaccggcgccgcgtcaggcatgtccgggtacgtgaacatcacccgcaaggacggcaaggtcagcttcacgacggacgacgccgacgccaccgcgaagcccacccggtacatcaggtccatcaaggagtacccctacgacatcgcggtgctcgaggtgagctccatcatctcctccgccgacgccgaggcggccgtgccgccgccggcgcccgtcgacctcgtcgagctcctctccaagaagtactgcaagtccttcgcgtccctcctctcggccaacaccgacgtgctccgcaccttgaacgagaccaaggaggacaacgggctgacgctcttctgccccgtcgactccgccgtcgcggcgttcgcggccacctacaagaacctcacggccaaggccaagacggccatcctgctctaccacggcgtgccggactacttctcgctgcagctgctcaagtccaacaacggcatggtcaccacgctcgccaccgccagcgagaacaagaaggactacagctacgacgtgcagaacaagggtgagacggtcaccctccagaccagggtcgtcacctccagcatcacggccaccgtgggtgacatggagccgctcgccgtctacgccgtgaacaagttcctcaagccgaaggagatattcaaggtcgtcgaggcacccgcgcccgcaccagagccgtccaagaagaagagcaaggcagctgacagcggagatgactcgtccgacgattccggcgacgtgacggccgacaagggcgacgctgcgccagccgccatgctcgctcggtgggtggccgcagccacaacagcggtagcggcatttgcgttgatgggctaaatagttgtttcaaatcttattaggccatcttattattctttttattttcatggtaaattgttttcctatttaatggcgctcgggcaaagggggaaaattgaaacacattgtttctgcatgcgccctgtagcaagaaacgtggaggaaggaactcgggattgtggcttgtagtgctttgagttttcgtcaattagcttgatatcgatgtaattattttgtaattaatacagttgttgtcagagtttgaaaagaagtcaggaatggtttcaagtggtt

SEQ ID NO: 8328 - protein, 400 aa, Panicum virgatum
  misc_feature: Ceres CLONE 1995956
  misc_feature: Great-hit functional homolog of the protein sequence encoded by LOCUS At4g12730
  misc_feature: Useful for making plants with altered cell wall content and/or composition
MARSRPAVLLSLAVVALAATALAPAPAAATKYNITKLLAPYKQYSRFNEMLSRTRLAYDINRRQTITVLAVDNAAMSALDHYSLQTIRHILSLHVLVDYYGDKKLAHGSTATSSMYQATGAASGMSGYVNITRKDGKVSFTTDDADATAKPTRYIRSIKEYPYDIAVLEVSSIISSADAEAAVPPPAPVDLVELLSKKYCKSFASLLSANTDVLRTLNETKEDNGLTLFCPVDSAVAAFAATYKNLTAKAKTAILLYHGVPDYFSLQLLKSNNGMVTTLATASENKKDYSYDVQNKGETVTLQTRVVTSSITATVGDMEPLAVYAVNKFLKPKEIFKVVEAPAPAPEPSKKKSKAADSGDDSSDDSGDVTADKGDAAPAAMLARWVAAATTAVAAFALMG

SEQ ID NO: 8329 - DNA, 1179 bp, Panicum virgatum
  misc_feature: Ceres CLONE 1995983
  misc_feature: Encodes the peptide sequence at SEQ ID NO. 8330
gtggggcgccggtgcgtgcccaaaacaagcaagcgtagaggcgccaacgcgcgaggagcggtgggatggcggcggccatggacttggaggacgacgaggacttctgggggaacaccgccagcagccccagcgcgtcgccgccggggtcgctcgccgcggccgcggtctccccctgcggcgccttcatctccacgcagctcagcctcaactcccgcctccacctcctctccacagcgggcggctcctccgccctgggcgccggcatctacgccgcggacgacggccgccaccacatggacctcggcggcggcttccgcaatgccgccgcgtccccggcgcccttcttctctgcctacaaccccgccgccggcgccggcaccgcgcgcagcgtgctcgaggacgagatgtgcctcggccccgacgcggcggcggccacctgggccggcgccggggtcgggggctccgaccgccgcaagaagcgcatgatcaagaaccgcgagtccgcggcgcgctcccgcgcgcgcaagcaggcctacgtccgcgagctggagcaggaggtgaagctcctgcagcaggagaacgagagcctccgcgtcaagtacgagcagctgagggtgtccgtggaggtggcggtgccggtgaagaagactctgcagaggatgccgtccgcgccattttgaggacgacggcgaggagatcgaaggaaggatggatcgaagcaggcggttgcccttctccttttgaggcgatccagtgatcgatattggttacaagtaatcgactaattaagtgagtgcttcacttcatatgccgcagccagtagtgctctgctgcttctctacctagctcgccgtgcttgtacaagcaacatcaaagtcatgttcaatctcgcctagggcgtgtactagctgctagcttttgccttgatccatctgtacagtggcagctgcctagctagaacaggggatgcctgccacggcggcgtcctggtggctgccatatatacttatgtgtatatgtgtgtagcttgtcgcgtgggattaggcagaagcagaaagatgatgggcctgcttgtacaaatgtagtaactattgcttcctggcacaatgtcatttcggagcgcaagaaagaaagaacaatccaggaaacttagctggtcaaaaaaaaaaaaaaaaaaaa

SEQ ID NO: 8330 - protein, 204 aa, Panicum virgatum
  misc_feature: Ceres CLONE 1995983
  misc_feature (4)..(53): Pfam Name: bZIP_1 Pfam Description: bZIP transcription factor
  misc_feature (1)..(55): Pfam Name: bZIP_2 Pfam Description: Basic region leucine zipper
MAAAMDLEDDEDFWGNTASSPSASPPGSLAAAAVSPCGAFISTQLSLNSRLHLLSTAGGSSALGAGIYAADDGRHHMDLGGGFRNAAASPAPFFSAYNPAAGAGTARSVLEDEMCLGPDAAAATWAGAGVGGSDRRKKRMIKNRESAARSRARKQAYVRELEQEVKLLQQENESLRVKYEQLRVSVEVAVPVKKTLQRMPSAPF

SEQ ID NO: 8331 - DNA, 1596 bp, Panicum virgatum
  misc_feature: Ceres CLONE 1996070
  misc_feature: Encodes the peptide sequence at SEQ ID NO. 8332
aaaaaaaaaaaaaaaaaaaaaaaaaaaatttttcccaaagccgatcgagcacaccgcccacccggccgcccccacccggtaatcactagctgccgggccagctgccccccagcaccacggtccagccatggccaccgtgccggaagcgcgagagctgctgctgcgcgtcctcctcgctgccgccgcgttcgcctgcgccgcggcggcggcggcggggagtggcagcaaggtgccggcgatctacgtgttcggcgactcgacggcggacgtgggcaacaacaactacctgccgggcagcgccgtgccgcgggccaacttcccgcacaacggcgtcgacttcccgacgtcgcggcccaccggcaggttcagcaatggctacaacggcgtcgacttcttggctatgaacatgggcttcaagcgcagccccccgccgttcctcgccgtggccaacagaagcaacaaccaggtcttcagaggtctccttggagtgaacttcgcctctgcgggatcgggcgttcttgacacgacagggagctccatcatcccgctgagccagcaggtggagcagttcgccaccgtgcagcgcaatatctcggcgcgcatcagccagggcgcggccggcgccgtgctgtcgcggtcgctgttcctcgtcagcaccggcggcaacgacctcttcgccttcttcgcgcggaacagttccacgccgtcggacgccgacaagcggcggttcatcggcaacctcgtctcgctctaccagaaccacgtcaaggccctgtacgtgctcggcgcgcgcaagttcgcggtgatcgacgtgcccccgatcgggtgctgcccgtacccgaggagcctgcacccgctcggcgcctgcatcgacgtcctcaacgagctggcgcgcgggttcaacaagggcctcagggacgccatgcgcgccgtcagctcgagcttccaggggctgaagtactccgtcgggagctcccacgccgtcgtgcagagcatcatgaagcacccgcagaggctcgggttcaaggacaccacgaacgcgtgctgcgggtcggggcggttcaacggcaagtccgggtgcacgcccaacgcgacgctgtgcggcaaccggcacgagtacctgttctgggacctgctgcacccgacgcacgccgcctccaaggtcgccgccgcggccatctacaacggctcgctccacttcgccgcgccggtgaacttcaggcagctggtggaggaccagtgctaggctactagacaggcggcgggggcaccaggcccccgtgtggccctgtaacttgtaccagtgtgtgctgtagaattacccgtgttggtgagattggtgtgtaggatacgcgtggcttgtgttcactctgtttctcgtggtttattagatggcgatggcgcttgtgtggtctggactctaagatagcagagttaaatacaccagcggtcctcgaacttgtctctatgtgccacttaggtccacaaactcgcaaaatcgaaatctggcaccataaacttgttaagttgtgccacttaggtccataacccttcaaggggtatgaatatatgaaaaaaaagccctggagttttatc

SEQ ID NO: 8332 - protein, 372 aa, Panicum virgatum
  misc_feature: Ceres CLONE 1996070
  misc_feature (1)..(313): Pfam Name: Lipase_GDSL Pfam Description: GDSL-like Lipase/Acylhydrolase
MATVPEARELLLRVLLAAAAFACAAAAAAGSGSKVPAIYVFGDSTADVGNNNYLPGSAVPRANFPHNGVDFPTSRPTGRFSNGYNGVDFLAMNMGFKRSPPPFLAVANRSNNQVFRGLLGVNFASAGSGVLDTTGSSIIPLSQQVEQFATVQRNISARISQGAAGAVLSRSLFLVSTGGNDLFAFFARNSSTPSDADKRRFIGNLVSLYQNHVKALYVLGARKFAVIDVPPIGCCPYPRSLHPLGACIDVLNELARGFNKGLRDAMRAVSSSFQGLKYSVGSSHAVVQSIMKHPQRLGFKDTTNACCGSGRFNGKSGCTPNATLCGNRHEYLFWDLLHPTHAASKVAAAAIYNGSLHFAAPVNFRQLVEDQC

SEQ ID NO: 8333 - DNA, 986 bp, Panicum virgatum
  misc_feature: Ceres CLONE 1996119
  misc_feature: Encodes the peptide sequence at SEQ ID NO. 8334
aaaaaaaaacttgcagattatgcgagtgtactagtgttctgatttctacgcggcacgcgcacacgtacaaacagccgccgccaggagaggagagcgagggatcgggcggagctgcggacgccgtcggcggccgcgtcccccgccaggagaagagagcgcaaggggactgggcggagctttaaaactgcgcggcagacggcgaccgcgacatctgcgctcgactcccacgcgcgattcagtccccagcgaccctccacccgtctcaacacccggcaaccggcacatccatcctctatccgcatccgccgccactccggcctgcgtccaagtccgtggatctgtattcctcttcccaagcaggtaagaaccacatttaccaaatgaagcacatattcaagattgttgcagtgcttgtagcaatctcagctgtctggattgccctccttgaaacctcgactgttccacgaagttatacttggctgcttcctatctacttggtagtggctcttggatgctatggcctttttatggttggattcggacttatgttcttcccaacttgtcctcaagaagctgtactgctacaacaggatattatggaggcaaaggaattcttagtaaagaaaggtgttgatgtaggctctgaatgatgtctattcgacaatcaattttcatgggaactttgaaggatcaactttgcgctatgtggaataggctaccttttggattctgtagctaggaaatgagtgccctgagctttttttgccttttaatatgtctgcaacccagaatatcaccataattggtgcgtgcctactgcctaattttgtatattgttatgcaaaacaagggatagtagcatgctacacaatttcaatccacttgctttctgttgatcatttgtggtgcagaaggcagatatgtcaccattatgttagctctgatttactgaatctctgttaccagaaaaaaaaaaaaaaaaaaaa

SEQ ID NO: 8334 - protein, 89 aa, Panicum virgatum
  misc_feature: Ceres CLONE 1996119
  misc_feature (1)..(86): Pfam Name: DPM3 Pfam Description: Dolichol- phosphate mannosyltransferase subunit 3 (DPM3)
MKHIFKIVAVLVAISAVWIALLETSTVPRSYTWLLPIYLVVALGCYGLFMVGFGLMFFPTCPQEAVLLQQDIMEAKEFLVKKGVDVGSE

SEQ ID NO: 8335 - DNA, 1408 bp, Panicum virgatum
  misc_feature: Ceres CLONE 1996181
  misc_feature: Encodes the peptide sequence at SEQ ID NO. 8336
acactaaatcaccgccgctgctgaccttgctttgccgcgcgggtgcccgatcccctcctcgcatttcgctgtagcgatttcaagtcgcctctcccgccccgtgccgcgcagccgcaagccccatggacctccccgtcgtggatctcgcgccgttcctcggcgccgccgccggcggggaggaggaggaggtgcgcgcgctgtgcgcgacggtgagcgccagcctgcgggacacgggggcgctgctggtgaaggacccgcgctgctccgccgccgacaacgaccgcttcctcgacgtcgtcgagcgctacttcgcccgatccgcggaggccaagcgcctccaggaacgcccccacctccactaccaggttggcgtgacaccagaaggggtggagattcctcgcagcttggttgacaaggacatgcaggagaagatcaggagtatgccggaggagtttcaaccagccacccctaaagggccagacccgaaatggcggtacatgtggagagttggtcctcgccctgcaaatacccgcttcaaggagctgaactctgaaccagtgatccctgatggattgcctgagtggaaagagacaatggattcctggggttctaaaatgatttctgcaattgaggtcgttgctgagatggctgcaattgggttcggcctgccaaaggatgcatttacttctttgatgaaggagggaccacaccttctcgcaccaactggaagtgacctggagcgtcatggttctgagggcactgttttcgctgggttccattatgatcttaatttcttgactatacatggccgaagtagatttccaggcctgaacatctggttaaggaatggtaaaaagatggaggtgaaggtccctgttggctgtctcctcattcaatcagggaaacagctggaatggcttactggtggtgagtgtttggctggaatgcacgaggtggtggtgacaaagagaacattagaggccatagcatcagcgaaggagcaaaatagaagcttgtggcgggtttcatcaacattgttctcacacattgcttcagatgcaattcttaagccgctgggccacttcgctgaaacaccgaatgctgccttgtatcccccaatatgcgctggggattatgttgaacaggagctttctgtgattaacctgaaaggaaaggatgcgttatagactgtgcagctgacaatcctggatatcttatggctgacagatatcagaatgaaaaattaaattgtcaaagctgacatttgtgtactgggggtgtgtttctgttgttccgaatacactgttatgtcctgcaaactatgattgatcattcctcttgataagatagtggataccctattatgtaccatacagatattacttgtgaaaaaaaaaaaaaaaaaaaa

SEQ ID NO: 8336 - protein, 354 aa, Panicum virgatum
  misc_feature: Ceres CLONE 1996181
  misc_feature (1)..(114): Pfam Name: 2OG-FeII_Oxy Pfam Description: 2OG-Fe(II) oxygenase superfamily
MDLPVVDLAPFLGAAAGGEEEEVRALCATVSASLRDTGALLVKDPRCSAADNDRFLDVVERYFARSAEAKRLQERPHLHYQVGVTPEGVEIPRSLVDKDMQEKIRSMPEEFQPATPKGPDPKWRYMWRVGPRPANTRFKELNSEPVIPDGLPEWKETMDSWGSKMISAIEVVAEMAAIGFGLPKDAFTSLMKEGPHLLAPTGSDLERHGSEGTVFAGFHYDLNFLTIHGRSRFPGLNIWLRNGKKMEVKVPVGCLLIQSGKQLEWLTGGECLAGMHEVVVTKRTLEAIASAKEQNRSLWRVSSTLFSHIASDAILKPLGHFAETPNAALYPPICAGDYVEQELSVINLKGKDAL

SEQ ID NO: 8337 - DNA, 1158 bp, Panicum virgatum
  misc_feature: Ceres CLONE 1996207
  misc_feature: Encodes the peptide sequence at SEQ ID NO. 8338
agtaggcaggaaatgggcggccctcacagcggccgccggtcgccggccctgccgtggacggtgcgcgccaagctggccgctctcgcggctgtgcaacgccgggacggcagcttccggcggcgcctcttctcgctgctcgaccggccagccaccgccaatccccgcccggacgcctcgggcgtgtcctccgccgacgtcaccatcgacgcctcccgcggcctctgggcgcgcgtcttcgccccctcggcgccggcgccggcggcacacgacgccccgctccccgtcgtcgtctacttccacggcggcgggttcgtggcgctctccgcggcgtcgcgcccctacgacgccctctgccgggagatctgccgcgcgctcggcgccgtcgtcgtgtccgtggactaccgcctcgcccctcgccaccgcttccccgccgcctacgacgacggcgtcgccgcgctgcgctacctcggcgccagcagcgccctgccgggcgtccccgccgccatcgacctctccagctgcttcctcgccggcgacagcgcgggcggcaacatcgcccaccacgtggcccagcgctgggcggcggcgccgacgccgccgacgtcttcgccaaccgtaagcctccgcgtcgccggcgtcatcctggtacagccgttcttcggcggggaggagcggacgggggcggaggtggcgctcgacaaggcgtgccgctctctgtcggtggccgcggcggattactattggagggagttcttgccggagggcgccacccgggaccacgcggcggcgcacgtgtgcggcgaggacgccgaggtggccgagtcgttcccgccggcgatggtggtgatcggcgggttcgacctgctcaaggactggcaggcgaggtacgtggaggcgctgcgcgggaaggggaagccggtgaaggtggtcgagtatccggacgccatccacggcttccacgcgttcccggagatcgccgacaccggcaagcttgtggaggagatgaagctgttcgtcgaagaacacaggtctgagcgtgtcccctagattgtccacctttgtacttctaggtttccattgagttcatgtaagattatgcaagatcaggtatgctttacttgcgaaaagagtgcttgccaagaggcgcagattttactt

SEQ ID NO: 8338 - protein, 344 aa, Panicum virgatum
  misc_feature: Ceres CLONE 1996207
  misc_feature (1)..(226): Pfam Name: Abhydrolase_3 Pfam Description: alpha/beta hydrolase fold
MGGPHSGRRSPALPWTVRAKLAALAAVQRRDGSFRRRLFSLLDRPATANPRPDASGVSSADVTIDASRGLWARVFAPSAPAPAAHDAPLPVVVYFHGGGFVALSAASRPYDALCREICRALGAVVVSVDYRLAPRHRFPAAYDDGVAALRYLGASSALPGVPAAIDLSSCFLAGDSAGGNIAHHVAQRWAAAPTPPTSSPTVSLRVAGVILVQPFFGGEERTGAEVALDKACRSLSVAAADYYWREFLPEGATRDHAAAHVCGEDAEVAESFPPAMVVIGGFDLLKDWQARYVEALRGKGKPVKVVEYPDAIHGFHAFPEIADTGKLVEEMKLFVEEHRSERVP

SEQ ID NO: 8339 - DNA, 1377 bp, Panicum virgatum
  misc_feature: Ceres CLONE 1996249
  misc_feature: Encodes the peptide sequence at SEQ ID NO. 8340
tcataggccacacactcattctcggtcctctctgcctcgtacgtgtgctgacccgcccgtgccatcttctccccgtctgtttgttgttgttgctgcctataggtgtgggggtgtgtgacatctcgtggccgagcttgtggttgccttcgtgggaaatggcattactggatgccgtggtatattcccaaccccaaggctatttcggctacgggcccagggacgcgtcctacgggctctcttggtcgtcagacgcgaccagcttcggcgaatgggatcaattcctgctcgcctccctcgtgcagaatgccgaggagtcgggggaggaggtgggttccaagaaggcctcgccggagcacgacgcggcgccgtcggttgtcgactcgccatcgccggtcacgacgacgaagaggaagagaaggcggcccaaggtcgtcaagaacgaggaggagatcaagtgccagcggatgacccacatttccgttgagcggaaccgccgccggcagatgaacgagtacctcgctgtgctccgatctctcatgccaccttcctacgcgcaaaggggagatcaagcatctattgttgggggagcaatcaactacgtgagggagcttgagcagctgctccaatccctccaggtgcaaaggagcctgaaggagcataaccccaacttgtccaatccctttgctggtttcttcaggtttccacagtactccgctacctccgcctctcactgtcacggtgaccccagtaaccacacgaacgaggatcagaggcccaataggagcccccggtcaccgtcggtcgccgccgacatcaaagcaagcatggtggagggacacgccagcgtcaaggttcaggcgccgcggcggcccaggcagctgctgcggctggcagacggtctccagcagctcgggctcacgaccttgcatctcaatgtcagcacggccggcaccacagtcatgtactccttcagcctcaaggtggaggatgaatgcaggctcagctctgtggaggagattgctaccgcagttcatgagattctagggagggtaggaggaggcaggctttagttgataccgaaaccgtcttgtgaatttgtactgtgtcttggattcttgcatgcgcaacagttgtgttcgaaagccaaggaaatataaatatttaagtagctattttttttctttttttcacctgaggttagcatctatataatgcccaaaaaaatttagtacacttcagatgtgactgatacattctagaccattgtaatagtcaccaaagcgtgcatccaatgggtaccgctattggcgtggagtagcctttcgctcctagatctgagctcgtttgtttcagcttgaaaaaaaaaaaaaaaaaaaa

SEQ ID NO: 8340 - protein, 304 aa, Panicum virgatum
  misc_feature: Ceres CLONE 1996249
  misc_feature (1)..(52): Pfam Name: HLH Pfam Description: Helix-loop-helix DNA-binding domain
  misc_feature: The sequence is a functional homolog of  SEQ ID NO 1501 in the  10/374,780 US patent application
  misc_feature: Useful for making plants with modulated growth and phenotype characteristics
MALLDAVVYSQPQGYFGYGPRDASYGLSWSSDATSFGEWDQFLLASLVQNAEESGEEVGSKKASPEHDAAPSVVDSPSPVTTTKRKRRRPKVVKNEEEIKCQRMTHISVERNRRRQMNEYLAVLRSLMPPSYAQRGDQASIVGGAINYVRELEQLLQSLQVQRSLKEHNPNLSNPFAGFFRFPQYSATSASHCHGDPSNHTNEDQRPNRSPRSPSVAADIKASMVEGHASVKVQAPRRPRQLLRLADGLQQLGLTTLHLNVSTAGTTVMYSFSLKVEDECRLSSVEEIATAVHEILGRVGGGRL

SEQ ID NO: 8341 - DNA, 1371 bp, Panicum virgatum
  misc_feature: Ceres CLONE 1996260
  misc_feature: Encodes the peptide sequence at SEQ ID NO. 8342
accacacatccatccatcctccctcacctctctctaggtcttcttctctccaacctccattaccgcagcacctctcttgatcttctcttggtgttctttctcccagttagctgccgccagcagcaagaagatcagatagctgttactagcatataggatgatcaggataatgaagtagctagataggttccacaggtggctactagctagcgaggtatagtcatccgtcgatcgatgatggccggggcaccgccgatgcacatctgcatggactcggactggctcaagggcatcgtccccgaggagcccgggatggggtcgtcgtcgccgtcggcggagctgatcgcgtgcccgcggtcggtgcacgccgcggcggcggaccggcgcctgcggccgcagcacgaccagccgctcaagtgcccgcggtgcgagtccacgcacaccaagttctgctactacaacaactacagcctctcgcagccgcgctacttctgcaagacgtgccgccgctactggaccaagggcggctcgctccgcaacgtccccgtcggcggcggctgccgcaagaacaagcgcgccagcgccaagaaacccgccgcgccgccgatgctgcaggcgcacgggcggcaggtggtggcggagaccggcctccacctgtccttctccggcatgcagcagctgccgccgcctccgcccgccgcggcggacccgctgtgcagcatcggcctcctggactggaagtacgacccgatcctcgcaggatcgtccggcggcgcgctggatggcgccagctccgaggcgcacttcgcgggggccggcatgatgggcatccccggcggcggcgagtgccacgcgctgagcgcgctccggtacgcggccggcctgggcgaccacctgcagctgcaggggctgccgttcggggggcgcgccgagcacgacgccgtggaggcgaagccgccggcggcggagaggctgctgtcgctggactggtacggcgaggcgagccgcgcgccggagagcgccatcagctcgctgggcgcgctgggcctgtggagcggcatgatcggcggcgcgcaccagcaccacggctcctccgcggccatctgaacttggcagaaacgtgcctccatacttgcgttgcatgcattagtggtttgctaatggcgttaacgagtgactatgtaggagtgcctgttttttcttcttcttcttctgctggttttgctattgtcatcttctgtttggtttcatcgttttgtttggacgatcgatgcttgcagctcgtcatttcagacggtgtctctgttgttgtcccacttcaatgttcgaacatttgctgtggttcgttcttaaaaaaaaaaaaaaaaaaaa

SEQ ID NO: 8342 - protein, 290 aa, Panicum virgatum
  misc_feature: Ceres CLONE 1996260
  misc_feature (1)..(61): Pfam Name: zf-Dof Pfam Description: Dof domain, zinc finger
  misc_feature: The sequence is a functional homolog of  SEQ ID NO 2318 in the  10/374,780 US patent application
  misc_feature: The sequence is a functional homolog of  SEQ ID NO 240 in the  10/225,066 US patent application
  misc_feature: Useful for making plants with modulated growth and phenotype characteristics
MMAGAPPMHICMDSDWLKGIVPEEPGMGSSSPSAELIACPRSVHAAAADRRLRPQHDQPLKCPRCESTHTKFCYYNNYSLSQPRYFCKTCRRYWTKGGSLRNVPVGGGCRKNKRASAKKPAAPPMLQAHGRQVVAETGLHLSFSGMQQLPPPPPAAADPLCSIGLLDWKYDPILAGSSGGALDGASSEAHFAGAGMMGIPGGGECHALSALRYAAGLGDHLQLQGLPFGGRAEHDAVEAKPPAAERLLSLDWYGEASRAPESAISSLGALGLWSGMIGGAHQHHGSSAAI

SEQ ID NO: 8343 - DNA, 1631 bp, Panicum virgatum
  misc_feature: Ceres CLONE 1996359
  misc_feature: Encodes the peptide sequence at SEQ ID NO. 8344
acgcacgccgtctgctggcggcttctccacccgaaacaaagccgcgcagcagccaaatccgaaagcgagcggagcacggggacgacgccatgagccgcgcgctgctcgcccatgtcctccaccgcccgccgctcctcggctcgaggagtggagctggcgcccgaggactgctcgcttctcgcatccaccctctccgtcgtctcaattgcagcgcggccgaagcggctcccggccccaccgaggaggcgcctgcttctccggcgaggaagaaaagagtagtttctggtgtgcagccaacaggaatggttcaccttggaaattatcttggtgctattaagaattgggttgcacttcaggatttgtacgagacattctttttcatcgttgacctgcacgcaattactttaccatatgatgcaccagagctatctaaagcaacaagaagcacagctgcaatatatctggcatgtggcattgacagctccaaggcttctatttttgtacagtctcatgtccgtgctcatgttgagttgatgtggctgttgagttcttctactcctattggctggctcaacagaatgatccagttcaaagagaagtcacgcaaggcgggtgatgaaaatgtcggggtggcacttctgacttatcctgttctaatggcctctgacatccttttgtaccagtccgacttggtacctgttggtgaagatcagacacaacatttggaattaactcgtgaaattgctgaacgtgtaaataatctctatggtggaagaaagtggaagaaattgggagggaaaggtggttctctatttaaggttcctgaagcccttattcctccagctggggctcgtgttatgtccctaactgatggtctatccaagatgtccaaatctacgccttcagatcagtctcgtatcaaccttcttgacccaaaagatgtgattgtcaataagatcaagcgctgcaaaactgactcatttccaggcttggagtttgacaacccagagaggccggaatgcagaaatcttctctcaatctaccagattattactgggaagtctaaagaggaagttgttagcgagtgccaagatatgaactggggaacattcaagactacccttacagatgctttgattgagcatttgcaacctattcaggcccgttatgaggagatagtgtctgatccaggctatttggataatgttcttttggaaggagcagaaaaagcttccgagatagcagacatcacccgcaacaatgtataccaagccatgggtttcttgcgcagatagcataaggatcaattctaccaaaacttgggtctgagccatgattcacattagaggcaacacttgtttttacaccttggacctgccacttttcgagttgaacacgtttattcatctctcgatatattttaccactgttcaaattattttaccactgttcaaattttactggagaaatgttactagcttttcgtgaaaatgaaactgctttagtcaagcttattttcatttctatcttgctgtggttttgggttttgaatttctgtacgcttggaatgtaactaacgttgttattgccccttggaacaagatatctgacaaaaaaaaaaaaaaaaaaaa

SEQ ID NO: 8344 - protein, 401 aa, Panicum virgatum
  misc_feature: Ceres CLONE 1996359
  misc_feature (63)..(398): SWISSPROT Homolog: EC 6.1.1.2 Tryptophanyl-tRNA synthetase
MSRALLAHVLHRPPLLGSRSGAGARGLLASRIHPLRRLNCSAAEAAPGPTEEAPASPARKKRVVSGVQPTGMVHLGNYLGAIKNWVALQDLYETFFFIVDLHAITLPYDAPELSKATRSTAAIYLACGIDSSKASIFVQSHVRAHVELMWLLSSSTPIGWLNRMIQFKEKSRKAGDENVGVALLTYPVLMASDILLYQSDLVPVGEDQTQHLELTREIAERVNNLYGGRKWKKLGGKGGSLFKVPEALIPPAGARVMSLTDGLSKMSKSTPSDQSRINLLDPKDVIVNKIKRCKTDSFPGLEFDNPERPECRNLLSIYQIITGKSKEEVVSECQDMNWGTFKTTLTDALIEHLQPIQARYEEIVSDPGYLDNVLLEGAEKASEIADITRNNVYQAMGFLRR

SEQ ID NO: 8345 - DNA, 1290 bp, Panicum virgatum
  misc_feature: Ceres CLONE 1996396
  misc_feature: Encodes the peptide sequence at SEQ ID NO. 8346
acgaaacggccgcctcatgcttccccgcgtcctcgttttaccccctcgcctgccggtcttgcaccccgtccaccacgaaacggccgcctccaccaccaccaccacctcctcctcctccgggccacgcagcatccccgccctgcccctataaatccacccaagcctaccgcggctacagtttgacgcacgcgtgcgcgggcggccgggcaagcgctagaaaggaaagccgaggcggcgcggcgagcgagcggcccaccaccgccgactgcctagctccttggctttgccatttttgcttaattggtcggggagcggaggagggatccaggatggtgcgggggaagacggagatgaagcggatagagaacgcgacgagccggcaggtgaccttctccaagcgccgcaacgggctgctcaagaaggcgttcgagctctccgtgctctgcgacgccgaggtcggcctcatcgtcttctccccgcgcggcaagctctacgagttctccagcgcctccagcctccagaaaacaatcgaccgctataagtcatatacaagggaaaatctcagtaacaaggatacacgacaacaggatatacagcaagtcaaagcagatgccttaagcttggcaaatagacttgaagcccttgaaatgaccaagaggaagtttttgggtgaaaatttagaaggctgctctgttgaagaactgcatagtttggaggtcaaactggagaagagtctccacgtcatcagaggaaagaagacccaactgctggagcagcagatagccaagctgaaggagaaggagaggaccctgctcaaagacaacaaagaattacgcgaaaagcaacgcgctgttcagccgccgctggtggctcccgccgtgacccgctgcctccctccgtggccgcgcaatctgccggcgccttgcaacgacggcgtggacgtcgagacggagctctacattgggttacccggcagggagcgctccgccaaccgggattcggggtgaagcacttgcacatccgatgcaatagctacattactaccgggcacatgcagcccttagtaccggttgccctgaccggtaccggctagccggtactaaatggacggtctatttagtaccggttgcagtgtccgatactaaatagctggtctctttgaaaaaataaatacatgtgtgccggggttcgaactcatgacctgtggcctcgcgtgtagtatcttctaccatatcacccacacagcatatgtgagtgtattgaagatgttaaaaaaaaaaaaaaaaaaaa

SEQ ID NO: 8346 - protein, 225 aa, Panicum virgatum
  misc_feature: Ceres CLONE 1996396
  misc_feature: The sequence is a functional homolog of  SEQ ID NO 122 in the  10/666,642 US patent application
  misc_feature: The sequence is a functional homolog of  SEQ ID NO 406 in the  10/412,699 US patent application
  misc_feature: Useful for making plants with modulated growth and phenotype characteristics
MVRGKTEMKRIENATSRQVTFSKRRNGLLKKAFELSVLCDAEVGLIVFSPRGKLYEFSSASSLQKTIDRYKSYTRENLSNKDTRQQDIQQVKADALSLANRLEALEMTKRKFLGENLEGCSVEELHSLEVKLEKSLHVIRGKKTQLLEQQIAKLKEKERTLLKDNKELREKQRAVQPPLVAPAVTRCLPPWPRNLPAPCNDGVDVETELYIGLPGRERSANRDSG

SEQ ID NO: 8347 - DNA, 1385 bp, Panicum virgatum
  misc_feature: Ceres CLONE 1996397
  misc_feature: Encodes the peptide sequence at SEQ ID NO. 8348
agccatcgacccccccaactcgccatccctcctcccccactccggcggggacctacacccatctcgctcgtacgtcttcctcgtatcagaggatgatgatgccccagagcggcggcagcctcgatctcgggctcagcctcgggctcacctcccagggcagcctctcctcctccaccacctccggcgcgctctccccctgggccgccgccctcagctccgtcgatggggacgcgatgacgaggagggacgcgcacgcgcagcagcacggcgccgccgcggcggcgatggatcccgaccgcgcggcgatgcgcgcgtccacgtcgcccgacagcgccgccgcgctctccagcggcgccagcggggacaacaacaagcgggagcgcggcgagctcgagcgcaccggctccggcggcgtgcgcagcgacgaggaggacggcgcggacggcgccggcggccgcaagaagctgcgcctctccaaggaccaggccgccgtgctcgaggactgcttcaagacgcacagcacgctcaatcccaagcagaaggtcgccctggccaaccgcctgggcctgcggccgcggcaggtggaggtgtggttccagaaccgccgcgcccgcaccaagctcaagcagacggaggtcgactgcgagtacctcaagcgctggtgcgagcgcctcgccgacgagaacaagcgcctcgagaaggagctcgccgacctccgggcgctcaaggccgcgccctcgcccgccgcgcagcccgcctcccccgccgccaccctcacaatgtgcccctcctgccgccgcgtcgccgccgccggcgcccctgccgctaatcaccaccagcaatgccaccccaaatctaacgctgccgctgccggcaacgtcgtgcccagccactgccagttcttcccggccgccgtcgaccggacagggcagagcacgtggaacgccgccgccgcgccgctcgtcaccagggagctgttctaaggtcgatcggatcgatcgatctcgccatggtgacgtcaaccaagtgcggaaggcgatggatcgaccgattcgacggttgattagaaggacaagctctgattaggatcttggcggtcgcagtaattaattacgattaatcaggagaggagattttcttttggtttcctttttttttccttttcttttcgattaattaattcatcagttggatttctgaaaacgacgacgacgaagaaggatgaacaacaaacaaagatggctgtctgctttttcctggacggcttgtaaaccagttcacctaatctgctggttggtgaaataacagcgtgattgattgtactaattgattggtgaagaaagttaatggaaatcaaatctttacaaaaaaaaaaaaaaaaaaaa

SEQ ID NO: 8348 - protein, 296 aa, Panicum virgatum
  misc_feature: Ceres CLONE 1996397
  misc_feature (1)..(55): Pfam Name: Homeobox Pfam Description: Homeobox domain
MMMPQSGGSLDLGLSLGLTSQGSLSSSTTSGALSPWAAALSSVDGDAMTRRDAHAQQHGAAAAAMDPDRAAMRASTSPDSAAALSSGASGDNNKRERGELERTGSGGVRSDEEDGADGAGGRKKLRLSKDQAAVLEDCFKTHSTLNPKQKVALANRLGLRPRQVEVWFQNRRARTKLKQTEVDCEYLKRWCERLADENKRLEKELADLRALKAAPSPAAQPASPAATLTMCPSCRRVAAAGAPAANHHQQCHPKSNAAAAGNVVPSHCQFFPAAVDRTGQSTWNAAAAPLVTRELF

SEQ ID NO: 8349 - DNA, 1037 bp, Panicum virgatum
  misc_feature: Ceres CLONE 1996409
  misc_feature: Encodes the peptide sequence at SEQ ID NO. 8350
accactcagatctccccgcctcacaggtcacagcgcgcgccaatgccatccgccgacgcgacgcccgaggcggcgccgccgcccagggccgcaatctcgcacgtcatcttcgacatggacggactgctcctcgatacggaggggttctacacggctgtgcaggagaagatcctggggaggtacggcaaggtgttcgactggtccgtcaaggccaagatgatgggcaagacgacggccgcgtccacgcgcatcttgttcgaggagtgcggcctcaccggcctgctcacgccggaggagttcctcgaggagcgcgagaccatgctcaagcagctcttgcccacctccgttgccatgccaggtgtcctacgcttgatccatcatctccatactaatggaataccaatagctgttgcaacaggaacccataaacatcactttgctctaaagactcaaaaccaccaggaaatattttccctgatgcatcatattgtcacgggggatgatccagatgtcaaggctggcaagccatctcctgatattttccttgctgccatgaggaggttcgagtgtgatgtagaacccagtaattgcttggttttcgaagatgcaccattgggtgtggcagcagctaaaactgctggaatccatgtagtgatggtcccagatgcacggttggatgtattgcatcacaaagaagcagaccaagttctcagctcactactggatttcaatcctagtgcatggggcttgccagtttttaaggattagaattttcatacaagatatgtggtctcaccagatatttggtgagatgatgtggttggcatcctaaaattcatctatgaatagtggcatatttaaaagattctaaaaagacaaagaaaactcgggtctaggctagcagaagcataggtcggctttacaggtttgttgctgcttcagcaaggtacagtattttcatattcatcattcatagacattttatttatcaaaaacgtgagaagagtttgagcattcaaaaaaaaaaaaaaaaaaaa

SEQ ID NO: 8350 - protein, 241 aa, Panicum virgatum
  misc_feature: Ceres CLONE 1996409
  misc_feature (1)..(192): Pfam Name: Hydrolase Pfam Description: haloacid dehalogenase-like hydrolase
MPSADATPEAAPPPRAAISHVIFDMDGLLLDTEGFYTAVQEKILGRYGKVFDWSVKAKMMGKTTAASTRILFEECGLTGLLTPEEFLEERETMLKQLLPTSVAMPGVLRLIHHLHTNGIPIAVATGTHKHHFALKTQNHQEIFSLMHHIVTGDDPDVKAGKPSPDIFLAAMRRFECDVEPSNCLVFEDAPLGVAAAKTAGIHVVMVPDARLDVLHHKEADQVLSSLLDFNPSAWGLPVFKD

SEQ ID NO: 8351 - DNA, 1935 bp, Panicum virgatum
  misc_feature: Ceres CLONE 1996436
  misc_feature: Encodes the peptide sequence at SEQ ID NO. 8352
gcaacttccatgatctccccaattaatttctctggtccttccatgccatgccaattctttttaccggaaatggaaaagtttggaaggaccaagagctagcagctgccatccactacctcactccctctcctcccctcagccctcacacctcactcactccaacaacttgcttcagagtcctaaccatcttcctctccccttacccaacaagaaccccacaaggcaagaccgagagaaccgcgaggctgtgaagggcatgtggcttgatctgctccaagaacttgttgccgatctcggcgtggtttcagtttgaggcattagctatggcaggctgatcttccactagcgatgaaactgcgcactgcagtgtttgctcatcttgacctcggtgatcttgattaagcactaccagttaccacttaccacccagctgagtcatggcgtattccgggcaaaggcacggtggtgttgggagttcctcaaggccagggaatggcttcaagggaccggccagctcggtcgagtttctgggaaggggggtgctggaaatgcaattgagcgatgccaaagcagatgctgatgatgaaagggacatatggtcaggctcagatgtgactgataattctagtaatgaagccagtcacataaaatcgactacaattcgtgggcacagcggcctgcctaaacagtcggtcacatacattgctgaacatgtggttggaactggttcttttggggttgtatatcaggccaaatgccgagaaacaggagaatttgttgccataaaaaaggttcttcaagataagcgttacaagaacagagagctacaaatcatgcatatgcttgatcatcctaacatcattggtcttaagcattacttcttttcaaccactgaaagggacgagctttatctcaatcttgttcttgagtttgttccagagacagtgaacaggatcgcaaggcagtacaaccgaatgaatcaacggatgcccctcatttatgtcaaactgtacacatatcagatatgccgagcacttgcttatatacataactgcattggcatctgccaccgtgatatcaagccacagaatgttcttgttaacccacatacgcaccagctcaaaatttgtgatttcggaagtgctaaagtattggtcagaggtgagccaaacatctcctacatatgctcaaggtattaccgggcaccagagctcatattcggtgcaacggaatatactactgctattgatttgtggtcaacaggctgtgtcatggcagagctgcttctaggacagcctctgtttcctggagaaagtggagttgaccaactcgttgagattatcaaggttttgggtactccaacaagggaagagatcaagtgcatgaacccaaactacacggagttcaagttcccgcaaattaaagctcacccatggcacaaggtttttcaaaaaaagcttccacctgaagcagtggaccttgttagcaggtttctgcagtactcaccaaatttacggtgcactgctttggaagcctgcatgcatcctttctttgatgagctgagagaccctagcactcgtctaccaaatgggcggcctttgcctcctctcttcaacttcagatctcaagagctgaaaggcgttcctccagaagtagttgagcgccttgtcccagagcacgcgagaaggcagagtttgttcatggcattgcggacctagttttcgctggtctttttgcccttttttcactggttgttccctgagggaagcatgtaaagctctagcttctccttttccttccgtcctcccctgctttcccgttctttctttggagctttatgtggatgagatccttgagatacactagagttgttccaggatgtgaggttgaagtgtgtggtgtgcagttggctttgaaaaaaaaaaaaaaaaaaaa

SEQ ID NO: 8352 - protein, 426 aa, Panicum virgatum
  misc_feature: Ceres CLONE 1996436
  misc_feature (1)..(426): SWISSPROT Homolog: EC 2.7.11.1 Shaggy-related protein kinase kappa
  misc_feature (10)..(426): SWISSPROT Homolog: EC 2.7.11.1 Shaggy-related protein kinase delta
MAYSGQRHGGVGSSSRPGNGFKGPASSVEFLGRGVLEMQLSDAKADADDERDIWSGSDVTDNSSNEASHIKSTTIRGHSGLPKQSVTYIAEHVVGTGSFGVVYQAKCRETGEFVAIKKVLQDKRYKNRELQIMHMLDHPNIIGLKHYFFSTTERDELYLNLVLEFVPETVNRIARQYNRMNQRMPLIYVKLYTYQICRALAYIHNCIGICHRDIKPQNVLVNPHTHQLKICDFGSAKVLVRGEPNISYICSRYYRAPELIFGATEYTTAIDLWSTGCVMAELLLGQPLFPGESGVDQLVEIIKVLGTPTREEIKCMNPNYTEFKFPQIKAHPWHKVFQKKLPPEAVDLVSRFLQYSPNLRCTALEACMHPFFDELRDPSTRLPNGRPLPPLFNFRSQELKGVPPEVVERLVPEHARRQSLFMALRT

SEQ ID NO: 8353 - DNA, 1500 bp, Panicum virgatum
  misc_feature: Ceres CLONE 1996456
  misc_feature: Encodes the peptide sequence at SEQ ID NO. 8354
atcggctaatgacacccaaatcagccgattagcttcctgacctcctcccttactggttcttctctgtccacgtccaggtcgtcgccgctcgcccatcaccacctctgacctccctcgatcccctccgtcctcccaccctcgcgatccggccttcgctgcttcttctcccccctcctgtatatcgcgctcgccgatcagcctctggcgtcgccgccggcgccggcgctttcttctcccctcccccctctttcgtcgcggcggcggcggcggcgccaccaccgagcaagctgcgattcgccgtggcgcgcctgacgcgcacggaagcggttgcacgcctcgaagcggggagtccactctcccgcacgggacgcttctcgggcctcccggcgaagaacctggtcggtcgtcgccgcaggcggactgctcatgttggacccgagatccgaaatctaccccaccatagagtatcgccctatccagccctccgacctcgaagctttagagaagattcatctagctctctttcccataaggtacgagagggagttcttcttgaacgttgtcaacggccatggtattgtttcctggggcgctgtggacaccagcagatcagatgaccgcagggatgagataataggttttgtaaccacgaggatgatcgccgcaaaagatagtgagattgaggacttgtttaggtataacagttcgcgcaaagatctaacacttgtgtatatattgacgctgggtgtggtggatagctacagaaaccttggcatagcatcgtcactggttcgagaagtggttaaatatgcagcaagtatatcaaattgcagaggtgtttatttacacgtcatttcatacaaccaacctgctatcagcttttataagaagatgttgtttaagctagttagaaggcttccaatgttttactacataagaggacaacattatgactcctacttgtttgtgtactacgtgaacggtggtcgttcaccttgctcaccactggagattgtaacttcatttgttgttgacttcagggctttcgtgaagatgctggttgccaagttctggaccaaagaggaccattgtaacccaagatggaccagatgtcaggaatcaaacaccctcttggccccacaaagcaataaacggatcatcagcggtgataataccagatgtcatgtctaatttcaggtgctcttgtgatgctttcttttgtttttttttctttgctacttttttggggagccgaagtttggagagacagtcgcatgtgatgctgttgtacacttctgatacgggtacataatttctcagtagttaatagtcacattcattgtaaagagagaactgtgagaacttgaactttcacctgcttctgataacgttggcagtgacgtgcaatgttgaaaagttgtgttgattgaacggaaacaaacctttttgtgtgtatggcatatcagatctttcactgttcaaaaaaaaaaaaaaaaaaaa

SEQ ID NO: 8354 - protein, 254 aa, Panicum virgatum
  misc_feature: Ceres CLONE 1996456
  misc_feature (1)..(99): Pfam Name: Acetyltransf_1 Pfam Description: Acetyltransferase (GNAT) family
MLDPRSEIYPTIEYRPIQPSDLEALEKIHLALFPIRYEREFFLNVVNGHGIVSWGAVDTSRSDDRRDEIIGFVTTRMIAAKDSEIEDLFRYNSSRKDLTLVYILTLGVVDSYRNLGIASSLVREVVKYAASISNCRGVYLHVISYNQPAISFYKKMLFKLVRRLPMFYYIRGQHYDSYLFVYYVNGGRSPCSPLEIVTSFVVDFRAFVKMLVAKFWTKEDHCNPRWTRCQESNTLLAPQSNKRIISGDNTRCHV

SEQ ID NO: 8355 - DNA, 1758 bp, Panicum virgatum
  misc_feature: Ceres CLONE 1996582
  misc_feature: Encodes the peptide sequence at SEQ ID NO. 8356
acagacccgacccgaggcctgcgttttaattagttttctccctcaccgccgtttcgccgtcgcggcggcggcggcggccaagtgcgcggttcgtcggccgccggtcgagcatctcctcgcctttttgcagaaccaggggggagaacagcggcgcggggtggcgggcagcgcagcgcagcgcgcgggggcgtggccgtcgtgggtgacgtcgggagggagggcgacgccgcgacggcgacgcggacgggcgctagtaaaaaaaaaaatccttccagccttgctagtgatagtataaaaataaccaccagccttgctagtcgcggggaaggaggaacagcaagcaagcaacaagggagagtcggtcaactcaagaggatcgtcaagagcaagaagatgggaagcacacagcagcagctgttcgtactcttcgtagtcttcctcctatctccggtcgccccgcaggtagtcagagcagtgaaaccaatcccaaattccattctcggggttgaggagagagacaattccagaggaatcatccagaaggacatcatagagacggtcaacaaccatcccgatgctgggtggacggctgcacacaatccttactttgcaaactatactattgcacaatttaaacgtatccttggagtgaagcccacaccacagaatgtgctgactgatgttcctaccaaaacttattcaagatcactgaaacttccaaaggagttcgatgccagatctaagtggtctcattgcagcacaattgggaacatacttgatcaaggtcattgtggctcctgttgggcttttggtgccgtggagtgcctccaggatcgtttttgcattcatatgaacatgaacatttcactatcagtcaatgacctactggcatgctgtggttttatgtgcggtgatggttgtgatggaggctatcctatcatggcatggcgctactttgttcaaaatggtgttgtcacagaggagtgcgatccatatttcgatcaggttggttgcaagcatcctggatgcgaacctgcttatcctacaccagtgtgtgaaaagaaatgcaaggtgcagaaccaagtttgggcggaaaaaaagcatttcagtgtcaatgcgtacagaataaattctaacccagatgacataatggcagaggtctacgaaaatggccctgtagaagttgctttcacagtttatgaggattttgcccactacaaatctggagtatacaagcacattaccggtggcatgatgggtggccatgctgtcaagttgattggatggggaaccagtgatgctggagaggattactggcttcttgcaaatcagtggaacagaggctggggtgatgacgggtacttcaagatcatacgaggcagaaacgaatgtggcatcgaagaggacgttgttgctggaatgccatccacaaagaatatggtcagaaactacggtggttcctttggaacagctgtagtttgatcactgccctaggcctgaaatactattggacaggacaaccatgtatttgtatcgctgaatgctgatgaactttgtaaagtagccttgatggtgtatgaattttatataccagcacgttggcaaggctggcaggttgctgagatatggcaacttctgttctgaaacatatatgacagtggatctcgctctcagccagcagatccgggttcgagtcctgccttcttctatgtgcaatgccgggaggcggtctgtctattcccgtctcgtttttttttc

SEQ ID NO: 8356 - protein, 362 aa, Panicum virgatum
  misc_feature: Ceres CLONE 1996582
  misc_feature (1)..(236): Pfam Name: Peptidase_C1 Pfam Description: Papain family cysteine protease
MGSTQQQLFVLFVVFLLSPVAPQVVRAVKPIPNSILGVEERDNSRGIIQKDIIETVNNHPDAGWTAAHNPYFANYTIAQFKRILGVKPTPQNVLTDVPTKTYSRSLKLPKEFDARSKWSHCSTIGNILDQGHCGSCWAFGAVECLQDRFCIHMNMNISLSVNDLLACCGFMCGDGCDGGYPIMAWRYFVQNGVVTEECDPYFDQVGCKHPGCEPAYPTPVCEKKCKVQNQVWAEKKHFSVNAYRINSNPDDIMAEVYENGPVEVAFTVYEDFAHYKSGVYKHITGGMMGGHAVKLIGWGTSDAGEDYWLLANQWNRGWGDDGYFKIIRGRNECGIEEDVVAGMPSTKNMVRNYGGSFGTAVV

SEQ ID NO: 8357 - DNA, 1969 bp, Panicum virgatum
  misc_feature: Ceres CLONE 1996591
  misc_feature: Encodes the peptide sequence at SEQ ID NO. 8358
aaaagaaaggctcacaccacccacctccattttagcttacttctctctcctcctctcgcgctctccccccacccaacccacaaatcgagccaccttaccagaggatcagaggtagagagcggcgcgacgcagcatcgaggggcggcggcggcgagaccaatccagagggagcagaggccgggcgcgcgcagggatgggcgcgccggtgcgcggcgcccttctcctctgcctcctgctcctggcgggggcggcggcggcggccggggacgcggcgccgcaagaacccacattgcccgccgcgggcgccggcgccggcgccgggggcggggcggcggtgggggtcaactccaactcggtgctggtggcgctgctggactcgcactacacggagctggcggagctggtggagaaggcgctgctcctgcagacgctcgaggacgccgtggggcggcacaacgtcaccatcttcgcgccgcggaacgaggcgctggagcgggacctcgacccggagttcaagcgcttcctcctcgagccccgcaacctcaagtcgctccaggcgctgctgctctaccacgtcctccccgcgcgcctcccctccgactcctggcccgccgcctcccaccccacgctctccggcgaggacctcgagctcgccgccggcatgcgcgtcggccacgccgccgtcacgcgcccggacgcggtgctccgccccgacggggtcatccacggaatcgagcgcctcctcgtgccccgctccgtgcaggaggacttcaaccgccgccgcagcctcgccgcgatctcggccgtgctgcccacgggcgcgcccgaggtcgacccgaggacgcaccgcctcaagaagcccgcgccgccggtgccccccggcgcgccccccgtgctcccgatctgggacgccatggcgcccggcccggccatcgcccccgcgcccgcgcctgggcccggctccgggaagcaccacttcgacgggcacagccaggtcaaggacttcatccagaccctcctcctgtacggcggctacaacgagctcgccgacatcctcgtcaacctcacctcgctcgccaccgagatgggccgcctcgtctccgagggctacgtgctcaccgtcctcgcccccaacgacgaggccatggcgcgcctcaccacggaccagctcagcgagcctggctcgccggagaacatcctctactaccacatgatccccgagtaccagaccgaggagtccatgtacaacgccgtgcggcggttcggtaaggtgcgctacgacacgctgcggctgccgcacaaggtcgtggcgcgggaggccgacggctccgtcaagttcggccagggcgagggctccgcctacctcttcgacccggacatctacaccgacggtaggatctcggtgcagggcattgacgccgtgctcttcccgccgggtgacaagaacgcgacgcagacggccgaccctcacaggaagcctcccgccatcaccacccacaagaagatcaagctccggcgaggcaagttgttagaagcatcgtgccaaatggctgccctcttcggtcagcgatcgcgattcgtaagctgccaagattgatctccatgataccgaaagacgaacgaactgaaacaaccaagtgatggccgatgggggctgtgctggagggagccgtccacattattatttgttttctttttttttgtttattgataagaataatgaatcaggtggggatgtaaactcggtggttgttggtgtgtccagagaaagagagggggggaaaagaaaaggcaagaaaaaaaattgtccatacatgaaggaagaccaggatcgtcgtctgtgtataggaagaattaaacgttttgttttctgtttttcgtcattctttgcttctgttcccgttttgacaatgagaatctcgggtaaacacacatcattcttatgattcaaaaaaaaaaaaaaaaaaaa

SEQ ID NO: 8358 - protein, 467 aa, Panicum virgatum
  misc_feature: Ceres CLONE 1996591
  misc_feature: Great-hit functional homolog of the protein sequence encoded by LOCUS At3g52370
  misc_feature: Useful for making plants with altered cell wall content and/or composition
MGAPVRGALLLCLLLLAGAAAAAGDAAPQEPTLPAAGAGAGAGGGAAVGVNSNSVLVALLDSHYTELAELVEKALLLQTLEDAVGRHNVTIFAPRNEALERDLDPEFKRFLLEPRNLKSLQALLLYHVLPARLPSDSWPAASHPTLSGEDLELAAGMRVGHAAVTRPDAVLRPDGVIHGIERLLVPRSVQEDFNRRRSLAAISAVLPTGAPEVDPRTHRLKKPAPPVPPGAPPVLPIWDAMAPGPAIAPAPAPGPGSGKHHFDGHSQVKDFIQTLLLYGGYNELADILVNLTSLATEMGRLVSEGYVLTVLAPNDEAMARLTTDQLSEPGSPENILYYHMIPEYQTEESMYNAVRRFGKVRYDTLRLPHKVVAREADGSVKFGQGEGSAYLFDPDIYTDGRISVQGIDAVLFPPGDKNATQTADPHRKPPAITTHKKIKLRRGKLLEASCQMAALFGQRSRFVSCQD

SEQ ID NO: 8359 - DNA, 1642 bp, Panicum virgatum
  misc_feature: Ceres CLONE 1996651
  misc_feature: Encodes the peptide sequence at SEQ ID NO. 8360
ttagtggctggagagatatatcctttgagatctgtgcatgcaggaaaaaaatattcgttatttgccccatattctggttgagttgcctgtttaaagtagggtgttataataatttggggctgacctgagatttatagtggcattattttgtttactatatgccatattgtgctgtatattttatagactatgctttaattgacatcgctaccgcctactcgttcatgctttctaggaaacacaaaacatgtattacagaaagcaaagcacactcaagtttcttctgtagaagatttaagagaattttagtttacatcacctcaccctatccgccgcttctagacagttcccctcgcggcatctcccatcccccatctcgtcgatctcgcagcactccttcgccatgggcaagattaagatcggaatcaacggtttcggaaggatcggcaggctcgtggcccgggtcgccctccagagcgaggatgtcgagctcgtcgccgtcaacgaccccttcatcaccaccgactacatgacctacatgttcaagtacgacaccgtgcacggccactggaagcacagtgacatcactctcaaggactccaaaacccttctcttcggtgagaagccggtcaccgtctttggcatcaggaaccccgaggagattccatggggtgaggctggtgctgactatgtcgtggagtccaccggtgtcttcactgacaatgagaaggctgcggctcacttgaagggtggtgccaagaaggttattatctctgctccaagcaaagatgcccctatgtttgttgttggtgtcaatgaggacaagtacacctcagatattaacattgtctccaatgctagctgcaccacaaattgccttgctcccctcgctaaggtcatcaatgacaactttggtatcattgagggtctgatgacgactgttcatgccattactgccacccagaagactgttgatgggccatcagccaaggactggagaggtggcagggctgccagcttcaacatcattcccagcagcactggtgctgccaaggctgttggcaaggttcttcctgaattgaatggcaagctcactggtatgtccttccgtgtccccactgtggatgtctcggttgttgacctcaccgttagaattgagaaggctgcttcctatgaggacattaagaaggctatcaaggctgcatctgagggtcctctcaagggtatcatgggttacacagaggaggatttggtctccactgacttcaccggtgacagcaggtcgagcatctttgatgccaaggctggaattgctctgaacgagcacttcgtcaagctcgtctcctggtacgacaatgagtggggctacagcaaccgtgtcgtcgacctgatccgccacatgttcaagacccagtagagcgtttcggcttgatggtgcccattgtctttctggtcgccgaccggcctactgcttgtctatgcagagaataaatgtgaatggtgcccttcggacgccaggattcatgctaagttgggacatgtgttaccttttgtttttgctatctccaccttcctgtaacgaagttgctaatatggacctgagtttagtttttgcttgtgaagaatataaacagggggttgt

SEQ ID NO: 8360 - protein, 337 aa, Panicum virgatum
  misc_feature: Ceres CLONE 1996651
  misc_feature (1)..(158): Pfam Name: Gp_dh_C Pfam Description: Glyceraldehyde 3-phosphate dehydrogenase, C-terminal domain
  misc_feature (1)..(151): Pfam Name: Gp_dh_N Pfam Description: Glyceraldehyde 3-phosphate dehydrogenase, NAD binding domain
  misc_feature (1)..(337): SWISSPROT Homolog: EC 1.2.1.12 Glyceraldehyde-3-phosphate dehydrogenase, cytosolic 1
  misc_feature (1)..(337): SWISSPROT Homolog: EC 1.2.1.12 Glyceraldehyde-3-phosphate dehydrogenase, cytosolic 2
MGKIKIGINGFGRIGRLVARVALQSEDVELVAVNDPFITTDYMTYMFKYDTVHGHWKHSDITLKDSKTLLFGEKPVTVFGIRNPEEIPWGEAGADYVVESTGVFTDNEKAAAHLKGGAKKVIISAPSKDAPMFVVGVNEDKYTSDINIVSNASCTTNCLAPLAKVINDNFGIIEGLMTTVHAITATQKTVDGPSAKDWRGGRAASFNIIPSSTGAAKAVGKVLPELNGKLTGMSFRVPTVDVSVVDLTVRIEKAASYEDIKKAIKAASEGPLKGIMGYTEEDLVSTDFTGDSRSSIFDAKAGIALNEHFVKLVSWYDNEWGYSNRVVDLIRHMFKTQ

SEQ ID NO: 8361 - DNA, 1979 bp, Panicum virgatum
  misc_feature: Ceres CLONE 1996662
  misc_feature: Encodes the peptide sequence at SEQ ID NO. 8362
tcgccagctagctagctccaccaccgtcttcttgcactttgcttcgctggccatcggtatcgatcgacatctccccatcgaatagatcgtcgtcgtcgtccatggatgaagtgtggtgcggcctcgacctgcagcagctgcagctgcaggccggcgaccccctcgccgcggccgccggcctccacgaccaagaccccttctggccggccgctctagcggactgcgcctccagcttcctcgccgccgacaccgcgtgcttcggcggcgtcgccgacatcgacctctccggcggctccgcggccagcgggaaggcggcggcggacggcatggacacggccagcttcttcgccgcggacgacggccaccaccaccacctgatgccccaagagcagcagccggtgcactcgtcctcgtcgctctcctccaagcgctccctctccgtcgacagcggcggctcctggtccaccttcttcccgctcgacgacgcctccctggccgccgcgggcggcctcttctcgacgccctcgccctcgcacgccgcggcgccggccgctttcgccgccggcgaggacgaggcgctcatgcgcgccatgatggccgtcatctcctcggcgtcgccctcctcctccgagtcctcgtcgccgccgctgggccaggactacaccacggccgcgcaggccgccgcagtgcagccgcgcccagcaagccggggcaacaacgccagccacgtgacggtcaggagcagcagcctcgccgttgggccggagaggaccacgtcgctgaccagcgccgccgccgccgccggccggcagcaggaggaggacgccaaggccggcagcaacaacagcagccaggtctaccacatgatgtcggagaggaagaggcgggagaagctcaacgacagcttccacacactggggtccctcctcccaccgtgttccaagaaggacaagacgacggtgctgatcaacgcggcgagcttcctgaagacgctggaggcgcaggtctcggagctggaggagaagaacaccaagctggagaggtacgtcccccgcgagggcgccggcggcgccaccgcggcggcggcgcaccggagagccaaggtccgtatcagcagggcggggccggacgagcggcaggtgagcctgacggtgatggtgatggtggagtgcgacatcgtggacctggtgctgcacctcctggagtgcctccggtggatgaggggggtgagcgtgctgtccgtcgacgccgacacctactcgccgcaggcgccgctcaaggcccgcgccaacatcaagctgcagatcatggacggcgactgctgggacgaggcgctgttccacgaggcgatgacgaaggccgtgcacgaggcgacctcgtctccctcctcgtcctcctgcgccgccccggctccgctcgtggccgcggcctactaggcaggagcagggggcgggcacgtaagcccccacctcctcggtttcttccgccacaggttggctgtgaagcgaccggttcagccatggccatgcgcgcgtgctccctccgatccgcattgggctcgatctatcggcagtcatgcatggttggactttgaaggggtaaaaccaaacgtgccggcgccgctgacggacgacgatcatcgagttcggcctgcggttctcctgtaagccgtgggcggttaattagaaaaggttatgcaactacaccttagtctatggttattagcgaagtgtaagaagccctgtggctgccctagcgcggtcagagaggttgcagatgatgatggcattatgagattgtaggttgtgtgatgcatggctagtgatcggtatttagtagtagcatgtgttggcatttggaaccaagttagtggagggattttgtacataggaaatgaagctcccatgactatgagcagttcgtatatgaatgaagaaacgtgcacacgcggaaggaatcaaaaaaaaaaaaaaaaaaaa

SEQ ID NO: 8362 - protein, 444 aa, Panicum virgatum
  misc_feature: Ceres CLONE 1996662
  misc_feature (1)..(50): Pfam Name: HLH Pfam Description: Helix-loop-helix DNA-binding domain
MDEVWCGLDLQQLQLQAGDPLAAAAGLHDQDPFWPAALADCASSFLAADTACFGGVADIDLSGGSAASGKAAADGMDTASFFAADDGHHHHLMPQEQQPVHSSSSLSSKRSLSVDSGGSWSTFFPLDDASLAAAGGLFSTPSPSHAAAPAAFAAGEDEALMRAMMAVISSASPSSSESSSPPLGQDYTTAAQAAAVQPRPASRGNNASHVTVRSSSLAVGPERTTSLTSAAAAAGRQQEEDAKAGSNNSSQVYHMMSERKRREKLNDSFHTLGSLLPPCSKKDKTTVLINAASFLKTLEAQVSELEEKNTKLERYVPREGAGGATAAAAHRRAKVRISRAGPDERQVSLTVMVMVECDIVDLVLHLLECLRWMRGVSVLSVDADTYSPQAPLKARANIKLQIMDGDCWDEALFHEAMTKAVHEATSSPSSSSCAAPAPLVAAAY

SEQ ID NO: 8363 - DNA, 1585 bp, Panicum virgatum
  misc_feature: Ceres CLONE 1996695
  misc_feature: Encodes the peptide sequence at SEQ ID NO. 8364
tccgtcgctgctgggctgcgccactccaaacccaacaaaaccccgcgagatctgcgcagcaatggcgacgccgcggcgcgtcctgctcctcctcctcgccctcgccgccgcggccctcgcgggcgccgaggaggggccccgcgggcgccgcctgctggtcctcctggacgacctggccgtgcggtcctcgcactcggccttcttcggctcgctccaggcgcgcggcttcgatctcgacttccgcctcgccgacgaccccaagctctcgcttcaccgctacggttttggtgggtcagtggaccagaatgcggttctcgagtttatcgatgctggccatgatgtaatcctggcggcagattcttccgcatctgatcttatccgtggcattgcgacagagtgtggggttgattttgatgaggatccagaggcaatggttattgaccacatcaattatgctgccacggatgttgatggtgatcacaccttgattgccggtgatgatctcatccaatctgatgtgatacttgggtccaaaaagattgaggctcctgtattgtttcgaggaattggacacacagctaatccatcaaacagcttggttctgaaagtcctatctgcctctccatcagcatattcagcaaacccaaagactaagttggcttctcctccatctctcactgggtcagctatatctctggtttctgttatgcaggcaagaaataatgctcgggtgctgatatccggatcacttgatctgtttagcaactggttcctaaagtctggtgttcaaaaggctggtagcaagaagaggcatgagagagctggaaatgagcaatttgtgacagagacaagcaaatgggttttccatgagaggggccatctaaaggcaattaatgtcaagcatcacaaggttggggagacaaatgagcctggcatgtaccgcattaatgatgacctggaatactcggttgagatctatgaatggtctggaacaagctggaagccatatgttgctgatgatgttcaacttcagtttttcatgatgagtccttatgttttgaaaactatgtcgactgacaagaagggtttatattcaacgtccttcaaagttcctgatgtttatggagttttccagttcaaagttgagtaccaaaggctgggatatactggtctgtcctttacaaagcagattccagtacgcccgtacaggcacaatgagtatgagagattcataacatcagcatacccatactacactgcctcattttcaaccatgggagctttcttcatattctcgtttgtgtacctgtaccacaaatagagaacccaccggatgctgacgcgaccttgatccgtggcaccagtcaggtgctaaaagccaagtgttacccggtgcaatttttatggaaccgtattttgtagtgccaacttagataacatttcatgaccgtggtcgcactcatgaaaagcttgttcgtgctaggatgtctgatcccctctttttctctgactgtttctgatcagcacttgcgaaaacttttacagcctatatgaattgaaatgatgacagagatgtagcgagtcg

SEQ ID NO: 8364 - protein, 419 aa, Panicum virgatum
  misc_feature: Ceres CLONE 1996695
  misc_feature (7)..(433): Pfam Name: DDOST_48kD Pfam Description: Dolichyl- diphosphooligosaccharide-protein glycosyltransferase 48kD subunit
  misc_feature (3)..(430): Pfam Name: DDOST_48kD Pfam Description: Dolichyl- diphosphooligosaccharide-protein glycosyltransferase 48kD subunit
  misc_feature (3)..(430): Pfam Name: DDOST_48kD Pfam Description: Dolichyl- diphosphooligosaccharide-protein glycosyltransferase 48kD subunit
  misc_feature (3)..(430): Pfam Name: DDOST_48kD Pfam Description: Dolichyl- diphosphooligosaccharide-protein glycosyltransferase 48kD subunit
  misc_feature (86)..(435): Pfam Name: DDOST_48kD Pfam Description: Dolichyl- diphosphooligosaccharide-protein glycosyltransferase 48kD subunit
MATPRRVLLLLLALAAAALAGAEEGPRGRRLLVLLDDLAVRSSHSAFFGSLQARGFDLDFRLADDPKLSLHRYGFGGSVDQNAVLEFIDAGHDVILAADSSASDLIRGIATECGVDFDEDPEAMVIDHINYAATDVDGDHTLIAGDDLIQSDVILGSKKIEAPVLFRGIGHTANPSNSLVLKVLSASPSAYSANPKTKLASPPSLTGSAISLVSVMQARNNARVLISGSLDLFSNWFLKSGVQKAGSKKRHERAGNEQFVTETSKWVFHERGHLKAINVKHHKVGETNEPGMYRINDDLEYSVEIYEWSGTSWKPYVADDVQLQFFMMSPYVLKTMSTDKKGLYSTSFKVPDVYGVFQFKVEYQRLGYTGLSFTKQIPVRPYRHNEYERFITSAYPYYTASFSTMGAFFIFSFVYLYHK

SEQ ID NO: 8365 - DNA, 1556 bp, Panicum virgatum
  misc_feature: Ceres CLONE 1996722
  misc_feature: Encodes the peptide sequence at SEQ ID NO. 8366
aaaaaataacccgaaacaccctgcaagacttggaaatcgcacgaccccgatcagtcctccactttcctctccggcgagccgcgagtgtcaaccaagtggacccaaccgaccgaccgaccatggccaccgccgacgtccgcctctccatcgcgcaccagacccgcttcgcgctccgcctcgccgccgcgctctcctccccctccgccgccgccgcaccacccgccgccaacgccgccttctccccgctctccctccacgtcgcgctcagcctcctcgccgccggcgccgggggcgccacccgcgaccagctcaccgccaccctgggaggcgacgggcccggcgccgccgagggcctccacgcgctcgccgagcaggtggtgcagctcgtgctcgccgatgggtccgccgccggcggcccgcgcgtcgccttcgccgacggcgtcttcgtcgacgcctcgctgaagctcaagccggccttcggggaggtcgccgtgggcaagtacagggccgagacccactccgtcgacttccagacaaaggctgctgaagctgctggtcaagtgaacacatgggtggaaaaaatcacatctggtctgatcaaagagatcctccccccaggttcagttgaccacaccaccaggcttgttcttggtaatgcgctctatttcaaaggagcttggactcagaagtttgatgcatctagaacaaaagatagcgagttccaccttcttgatgggagctcagttcaagcaccattcatgtccagcacagacaagcaatatattgcgtcttacaataacttgaaggtgcttaagcttccataccagcaaggtggggacaagaggcagttctccatgtacattcttcttccagaagcacaagatggcatctggagcttggctgaaaagttgagctctgaaccagagttcctggagaagcatataccaatgcagaaggttccagtgacgcagttcaaggttcccaagttcaagatatcctttggatttgaagcatccaaattgctcaaaggtctaggcctccagctgcctttcagcccagaagcagatttagcagagcttgttgattcacctgagggacggaacttgtgtgtttcgtccattttccacaaatcatttgtcgaagtgaatgaggaaggaacggaggctgccgctgcatctgctgcaacagttgtgctcaggtcattcacgatgcccatggatttcgtcgcagatcaccctttcctgttcctgatccgagaagacatgactggtgtggtgctgtttgtcggtcacgtggtgaatcccttacttgctccatagtgcatctgtgtgtgtgttcaaagtcaccgccctggtgcgattccatcctgtcgtgtgtgcagggtcgtgacaattgatcatgcctcctgtgcaatctgacttttgttttgtttctgaataaatagatggcatgatcaatgtatgtaaggttgtgggatgatgtagctcagaattgctatacatgtccggcctccatggtcttcctgttttctgcttcaaaaaaaaaaaaaaaaaaaa

SEQ ID NO: 8366 - protein, 399 aa, Panicum virgatum
  misc_feature: Ceres CLONE 1996722
  misc_feature (3)..(389): Pfam Name: Serpin Pfam Description: Serpin (serine protease inhibitor)
  misc_feature (2)..(391): Pfam Name: Serpin Pfam Description: Serpin (serine protease inhibitor)
  misc_feature (3)..(389): Pfam Name: Serpin Pfam Description: Serpin (serine protease inhibitor)
  misc_feature (1)..(388): Pfam Name: Serpin Pfam Description: Serpin (serine protease inhibitor)
  misc_feature (3)..(390): Pfam Name: Serpin Pfam Description: Serpin (serine protease inhibitor)
  misc_feature (3)..(390): Pfam Name: Serpin Pfam Description: Serpin (serine protease inhibitor)
  misc_feature (3)..(389): Pfam Name: Serpin Pfam Description: Serpin (serine protease inhibitor)
  misc_feature (1)..(392): Pfam Name: Serpin Pfam Description: Serpin (serine protease inhibitor)
  misc_feature (3)..(391): Pfam Name: Serpin Pfam Description: Serpin (serine protease inhibitor)
  misc_feature (3)..(389): Pfam Name: Serpin Pfam Description: Serpin (serine protease inhibitor)
MATADVRLSIAHQTRFALRLAAALSSPSAAAAPPAANAAFSPLSLHVALSLLAAGAGGATRDQLTATLGGDGPGAAEGLHALAEQVVQLVLADGSAAGGPRVAFADGVFVDASLKLKPAFGEVAVGKYRAETHSVDFQTKAAEAAGQVNTWVEKITSGLIKEILPPGSVDHTTRLVLGNALYFKGAWTQKFDASRTKDSEFHLLDGSSVQAPFMSSTDKQYIASYNNLKVLKLPYQQGGDKRQFSMYILLPEAQDGIWSLAEKLSSEPEFLEKHIPMQKVPVTQFKVPKFKISFGFEASKLLKGLGLQLPFSPEADLAELVDSPEGRNLCVSSIFHKSFVEVNEEGTEAAAASAATVVLRSFTMPMDFVADHPFLFLIREDMTGVVLFVGHVVNPLLAP

SEQ ID NO: 8367 - DNA, 1472 bp, Panicum virgatum
  misc_feature: Ceres CLONE 1996876
  misc_feature: Encodes the peptide sequence at SEQ ID NO. 8368
aaaaacactagtggagagagacactcgcggctgccgtgccggctgccgagcgaccaccaagcggccagcgaggctcgggctctcggctctctccgcttgcccgcaggccgcagcagttgtcagactcgctcgcagttgcacgcgtgcacgccatgaggcctttcctgctcacgccgggcgcccgggcggcgccctcgccgtcaacgctctcgcgcctactcctctcgctccacctacaaattaatggccggcgcaaccacctccgtcgtcacgtccacgcttcctcagcctctccacctcttctcatcaacccgcgcctccgcaaccgccgggcccgattcttcgccggcgccgcctcctcctcctccccctcccagatggcggcgccagctgatgcccccggcggatcggctgatgccttcgaggtgatccgcgctcaccaggcaaaagctgctcgtctttctccagtggaagaaatacggaccattatggaccggagtgtcagaggtgttcttgccacccattctcaggaacatgctggttatccttctggttcaatggttgattttgcatgtgatcaggatggctccccaatattagcagtcagtagtttagcagttcattcaaagaatctctccggaaatcctaaatgctcacttcttatagccaaagaccctgaggacagaacagatactgtgatcactgtatatggtgatgctgtccctgtttctgatgaacaaaaagattcagtgagaagtgcttacctacgaagacatcctgatgccttttgggttgattttggtgacttcagtttcctgcacattaaacctaaagctgtgcgctatgtatctggtgttgcaactgctctccttggctctggagaattcagtcctactgagtacaaggaagcaaaagttgacccaatatctcaattctcaactcctatcacaagccatatgaataaggatcacgctgatgatacaaagctcattgtgcaacattcaaccactgttaaggtggattttgcttatatgctggatgtggatagccttgggttcaatgtgaaggccggttatgatggaagtgttctgaagttgcgtattcccttccctaggcaggcgcaagacaggaaggatgttaagacactaattgtggaaatgctccaagctgcaaaagccgcatcttcacatgctgattgattgccatagttctggaaggtgttgaatctgtcaatgtaaatgaaagatagctagatcaataagagcccaggcttacgttcagttggtctatgtggaagatggagctacaaatatgttcatggtttgatgcattgctttgttgtatataacaaacaacagtacgtgaagcacttccagttgaaccaacgggaagcaacttgtatgcaactcatttgaacttgttgttcagcaaacaaaacaagttatcttaccgaaaaaaaaaaaaaaaaaaaa

SEQ ID NO: 8368 - protein, 348 aa, Panicum virgatum
  misc_feature: Ceres CLONE 1996876
  misc_feature (1)..(94): Pfam Name: Pyridox_oxidase Pfam Description: Pyridoxamine 5'-phosphate oxidase
MRPFLLTPGARAAPSPSTLSRLLLSLHLQINGRRNHLRRHVHASSASPPLLINPRLRNRRARFFAGAASSSSPSQMAAPADAPGGSADAFEVIRAHQAKAARLSPVEEIRTIMDRSVRGVLATHSQEHAGYPSGSMVDFACDQDGSPILAVSSLAVHSKNLSGNPKCSLLIAKDPEDRTDTVITVYGDAVPVSDEQKDSVRSAYLRRHPDAFWVDFGDFSFLHIKPKAVRYVSGVATALLGSGEFSPTEYKEAKVDPISQFSTPITSHMNKDHADDTKLIVQHSTTVKVDFAYMLDVDSLGFNVKAGYDGSVLKLRIPFPRQAQDRKDVKTLIVEMLQAAKAASSHAD

SEQ ID NO: 8369 - DNA, 1356 bp, Panicum virgatum
  misc_feature: Ceres CLONE 1996977
  misc_feature: Encodes the peptide sequence at SEQ ID NO. 8370
atatgtggtcatcctcatcagacacacacacacacactactctcgttaacatcgagagaggggggccagcttcacctcggaagctcaggctcgcaggatgcaacaagaacatggccaagcttcaatggttgaggaagggtgtgacagctgcaggaagtggcaagagcactactactgggagcacatggatgtgagcaagatccgcttcttcaagctaatgaccggagattttgccaagggcactagcataccagagaagttcgcacagaatttcaaggggcagattactggagggttcgaactgaatgcgccgagtggcaaaacatggcacatcagtgtagataagcgtggagatgaactgttcctcatgtcaggatgggaggattttgttaaggctcatgaactacaggagaatgatctcctgctcttcacatgctgtggcaactcttcctttcaggtgctagtcttcgaagcaagtggttgtgagagagtgtcttctatgtttggcaaccaaattggtcctgatatgtgcaaacatgtcaagaatatcgtgggtcaacatggtgaacctgacgctccaaacacaagcaacttcattgtcaattattctgcaaacagtgatgatggtagtgatgacgattttgccaactctaactgctactactcgatgtttgccaatcgcctaagagatgaggaaaaggaggagataataggtttggcttccatccaacggaacaatcctgcttttgtgactgttctgaagaaacagcatgttcagcgcaacaacaactctctgatcatcccctgtagatttgctgctgatcatctagaggaaagatcgcaggatatcatacttcgtaggccaaacaggaaagataagtggctcgtaagctactactactcgtgctacacacgatgcttccaaaacttgccatttttcaagtttgtgcgcgacaacaagctccgggagggtgacatctgcgtcttcgagctgttgaaaggcaaaatgagggtgacaatgaccgtccatgtcatcagaaaggccagtgaccggtttattctggtgggataagttgcgttgtatcctccaagagtagacatgtaggatgtgcacttgtactggtgatgaagtttctgcagtatgtactatcccaagagtggcactggaaacttaaaactggaagtgcctagcattatcccttgctttgtaggaagtgcacttctgtatcctctaagttaacttcttgatgcagcagtatggctgctagaacaaggtgtgacctgtgtaatgtaaatgtttctaagcaaatggtgccctaaggtggtggtttgtgccaaaaaaaaaaaaaaaaaaaa

SEQ ID NO: 8370 - protein, 324 aa, Panicum virgatum
  misc_feature: Ceres CLONE 1996977
  misc_feature (1)..(98): Pfam Name: B3 Pfam Description: B3 DNA binding domain
MQQEHGQASMVEEGCDSCRKWQEHYYWEHMDVSKIRFFKLMTGDFAKGTSIPEKFAQNFKGQITGGFELNAPSGKTWHISVDKRGDELFLMSGWEDFVKAHELQENDLLLFTCCGNSSFQVLVFEASGCERVSSMFGNQIGPDMCKHVKNIVGQHGEPDAPNTSNFIVNYSANSDDGSDDDFANSNCYYSMFANRLRDEEKEEIIGLASIQRNNPAFVTVLKKQHVQRNNNSLIIPCRFAADHLEERSQDIILRRPNRKDKWLVSYYYSCYTRCFQNLPFFKFVRDNKLREGDICVFELLKGKMRVTMTVHVIRKASDRFILVG

SEQ ID NO: 8371 - DNA, 1218 bp, Panicum virgatum
  misc_feature: Ceres CLONE 1996997
  misc_feature: Encodes the peptide sequence at SEQ ID NO. 8372
tctccatctctagggtttgggattttagccgccgccgccgccgctcctcacgtccttgagaagtcgcagccgacgtagtcctcgccggatccgatggccgtgactttctctgagcttcacaccgccgacggcctcaacgccctcgaggcgcacctcgccggcaagacctacgtctccggggatgccatcagcaaggacgacattaaggtgtttgcggcggtgccgtcgaagcctggtgccgagttccccaatgctgcccggtggtacgagaccgtcgccgcggctgttgcctccagattccctggcaagggtgttggtgtgaatctgcctggagcccgatcggctcctgcagcagcagcagctcctgcggctgaggttgccaaggatgatgatgacttggatcttttcggtgatgaaactgaggaggacaagaaggctgcagatgagcgtgcggctgccaaggcctctgccaagaagaaagaaagtggcaagtcctctgtcctgatggacgtgaagccgtgggacgatgaaactgacatgaagaagcttgaggaggctgttcgcagtgtccagatggagggtctcacttggggagcttcaaagcttgtgcctgttggttatggtatcaagaagatgacaatcatgttgaccattgtggacgacctcgtgtcagttgacagtctgattgaggaccacctcacggaggcacccatcaacgagtatgtccagagctgtgacattgttgccttcaacaagatctagaatcccaattgttgggcactaaatctgctgctggggtcttggaactggattggttgtgatggaaagccctcaagtttcctgtgggatgcgagctcttaccccttttagtaactctgctatagaaatggtcggtccgagtctattgttaagtgctgccaggtttttgaatgtctgtttatcttgaatagttgaactgctgggcagtgaaacatgtgctgtgtctaaagtacaccagttttctttgcaatgctagttttgaacattatattatatatgtttgcctaatccagttcttttgctgacctggtgctcgtgtattttgattcattctagcttgtaacagatatacccagcgtgtgaataagttgtgtactcgcgtgctaccgtctggtgcttttgacgtgacatttgtatatttttactgcattctgcgctcaaaaaaaaaaaaaaaaaaaa

SEQ ID NO: 8372 - protein, 222 aa, Panicum virgatum
  misc_feature: Ceres CLONE 1996997
  misc_feature (1)..(46): Pfam Name: GST_C Pfam Description: Glutathione S-transferase, C-terminal domain
MAVTFSELHTADGLNALEAHLAGKTYVSGDAISKDDIKVFAAVPSKPGAEFPNAARWYETVAAAVASRFPGKGVGVNLPGARSAPAAAAAPAAEVAKDDDDLDLFGDETEEDKKAADERAAAKASAKKKESGKSSVLMDVKPWDDETDMKKLEEAVRSVQMEGLTWGASKLVPVGYGIKKMTIMLTIVDDLVSVDSLIEDHLTEAPINEYVQSCDIVAFNKI

SEQ ID NO: 8373 - DNA, 1373 bp, Panicum virgatum
  misc_feature: Ceres CLONE 1997060
  misc_feature: Encodes the peptide sequence at SEQ ID NO. 8374
accgatgctaaaaccccagacggcgtggacagcttccctccctctcttcctcctccgtcgctgctcgagatccgcgctcaacccctttcctcccggcggccgccggcttccctgtctcccggtttgcaagcggcggatgagcacgcaggcgcagcccaggttcgcccccctccctacggagcaatctgaatcccaaaccgatgccggggctgcaaggcatcagttccggctggtctcctacaacattttggcccaggtttatgttaagagtgcgtttttcccgcattctccatctgcgtgcctcaagtggaaatctcgatccacagctgttctaacagagctcaagagttttgatgctgacctcatgtgcatacaggagttggatgagtatgataccttctacaagaaaaacatggaaagttctggatattcaagtatttacattcagcgatctggagacaaacgggatggctgtggtatattctataaaccaaaaagtgcagaactggtgcagaaagaaggaatacattacaatgatttagtggaaaaatatgttcctagtgatcacgtaaatagtgcctcgcctaataattcttcaccagaagaagacacaaattcaaagcaacataataacaagcgtggagatccaaatgatccacgcgtaagactgaagcgtgactgtgttggtttacttgcagctttcaagcttagtgacccctgtgatcacattttaatagtggcgaatacacatatttattgggacccagaatggattgatgtaaagttggcgcaggcaaaatatcttctttcgagagtatctcagtttgagcaactcatctcaaacaaatttaattgtaaaccttcagtgatcattgctggtgacttcaattcgaccccaggtgacaaggtatacaattgccttgtgtcagccaatatagaatctacagatgaagctcctatcaagttacgcagcctttatgctgcgaatggaggggagccagaattcacaaactacactcctggttttactggaacactggactacatattcttgtcagatggtagttcaataaaacctaccagcctgcttcgtttgccgcgaggggattccaaggaggtgcaaggagggctgcccaactttcagcatcctagtgatcatctaccaattggtgctgattttcttgtagttaacagctagtacaaaggctcgttgcttttcctacagcaataacaaattatttttgtggcactttcacagttcaggcttcagagtcaacatgtaatatctcatatctcgagtcacatttaattgtttatcttcttgtggaaccaatagcgactaataataccaacaaaaaaaaaaaaaaaaaaaa

SEQ ID NO: 8374 - protein, 397 aa, Panicum virgatum
  misc_feature: Ceres CLONE 1997060
  misc_feature (1)..(319): Pfam Name: Exo_endo_phos Pfam Description: Endonuclease/Exonuclease/phosphatase family
MLKPQTAWTASLPLFLLRRCSRSALNPFPPGGRRLPCLPVCKRRMSTQAQPRFAPLPTEQSESQTDAGAARHQFRLVSYNILAQVYVKSAFFPHSPSACLKWKSRSTAVLTELKSFDADLMCIQELDEYDTFYKKNMESSGYSSIYIQRSGDKRDGCGIFYKPKSAELVQKEGIHYNDLVEKYVPSDHVNSASPNNSSPEEDTNSKQHNNKRGDPNDPRVRLKRDCVGLLAAFKLSDPCDHILIVANTHIYWDPEWIDVKLAQAKYLLSRVSQFEQLISNKFNCKPSVIIAGDFNSTPGDKVYNCLVSANIESTDEAPIKLRSLYAANGGEPEFTNYTPGFTGTLDYIFLSDGSSIKPTSLLRLPRGDSKEVQGGLPNFQHPSDHLPIGADFLVVNS

SEQ ID NO: 8375 - DNA, 1110 bp, Panicum virgatum
  misc_feature: Ceres CLONE 1997100
  misc_feature: Encodes the peptide sequence at SEQ ID NO. 8376
cagttcccggccttccccattctgctccgcaccgcactggcatcggtattcccgatggcggcggcgcccgccctcctctcgctaactcccgccgtctccaggcacgcgcacctccacttctcccgttgcccctcgccgcgccacctccgcctcgcccctcccgccgccgcccccaccccggggggcagccccggccccggcgtcttcctgtcgccgcgcgcgctctcgcagctcgacgagctcgcggccttccgctacgagcacgccttcccgcacggcctcctcaccgtgcgcgccctcacccgcggccccgaagacgacgccgtggccgaggcgctcgtccgcctcctggcctcctcgttctccgagaccgtccggtgggccccggcccagcgctacgagcagctcctcacgttcgtcatccgcaggtacctccacgagcgccgcgggctcgcgccgcacgccgcggtgctcgtggggttctaccgccccgccgacgcggtggacgcggccgacgccacggaggatgacggagatgagggcagcgaagatgggggaggtaaagatgaaggggagatggcgtgcacggcggaggtgtcgttcgacgcggtgggcgcgcccggggccccgcccacgcccaccccgccgctcgacttcccgtacatctgtaacatgactgtgaagacggcattgaggaggagaggaatcggaaaacaacttcttaaggcatgtgaggatttggtcatcaaaatggatgcaaaaagacgtgtacatcttcattgtcgaattatcgatcaagtgccattcaacatgtacaggaaagctggatataacattgtcgagactgacaatattttggtttggctgagccttcaaaagcggaagtatttgatgagcaaggaattaccccaagcttctgttgttgagccttcaaccaaagactttgatgataatattttgacacgctaaacgttcaacaggatcaacaggtacacatgaggttgaattttgtgtataaatgtatggttctgttcgtcacatattttcacaactgccattcattaattggctatcacaaaattatttagttaaaaaaaaaaaaaaaaaaaa

SEQ ID NO: 8376 - protein, 304 aa, Panicum virgatum
  misc_feature: Ceres CLONE 1997100
  misc_feature (1)..(123): Pfam Name: Acetyltransf_1 Pfam Description: Acetyltransferase (GNAT) family
MAAAPALLSLTPAVSRHAHLHFSRCPSPRHLRLAPPAAAPTPGGSPGPGVFLSPRALSQLDELAAFRYEHAFPHGLLTVRALTRGPEDDAVAEALVRLLASSFSETVRWAPAQRYEQLLTFVIRRYLHERRGLAPHAAVLVGFYRPADAVDAADATEDDGDEGSEDGGGKDEGEMACTAEVSFDAVGAPGAPPTPTPPLDFPYICNMTVKTALRRRGIGKQLLKACEDLVIKMDAKRRVHLHCRIIDQVPFNMYRKAGYNIVETDNILVWLSLQKRKYLMSKELPQASVVEPSTKDFDDNILTR

SEQ ID NO: 8377 - DNA, 1156 bp, Panicum virgatum
  misc_feature: Ceres CLONE 1997214
  misc_feature: Encodes the peptide sequence at SEQ ID NO. 8378
gccatcgcctcgctccagcgccccgccgaggccgaagccctagcgcgccgccgtccccctccgccgcacgcgtgccggtccgggagcccttccaccccacgcggcggttccccgtctcgcccccttcccgttggccccccgatgacgaggaccaacggcgccagcggcggcggcggccagcagcagcagcagccgtcggctgcggggaagctcccccggaagcggttctaccgcgcccgggcgcacagcaacccgctcagcgactcgcacttcccggtcccggtgtcgcccgacgaggtcgacctctcgcagcactacccgcgctacttccctgccgacaacggtggcggcgaggaggcgccgccgccgccgccgaggatccgcttcgcggacgtggggtgcgggttcggcgggttgctcgtcggcctctcgcccctcttcccggacacgctcatgatcggcatggagctgagggacaaggtaactgagtatgtcaaggagaggatattagctttaagagcatcaaacccaggacagtatgacaacatatctgttgtgcgcacaaactcaatgaaatacatccctaactacttcaggaaggctcagctcaccaagatgttcttcctgttccctgatcctcacttcaaggagaagaaccatcgaaggagggttattagcatgcagttgctggatgagtatgcttatgtgatggaagtaggaggaatcatatataccatcactgacgttgaggaacttggagaatggatgcggtcgtgtctggagaaacacccattatttgaagctgttcccgatgaagagataaaagctgatccagttgtcaagttactgtctactgccacagaagaaagccagaaggttgctagaaatggagggcaaactttccatgccatcttcaggcggatctccttacaagaagaatgagtcatttgggagcttattagctcgtagtgtacttccctagatcgtgttacatgtgtttgtcgtgttacatgtgtttgtcatctttgtgagctttttagcagatagttgcgatgagttcaaactcagattctgtcataaaacctaagttgcaggattgtaaagtcgatagctatgtgcaagcgctttcctaatcagaaaaaaaaaaaaaaaaaaa

SEQ ID NO: 8378 - protein, 266 aa, Panicum virgatum
  misc_feature: Ceres CLONE 1997214
  misc_feature (1)..(216): Pfam Name: Methyltransf_4 Pfam Description: Putative methyltransferase
  misc_feature (25)..(261): SWISSPROT Homolog: guanine-N(7 tRNA
MTRTNGASGGGGQQQQQPSAAGKLPRKRFYRARAHSNPLSDSHFPVPVSPDEVDLSQHYPRYFPADNGGGEEAPPPPPRIRFADVGCGFGGLLVGLSPLFPDTLMIGMELRDKVTEYVKERILALRASNPGQYDNISVVRTNSMKYIPNYFRKAQLTKMFFLFPDPHFKEKNHRRRVISMQLLDEYAYVMEVGGIIYTITDVEELGEWMRSCLEKHPLFEAVPDEEIKADPVVKLLSTATEESQKVARNGGQTFHAIFRRISLQEE

SEQ ID NO: 8379 - DNA, 1560 bp, Panicum virgatum
  misc_feature: Ceres CLONE 1997220
  misc_feature: Encodes the peptide sequence at SEQ ID NO. 8380
ggggatcccagtggacactagtggcgggcagaaagcggcaggttaggacgccggggtccgggtgtgggcttgccaccggttacgcagtgagatcctttgcctcccggctccggcgtactgactgaaactttgcttacctgccgccgcccctgctcttgacccgccagccaacgcccaacgccgtctgccgcagctgggaagttgtctctgccggcggccgtctagcatacccatggccttgtccggcgagaagcggcctccgccgccggtagctgcctccggcgggacaaggaggaagcttatcctagcactgtttgtgtccttgtcggcactgttttacaagcagattcagccgccaccgcccaagatccccggctccccgggcggccctccggtgacggcaaccagaacaaggctcagtgacggcaggtacctggcctacctggaatccggcgtcccgaaggaggaggccaagtacaagatcatctttgtccacggattcgactcctgcagatacgacgcgctcccgatttccagggagctggtgcaggagctgggcatctacctgctgtccttcgaccggcccgggtacgccgagagcgacccgcacccgggccggacggagaagagcgtcgccctcgacatcgcggagctcgccgacaacctgcagctgggccccaagttctacctcgccggcttctccatgggcggcgagatcacgtggagctgcctcaagcacatcccgcacaggctctccggcgtggccatcctcggccccgtgggcaactactggtggcccgggctgccggcgaacgtgtcgcgggaggcctggtaccagcagctcgcgcaggaccggtgggcggtctgggtcgcccaccacctgccgtggctgacccactggtggaacacccagaaggtcttcccggcgtccagcgtgatcgcctacaaccccgccctcctgtccgaggaggacaagctggtcatccagaagttcgcccacagagcctacatgccgcagatccgtcagcagggggagcacgagtgcctgcaccgggacatgatggtggggttcgggaggtggagctggagcccgctgcagctggaggacccgttcgccggcggcgggcgggggaataaggtgcacctgtggcacggcgccgaggaccggatcgtgccggcgagcctgtcgaggcacatcagcgggaagctgccgtgggtcgtgtaccacgagctccccacgtcggggcacctcttcccgatcgccgacgggatggccgacgccatcgccaggtccctgctgctcggggaagacgacgacggcccgcagccggcccgagacccttagtcgatcacccgggctggtttctccacgaaatccacgccctgcttaaccggcttaccatcatgctgctactgctactgctcatgtgcgctgaataaagtctcaatgcaacttgtaagaacttcgtgagaaacgtacgtgtccttttctggtctctctttttttttttttttgagaattttttgctggtctcgttgcaaaaaaaaaaaaaaaaaaaa

SEQ ID NO: 8380 - protein, 370 aa, Panicum virgatum
  misc_feature: Ceres CLONE 1997220
  misc_feature (1)..(227): Pfam Name: Abhydrolase_1 Pfam Description: alpha/beta hydrolase fold
MALSGEKRPPPPVAASGGTRRKLILALFVSLSALFYKQIQPPPPKIPGSPGGPPVTATRTRLSDGRYLAYLESGVPKEEAKYKIIFVHGFDSCRYDALPISRELVQELGIYLLSFDRPGYAESDPHPGRTEKSVALDIAELADNLQLGPKFYLAGFSMGGEITWSCLKHIPHRLSGVAILGPVGNYWWPGLPANVSREAWYQQLAQDRWAVWVAHHLPWLTHWWNTQKVFPASSVIAYNPALLSEEDKLVIQKFAHRAYMPQIRQQGEHECLHRDMMVGFGRWSWSPLQLEDPFAGGGRGNKVHLWHGAEDRIVPASLSRHISGKLPWVVYHELPTSGHLFPIADGMADAIARSLLLGEDDDGPQPARDP

SEQ ID NO: 8381 - DNA, 1705 bp, Panicum virgatum
  misc_feature: Ceres CLONE 1997703
  misc_feature: Encodes the peptide sequence at SEQ ID NO. 8382
aacgcgatcagtgagccgtcccctctcggctctcgcttgcctcgccacgggtgacaactggcagagtgagtcactcggcggccttgccccggaacgaattattggccgacggcgcgatgctccagggcgtgttgtcccgcgcgcccgccaccgacgcgccagcagcggtagcgatgaaggccaagcgggcgccggcgtcccccgacgatgaggatgacggggagggccgcccggcgccggggaagcggcagcagctgcttgggctcggctccgcctcggcggcggcggcggatgaggagggcccggagacgcggggtcttcggctgctaagcctcctgctccggtgcgcggaggcggtggccatggaccagctgacggaggcgcgggagctgctgcccgagatcgccgagctggcgtcgccgttcgggtcctccccggagcgcgtggccgcctacttcggcgacgcgctgtgcgcgcgcgtgctcagctcctacctgggcgcctactcgccgctcgcgctccgcccgctggcggccgcgcagagccgtcgcgtcgcgggcgcgttccaggcgtacaacgcgctgtcgccgctcgtcaagttctcgcacttcaccgccaaccaggccatcctgcaggcgctccacggcgaggaccgcctccacgtggtcgacctcgacatcatgcagggcctgcagtggccgggcctcttccacatcctcgcctcccgcccgcgcaagccgcgctcgctccggatcaccgggctcggagcctcgctcgacgtcctcgaggccacgggccgccgcctcgccgacttcgcggcctcgctcggcctgcccttcgagttccaccccatcgaggggaagatcgggcacgtcgcggacgccgcggcgctgctcggcccgcgccatcaccaccaccacgaggccaccgtcgtgcactggatgcaccactgcctctattacgtgacggggtcggacctgggcacggtgcggctgctcaggagcctgcgcccgaagctcatcaccatcgtggagcaggacctgggccacagcggcgacttcctcggccggttcgtggaggcgctgcactactactcggcgctgttcgacgcgctgggcgacggcgccggcgccggcgcggcggcggaggagtccgccgagcgccacgccgtggagcggcagctcctgggcgcggagatacggaacatcgtggccgtgggcggacccaagcggaccggggaggtgcgcgtggagcggtggggcgccgagctgcggcgcgctgggttccggccggtgtccctggccgggagccccgccacgcaggccaggctgctcctcggcatgtactcgtggaaggggtacacgctggtggaggaggacgcgtgcctcaagctcggctggaaggacctctccctgctcaccgcgtcggcgtgggagccggcggacgccgccgctgcccccacgccacgccgcggaagccaggagacgtaattgcaagccaagattttgccgcagcacctagattggcaaccattctcgatcacttgtgctgctaatctcgcagctccttcgtggccacttctgtttcttgttgtctcccctgttcgtcttcttcttgtgagtaacttgtgtttgtgatataaatcgtgtaggattcggcattcgttccatctccatgctcaaatcaacattccatttcagattct

SEQ ID NO: 8382 - protein, 457 aa, Panicum virgatum
  misc_feature: Ceres CLONE 1997703
  misc_feature (1)..(208): Pfam Name: GRAS Pfam Description: GRAS family transcription factor
MLQGVLSRAPATDAPAAVAMKAKRAPASPDDEDDGEGRPAPGKRQQLLGLGSASAAAADEEGPETRGLRLLSLLLRCAEAVAMDQLTEARELLPEIAELASPFGSSPERVAAYFGDALCARVLSSYLGAYSPLALRPLAAAQSRRVAGAFQAYNALSPLVKFSHFTANQAILQALHGEDRLHVVDLDIMQGLQWPGLFHILASRPRKPRSLRITGLGASLDVLEATGRRLADFAASLGLPFEFHPIEGKIGHVADAAALLGPRHHHHHEATVVHWMHHCLYYVTGSDLGTVRLLRSLRPKLITIVEQDLGHSGDFLGRFVEALHYYSALFDALGDGAGAGAAAEESAERHAVERQLLGAEIRNIVAVGGPKRTGEVRVERWGAELRRAGFRPVSLAGSPATQARLLLGMYSWKGYTLVEEDACLKLGWKDLSLLTASAWEPADAAAAPTPRRGSQET

SEQ ID NO: 8383 - DNA, 1165 bp, Panicum virgatum
  misc_feature: Ceres CLONE 1997706
  misc_feature: Encodes the peptide sequence at SEQ ID NO. 8384
aaaagcaaagcctcacagctgcgcagttccagcctccatagctcggccagcaaactcttcagcctcgtcatatccatcgcctccgattccctggcgtttgcttcctccctgggaggtcatagctagctgctcgccctgtctcggtgaggagcgacgagctgagggtacgccgaatcacggtcgggatgaagagccggaggcagagcagcgggggcagctcgggcggcgcgacggccgcgggggtggggaacacgcacagcagcggcggcgggtgcaagctggagaggaaggacgtggagaagaaccggcggctgcacatgaagggcctctgcctcaagctctcctccctcatcccgcccgccgccaggcgcgcgtccctgctctcggaggcggcggcgtccgcgtccaaccccaacaaggacgcggcgacgcagctggatcagctggacagcgcggcggcgtacatcaagcagctcaaggagcgggtcgatgcgctgaagcggaggaaggagggcggcgccgtgcgcatgccggtggtcgaggtgcggtgccaggacggggcgacgctggacgtggtgctcatcagcgaggccgggcggccgttcaagctgcacgaggtgatcacggcgctggaggaggagggcgccgaggtcgtcagcgccagcttctccgtcgtgggcgacaagatcttctacaccatccactcgcaggcgctcagcccccggatcgggctcgacgccgccagggtctccgagaggctgcacgacctgctgctcctcgtctgacgaaccacctactgaagaccaccagcgacggtgctgacgagggagagatctactgtattgttagcgtagctatagtcgaggtcaggacgcacggagcgcggtagcaggggacggatccaggggagggaagctgcaggtttcttagcagttgtgcatctgtaggagcaagcgagcagactgcttttttttttttttggcttgttttttcagctcttagaacgaaacggccggtgctgtgtaccacactggagtgtacatgcatcctgtctctgttctattacgtgctgtttcagcttcctgtactactgatgctcactccacggaatcggatgcacacttgtgttcctgtgtgttgcagttgcagcacgtttccagaatcc

SEQ ID NO: 8384 - protein, 199 aa, Panicum virgatum
  misc_feature: Ceres CLONE 1997706
  misc_feature: Great-hit functional homolog of the protein sequence given in SEQ ID NO 9607
  misc_feature (2)..(72): Pfam Name: HLH Pfam Description: Helix-loop-helix DNA-binding domain
  misc_feature: Useful for making plants with altered Lignin content
MKSRRQSSGGSSGGATAAGVGNTHSSGGGCKLERKDVEKNRRLHMKGLCLKLSSLIPPAARRASLLSEAAASASNPNKDAATQLDQLDSAAAYIKQLKERVDALKRRKEGGAVRMPVVEVRCQDGATLDVVLISEAGRPFKLHEVITALEEEGAEVVSASFSVVGDKIFYTIHSQALSPRIGLDAARVSERLHDLLLLV

SEQ ID NO: 8385 - DNA, 1192 bp, Panicum virgatum
  misc_feature: Ceres CLONE 1997710
  misc_feature: Encodes the peptide sequence at SEQ ID NO. 8386
atcctaccacccacatccattcctccctccgtcctgctcggctgctgggccttcctctgctctggctctgctcagggctgttcggctgatttaaaagccggctgatttcggctgatttaatagtaccatgtgagaagaaataagccaaaacaagccgaaataagccgggaaaagaaaagcgaacagggaattgatacagtgaagtgaaggcagtcagattttaagatggagttaaaagctagaatatttaccgtggccatggccattgtgctctcctcaccagcaactgctcagaagagtcctcctgctccagcgacctcagttcttccaccagctccggcaccagcacctgcgccgcaccatgtggaccttgctgatctcttcagtgtggccggcccattccacaccttcctggagtacctgcaaaagaccaatgtcattgagaccttccagaaccaggcaaacaacaccaaggagggcatcaccatctttgttcccaaggactcagccttcgctgcactgaagaagaccacatttgccaacctcacccaggaccagctcaagtccctgctcctgtaccatgcgctccccaagtactactctctggccgagttcaacaagctgagcaccctcaacccggtggccaccttcgctggctcacaatacactctgaacctcacctacaacatgggcaccatccaagtgaagtcgatgtggtccaatccaaagatcagcagcagtgtgtactcaacccgcccggttgcagtgtacgaggtcaacaaggttctcctgccaatgcagatcttcaagagcaaccccccactcactccagcccctgctcctgccccagatgccaaggcctctgatgtcgctcccagcccaacctcagggaaagcagcgagcgcaaaggcgaaggcagacgagaagaattcatcatatcaagtcggtgtcagcgtcgttacttatttggcccttgctgtctcaggtggtttgatgctcttctggtgagaattgaaaagttctgaccatgttaaagcacagggttcagcttagcttccccgtcttcaatgttatatggattttctggattcattcttttggacatatagtaggcattgtgttaggattgagttgttgagtgtttgcaccatatacttctatgattactcccgaaaaaaaaaaaaaaaaaaaa

SEQ ID NO: 8386 - protein, 260 aa, Panicum virgatum
  misc_feature: Ceres CLONE 1997710
  misc_feature: Great-hit functional homolog of the protein sequence given in SEQ ID NO 9209
  misc_feature: Useful for making plants with altered Lignin content
  misc_feature: Useful for making plants with altered cell wall content and/or composition
MELKARIFTVAMAIVLSSPATAQKSPPAPATSVLPPAPAPAPAPHHVDLADLFSVAGPFHTFLEYLQKTNVIETFQNQANNTKEGITIFVPKDSAFAALKKTTFANLTQDQLKSLLLYHALPKYYSLAEFNKLSTLNPVATFAGSQYTLNLTYNMGTIQVKSMWSNPKISSSVYSTRPVAVYEVNKVLLPMQIFKSNPPLTPAPAPAPDAKASDVAPSPTSGKAASAKAKADEKNSSYQVGVSVVTYLALAVSGGLMLFW

SEQ ID NO: 8387 - DNA, 908 bp, Panicum virgatum
  misc_feature: Ceres CLONE 1997820
  misc_feature: Encodes the peptide sequence at SEQ ID NO. 8388
acacagccttcgcaacctcctctccccaaatcaaacccggcccaccgcctcccaccaccgcgaacccgagcgggatcatccatggcgcccaaggcggagaagaagccggcggcgaagaagcccgcggaggaggagccggcggccgagaaggctcccgcggggaagaagcccaaggccgagaagcggctcccggcgggcaagtcggcggggaaggagggcggcggcgacaagaaggggaagaagagggcgaagaagagcgtggagacgtacaagatctacatcttcaaggtgctcaagcaggtccaccccgacatcggcatctcctccaaggccatgtccatcatgaactccttcatcaacgacatcttcgagaagctcgccgccgaggccgccaagctcgcgcgctacaacaagaagcccaccatcacctcccgcgagatccagacctccgtccgccttgtcctccccggcgaactcgccaagcacgccgtctctgagggcaccaaggccgtcaccaagttcacatccgcttaggttggtggtgctaagtactagtttggtggtgctggtacctatggctcagtttatctgtttagactggtaggggtagctgcggttggagtagtgaagtactccgtacaatggatggatgctatcctctgtagttgggtgtcgttaactagctgtatgatgatttgcggtgctgcctatggaacactgtaaattcatggatctggattataactattgctatgcgaactattgccgtacctgcttagtgaagtgatgataattgctgtgtgaagcttggctttggatggtgaaattgctgggctgtgtcgaacagtgaactttctatataactagcaggctttttttgtagttcagaaaaaaaaaaaaaaaaaaaa

SEQ ID NO: 8388 - protein, 150 aa, Panicum virgatum
  misc_feature: Ceres CLONE 1997820
  misc_feature: Great-hit functional homolog of the protein sequence given in SEQ ID NO 9491
  misc_feature: Useful for biocontainment applications
  misc_feature: Useful for making plants with modulated flowering time
  misc_feature: No seed is being produced by the plant
  misc_feature: The plant flowers significantly late compared to wild-type.
MAPKAEKKPAAKKPAEEEPAAEKAPAGKKPKAEKRLPAGKSAGKEGGGDKKGKKRAKKSVETYKIYIFKVLKQVHPDIGISSKAMSIMNSFINDIFEKLAAEAAKLARYNKKPTITSREIQTSVRLVLPGELAKHAVSEGTKAVTKFTSA

SEQ ID NO: 8389 - DNA, 1323 bp, Panicum virgatum
  misc_feature: Ceres CLONE 1997843
  misc_feature: Encodes the peptide sequence at SEQ ID NO. 8390
ctcctcctcctcctccccttccgcttccgcccctcccaaatcccccagacctgacgcgttggagcgccgattcgcggctcgcggctgcttgattcgaccgggctcgtcgtccccgccggtgatccgcgggggatggggtacctgagcaccgtgatcggccaccccaccgacggatcgcccgtcagcggcggcggcctcagccagaatggtaaatttagctatggttatgcaagctcccctggtaaaagggcttccatggaagacttctatgaaacaaagattgactgtgttgatggtcagatagttggcctttttggagtttttgacggtcatggtggggctaaagtagcagagtatgttaaagaaaacctgttcagccatcttcttaggcatccaaagttcatgagtgataccaaagtcgctatagatgatgcttataaaagcaccgacagtgaattcttagaatctgatagtagtcaaaatcaatgtgggtctactgcatcaactgctgttcttgtcggtgatcgtctctttgtcgcaaatgtcggggactctagggctatcatatgcaggggtggaaatgctgttgctgtttcaaaagatcacaagcctgatcagacagatgagcggcagcgtattgaagatgctggaggttttgtgatgtgggcaggaacatggcgtgttggtggtgtacttgcagtttcacgcgcttttggtgacaaactcttaaagcaatatgtagttgtggatccggagatccgagaggaagttgtcgatgacacacttgagtttctcatccttgcaagtgatgggctgtgggatgtggtctctaatgaggaagctgtcgccctgaccagatccattcaggacccggaagaagctgcaaagaagctcctgcaagaggcctacaagagggagagcagtgacaacataacctgtgttgtcgtgcgcttcttgcacgggcaaggtactagcggatatgcttaaagcaaagcagtaaaagtaccctatgccgtgtgtgctaatagatgcgttgattgatggttccaaggttaaatggagaaatggtgaagctaggatacgtgtatcctgttgactaatgggagttaccgggaaatgtgtgtaccttattaggttaaacaataagtttgctggccgctgttcaccgtagtttcgtcgcagtggatgtggggtctgacgatagtgttgtattgttgtggaaaaaaacacgatatgtggagacttttgatcgtctccatcagtttccacttttggaagtgaattgctgcagacattttctttcaaaaaaaaaaaaaaaaaaaa

SEQ ID NO: 8390 - protein, 284 aa, Panicum virgatum
  misc_feature: Ceres CLONE 1997843
  misc_feature (1)..(240): Pfam Name: PP2C Pfam Description: Protein phosphatase 2C
MGYLSTVIGHPTDGSPVSGGGLSQNGKFSYGYASSPGKRASMEDFYETKIDCVDGQIVGLFGVFDGHGGAKVAEYVKENLFSHLLRHPKFMSDTKVAIDDAYKSTDSEFLESDSSQNQCGSTASTAVLVGDRLFVANVGDSRAIICRGGNAVAVSKDHKPDQTDERQRIEDAGGFVMWAGTWRVGGVLAVSRAFGDKLLKQYVVVDPEIREEVVDDTLEFLILASDGLWDVVSNEEAVALTRSIQDPEEAAKKLLQEAYKRESSDNITCVVVRFLHGQGTSGYA

SEQ ID NO: 8391 - DNA, 1187 bp, Panicum virgatum
  misc_feature: Ceres CLONE 1997860
  misc_feature: Encodes the peptide sequence at SEQ ID NO. 8392
gtttccctccacgccccgcgcccgtctctcttccctcctccattttgagatcaaaacctggggccagctcgccctttttcttcttctgccctccctccacccgtccatcgcatcccacccatcccccacaacacatcgcccgcctcggttccctccactggacgcttctcccgctcctaacccctagtcccctcttctgctactccgccgccgccgccgccgccgcaacccccagcggccagatccgagcggcggggatcgtcccccacacggatcgagctcccgatccgcgcaggggagtggcggcgctggagcgccggggccccgagaggctggagacggaggaggggagtagttccgcggtggtagatccgccggccatggcgcccgtgatggactcctcggtagagaagcaggggagcgggtccgcggatccggacgagcgcccggccgccggcgagcccaaggcctgcaccgagtgccacaccaccaagaccccgctctggcgcggggggccctgcggacccatgtcgctgtgcaacgcgtgcgggatccggtatcggaagaagagaagggaggcgctgggcctcgacgccaacaagtccggcgccgccgagcagcagcaccagcagcggaagaagaaggccaccgccaccgcctccaagatggagagggaaaaggaggcggagacggatgaggtcaccgtagagctccgcacggtggggttcggcaaggaggtggtgctcaagcagcggcggcggatgcgccggaggaggcgcctcggcgaggaggagcgcgcggccatcctgctcatggccctctcctccggcgtcgtgtacgcctgacaccccgccgccgccacctagcagccaaggcaccaaaggcgatgagaggaagagagcggctgcagctgcagatttgcttaacatgcagcatgatcttagcccaagagagatgcgtctctctaccccttttcccccctggatctatgctaagttttcccggctaagtagtagttggaacaaaagcgagttaataatcgtgtcgcgctctagactattagctgttcttccctgttactgttgctgtctttgcctagttgtaatgttactggtagtagtgtggtagtatcttgtaaccttgcaatgtaaggagagcttattgatcaaaaaaaaaaaaaaaaaaaa

SEQ ID NO: 8392 - protein, 154 aa, Panicum virgatum
  misc_feature: Ceres CLONE 1997860
  misc_feature: Great-hit functional homolog of the protein sequence given in SEQ ID NO 9706
  misc_feature (1)..(36): Pfam Name: GATA Pfam Description: GATA zinc finger
  misc_feature: The sequence is a functional homolog of  SEQ ID NO 1054 in the  10/666,642 US patent application
  misc_feature: The sequence is a functional homolog of  SEQ ID NO 124 in the  11/375,241 US patent application
  misc_feature: The sequence is a functional homolog of  SEQ ID NO 2806 in the  10/374,780 US patent application
  misc_feature: The sequence is a functional homolog of  SEQ ID NO 84 in the  10/225,066 US patent application
  misc_feature: Useful for making plants with altered alkaloid content
  misc_feature: Useful for making plants with modulated growth and phenotype characteristics
MAPVMDSSVEKQGSGSADPDERPAAGEPKACTECHTTKTPLWRGGPCGPMSLCNACGIRYRKKRREALGLDANKSGAAEQQHQQRKKKATATASKMEREKEAETDEVTVELRTVGFGKEVVLKQRRRMRRRRRLGEEERAAILLMALSSGVVYA

SEQ ID NO: 8393 - DNA, 1134 bp, Panicum virgatum
  misc_feature: Ceres CLONE 1997908
  misc_feature: Encodes the peptide sequence at SEQ ID NO. 8394
gcccacagcatccaaccgccggccggtcatggccgcccaggctccggcgcgcgcctcctccgccgtgcggctcttcgacgcgcactgccacctccaggacccccgcgtcgcggccgtcgcgcccgccctcatgcgcgccgccgccgcatccggcgtcgcccgcttcgctgtcaacggcacctccgaggaggactggcacctggtgaagcggatggccgaggatcaccccgctgtcgtcccctgcttcggcctgcacccatggtgggtccccgagaggtcgccggattggatggattcgctccggaggttcttcgctgaaaccccggaagcggctgttggggagattggtctggacaaaggatcccatggaagaaccatcgacttcgcagaacaggttgaagtgttccggcgacaacttgagcttgctaaggaattggagagacctgtttctgttcattgtgtgcgggcgtttggtgatcttctggaaatcctgaagcaaactggacctttcccagcaggtgtgttgttacattcatatctgggatctgcagaaatggtgtctggccttgcaaatttaggctgttacttttcattgtctggcttcttgacaggcatgaaatccactaaagcaaagcaaatgctgaagtcaatacccttggatagaattcttttagagacggatgcacctgatgcattgccaaaattggacaatatttctgtatcactggtccctgtgcacagttcagatgcagatactgaaaagcatcacaaagattcagagtcacaggccgctaccgcatcgaatgagtccttgaaccacccagaaaatatccatatcgttttggagtatgtggcatcactgcttgaaatgcctgagacagaactggcggagcttagtttcaagaatgctaccaaactgttttcttatcctggctccaaagttcaccctgaagcaggagatatctgatgggtttgccgctaccttactcactggtctgcaaatctggaccctgttttttctcccctcctgaatgcttgtgtacccggaaaaaatatacatgaaatggctgtacattactgttaatattagtgaaatataagtggatgctgaatcaaaaaaaaaaaaaaaaaaaa

SEQ ID NO: 8394 - protein, 312 aa, Panicum virgatum
  misc_feature: Ceres CLONE 1997908
  misc_feature: Great-hit functional homolog of the protein sequence given in SEQ ID NO 9663
  misc_feature (1)..(287): Pfam Name: TatD_DNase Pfam Description: TatD related DNase
  misc_feature: Useful for making plants with modulated biomass
  misc_feature: The plant is abnormally small.
MAAQAPARASSAVRLFDAHCHLQDPRVAAVAPALMRAAAASGVARFAVNGTSEEDWHLVKRMAEDHPAVVPCFGLHPWWVPERSPDWMDSLRRFFAETPEAAVGEIGLDKGSHGRTIDFAEQVEVFRRQLELAKELERPVSVHCVRAFGDLLEILKQTGPFPAGVLLHSYLGSAEMVSGLANLGCYFSLSGFLTGMKSTKAKQMLKSIPLDRILLETDAPDALPKLDNISVSLVPVHSSDADTEKHHKDSESQAATASNESLNHPENIHIVLEYVASLLEMPETELAELSFKNATKLFSYPGSKVHPEAGDI

SEQ ID NO: 8395 - DNA, 1129 bp, Panicum virgatum
  misc_feature: Ceres CLONE 1997992
  misc_feature: Encodes the peptide sequence at SEQ ID NO. 8396
actgcacgtagccggccggcatcacaccgcacacacagtactcctcttcctcttcctcgcaccagcacgccaccgttggcttgcttcgcctgcacagctagctagggcctaggggagggaggggggagctggtggtggcagatggcgagcagcgcgggggaccgcttcctcaggcagctgagcgccagcaacggcggcggctacgacggcggctgcgggctgcagcaggagtacggcggcggcgggaggaggggctcgcggcggtggtccaagaagcgggccgccgcggcgaggggctacggcgtcaagcagggggaggcctccgcggcgaggaagcgggtgatggtggtggtggacgagagctccggcgccaagcacgccatgatgtgggcgctcacccacgtcgccagcaagggggacttcctcacgctgctccacgtcctgcctcactccggcagcggcaggggcgaggaggcctcctccctcgccaactcgctcggcacgctctgcaaggccagcaggcccgaggtggaggttgaagcgcttgtgatccaagggcccaagctggccaccgtgctcagccaggtgaagaagctggaggcctccgtgctggtgctcagccagagcaagccatctccctactgctggctaggctgcctcctgcggaacagcagcgctgagtttgtggagcagtgcatcaaccaggcggagtgcctgacgctggcggcgaggaagcagagcaagggcgtcggtgggtacctcatcagcacccggtggcagaagaacttctggctcctggcctgaaaaccttgtcattatagcctagtcactactacatgaatcacattttcactccccgtatatctgctgtcattgcgtttaaccaagtccgtcacaaaaatgtctttgcccctgccttgtcggtgtatctgtgtggatggttctgctgtttctgttgtaaagccaaaagagccttagatatgaccctacccccaacaaacctgtgtctccactgtggtgttcgtaatctgtaatgtactcgtgtaatgctgcgtaaatgaccaaccctcctgttgtaatactatatgtcctgtctgctgagattatcgaagtttccaagtttgttgtt

SEQ ID NO: 8396 - protein, 220 aa, Panicum virgatum
  misc_feature: Ceres CLONE 1997992
  misc_feature (2)..(135): Pfam Name: Usp Pfam Description: Universal stress protein family
MASSAGDRFLRQLSASNGGGYDGGCGLQQEYGGGGRRGSRRWSKKRAAAARGYGVKQGEASAARKRVMVVVDESSGAKHAMMWALTHVASKGDFLTLLHVLPHSGSGRGEEASSLANSLGTLCKASRPEVEVEALVIQGPKLATVLSQVKKLEASVLVLSQSKPSPYCWLGCLLRNSSAEFVEQCINQAECLTLAARKQSKGVGGYLISTRWQKNFWLLA

SEQ ID NO: 8397 - DNA, 1328 bp, Panicum virgatum
  misc_feature: Ceres CLONE 1998390
  misc_feature: Encodes the peptide sequence at SEQ ID NO. 8398
gttcacttcccacaaccacacagccgcacccgccgccggcagccatgcggcgccgcgccctcctcctcctcgtcctcctggtcgctgcggcggcgccggcggccacggcggcgcgcgcggcgttcgcgtgcgccccgggcgggccggggtcgtcgctgccgttctgccggcggtcgctggcggcccgcgcccgcgcccgggacctggtgtcgcggctgacgcgcgcggagaaggtgcggctgctggtgaacaacgcggcgggggtgccgcggctgggcgtgtcccggtacgagtggtggtcggaggcgctgcacggcgtgtcggacacgggtcccggggtgcggttcggcggcgcgttccccggcgccaccgcgttcccgcaggtcatcggcgccgccgccgcgctcaacgcctcgctctgggagctcgtcggccgggcggtgtcggacgaggcgcgcgccatgtacaacggcggcgcggcggggctgagcttctggtccccgaacgtcaacaactcggcccagcccccctcgcttcctttcccctcctcgtcgctcggctcgctcgctcgtctgcacagcggaatcccccctccgccgccgctccttccggcttcggaactcgcccgagatggcaaacgcaagatcaggagtcgcggtgaatgatgactgcatgctgaagttcggcgagctgcagtcgaagaggctgcaccgtttcattgtttacaagatggatgacaagttcaaggagattattgtggataaggttggggatcgcgagaccagctatgaggatttcaccaacagcctacctgaaaatgactgccgatatgctatctatgattttgactttgttactgcagaagacgtccaaaagagcaggatcttctatatcctatggtccccgtccactgccaaggtgaagagcaagatgctttacgctagctcaaaccaaaaattcaagagtgggctcaatggcatccaggtggaactgcaggctactgatgctagtgaaatcagccttgatgagatcaaggatcgggcgcgctaggctccatcgtgcagctcatgaccattcatcgtggacttgcctactgctgtggatttgtatgccattatagacttggtgctatgaaagaccgcttggtgatttatgggtttgttgatgtgtaaaaagatcctcgtggcttttccagaaagaccatgaaggtttggatctaccatgtacttccttgtctgccaaatgatgtgttgcgctgtccaagttactaaaataagtaatcgatgtgttccctactcgtcattctgtaaaaaaaaaaaaaaaaaaaa

SEQ ID NO: 8398 - protein, 206 aa, Panicum virgatum
  misc_feature: Ceres CLONE 1998390
  misc_feature (1)..(91): Pfam Name: Glyco_hydro_3 Pfam Description: Glycosyl hydrolase family 3 N terminal domain
MRRRALLLLVLLVAAAAPAATAARAAFACAPGGPGSSLPFCRRSLAARARARDLVSRLTRAEKVRLLVNNAAGVPRLGVSRYEWWSEALHGVSDTGPGVRFGGAFPGATAFPQVIGAAAALNASLWELVGRAVSDEARAMYNGGAAGLSFWSPNVNNSAQPPSLPFPSSSLGSLARLHSGIPPPPPLLPASELARDGKRKIRSRGE

SEQ ID NO: 8399 - DNA, 1203 bp, Panicum virgatum
  misc_feature: Ceres CLONE 1998404
  misc_feature: Encodes the peptide sequence at SEQ ID NO. 8400
actccccagtaacccaaccaaacccgcccactgatttccgacgcgcggtagcgaagggggcgaggcagcgcgcagccatggacttcctgcaggggcagagcacggagaccatggtggccgtcgccgtcgccgtcgtcgcggtcgccgcgggcgccgccttcgtcctcctccgatccgggaagaccaaggggtgcttggatcctgagaacttcaagaagttcaaacttgttgaaaagaagcagataagtcataatgttgccaagttcaaattcgctcttccaagtccaacttctgtattgggccttccaattggtcaacatatcagttgcagaggacaagatgctacaggtgaagaagtaatcaagccttatacccctactaccttggattctgatctcggatattttgagcttgtcataaagatgtatcctcaagggagaatgtcccatcatttccgtgagatgcaagttggtgattatttatctgtgaagggacctaagggtcgtttcaagtaccaagttggccaagtgagagcatttggaatgctggctggtggatcaggcattactccaatgttccaagttgccagagcaattcttgagaaccctaatgacaacaccaaggttcacttaatctatgctaatgtcacatatgaagacattcttctgaaggaagagctggacaacatggccaaaacctatcccgaccgctttaagatctactatgttttgaatcagcctcctgaaaattggaatggtggtgttgggtttgtgtccaaggaaatgatccaatctcattgcccagcgcctgctgatgacattcagatcctgagatgtggtcctcccccaatgaacaaggcgatggctgcacaccttgacgagctcaagtacacaaaggagatgcaattccagttctaagcaacgctgagctcacgaataataaggtgaccggcatggttctttggttaagggaacggtttctgaccgtttgttgacattaggaattcaggattgcatgatcaattagtattgcgccagcaacttgtgcagtcgccattttttagcgcaaaggttatctctctcgagggaagcccacgttggcagagactccattgttgctattattgatttgaaatgtgtaacattggatgctataagaaacattacattaccacggatgaactaaaaaaaaaaaaaaaaaaaa

SEQ ID NO: 8400 - protein, 279 aa, Panicum virgatum
  misc_feature: Ceres CLONE 1998404
  misc_feature (1)..(110): Pfam Name: NAD_binding_1 Pfam Description: Oxidoreductase NAD-binding domain
  misc_feature (1)..(100): Pfam Name: FAD_binding_6 Pfam Description: Oxidoreductase FAD-binding domain
MDFLQGQSTETMVAVAVAVVAVAAGAAFVLLRSGKTKGCLDPENFKKFKLVEKKQISHNVAKFKFALPSPTSVLGLPIGQHISCRGQDATGEEVIKPYTPTTLDSDLGYFELVIKMYPQGRMSHHFREMQVGDYLSVKGPKGRFKYQVGQVRAFGMLAGGSGITPMFQVARAILENPNDNTKVHLIYANVTYEDILLKEELDNMAKTYPDRFKIYYVLNQPPENWNGGVGFVSKEMIQSHCPAPADDIQILRCGPPPMNKAMAAHLDELKYTKEMQFQF

SEQ ID NO: 8401 - DNA, 1950 bp, Panicum virgatum
  misc_feature: Ceres CLONE 1998592
  misc_feature: Encodes the peptide sequence at SEQ ID NO. 8402
ccccctgcgctctggctctgcttcccagcagtggctcagcggctgcccccgccagccgtgcctgaatcgtctttgtcctcaccccgccactcctcgtgctctctccctctctctctctctctccccacaacgggcaaggctgcagcattgcggccatcgacgcattgctatcgagagcgcgggcaccgagggcggggggcggcggcggtgccggagctcggcgcgcggtcggcaatggcggggcggctcgtgctggcgctccctgtgctcctcctcttgctgctcgtcgggcactgtcgcggaggcaagattggcgtctgctacggccggaacgccgacgaccttccggcgccggacaaggtggcgcagctcatccagcagcagtccctcaagtacgtgcgcatctacgacaccaacatcgacgtcatcaaggccttcgccaacaccggcgtcgagctcatggtcggcgtccccaactccgacctcctcgccttcgcgcagtaccagtccaacgtcgacacctggctcaagaacagcatcctcccctactacccggccaccatgatcacctacatcaccgttggcgccgaggtcactgagagccccgtcaacgcctcggcactcgtcgtgccggccatgcgaaatgtgcacaccgcactcaagaaggccggcctgcacaagaagatcaccatctccagcactcattcgctcgggatactgtcccggtcgttcccgccatccgctggggcgttcaacagcagctatgcctacttcttgaagcctatgctggagttccttgtggagaaccaggcgccgttcatggtggacttatacccctactatgcgtaccagaattcgcccagcaatgtgtccctcaactatgcgctgttctcgccgcagtctcaggatgtgattgacccaaacaccggactggtttacactaacatgttcgatgctcaggttgattccatcttctttgcgctcatggctctgaacttcaagactctgaagatcatggtcactgagtctgggtggccaaacaaaggggcagccaaggagactggagccactccggacaatgctcagacttacaataccaatttgatacgccatgttgttaatgacagcggcacaccggcgaaaccaggggaagaaattgatgtctacatattttcattgttcaatgagaaccgaaaacctggaatcgagtcggagaggaactggggattgtttttcccagacaagagctcgatctacagccttgactggactgggcgaggtaatgtggatgttatgactggagcaaacattacaaatgcaaatgggacctggtgtattgcttcggctaatgcatcagaaacagatcttcagaatgccctaaactgggcatgtggtccaggcaatgtagattgctctgctattcaaccgagccaaccctgctatcagccagacactttggcttcccatgcttcatacgcattcaatagctattaccagcaaaatggggccaacgttgtggcctgcgactttggtggtgctggagtgcggacaacaaaagatccaagttatgacacctgtgtctatttggctgctggcagtaagatgagcaccacaaattcaacgtctcttccagctcggagcggctccagtccacacccatcggccaaatgcttcacccccttgctctttgtgctgtcctttgcgatagctgcggctatgctgtgatgtatggagaacactccagcaatcctcttcaggtgtaagatggaaggtgaatcgcctgatgctggtaataatcagcaatgttctgttttgcccatgagtagtaggctagtagtagagaaggcgtaccatgcagtaggtattctctggtcagttaagatgtacatcgtcgcgcagacaatatatatcagctggcgttaagaacttgaaaaaaaaaaaaaaaaaaaa

SEQ ID NO: 8402 - protein, 496 aa, Panicum virgatum
  misc_feature: Ceres CLONE 1998592
  misc_feature: Great-hit functional homolog of the protein sequence encoded by LOCUS At5g56590
  misc_feature (1)..(319): Pfam Name: Glyco_hydro_17 Pfam Description: Glycosyl hydrolases family 17
  misc_feature (1)..(320): Pfam Name: Glyco_hydro_17 Pfam Description: Glycosyl hydrolases family 17
  misc_feature: Useful for making plants with altered cell wall content and/or composition
MAGRLVLALPVLLLLLLVGHCRGGKIGVCYGRNADDLPAPDKVAQLIQQQSLKYVRIYDTNIDVIKAFANTGVELMVGVPNSDLLAFAQYQSNVDTWLKNSILPYYPATMITYITVGAEVTESPVNASALVVPAMRNVHTALKKAGLHKKITISSTHSLGILSRSFPPSAGAFNSSYAYFLKPMLEFLVENQAPFMVDLYPYYAYQNSPSNVSLNYALFSPQSQDVIDPNTGLVYTNMFDAQVDSIFFALMALNFKTLKIMVTESGWPNKGAAKETGATPDNAQTYNTNLIRHVVNDSGTPAKPGEEIDVYIFSLFNENRKPGIESERNWGLFFPDKSSIYSLDWTGRGNVDVMTGANITNANGTWCIASANASETDLQNALNWACGPGNVDCSAIQPSQPCYQPDTLASHASYAFNSYYQQNGANVVACDFGGAGVRTTKDPSYDTCVYLAAGSKMSTTNSTSLPARSGSSPHPSAKCFTPLLFVLSFAIAAAML

SEQ ID NO: 8403 - DNA, 1853 bp, Panicum virgatum
  misc_feature: Ceres CLONE 1999444
  misc_feature: Encodes the peptide sequence at SEQ ID NO. 8404
ggctgggattttgccttgttccccatgacggcgtcagcttaagcccttcctctcgctgctccctctccttccctgcatcgccgcggcggaggcccgcgagaccggccggcgatcgccgggcttgtcgcggtgggtgccctcgcctcgccctccccttcgccgccccctatcccctcccggcaatactctctcgcccgatcccttagcttcacccgcccgagggcgatcccaatcatcccagatccggcccgcgactcgccctgctctaccccactcccacggcagaggctcccaggtggctcccgcgatcggcccgcccgccagcgccgcctcgcgcggctcgacaggagtagcggcgcccccctccccctggttgcgggttgggggctcggctgtcgaggatgagcgggaggaagaatgccggcaggacctccccctggctgctcatcctcatctccgctgggtgcttcttcgcgacctacaacttcctgacgatgcacggccggggccgggacgggccgcgcaagctcctcgacggcgggggctcctacgggtcgcgctccggctccgacccggcgaagcggttccacgtcgcgctgacggcgacggacgcgctctacagccagtggcagtcccggatcatgcactactggtacaaggagatgagggaccgccccggctccgacatgggcggcttcacgcggatccttcactcggggaagcctgatgggttgatggatgagatacccaccatggtggtggaccctcttcctgaaggcaaggataagggatacattgtcttgaataggccgtgggcatttgtccagtggctgcagagagcaaaaattgacgaagactacatactaatggcggagccagatcatgtctttgtgaagcctttgccaaacttagctcatggtgatgaaccagcagcatttccatttttctacatcaatccaactgtgaatgagaagatattgcggaagttttttccagaggaaaaaggacctgtctcaaaaattgatcctatcggcaactctccagttataatcaagaaggcccaacttgagaagattgctccaacctggatgaatgtttcattaaaaatgaaagaggatcaggatacagacaaagcttttggatgggtcttggaaatgtatgcatatgctgttgctagtgcactgcatggtgtgcaccatagtctccgtaaagatttcatgattcagcctccttgggacctaaaaacagacaacacattcattatccattatacgtatggatgtgattatacaaatgagggtcagctaacttatgggaaaattggtgaatggcgttttgacaaaagatcttatcttgaatcaccaccaccaagaaatctttcactaccccctcctggagttcctgaaagtgtggtcactcttgtgaagatggtgaatgaggccactgcaaacattccagggtgggaggatgagagataatctgatggcctgatcagttgtagcttattttagctcctagctggtatggtttttgttggaaaacatagaggaataccacgggtgaataaaagaagagcgttcaattcatatctgaagtgtaggactgtggtcaattttctacagttcaacgtaggttagtgttcaggaagaaaaagatatattcactttgatctagtgagttgcatcattttttgtattgtaaagcagaaatatgggcttttggctacttttggttcatttagccgtgttgtaaatcagagatgtagtttagagtcctccaaccctgagaggtttgttattagtcatcttgggaaaagttctgctgggtgctgccaaaaaaaaaaaaaaaaaaaa

SEQ ID NO: 8404 - protein, 358 aa, Panicum virgatum
  misc_feature: Ceres CLONE 1999444
  misc_feature: Great-hit functional homolog of the protein sequence given in SEQ ID NO 9662
  misc_feature: Useful for making plants with modulated drought sensitivity
MSGRKNAGRTSPWLLILISAGCFFATYNFLTMHGRGRDGPRKLLDGGGSYGSRSGSDPAKRFHVALTATDALYSQWQSRIMHYWYKEMRDRPGSDMGGFTRILHSGKPDGLMDEIPTMVVDPLPEGKDKGYIVLNRPWAFVQWLQRAKIDEDYILMAEPDHVFVKPLPNLAHGDEPAAFPFFYINPTVNEKILRKFFPEEKGPVSKIDPIGNSPVIIKKAQLEKIAPTWMNVSLKMKEDQDTDKAFGWVLEMYAYAVASALHGVHHSLRKDFMIQPPWDLKTDNTFIIHYTYGCDYTNEGQLTYGKIGEWRFDKRSYLESPPPRNLSLPPPGVPESVVTLVKMVNEATANIPGWEDER

SEQ ID NO: 8405 - DNA, 1024 bp, Panicum virgatum
  misc_feature: Ceres CLONE 1999828
  misc_feature: Encodes the peptide sequence at SEQ ID NO. 8406
cccttccctccccccgccgccgcggccgccgccgaggaagacaccggctgtagcaagcaagcgcgagagaggcagcagtagccacagatggcgaacaagcggcagatagaggcgcggaagcgcttccgggaggcgaacccggacctcttccctccgcagccggccccttccgccgacggctccaagaagaagaacaagaagaacaagaagagcatgtttaagaaggccaagaagggcggcaccggaaggtcgaagcacccgctgcgggttcccgggatgcggcccggggagtgctgcttcatctgcaagtccactgagcacgtcgccaaggcctgccccgagaaggccctctgggacaagaacaagatttgcttgctctgcagggagcgtggccatagtctgaagaactgtcctgagaaaaacgaggggaattcaaagaaattttgctataactgtggtgaatctggacattctctttccaaatgccccaagccaattgaaaacgggggtacaaagtttgcaagctgctttgtttgcaaacagcaagggcatttgagcaaggattgtcctgaaaacaagcatggcatttatccaaagggtggttgttgtaagatatgtggtgaagttacgcacttggccaagcattgtccaaataaagggaagcaggatttgatgtcctccagagacgatgatgtcaacatggaagaacactatcaggaaggtcctgtcgttcaccatggtggagacgaccttgaagatgatttcattgaagaagaagaatcgaaacccgccaaatcaaaaaaagcaaagcaatctggttcaaaatcggcgggaaatgatgagaagaatgccaacccaaaggcaaaagctaaacaggccccaaaagttgtaaaattctttggttgaggagtgaaaattttgtagctgaagatgcagaagatccttctggacaacttgtattgtgcgatcatggttgcttaactgacgatgagaatttatctgccaaaaaaaaaaaaaaaaaaaa

SEQ ID NO: 8406 - protein, 272 aa, Panicum virgatum
  misc_feature: Ceres CLONE 1999828
  misc_feature: Great-hit functional homolog of the protein sequence given in SEQ ID NO 9293
  misc_feature: Useful for making plants with altered alkaloid content
  misc_feature: Useful for making plants with altered protein content
MANKRQIEARKRFREANPDLFPPQPAPSADGSKKKNKKNKKSMFKKAKKGGTGRSKHPLRVPGMRPGECCFICKSTEHVAKACPEKALWDKNKICLLCRERGHSLKNCPEKNEGNSKKFCYNCGESGHSLSKCPKPIENGGTKFASCFVCKQQGHLSKDCPENKHGIYPKGGCCKICGEVTHLAKHCPNKGKQDLMSSRDDDVNMEEHYQEGPVVHHGGDDLEDDFIEEEESKPAKSKKAKQSGSKSAGNDEKNANPKAKAKQAPKVVKFFG

SEQ ID NO: 8407 - DNA, 805 bp, Panicum virgatum
  misc_feature: Ceres CLONE 1999867
  misc_feature: Encodes the peptide sequence at SEQ ID NO. 8408
acccctttcccttctctgcctccgcttcgcttggtgagtttggtctcccttccctggcggcagcggcggcggcggcgactggacgagcggcggcgcttctcttctcgtcttcgccccgccctttgccggcgacgagcatccaccaggggaaatggttgagtatctctttgacgataacttcagtgtgagcaggctcgatcctgatggcaagaagtttgacagagtgacccgcatcgaagctcataacgagcagatgtacatgcagctagatgttgctactgagatctacccgattcgtgttggtgacaaattcaacatggtgttagctcctactctgaatctggatggaacaccagacactggctactacacacaggctggaagaaaaacacttgctgacaagtttgaatatgtcatgcatggaaaactttacaagatctcagaagacagttccaccagctcatctactaaagtggagatctatgcatcttttggtggcctcctgatgcagcttaggtgtgatagttccagtgcagctagcttcgagctggatcagaggctgtttcttcttatcagaaaggtgtaaacgtattggctactcgaaaggctggttaccttgttgattgtactcaacttccacccaatatgtactctcagtggtggtatggctttcaattggtaaaaacaacttctaccatgtagtgatgtaatctcgctacaactgagcacgtgaagtgcttcattggcggataatactatgtctgttctatcttttggtttgttacaaaaaaaaaaaaaaaaaaaa

SEQ ID NO: 8408 - protein, 144 aa, Panicum virgatum
  misc_feature: Ceres CLONE 1999867
  misc_feature (1)..(139): Pfam Name: RNA_pol_Rpb8 Pfam Description: RNA polymerase Rpb8
MVEYLFDDNFSVSRLDPDGKKFDRVTRIEAHNEQMYMQLDVATEIYPIRVGDKFNMVLAPTLNLDGTPDTGYYTQAGRKTLADKFEYVMHGKLYKISEDSSTSSSTKVEIYASFGGLLMQLRCDSSSAASFELDQRLFLLIRKV

SEQ ID NO: 8409 - DNA, 797 bp, Panicum virgatum
  misc_feature: Ceres CLONE 1999872
  misc_feature: Encodes the peptide sequence at SEQ ID NO. 8410
gacctcgctctcatccctcgctcgccgctcactcacccagactacactcacacagacaaagctcacagccgcgcgcaaaggaaatccgatccgcttgggggagaagcagaagatggccaagccccggggcaggggcgccgccgcggccctcctactcctcctgctgctggtcgtcgccgccgcgtcgtggctccaggccgccgacgccgcctcagggttctgctcgagcaagtgcggcgtgcggtgcgggcgggcgggcgggcgcgcgcggggcgcgtgcatgcggacctgcgggctctgctgcgaggagtgcaactgcgtgcccacgggagggcgcggcggcggcggcgtgaacgagtgcccctgctaccgcaacatgctcaccgccgggcccaggaagaggcccaagtgcccctgaacccgaccagctgcgtgccaagatgacgacgaggcgaggcgagacggaaggacggacctgccactggcaatctggcgtcgctactactcctacgtactatagtagtactgtactagtacggcggtatgtgtgtatgtattcagtattcatgtacagtacgttgtccgtatgacgtgtgtgtgaatgtgagctggtagtgagctaataaggtgctggacggttgtgccaccgagggcctgcaagtgcgacgtaggagcagtagatccaccagcacagtgtcatgcatggtcagtccgtgcctgtattagtcaggagtaccactgctaatgtctaggttaattgtggtttcgtgctgtcgtaaaaaaaaaaaaaaaaaaaa

SEQ ID NO: 8410 - protein, 101 aa, Panicum virgatum
  misc_feature: Ceres CLONE 1999872
  misc_feature (6)..(94): Pfam Name: GASA Pfam Description: Gibberellin regulated protein
MAKPRGRGAAAALLLLLLLVVAAASWLQAADAASGFCSSKCGVRCGRAGGRARGACMRTCGLCCEECNCVPTGGRGGGGVNECPCYRNMLTAGPRKRPKCP

SEQ ID NO: 8411 - DNA, 764 bp, Panicum virgatum
  misc_feature: Ceres CLONE 1999976
  misc_feature: Encodes the peptide sequence at SEQ ID NO. 8412
ggtgtcagtcgcttcctcacgctcacgcacgcacaccgccgtccggcaaccgcttttctgccatccttatcctccgctcccgcgaggccagagagaggggggagccatcagccatggctgctgctgccgccgcgtcgtcgtctcgccgcgcgccggcgctgctcctcgtggccgccgcgctggcgctggcgctggcggcgcggcctgccggggcggcgctgtcgtgctccacggtgtacaacacgctgatgccgtgcctcgggtacgtgcagtcgggcggggcggtgccccaggcgtgctgctcggggatccagagcctcctgtccgtggcgcgcaccacccccgaccgccgcgccatctgcacctgcctcaagaacgtggcggcgggcgccgccggcgggccctacatcagccgcgccgccgggctgcccggcaggtgcggcgtctcgctgccctacaagctcagccccaacatgaactgcaactcgattaactgaggtggctctacgtactgtcaaccgtgaagtcatcacgagacggagggcggccgtaggctgctgcttctactatagtatagcctaaataaagtcgtgagattctaagaccggtgaatctctcaatatgcttgaagtagtatattactacatactgtatgtcccgtaatatgcctgaagcatatatatgtatatgtgatgaaatgaaacaaataaatggacacaatcgtacgtattttatagattggtcaaaaaaaaaaaaaaaaaaaa

SEQ ID NO: 8412 - protein, 127 aa, Panicum virgatum
  misc_feature: Ceres CLONE 1999976
  misc_feature (1)..(86): Pfam Name: Tryp_alpha_amyl Pfam Description: Protease inhibitor/seed storage/LTP family
MAAAAAASSSRRAPALLLVAAALALALAARPAGAALSCSTVYNTLMPCLGYVQSGGAVPQACCSGIQSLLSVARTTPDRRAICTCLKNVAAGAAGGPYISRAAGLPGRCGVSLPYKLSPNMNCNSIN

SEQ ID NO: 8413 - DNA, 682 bp, Panicum virgatum
  misc_feature: Ceres CLONE 1999979
  misc_feature: Encodes the peptide sequence at SEQ ID NO. 8414
caaaaaatcgcatctcctctcgctctctgttgtgtgactgattgccaagaaagctctctgcttgcttgtgttccagcctctgaatctcgtgaggatgtcgtgctgcggaggcaactgcgggtgcggctccggctgcggagggtgcaagatgtacccggacatgactgagcagggcaccaccaccaccacccagactgtcatcatgggcgttgcaccaaccaacaaggggcacgccgagggcggatttgaggccggcgccggagccgagaacggctgcaagtgcggtgccaactgcacctgcaacccctgcacctgcaagtgaggagctcagggccatggccggaccggaggagatctgaagctagtatagcggcgttgtgtgtgcgtcgttcgtttgtctgaaagtgtgtgtggcatgcttaataacggtgttgcgcgtgctgctagtagatggtactgatggggaacaataataatgatggtgctgagatgtcgtcggcgtcgccgccgccgtcgtgtccttcctctccggccggtcgggcacctgtggcggtgctctagcagtgtgttgtgtgtgcagcaggccatgctctgatctttgtggtgtggcctgctgcttggtgtccctagtgtcatgtgtaaccatccatctatatctatctacatccatcttgtgtactcg

SEQ ID NO: 8414 - protein, 75 aa, Panicum virgatum
  misc_feature: Ceres CLONE 1999979
  misc_feature (1)..(80): Pfam Name: Metallothio_2 Pfam Description: Metallothionein
MSCCGGNCGCGSGCGGCKMYPDMTEQGTTTTTQTVIMGVAPTNKGHAEGGFEAGAGAENGCKCGANCTCNPCTCK

SEQ ID NO: 8415 - DNA, 587 bp, Panicum virgatum
  misc_feature: Ceres CLONE 2000095
  misc_feature: Encodes the peptide sequence at SEQ ID NO. 8416
ctctctctccgtgcccggcgatgccgggagccaacaacgacggagggcggatggatccccctgttccctttccctccgcgggcacggccatcccacctccctcccgctcccctcctattcctccgcgatccggcctccacccccagacgcagtcctcaccgccccacgcctctcgcctccgaagatttggccttgataatgcagaagaagcggtcttaatcataaaacatagcaatggggatatccaaggtcatggaagaagcgcttgtgttgtgtgcgcaattctagtagcgcttggtgtcgctgaaacttggaaagatgctgagaatatcatacgtgaaagaagaaagataaaaatgaatgctcttcaccggaaaaccttggaagagtggtccaaacatcgagctgctcagaaaaagggaaattagttgtatgtgataccattttcctcagtggtttaaagcctgtttaaaacatcataaagtggcatattaggcccgttgtacgattgtaacattgttcttttcagataatacaatgtacgtggcaaccatttgcacatgattcaactattcagcttttaactc

SEQ ID NO: 8416 - protein, 135 aa, Panicum virgatum
  misc_feature: Ceres CLONE 2000095
  misc_feature (86)..(137): Pfam Name: DSPc Pfam Description: Dual specificity phosphatase, catalytic domain
MPGANNDGGRMDPPVPFPSAGTAIPPPSRSPPIPPRSGLHPQTQSSPPHASRLRRFGLDNAEEAVLIIKHSNGDIQGHGRSACVVCAILVALGVAETWKDAENIIRERRKIKMNALHRKTLEEWSKHRAAQKKGN

SEQ ID NO: 8417 - DNA, 730 bp, Panicum virgatum
  misc_feature: Ceres CLONE 2000119
  misc_feature: Encodes the peptide sequence at SEQ ID NO. 8418
aaaaaaaattgcaatctcgttttctgttgtgagtgacttgtgatttccaagccaagaacgatctctgcttgtgttcatctctgaatcaatctcgtgaggtgaggatgtcgtgctgcggaggcaactgcgggtgcggctccagctgcaaatgcggcagcggctgcggagggtgcaagatgtacccggacatggctgaacagggcaccgccagcacccagactgttgtcatgggcgtcgcaccttccaacaaggggcacgccgacggcgtgttcgagggcggcgcggcggcggccggagccgagaacggcgggtgcaagtgcggccccaactgcacctgcaacccctgcaactgcggcaagtgaggagctcagcttctcgtggccctgcacctgcccggaggagatgaggacgccttctgtagctaagctagtagtatagcagtgccgtgtggctggtcctgtcgagttccatggcggcatgcttaacaacagcgttgcgcgtgctgccattaagtggtagtactgatggagagaagaataatggtactgatcgagtgtggtgtccttccgggccggggggctctatcagtgtgtttgtgttcacgggtagcaaggccatgatctgttgcactgtggtgtggcctgcttcctgtccctagtgtgtcctgtgtaatcatccatctatatatatatctgtgtccatctcgtgtcaaaaaaaaaaaaaaaaaaaa

SEQ ID NO: 8418 - protein, 85 aa, Panicum virgatum
  misc_feature: Ceres CLONE 2000119
  misc_feature (1)..(80): Pfam Name: Metallothio_2 Pfam Description: Metallothionein
MSCCGGNCGCGSSCKCGSGCGGCKMYPDMAEQGTASTQTVVMGVAPSNKGHADGVFEGGAAAAGAENGGCKCGPNCTCNPCNCGK

SEQ ID NO: 8419 - DNA, 1081 bp, Panicum virgatum
  misc_feature: Ceres CLONE 2000189
  misc_feature: Encodes the peptide sequence at SEQ ID NO. 8420
accatcccccccacccgccgccgcaaggaattccaccgcacgcgagaccaggagggggagaacggagaaagcacacagctagctacgaacagcggagcaaggccaagaacaaccaaccagccagcagccagcagccagcgcaagatgccgtgcatccaggcgtccagccccggcagcatgccgcaccagcaccacggccgggtcctggccggcgtcgggtgcgcggcggaggtggccgcagcggcggtcgcgacgaccgcggggatgctgtgcggggcgcacgacggcgaggtgcccgctgaggcggcgcgccaccacgagcacgcggcgccggggcccgggcggtgctgctccgcggtggtccagcacgtggcggcaccggcagcggcggtgtggtccgtggtgcggcggttcgaccagccgcaggcgtacaagcggttcgtgcgcagctgcgcgctgctggcgggcgacggcggcgtgggcacgctccgggaggtgcgcgtcgtgtcggggctccccgcggcgtccagccgcgagcgcctcgagatcctggacgacgagagccacgtcctcagcttccgcgtcgtcggcggcgagcaccggctccagaactacctctcggtgaccaccgtccacccgtcccccgccgcgcccgactccgccactgtcgtcgtggagtcctacatggtggacgtgccgccgggtaacacccccgaggacacccgcgtgttcgtggacaccatcgtcaggtgcaacctccagtcgctggcaaccaccgccgagaagctcgccgccgtgtcgacgtgaggagggacctccatctccatgggcgatcgatcggtcgatggtttttccggggccaggagagggttgcgtgtttcttcggcgcgtgagcctttttcttcttcttcttccttcttctctatttcttcacatttgaccctcttgtttttccttatttttttctcgttgttgcgagagacacccaaccctcctcctgtcccttgtccaaagattcaagagacgacaagtataaatcgatagagattttaagttccgccaaaaaaaaaaaaaaaaaaaa

SEQ ID NO: 8420 - protein, 220 aa, Panicum virgatum
  misc_feature: Ceres CLONE 2000189
  misc_feature (2)..(142): Pfam Name: Bet_v_I Pfam Description: Pathogenesis-related protein Bet v I family
  misc_feature (1)..(133): Pfam Name: Polyketide_cyc Pfam Description: Polyketide cyclase / dehydrase and lipid transport
MPCIQASSPGSMPHQHHGRVLAGVGCAAEVAAAAVATTAGMLCGAHDGEVPAEAARHHEHAAPGPGRCCSAVVQHVAAPAAAVWSVVRRFDQPQAYKRFVRSCALLAGDGGVGTLREVRVVSGLPAASSRERLEILDDESHVLSFRVVGGEHRLQNYLSVTTVHPSPAAPDSATVVVESYMVDVPPGNTPEDTRVFVDTIVRCNLQSLATTAEKLAAVST

SEQ ID NO: 8421 - DNA, 803 bp, Panicum virgatum
  misc_feature: Ceres CLONE 2000238
  misc_feature: Encodes the peptide sequence at SEQ ID NO. 8422
aggtccagcccgttccctccgtcgtctcccgtcctctcctccaccgaccaccgtctctccccaggcacggctgacggccccgccaaccctgaagctcatccccctctccttccccgttctccggtcggcgtcacagcccccggccgctgcctggcgtggagtgctgatccatcccgggtccagaccgattgcttctctcctcgctgtgattgaagcaggaggtgccaggagttaaccggagatgaatgccccagatcgctacgagcgctttgttgtgcctgagggcaccaagaaggtgtcatatgagagggataccaagattgtgaatgctgcatccttcaccattgagcgtgaggaccacaccattggcaacatcgttcgcatgcagctgcacagggacccaaatgtgctcttcgctggatataagctccctcaccctcttcagtacaagattattgttagaatccatactacgagccagtcttccccgacacaggcctacacgcaggctatcaatgatctagacaaggagctcgagtaccttaagctagcttttgaggatgagaagaccaggtacgaggaaagggccaagcaggggttctaaaaccatggtgctggagatctgaccttaaaaactccgcgtgttagttttctcggaggcacgagccgccttgaaacaatcacacaaggattgtgagcatgatgtaagactgatgatcccggaacaaccggcgcacgactcgccttgagacgaaatgcttaaggatcgtgtaagtttgcaacaaaaaaaaaaaaaaaaaaaa

SEQ ID NO: 8422 - protein, 120 aa, Panicum virgatum
  misc_feature: Ceres CLONE 2000238
  misc_feature (1)..(74): Pfam Name: RNA_pol_L Pfam Description: RNA polymerase Rpb3/Rpb11 dimerisation domain
  misc_feature (1)..(115): SWISSPROT Homolog: EC 2.7.7.6 DNA-directed RNA polymerase II subunit J
MNAPDRYERFVVPEGTKKVSYERDTKIVNAASFTIEREDHTIGNIVRMQLHRDPNVLFAGYKLPHPLQYKIIVRIHTTSQSSPTQAYTQAINDLDKELEYLKLAFEDEKTRYEERAKQGF

SEQ ID NO: 8423 - DNA, 721 bp, Panicum virgatum
  misc_feature: Ceres CLONE 2000313
  misc_feature: Encodes the peptide sequence at SEQ ID NO. 8424
aaaaacagtgtactggtactcaattcatttcttttattcatcaaagaggaaaagaatggtgcagcttgcattgctagctacagtagtgcatttgcatctgcctacctagctagcttgcattcattcttgccttgcccccaaccaattcactcacagcacatcacaaagttgaagcagcatgaagaagcagcggatcctcttcttcttcgtcgtcgtcgtcttcttcttcctcatggtggcccttcctgctgatgctgatgatccacaggagctgcagcagcagcagcagcatcgctcgagcatcagatccctgctccaggctcccccgaagatagactgcccgtcgagttgcgtggtgcgttgcggcaacaactggaagaaccagatgtgcaacaagatgtgcaacgtctgctgcaaccgctgcagctgcgtgccgccgggcaccggccaggagacacgccacctctgcccctgctacgacaccatggtcaacccgcacaccggcaagcttaagtgcccgtagcctagcgcgtgctatgtatgctatcatcttcatgttctatcagcagctccctctgctcaagatgaacctttcataataagagcactagattcgttggggaaaatagtctggttcaacgtgttcagctgccaaataaaagacaggatcttggtcaataccaccaggtatagttcaaaccaaaaaaaaaaaaaaaaaaaa

SEQ ID NO: 8424 - protein, 114 aa, Panicum virgatum
  misc_feature: Ceres CLONE 2000313
  misc_feature (2)..(108): Pfam Name: GASA Pfam Description: Gibberellin regulated protein
MKKQRILFFFVVVVFFFLMVALPADADDPQELQQQQQHRSSIRSLLQAPPKIDCPSSCVVRCGNNWKNQMCNKMCNVCCNRCSCVPPGTGQETRHLCPCYDTMVNPHTGKLKCP

SEQ ID NO: 8425 - DNA, 803 bp, Panicum virgatum
  misc_feature: Ceres CLONE 2000328
  misc_feature: Encodes the peptide sequence at SEQ ID NO. 8426
agccgagagaccgcgtacgaaccaagcagacccgagccgaagcagcgaaagcgaagtcgtcgccggagcaggaggaggaagcgcgccggagcaagatgtcgtggcaggcgtacgtcgacgaccacctgatgtgcgagatcgaaggccagcacctcacctccgccgccatcgtaggccacgacggcagcgtctgggcgcagtccccgaacttcccccagtacaagcctgaagagattgctgccatcatgaaggacttcgatgaacctggtagtcttgcaccaactggtcttttccttggaggcacaaaatacatggtgatccaaggtgaacctggtgttgttatccgaggaaagaagggcactggaggcatcactgtcaagaagacgaacctagccatcatcattggtatctatgacgagccaatgactggagggcaatgcaacatgatagtggagaggctcggcgactacctgttcggccagggttactaagtttgtcgttttgttattttagtcatttggcacttaagtttgtacctcatttggttaagtaatctgtgggcttgcgcatctacttggcgaatcgcattatatgcatgcagtgaataattagcttgggtttgttggttggtgataatgttggaaaaggatctgaattggggtttatgttttgcctcgcgtcatatcaaactcagctgctgtttcactgagtaatgtacatttcccgggtcatgctacttgtggactctgatgcattatggagatgcgtgcacttttcctgaataaaaaaaaaaaaaaaaaaaa

SEQ ID NO: 8426 - protein, 131 aa, Panicum virgatum
  misc_feature: Ceres CLONE 2000328
  misc_feature: Great-hit functional homolog of the protein sequence given in SEQ ID NO 9416
  misc_feature: Useful for biocontainment applications
  misc_feature: Useful for making plants with modulated biomass
  misc_feature: The plant is abnormally small.
  misc_feature: The plant produces a reduced number of seeds.
MSWQAYVDDHLMCEIEGQHLTSAAIVGHDGSVWAQSPNFPQYKPEEIAAIMKDFDEPGSLAPTGLFLGGTKYMVIQGEPGVVIRGKKGTGGITVKKTNLAIIIGIYDEPMTGGQCNMIVERLGDYLFGQGY

SEQ ID NO: 8427 - DNA, 1045 bp, Panicum virgatum
  misc_feature: Ceres CLONE 2000909
  misc_feature: Encodes the peptide sequence at SEQ ID NO. 8428
attcggccaccgcctcctacccacagtccaagctcggtcgatttcggtgctccagaagcccaactgctcgtctagcgggtctcctctacgctgtggacgatggtggggctgtcggaaggggagaagcacttcatccgcggcggcatcgcgcaggacattcgcaccgacggccgcaggcggctgcagttccgggcactctccgtcgagaccggagtcatcccgcaggctaatggttcagcgcgtgtcagattgggtgccacggagatcatcgctagtgtcaaggctgaattggggaaaccaaacattcttcaccctgacaaaggaaaagtttctatttttgttgactgtagtccaactgctgagcctacatttgagggtagaggttcagaagaattgtctactgagctgtctgttgccctgcaaagatgcctgctaggtggtaaaagtggtgcaggtgctgcaattgatctgtcatccctaattattgttgagggaaaggtatgctgggatctgtacattgatggacttgtggtcagttctgatggtaacctactagatgcgttagctgctgctataaaggttgctttgagtaatacaggtataccaaaagttaatgtttctcttagtgctgcatctgatgaggaacctgaggttgatgtaagcaatgaggaatttctgcagttcgacacctccagtgtgcctgttatcgttacattaaccaaggtgggtcagcactacattgttgacgctacctcagaggaagaatcccagatgagttctgcagtgtcggtatcagtcaataggaatggccaagtatgcgggctaaccaagaggggtggtgcagggctggacccaagcgtcatcttcgatatgatatcagtggccaagcatgtgagccagcagttcatagctcacttggactcaaagatatctgccgctgaagctgctgctgagtgaaggggggaaaaatagcagggaagaggttctaatacacatgtgatcaatcttagtgacctgctgccctcaaaaaaaaaaaaaaaaaaaa

SEQ ID NO: 8428 - protein, 285 aa, Panicum virgatum
  misc_feature: Ceres CLONE 2000909
  misc_feature (2)..(141): Pfam Name: RNase_PH Pfam Description: 3' exoribonuclease family, domain 1
MVGLSEGEKHFIRGGIAQDIRTDGRRRLQFRALSVETGVIPQANGSARVRLGATEIIASVKAELGKPNILHPDKGKVSIFVDCSPTAEPTFEGRGSEELSTELSVALQRCLLGGKSGAGAAIDLSSLIIVEGKVCWDLYIDGLVVSSDGNLLDALAAAIKVALSNTGIPKVNVSLSAASDEEPEVDVSNEEFLQFDTSSVPVIVTLTKVGQHYIVDATSEEESQMSSAVSVSVNRNGQVCGLTKRGGAGLDPSVIFDMISVAKHVSQQFIAHLDSKISAAEAAAE

SEQ ID NO: 8429 - DNA, 1146 bp, Panicum virgatum
  misc_feature: Ceres CLONE 2001071
  misc_feature: Encodes the peptide sequence at SEQ ID NO. 8430
aaaaaaaaaaatttccagtttccaggccgccgccaccatgtccctctcggccgtcgcctccgccgccgccgcgtcgacgtccctctcctccgtcaatccccgccgatcgtcgcctgcgtccagggtcccggcgccgcttcgtcgatcccttccatgcaggctcctgtcgtcgacgccgtcgtcccactctccccttaggccggtctccgccatggccgccccccgcaccgccgccggcgaggctgcatcaaggaagaaactcatcatcttcgacgccgaagaggacctcgcggcttcgctggccaagcgcacggcggagctgtcggcgaggttcgctgcggagaggggcgccttcaccgtcgtgctctccggcggatccctcgtcaaggccctaaggaaactgacggagccaccgtacctggacgcggtggattggagcaaatggcatgtgttctgggttgacgagagggtggtgcccaaggaccacgcggatagcaactacaagctcgcctccgatgagttcctttccaaggtgccaattcctgctggccaagtttatgctataaatgatacagtgtcagcccagggggctgcagaggactatgaaactcgtttaaggcaacttgtcaaggatggcgtgattggaatgtcaccagtgacaggtttccccaagttcgatcttacgcttatcgggatggggcctgacggccatgtcgcctcgctcttcccaggtcaccctgttgtccatgaaaaccagaaatgggtcaccttcatcaaggattctccgaagccgccaccggagagaataacattcactctccccgtgatcaactcgtcggcatatatcgcacttgtggtcaccggtgccggaaaagctggcgctgttcataaggcactttcagaagagcagaacacatcagatttgctgcccgtcgagatggtttcgcttcaagatggagagctcacttggttcactgacaagccggcggtgtccatgttgtcgagcatttgaagccatagtcgtataagtttgcttgaaagttgaaactctcgtattgagtacttcataaaagacttgatggatatccattaggttcggcaggaaattgtgagtttcgtttgtattaaaaaaaaaaaaaaaaaaaa

SEQ ID NO: 8430 - protein, 324 aa, Panicum virgatum
  misc_feature: Ceres CLONE 2001071
  misc_feature (1)..(236): Pfam Name: Glucosamine_iso Pfam Description: Glucosamine-6-phosphate isomerases/ 6-phosphogluconolactonase
MSLSAVASAAAASTSLSSVNPRRSSPASRVPAPLRRSLPCRLLSSTPSSHSPLRPVSAMAAPRTAAGEAASRKKLIIFDAEEDLAASLAKRTAELSARFAAERGAFTVVLSGGSLVKALRKLTEPPYLDAVDWSKWHVFWVDERVVPKDHADSNYKLASDEFLSKVPIPAGQVYAINDTVSAQGAAEDYETRLRQLVKDGVIGMSPVTGFPKFDLTLIGMGPDGHVASLFPGHPVVHENQKWVTFIKDSPKPPPERITFTLPVINSSAYIALVVTGAGKAGAVHKALSEEQNTSDLLPVEMVSLQDGELTWFTDKPAVSMLSSI

SEQ ID NO: 8431 - DNA, 738 bp, Panicum virgatum
  misc_feature: Ceres CLONE 2001266
  misc_feature: Encodes the peptide sequence at SEQ ID NO. 8432
cacaagccattcttccctccatttcacagcttgagagaacatgtaccctgctgagattgctagtgttccatacttatctcatgcaagtgcagcctctttcaaacctcattaccatgcagccacaaatgacttcctcttccagtatagcaaccttctggtacctcatccttcatactaccaagatgttgcccacctggtttatgaagcaagcttgccagttggtaacaaatccaattcagaggaatcagatgattatcaacgcagccttgcagaagagcgcaggaagagaaggatgatatccaatagggagtccgcccgacgatcacgcatgagaaagcagaagcagttgagtgagctctgggcgcaggttgtccacatgcgcagcaccaaccgtcaactccttgatcagctgaatcatgtcatcagagactgcgaccgtgttctccatgaaaactcgcagctgagagatgaacaaaccaaattgcagaagcagcttgagaagctccctgtagagaccacaggtagtggcgtcatgagtcctgactcttgaagtatccaggattacatgtattagatggataatatgagacttaaactaagaggcttccttcgttctatcctgagatttcatttttgtatctttgctctatgttcggtatcaatgttagtatgtagcagccaggtggtgactagtgagttctccattttatttcatcagaaaaaaaaaaaaaaaaaaaa

SEQ ID NO: 8432 - protein, 169 aa, Panicum virgatum
  misc_feature: Ceres CLONE 2001266
  misc_feature (3)..(52): Pfam Name: bZIP_2 Pfam Description: Basic region leucine zipper
  misc_feature (3)..(65): Pfam Name: bZIP_1 Pfam Description: bZIP transcription factor
  misc_feature: The sequence is a functional homolog of  SEQ ID NO 2518 in the  10/374,780 US patent application
  misc_feature: The sequence is a functional homolog of  SEQ ID NO 252 in the  10/225,066 US patent application
  misc_feature: The sequence is a functional homolog of  SEQ ID NO 526 in the  11/435,388 US patent application
  misc_feature: Useful for making plants with modulated growth and phenotype characteristics
MYPAEIASVPYLSHASAASFKPHYHAATNDFLFQYSNLLVPHPSYYQDVAHLVYEASLPVGNKSNSEESDDYQRSLAEERRKRRMISNRESARRSRMRKQKQLSELWAQVVHMRSTNRQLLDQLNHVIRDCDRVLHENSQLRDEQTKLQKQLEKLPVETTGSGVMSPDS

SEQ ID NO: 8433 - DNA, 848 bp, Panicum virgatum
  misc_feature: Ceres CLONE 2001339
  misc_feature: Encodes the peptide sequence at SEQ ID NO. 8434
gaacacgactagcttcttccgagctctcctccctcgccgccgccgccgccgccatgccgggcttcttccggcgcgtgggggccatcccgtggcggagcatcgcgggcgaggccttctcccgggcgttcctggtggcgcaggcgttctgcgccgtccacgtcgtggaccaccacctctgctcgctcgccatcgtgcggggccccagcatgctgccggcgatgaacctggcgggggacgtggtggcggtggacagggtgagcgtgaggctcgggcgggtggggcccggggacgtcgtgctgatgatctcccccgaggacccgcgcaaggcggtcgccaagcgcgtcgtcgggatagggggcgactccgtcacctacctcgtcgaccccgggaacagcgacgccgccaagaccgtcgtggtaccacaaggtcatgtttgggtgcagggcgataatatttatgcttctagagattcaaggcaatttggagcggtgccttatggtctcattacagggaagatcttttgtcgggtatggccattggagggctttggttccattgattcaaatcattctcaataaagatgtacccctattattgcacatgttaagagacttgtatgcaactgctgggccttgacttctggaagctttttttatctgtcgtgggacatttctatagtgaagcagagtgtatcatgatatcccatcttttgatgtttaatgtgtaacaatttaagttctcacacctgaaacccaatcagcacatgttctgatacaaatttttgtgcaactgtttgggttgtaattttattgtcagtcattttggtagaaaaaaaaaaaaaaaaaaaa

SEQ ID NO: 8434 - protein, 174 aa, Panicum virgatum
  misc_feature: Ceres CLONE 2001339
  misc_feature (2)..(80): Pfam Name: Peptidase_S24 Pfam Description: Peptidase S24-like
MPGFFRRVGAIPWRSIAGEAFSRAFLVAQAFCAVHVVDHHLCSLAIVRGPSMLPAMNLAGDVVAVDRVSVRLGRVGPGDVVLMISPEDPRKAVAKRVVGIGGDSVTYLVDPGNSDAAKTVVVPQGHVWVQGDNIYASRDSRQFGAVPYGLITGKIFCRVWPLEGFGSIDSNHSQ

SEQ ID NO: 8435 - DNA, 638 bp, Panicum virgatum
  misc_feature: Ceres CLONE 2001416
  misc_feature: Encodes the peptide sequence at SEQ ID NO. 8436
acaacagccacactaaccaacccgaagtccagagccacacccacattaaacaagcgccaccccgagtctcgcaacaggcgacatggccaggtcaccggcgctgactgccgtcgctctgctgctcactgccgcggcggtggcggcactgctcgtgcccacggaggccgtgtgcaacatgagcaacgagcagttcatgtcgtgccagcccgcggcggccaagacgacggacccggcgacgaagccgtcggacgcgtgctgcgcggcgctgggcgccgcggacctcaagtgcctctgcgcgtacaagaactcgccgtggatgaccgtctacaacatcgaccccacgcgcgccatggagctgccggccaagtgcggcctcaccacgccgccaaactgctagagacccaaatgctgctttcgtcgctgatcaatcagtcgataggttgtgtctggctggaaatgtcggatcatgtcacgtacgttcttgttcatgtgcacatgtttatgtgcgcgtcgtttgtgtcacatgtctatggtttggagtttgtatctgtttgtgagcatgagcctgtgacttgtcatcgtgtgtgtgtgattgtgtaactgtgagggtcttgatcatatattgtttgttttccagc

SEQ ID NO: 8436 - protein, 104 aa, Panicum virgatum
  misc_feature: Ceres CLONE 2001416
  misc_feature (1)..(75): Pfam Name: Tryp_alpha_amyl Pfam Description: Protease inhibitor/seed storage/LTP family
MARSPALTAVALLLTAAAVAALLVPTEAVCNMSNEQFMSCQPAAAKTTDPATKPSDACCAALGAADLKCLCAYKNSPWMTVYNIDPTRAMELPAKCGLTTPPNC

SEQ ID NO: 8437 - DNA, 949 bp, Panicum virgatum
  misc_feature: Ceres CLONE 2001531
  misc_feature: Encodes the peptide sequence at SEQ ID NO. 8438
agaatcaccatcaccacttctcgccggagaaccccaaatccaccgcatccgagatagtagaggggagaattcggcggcggacaagatggtgtgcatccggcaggcgaccatcgacgacctgctcgcgatgcaggcgtgcaacctgatgtgcctgccggagaattaccagatgaagtactacctctaccacatgctctcgtggccgcagctcctcttcgtcgcagaggactacggcggccgcatcgtcggctacgtgctcgccaagatggaggaggacccctcggagccctgccacggccacatcacctccctcgccgtcctccgctcccaccgcaagctggggctcgccaccaagctcatgtccgccgcacaggccgccatggaccaggtcttcggcgccgagtacgtctccctccacgtgcgccggtccaaccgcgccgccttcaacctctacacctccaccctcgggtaccagatccacgacatcgaggccaagtactacgccgacggggaggacgcgttcgatatgcgcaagcctctgcggcagccgcagcctaagaagcaccaccaccaccatcaccaccaccaccaccacggccccggtggatgctgctcccacgacgcaccttcggcggcggctggttcttctccgcagtcttctaattcgccggataagaaggctaacacttgacatggggagtgaatctttggggatgagttgcggagcccattggatatcacacatcttgtgcttgccatttgataaaagattgtagctttcctttcctattagaacagaaaggccctgtaatgtgattatttgtgtttgtatgtgtctggttgatgatttaaatccattaactgattccctgtaaactttgagaatgtcgtggaaatatactgacatttcaagtcacttattttggatgaaaaaaaaaaaaaaaaaaaa

SEQ ID NO: 8438 - protein, 201 aa, Panicum virgatum
  misc_feature: Ceres CLONE 2001531
  misc_feature (1)..(86): Pfam Name: Acetyltransf_1 Pfam Description: Acetyltransferase (GNAT) family
  misc_feature (4)..(192): SWISSPROT Homolog: EC 2.3.1.88 N-terminal acetyltransferase complex ARD1 subunit homolog A
MVCIRQATIDDLLAMQACNLMCLPENYQMKYYLYHMLSWPQLLFVAEDYGGRIVGYVLAKMEEDPSEPCHGHITSLAVLRSHRKLGLATKLMSAAQAAMDQVFGAEYVSLHVRRSNRAAFNLYTSTLGYQIHDIEAKYYADGEDAFDMRKPLRQPQPKKHHHHHHHHHHHGPGGCCSHDAPSAAAGSSPQSSNSPDKKANT

SEQ ID NO: 8439 - DNA, 1076 bp, Panicum virgatum
  misc_feature: Ceres CLONE 2002151
  misc_feature: Encodes the peptide sequence at SEQ ID NO. 8440
acgcgcacgcagaggcgaagccgaacaccccttccccgcgccgccacccgccccgcgctcctacgccatgggcgacaccagcgcggcggacgcgccggcggcgagcaggttcggcaggatctgcgtcttctgcggcagcaaccccggcaaccgcccggtcttcggggacgccgcgctcgacctcgggaaagagctggtggcgagggggatcgatttggtctacggcggcggcagcgtcgggctcatgggcctgatcgcgcagacggttcttgatggcggctgcagtgtcctcggggtgattccaaaagcactcatgcctcttgagatatccggtgctagcgttggagaagtaaaggttgtcaccgacatgcacgaaaggaaagctgagatggcacgacaagctgatgcctttattgctcttcctggagggtatggaacaatggaagagttgttagagatgataacatggtcacaacttggaattcatgacaaaccagttggattgctaaatgttgatggttactatgacccgttgctcatgctatttgataaaggggcgatggaaggttttattaagcaagattgcagggatataatagtctcagcgccgaccgcccatgaattgctgaagaaaatggagcaatacactcgaccacaccaggaggtcgccccccggacaagctgggagatgtcagagctgggctatggaaatggaaaagcaccagtgtttcttggatgttcttctgctagcgtttagtgttactgggctgggggcattggctttcaagtatcatcttttgacatctttttagtagccattcatgctacttgtgcgctcaaaattcttatttcatctgggaagcaagagtgtaagaatttatatgttcttcaacagtaacagtgttggcaaatggatacatggctgcaccagcactttgttcgcggtggttacaataatacacgttgtacaatgagaaatattttatgactgttgttatgtgtggtcagtgtgtggttatccttgcgttttgttcaagaattcgaaacatttcgtccaaaaaaaaaaaaaaaaaaaa

SEQ ID NO: 8440 - protein, 229 aa, Panicum virgatum
  misc_feature: Ceres CLONE 2002151
  misc_feature (1)..(134): Pfam Name: Lysine_decarbox Pfam Description: Possible lysine decarboxylase
MGDTSAADAPAASRFGRICVFCGSNPGNRPVFGDAALDLGKELVARGIDLVYGGGSVGLMGLIAQTVLDGGCSVLGVIPKALMPLEISGASVGEVKVVTDMHERKAEMARQADAFIALPGGYGTMEELLEMITWSQLGIHDKPVGLLNVDGYYDPLLMLFDKGAMEGFIKQDCRDIIVSAPTAHELLKKMEQYTRPHQEVAPRTSWEMSELGYGNGKAPVFLGCSSASV

SEQ ID NO: 8441 - DNA, 757 bp, Panicum virgatum
  misc_feature: Ceres CLONE 2002198
  misc_feature: Encodes the peptide sequence at SEQ ID NO. 8442
aagtccaaccaaaccgcagtcggccttccctcgcgccgccttcccctcccacgcgccacaagccccagagcaggcgaccccggcgggcggcggcgatggcggacgacgactacaacgacatggacctggggtatgaggatgagcccccagaaccagagattgaggagggggctgaggaggagcttgagaacaacaatgaggacgctcctgatgatgtggtaggggcagaagttgaagacaaggaacaagaaaagaaggcacgcgagcggaaaacatcgaagtatatgacaaagtatgagcgtgcacgcattcttggtacacgtgctttgcagattagcatgaatgctccagttatggtcgagcttgaaggggaaactgatcctcttgagattgccatgaaagaactgagggcacgcaagatcccattcacaatcaggcgatatttaccagatggaagctacgaggattggggtgttgatgaactcatcgtggaggactcctggaaacgtcaagtcggtggggactaatgcagagtgcttgcttgacatgcaaatctaatatccgggagtgaaggttatacctagcgctgagttgtgtggctgcagcgatggactgtcctgcaactgtaatgcgaccttattgtgttgtgcccttgtcctggtactgtccatttttatggttccatacttccatcggtccttaggagttaggggctattgcgttcttgcccctgttttaaaaaaaaaaaaaaaaaaaa

SEQ ID NO: 8442 - protein, 143 aa, Panicum virgatum
  misc_feature: Ceres CLONE 2002198
  misc_feature (1)..(54): Pfam Name: RNA_pol_Rpb6 Pfam Description: RNA polymerase Rpb6
  misc_feature (1)..(134): SWISSPROT Homolog: EC 2.7.7.6 DNA-directed RNA polymerases I, II, and III 14.4 kDa polypeptide
MADDDYNDMDLGYEDEPPEPEIEEGAEEELENNNEDAPDDVVGAEVEDKEQEKKARERKTSKYMTKYERARILGTRALQISMNAPVMVELEGETDPLEIAMKELRARKIPFTIRRYLPDGSYEDWGVDELIVEDSWKRQVGGD

SEQ ID NO: 8443 - DNA, 595 bp, Panicum virgatum
  misc_feature: Ceres CLONE 2002261
  misc_feature: Encodes the peptide sequence at SEQ ID NO. 8444
acacagccctagagaaatcaagaagagacgacggcgatggcggagagggtgtcgaggctgtcgacggagaaggctgtggtgatcttcacgcggagccagtgcccgatgtgccacgcgatgttgagcctcttctccgagctcgacgtgtgcgcggcggtgcacgagctggacaaggacccgcgcggccgcgacatggaacgggagctcgcccgccgcctcggccgcgcgccgccggtccctgctgtcttcgtcggcggcaacctcgtcggctccaccgacaaggtcatgtcgctccacctcgccggcaagctcgtgcccatgctcaaggccgccggcgccatatggctctgaatccctctatccatcggcgacagcaactatatatataaatccctcgctccgatccaatatagttcccaaatcccaccaagaattttgagaagttttgttcagcgcggctagtagtgtaaccacttgcagggctgaaaagggtttggaatgaccagcccatgtctttgaatgtacatggacatatgtaaccctaacctttccaggattttcagagtgagatgtggactttgatgagttaaatgtc

SEQ ID NO: 8444 - protein, 104 aa, Panicum virgatum
  misc_feature: Ceres CLONE 2002261
  misc_feature (1)..(65): Pfam Name: Glutaredoxin Pfam Description: Glutaredoxin
MAERVSRLSTEKAVVIFTRSQCPMCHAMLSLFSELDVCAAVHELDKDPRGRDMERELARRLGRAPPVPAVFVGGNLVGSTDKVMSLHLAGKLVPMLKAAGAIWL

SEQ ID NO: 8445 - DNA, 1465 bp, Panicum virgatum
  misc_feature: Ceres CLONE 2002392
  misc_feature: Encodes the peptide sequence at SEQ ID NO. 8446
gatcttgggccgcggagcttttcccatcgagacaacaagacgagccacgcgctgacgcgcaaaccgaacccaccaccaccaccaccaccaccaccaaacgaacccacctcgcccggcgaccccgtctcctcccgtcgactctcgtccccgccgccggcagacacgggcaacgccagcgcggctccgagatcggcgggcaggatgatgatgctgatcagctgctcggggtgccgcaccccgctgcagctgccgcacggggcgccctgcatccgctgcgccatctgcggggccgtcacgcacgtcgcccccgccccccacgccgaccccagccgcggcgccgtgcagccggcgccggggtggggcccgcccccgccgccggcgcacgggcggaagcgcgccgtggtgtgcgggatctcgtaccgctactcgcgccacgagctcaagggatgcatcaacgacgccaagtgcatgcggcacctgctcatgacgcgcttcaacttccccgacgattcgatcatcatgctcaacgaagaacaaaccgacccctacaaaatcccaacaaagcataacataaggatggccatgtattggcttgtacaaggttgtcagcctggagactcactggtgttccattattctgggcatggagcacaacaaagaaactacagtggagatgaggttgatggttttgatgaaactctctgcccattggattttgagacacaaggaatgattgtggatgatgagataaatacggcacttgttagaccacttcctcatggagttaaactccacgcactcattgatgcttgtcatagtgggactgcacttgatttgccattcctctgcagaatgaacaggagtggtcaatatgtctgggaagatcaccggccacgatcaggtgtctggaaaggcactagtggtggggaggctatttcatctagtggttgtgatgatgatcagacctctgcagatacttctgctttgtcaaagatcacttcaactggcgcaatgacattctgcttcatccaagccattgaacgtggccagggcaccacctacggtagtatcctgaactctatgcgtacgacaatccgcagcacgggcgaatcagcaggtgctggtggtggtgccgttacatcactcattacaatgcttctaacgggagggagcctttccactggtggtctgagacaggagccacagctgacagcgtgcgagccattcgatgtctacgcgaagcctttctcgctatgacggttcctggtattcccgaagaagctactatataggtgctcccgtttcacgttatcatgtacattttcgttattgaagtgatccatccatcccataaaatagagctgaaatgtatgcttgtcgatttgacatctattttacgacgatttccatatttgaatcattcacgatgcgggcgattgcactttaaaaaaaaaaaaaaaaaaaa

SEQ ID NO: 8446 - protein, 351 aa, Panicum virgatum
  misc_feature: Ceres CLONE 2002392
  misc_feature (1)..(284): Pfam Name: Peptidase_C14 Pfam Description: Caspase domain
  misc_feature (1)..(25): Pfam Name: zf-LSD1 Pfam Description: LSD1 zinc finger
  misc_feature (1)..(299): Pfam Name: Peptidase_C14 Pfam Description: Caspase domain
  misc_feature: The sequence is a functional homolog of  SEQ ID NO 110 in the  11/479,226 US patent application
  misc_feature: The sequence is a functional homolog of  SEQ ID NO 1289 in the  11/479,226 US patent application
  misc_feature: The sequence is a functional homolog of  SEQ ID NO 180 in the  10/374,780 US patent application
  misc_feature: The sequence is a functional homolog of  SEQ ID NO 234 in the  10/225,068 US patent application
  misc_feature: The sequence is a functional homolog of  SEQ ID NO 596 in the  10/412,699 US patent application
  misc_feature: Useful for making plants with modulated growth and phenotype characteristics
MMMLISCSGCRTPLQLPHGAPCIRCAICGAVTHVAPAPHADPSRGAVQPAPGWGPPPPPAHGRKRAVVCGISYRYSRHELKGCINDAKCMRHLLMTRFNFPDDSIIMLNEEQTDPYKIPTKHNIRMAMYWLVQGCQPGDSLVFHYSGHGAQQRNYSGDEVDGFDETLCPLDFETQGMIVDDEINTALVRPLPHGVKLHALIDACHSGTALDLPFLCRMNRSGQYVWEDHRPRSGVWKGTSGGEAISSSGCDDDQTSADTSALSKITSTGAMTFCFIQAIERGQGTTYGSILNSMRTTIRSTGESAGAGGGAVTSLITMLLTGGSLSTGGLRQEPQLTACEPFDVYAKPFSL

SEQ ID NO: 8447 - DNA, 1331 bp, Panicum virgatum
  misc_feature: Ceres CLONE 2002464
  misc_feature: Encodes the peptide sequence at SEQ ID NO. 8448
agagcacctgcgcggccgcgcctctcccatcactcggttccccgcctctcctgggcgatgcggtggctaccgaggctgctctcccacgccgccgcggccgggagggcgtccacggcggccaggtccaccaccagccacgtcagcggaggatcccacgggttcgccagcggcggctgggaggggtcgccagcggtgccccgggagtggctgcggaagctgtggcgggaggagctgaggaagctgaaggaggccgcgaggagctatgagtccgtggaggttgcaggagcggccacggaggcaccgtcgaggagctatcagtacgacgacagggacctcgatcccgtcgaggccaaactggctcctcttctcgcaagagctaaccttgtgatcgccagggacattgagtgggcaaacatcatgtttgcttttgagcaggagagcagatatatcataatggacccactctttccacaatctccagtaggttttattcgagagaaaagcaatgtcatctttaggcagctactcagaacaagacggccatttgttgcagaaataactgatgctatgggcaatgaaatatttaaggttcgcaggccattttggttgatcaacagctccatttatgcagaagtggatgggaaggagataggtgtagtccacaggcgttggcacctttggcggagaatttatgacctgtacttagggaataggcaatttgcagttgttgagaatccgggtttctggaactggacctttaacctggtggatgaagatgataaactgttggctcagattgatcgtaactggaggggaattgggtttgagctcttcacggatgctggtcagtatgcaattcggtttggtgatgagggactaaggcacaagtttgctcttgcagcagatgtcgaagaattacatgttactcggcagctgactttgcctgaaagggccgtggctcttgcccttgcgatatccctggacagtgattacttctctaggagaggtggctggggacttccttttctcattgccacagagtagacacacccaaactgcaatcacctgtacgcaagggaaaacatggtcgtttctcaatgttgatacaagcttagcagtagtataatgttgttcagcgattgagatcatcgccagcggcaggaaatggttcctgtgtgactgactaatcagattgctcctctgcttgacgagaaacccgaaagtggaggtttcccgaggagattggcttgcctccaactttgccacccctgttggttgtcgctcaagcagacattgctgaatttttttttcaaaaaaaaaaaaaaaaaaaa

SEQ ID NO: 8448 - protein, 328 aa, Panicum virgatum
  misc_feature: Ceres CLONE 2002464
  misc_feature (1)..(223): Pfam Name: Scramblase Pfam Description: Scramblase
MRWLPRLLSHAAAAGRASTAARSTTSHVSGGSHGFASGGWEGSPAVPREWLRKLWREELRKLKEAARSYESVEVAGAATEAPSRSYQYDDRDLDPVEAKLAPLLARANLVIARDIEWANIMFAFEQESRYIIMDPLFPQSPVGFIREKSNVIFRQLLRTRRPFVAEITDAMGNEIFKVRRPFWLINSSIYAEVDGKEIGVVHRRWHLWRRIYDLYLGNRQFAVVENPGFWNWTFNLVDEDDKLLAQIDRNWRGIGFELFTDAGQYAIRFGDEGLRHKFALAADVEELHVTRQLTLPERAVALALAISLDSDYFSRRGGWGLPFLIATE

SEQ ID NO: 8449 - DNA, 610 bp, Panicum virgatum
  misc_feature: Ceres CLONE 2002551
  misc_feature: Encodes the peptide sequence at SEQ ID NO. 8450
cttcaccgcactcagtacgcgctcgaactagctagaagaagcttagacagaccatgggcaaggcggcggtctccgcgctggcgctggcgctgtgcgtcctgctggcggcgcaggcgctggacgcggcgtgcaacccggcggcgctgagcccctgcggcggcgccctgttcggcgggatggtgacccacgggtgctgcgtgcagctgcgggcgcagcaggggtgcctctgccagtacgcgcgcaaccccgcctaccgcggctacgtcaacggccccgcggcgcagaacgtcgccaggtcctgcggcctccccatcatcaagtgctgatgatctgatcgatcgagcctgcccgtcggcacggggcgtacgtgtatgtgtgtggagagtcctcgatccatcgatgggcgtacgtgtcaataaacgcgaccgctagcttgcctgttgcttcggctgctgcatggttcagctatgcttatatgttttgtgtagcaactccatcgtcagctacgtatgcatgacgtatgttgctttttgtaacgtttccgtgcctgtcgttctatacgaataaaaagttatatcgagtattcccctaaaaaaaaaaaaaaaaaaaa

SEQ ID NO: 8450 - protein, 90 aa, Panicum virgatum
  misc_feature: Ceres CLONE 2002551
  misc_feature (1)..(66): Pfam Name: Tryp_alpha_amyl Pfam Description: Protease inhibitor/seed storage/LTP family
MGKAAVSALALALCVLLAAQALDAACNPAALSPCGGALFGGMVTHGCCVQLRAQQGCLCQYARNPAYRGYVNGPAAQNVARSCGLPIIKC

SEQ ID NO: 8451 - DNA, 593 bp, Panicum virgatum
  misc_feature: Ceres CLONE 2002553
  misc_feature: Encodes the peptide sequence at SEQ ID NO. 8452
aaggccgcggcacccctcactgcgcagctccgcccaggccgtgcccccctccccgcgtgcagcactcctggggaggagctcctgctgcaacggcgtggagagaggcggggcggggcacaaggacgtctggagcgcggcggcgaagcgcggcgatggagttctgcccggcgtgtgggctgctgctgcagatagatccgggcacaggagagcacagcctgcgcctcttctgtcccgtctgcccctacgtctgcccgatgcagaacaagatcgtgaagaaggcgaaggtggtaaagaaggaggtagagcccatcttcagcaaagccgacgcgatgaagttggcccccaagaccgcaagtgagatctctgcccttttctttgttctctggagctactatatactctgtgcgctcttacgagctatgattcggttcttatctcaggcgatagctttgctatttgctaatgatgttttcattattagccattgggcatcgctattgagttgtcatcttaatccttgacctcgaagaagtttgagcctcgaaattcgaaagtaaaaaaaagattaatcagaacagccagtattgtagtac

SEQ ID NO: 8452 - protein, 122 aa, Panicum virgatum
  misc_feature: Ceres CLONE 2002553
  misc_feature (1)..(54): Pfam Name: RNA_POL_M_15KD Pfam Description: RNA polymerases M/15 Kd subunit
MEFCPACGLLLQIDPGTGEHSLRLFCPVCPYVCPMQNKIVKKAKVVKKEVEPIFSKADAMKLAPKTASEISALFFVLWSYYILCALLRAMIRFLSQAIALLFANDVFIISHWASLLSCHLNP

SEQ ID NO: 8453 - DNA, 904 bp, Panicum virgatum
  misc_feature: Ceres CLONE 2002703
  misc_feature: Encodes the peptide sequence at SEQ ID NO. 8454
acaagcacgagagagagaagagagcgagcgaggtgtcgagcatggaggcacacttggagcgggctctgcgcgcgacgctgacggaggcggaggcacgggcgctggagggcaccgtgcgcgagcaccacacgttcccgggccgctcgggcgcggggccggcgacgtgcacgtcgctggtggcgcagcgcgtgtcggcttcggtgcgcgcggtgtggcccatcgtgcgcagcttcggcaacccgcagcggtacaagcacttcgtgcgcacctgcgcgctcgccgccggcgacggcgccagcgtcggcagcgtgcgcgaggtcaccgtggtgtcgggcctcccggcctcctccagcaccgagcgcctcgaggtgctggacgacgaccgccacatcctcagcttccgcgtcgtcggcggcgaccaccgcctccgcaactaccgctccgtcacctccgtcaccgagttccagcgccagcccgccggcgccggcccgccctactgcgtcgtcgtcgagtcctacgtcgtcgacgtgcccgagggcaacaccgaggaggacacgcgcatgttcaccgacaccgtcgtcaggctcaacctccagaagctcgccgccgtcgccgaggagtccgcggccgccgccggcaggagctagctagctccgatcctgatcgctcttccgctcgtggtgggcgcggcgtgccagagcggcgccgtcgttgttgctctgtttgtcctttcttgttccttttctttcccttttccgtttggtttttatcttcttcgtttttttttctcttgtcttttgttctcgtgtataaaaaggcctttgctgcggcgcaagaaagcctacttctgtaacacgtaactttgtccgtttctctctctagctaaaaaaaaaaaaaaaaaaaa

SEQ ID NO: 8454 - protein, 201 aa, Panicum virgatum
  misc_feature: Ceres CLONE 2002703
  misc_feature (1)..(138): Pfam Name: Polyketide_cyc Pfam Description: Polyketide cyclase / dehydrase and lipid transport
  misc_feature (1)..(152): Pfam Name: Bet_v_I Pfam Description: Pathogenesis-related protein Bet v I family
MEAHLERALRATLTEAEARALEGTVREHHTFPGRSGAGPATCTSLVAQRVSASVRAVWPIVRSFGNPQRYKHFVRTCALAAGDGASVGSVREVTVVSGLPASSSTERLEVLDDDRHILSFRVVGGDHRLRNYRSVTSVTEFQRQPAGAGPPYCVVVESYVVDVPEGNTEEDTRMFTDTVVRLNLQKLAAVAEESAAAAGRS

SEQ ID NO: 8455 - DNA, 1503 bp, Panicum virgatum
  misc_feature: Ceres CLONE 2002706
  misc_feature: Encodes the peptide sequence at SEQ ID NO. 8456
ctgacccgcacggcattctgttcctttccataactcagaagtgcacagcttgctttgtgccatctaaatcgaaagatggcaagcacaacttctgcagcagaaggtgcacacccgaccaaccctgaaaaggtcaagctggtcaccgttctgagcatcgacggtggcggtgttagaggaatcataccggccgtcatcattgccttcctcgaagagaagctccaagaactggatggcccagatgctaggattgctgattacttcgatgttgttgccggcacgagcaccggtggtctcttgacggcgatgctcacagccccggacaagaatggacggccactcttcaacgccaaggatttggcgcagttctacatcgaccactcgcccaaaattttcccacagaagaactggatcctatccaaaatctttagcatgttgaggatggtaaggggccccaagtatgatggcaagtaccttcatgcgctgcttcgtcagtaccttggcgacttgaggttggacaagacgctaactaatgtgatcatcccaacctacgacatctccatcctgcaacccacgattttctcaagctttgagctgaagcaccggccgtataaaaatgcactcctgtctgacatctcaatcagcacctccgcggctccaaccttcttcccggcacactacttcgagacaaaagacgtgaacggcagtaccaggaccttcaacctcgtcgatggaggcctcgccgctaacaatcccacgctgtctgcgatgggccaggtgtcgaaggacatcatccttggggaccccgacttcttccccgtcaagccggtggactacggcaagttcatggtgatctccctcggctgcgggtcgaacaggaagcgcaggtacagcgccaaggctgccgccaagtggggcatcttcaactggctcatcatggacggcacggcccccatcatcgacatgttcaactccgccagcgctgacatggttgacatccacctctgcgtcctcttcagggccctgcactccagccacaactacctgcgcattcagtacgatcagttgacgggcagcgccggctccatcgacgactgctccaaggagaacctggacaagctggtgaagattgggaaggaccttctcgccaagaacgtctcccgggtggacctggagaccggacggatcgtggacattcccggcgaaggcaccaacgccgagaagctcgccaagttcgcgaagcagctctccgacgagcggcgccggcgccagaaccttccgaagtagaactaaatcagatggcgcatttcactgtgttttcaacgttatctagctagctgcacgcgttttcgtgatttgtcgggcatttgcattccattccattcatttccccgtgttgtcgtcacgtacactttgatatgtattgtaatttgttagtaagctaataacgggtttattttacttggaataaaaggcaattctctcgaaaaaaaaaaaaaaaaaaaa

SEQ ID NO: 8456 - protein, 402 aa, Panicum virgatum
  misc_feature: Ceres CLONE 2002706
  misc_feature (1)..(207): Pfam Name: Patatin Pfam Description: Patatin-like phospholipase
MASTTSAAEGAHPTNPEKVKLVTVLSIDGGGVRGIIPAVIIAFLEEKLQELDGPDARIADYFDVVAGTSTGGLLTAMLTAPDKNGRPLFNAKDLAQFYIDHSPKIFPQKNWILSKIFSMLRMVRGPKYDGKYLHALLRQYLGDLRLDKTLTNVIIPTYDISILQPTIFSSFELKHRPYKNALLSDISISTSAAPTFFPAHYFETKDVNGSTRTFNLVDGGLAANNPTLSAMGQVSKDIILGDPDFFPVKPVDYGKFMVISLGCGSNRKRRYSAKAAAKWGIFNWLIMDGTAPIIDMFNSASADMVDIHLCVLFRALHSSHNYLRIQYDQLTGSAGSIDDCSKENLDKLVKIGKDLLAKNVSRVDLETGRIVDIPGEGTNAEKLAKFAKQLSDERRRRQNLPK

SEQ ID NO: 8457 - DNA, 660 bp, Panicum virgatum
  misc_feature: Ceres CLONE 2002710
  misc_feature: Encodes the peptide sequence at SEQ ID NO. 8458
tgcgagatagttatcatcaaaggagaacacgcacggtctgctcgttgtttgagttgcgttgttgatctcgtcgatctgaagatgtcgtgctgcggaggcaactgcgggtgcggctccggctgcaagtgcggcagcggctgcggagggtgcaagatgtacccggacatggccgacgaggtgaccaccaccaccacccagactgtcatcatgggtcttgcgccttccaaggggcacgccgaggacgggttcgaggctgccggagctgagaacgacggttgcaagtgcggccccaactgcagctgcaacccttgcaattgcggcaagtgagctgcctgccctgctctgccctgcccgccaccggagatggaaggactagctagtcgttgaacagctaatggtgtctctgatgttcatcagacttatttacgtgtgtttaccaagtgcgtgtggcaagcttaacaaccgtgttgtgcatgctgctactggtagtagtaattaagtactgagaataataaggcgaagcagagcgtatggcgtccttcctctccagctggggtggtgaggctctagctgtgtgtactgtgccctgctgtttgtgtgtgtgtatgcctcatgtatggtcactgtgtttaagctgttctagtcttctgtgttactgtt

SEQ ID NO: 8458 - protein, 81 aa, Panicum virgatum
  misc_feature: Ceres CLONE 2002710
  misc_feature (1)..(79): Pfam Name: Metallothio_2 Pfam Description: Metallothionein
MSCCGGNCGCGSGCKCGSGCGGCKMYPDMADEVTTTTTQTVIMGLAPSKGHAEDGFEAAGAENDGCKCGPNCSCNPCNCGK

SEQ ID NO: 8459 - DNA, 1617 bp, Panicum virgatum
  misc_feature: Ceres CLONE 2002723
  misc_feature: Encodes the peptide sequence at SEQ ID NO. 8460
cccgtccggtcccctctctgtttcctctcccgaccgatcgacgacgtccgtccgtcgcctgcctgctgctgcctccccgtccggcggtttcgccatcgttgcttctccgatccatcacgtattgacatggcggcggaggccaggcacttcaagtacgtcgtcctcggcggcggcgtcgcggcggggtacgcggcgagggagttcggcaaccagggcgtcaaccccggcgacctcgccatcatctccaaggaacccgtggccccgtacgagcgccctgcactcagcaagggatacctcttccctcagaatgccgcaagactgcctgggttccacacgtgcgtggggagcggcggagagaggctacttcctgaatggtactcagagaaaggcattgagctgatcctgagtactgagattgtgaaggctgaccttgcctccaagaccctgacaagtgcagctggggcaaactttacatatgagaccttgctcattgctactggctcctcggtcataaagctcacggactttggcgttcagggagcagaatccaacaacatattgtatctaagggatattgccgatgcggacaagttggttgcagctatgcaagcaaagaaggatggaaaggttgtgattgttggaggtggttacatagggcttgagcttagtgcagccttgaaaatgaacaactttgatgtcactatggtgtaccctgaaccctggtgcatgccccgtctcttcacctccggtatcgctcatttctatgagggctactactctaacaaaggaatcaagattgtgaagggcacagttgctgctggcttcgaagctgatgccaatggagatgtcactgcagtgaagctgaaggatggaagagtactggaagctgacattgttgttgttggcgtcggcggcaggccactgacggctctcttcaagggtcaacttgccgaggagaaaggtggactcaagacggatgcattcttcgagacaagcgttcccggagtatacgccatcggcgacgtggccaccttccctctgaagatctacaacgagcagcggcgagtggagcacgtggaccacgcccggaagtcagcggagcaggccgtgcgggcgatcaaggccaaggagtccggcgagtcggtgcccgagtacgactacctgccctacttctactcccggtccttcgacatcgcgtggcagttctacggcgacaacgtcggcgacgacgtgctgttcggcgacaacgacccggcctcggccaaccacaagttcgggagctactgggtcaaggacggcaaggtcgtcggcgtgttcctcgagggcgggtcggccgaggagaaccaggccattgccagggtcgcaaggacccagccggcggtggccgacgtcgaggcgctcaagacggaggggctggagttcgccaccaaagtctgatcaagcaattcggcagatgtaacaaaaacaaaattagagactgccaatttgaggagcatatatgtttaatttcttggcaattctgctttgagcttttcacatcactcggtgcttcatagtagttcaaatatccctgaagcaattcataatagttgataacaaaaaaaaaaaaaaaaaaaa

SEQ ID NO: 8460 - protein, 436 aa, Panicum virgatum
  misc_feature: Ceres CLONE 2002723
  misc_feature (1)..(297): Pfam Name: Pyr_redox_2 Pfam Description: Pyridine nucleotide-disulphide oxidoreductase
  misc_feature (2)..(297): Pfam Name: Pyr_redox_2 Pfam Description: Pyridine nucleotide-disulphide oxidoreductase
  misc_feature (1)..(297): Pfam Name: Pyr_redox_2 Pfam Description: Pyridine nucleotide-disulphide oxidoreductase
  misc_feature (2)..(297): Pfam Name: Pyr_redox_2 Pfam Description: Pyridine nucleotide-disulphide oxidoreductase
  misc_feature (1)..(436): SWISSPROT Homolog: EC 1.6.5.4 Monodehydroascorbate reductase, seedling isozyme
  misc_feature (6)..(436): SWISSPROT Homolog: EC 1.6.5.4 Monodehydroascorbate reductase
MAAEARHFKYVVLGGGVAAGYAAREFGNQGVNPGDLAIISKEPVAPYERPALSKGYLFPQNAARLPGFHTCVGSGGERLLPEWYSEKGIELILSTEIVKADLASKTLTSAAGANFTYETLLIATGSSVIKLTDFGVQGAESNNILYLRDIADADKLVAAMQAKKDGKVVIVGGGYIGLELSAALKMNNFDVTMVYPEPWCMPRLFTSGIAHFYEGYYSNKGIKIVKGTVAAGFEADANGDVTAVKLKDGRVLEADIVVVGVGGRPLTALFKGQLAEEKGGLKTDAFFETSVPGVYAIGDVATFPLKIYNEQRRVEHVDHARKSAEQAVRAIKAKESGESVPEYDYLPYFYSRSFDIAWQFYGDNVGDDVLFGDNDPASANHKFGSYWVKDGKVVGVFLEGGSAEENQAIARVARTQPAVADVEALKTEGLEFATKV

SEQ ID NO: 8461 - DNA, 1127 bp, Panicum virgatum
  misc_feature: Ceres CLONE 2002902
  misc_feature: Encodes the peptide sequence at SEQ ID NO. 8462
aacaatttgccgcagcttctctcctccctctctggcgctcactcccccccccccccttcccctcgcatgccgatcgcctccaagctcctctacttccagcgccgcccctcgccggcgccgccggacccgggccccgagccacccgaccctcgccgccgggccggccgcgaccactccgcccgccagcgccgccgcagctccttctcctcccaccacaagccgggccaggaacctgttccagggaaccaaagagactctagcaagtctcttggaccagctggaaacctaacagagcatgtagcagggatatcctctatcacgagactaaaccgcagcgtatccgaccatggccgccttcctgatgctgtgcaacaggccagggaaaggcttcttcagaggctcaacagcgtggacttatcaagaagaaggcaaaagtcatgcccctcagaaaccatttgggctgacttctcttctgactgcatcctaggcaccctaaccaactgcttccagcctgacgactccatcgctgccagcaaggttgaagaagacgtgacggagcccgtcggcagtaacactgatgagcgtacgcccatctcaccattctcggaacccattgtccctgagattcaacactcagtctgcaacagagcagcagaggaaggcgacgattgcacctgtgaacctccagcagagtgctccatatgcctggagcgatgcggcggcacaggcgacgggctcacccagctgcactgcaagcacgtcttccactcggtgtgcctggagcggtggctgcggtcccgcggcgactgcccctattgccgggccactgtggccctctcctaacagcaggatgcagaaactgaaagagattgaccacgagtccaactgcgcggattacagaacctcccctatcccctctaagctttaacaatctccctgcttagtgcttaccccttgtactgttactgctacattttcattagccgttatgagaccgaactattaagccctgtgcggctcagcaattactgtagactctagtatcttttcacgtgtatatatcatgccttgtaaacgcactgtgtcagagtaactggatgtttgcatcaaaaaaaaaaaaaaaaaaa

SEQ ID NO: 8462 - protein, 258 aa, Panicum virgatum
  misc_feature: Ceres CLONE 2002902
  misc_feature (1)..(41): Pfam Name: zf-C3HC4 Pfam Description: Zinc finger, C3HC4 type (RING finger)
MPIASKLLYFQRRPSPAPPDPGPEPPDPRRRAGRDHSARQRRRSSFSSHHKPGQEPVPGNQRDSSKSLGPAGNLTEHVAGISSITRLNRSVSDHGRLPDAVQQARERLLQRLNSVDLSRRRQKSCPSETIWADFSSDCILGTLTNCFQPDDSIAASKVEEDVTEPVGSNTDERTPISPFSEPIVPEIQHSVCNRAAEEGDDCTCEPPAECSICLERCGGTGDGLTQLHCKHVFHSVCLERWLRSRGDCPYCRATVALS

SEQ ID NO: 8463 - DNA, 1149 bp, Panicum virgatum
  misc_feature: Ceres CLONE 2002905
  misc_feature: Encodes the peptide sequence at SEQ ID NO. 8464
aaacacaacccaagcatcctcccctttccaataagctcatttccaacaagaagccacaccatggcgcggcgttccctcgctctgctcgccgtctccctcgcgctcttgcaggtcgcctcggcggcgaggtcctggctcacccagttcaccacggacggcaccgtccgcacggggtacgacgctgcaggccagaaggtgatgatgctcaacctcgaccggagctccggccccgctggcttcaactccaaggagcagttcctctacggcgagttcagcatcgagatgaagctcatccgcggaaactccgccggcaccgtctcctgcttctacctctcctccggcaccgacgactggcgcgacgagatcgacatggagttcatgggcaactcgagcggccagccggtggtgctcaacaccaacgtgtgggccaacggcgacggcaagaaggagcaccagttcgacctctggttcgacccctccgccgactaccacacctacaccatcatctggaacccggagaacatactgttcaaggtggacaacgtgttcatccgctccttcaagcgctacgccgacctgccctacccgagctccaagcccatgacgctgcacgccacgctgtgggacggcagctactgggccaccgagaagggcaaggtccccgtcgactggaacaacgcgcccttcgtcgtctcctaccggagcttctacgccaacgcctgcgtcagcggcggcgcgtgccgcgccgccagcgacgggtggatgcacaggcagctcgacgccgccgagtggggcacagtgaggtgggcggagcgcaactacatgcgctacaactactgccaggatgggtggaggttctcgcaggggctccccgccgagtgcagccgcaactgatgatgatgatccgcgtcgtccggcgtctgatttatccagccgggccatccattgttcttgcattggtttctttttaattgggttgtttatgattattcttgttcttctttgtgaatttgtgattacaaaagcagccccgcagcagcaaagtgtgggcggttgtacaccgaaattttaaagaagcatgtaattttttatcgtgcctttggataaagcaatacaacgttatgctctgaaaaaaaaaaaaaaaaaaaa

SEQ ID NO: 8464 - protein, 277 aa, Panicum virgatum
  misc_feature: Ceres CLONE 2002905
  misc_feature (4)..(180): Pfam Name: Glyco_hydro_16 Pfam Description: Glycosyl hydrolases family 16
  misc_feature (10)..(276): SWISSPROT Homolog: EC 2.4.1.207 Xyloglucan endotransglycosylase/hydrolase protein 8 precursor
MARRSLALLAVSLALLQVASAARSWLTQFTTDGTVRTGYDAAGQKVMMLNLDRSSGPAGFNSKEQFLYGEFSIEMKLIRGNSAGTVSCFYLSSGTDDWRDEIDMEFMGNSSGQPVVLNTNVWANGDGKKEHQFDLWFDPSADYHTYTIIWNPENILFKVDNVFIRSFKRYADLPYPSSKPMTLHATLWDGSYWATEKGKVPVDWNNAPFVVSYRSFYANACVSGGACRAASDGWMHRQLDAAEWGTVRWAERNYMRYNYCQDGWRFSQGLPAECSRN

SEQ ID NO: 8465 - DNA, 1196 bp, Panicum virgatum
  misc_feature: Ceres CLONE 2002911
  misc_feature: Encodes the peptide sequence at SEQ ID NO. 8466
gacgccgacgccgccgctgcctcctccttcttcttctccgtctccgcccgtcccaccggcatggccggcatcagcaagcgccgcacctccccggcctccacctcctcctcctccggcgacggcatgccgcggaggatcacccggaagccgaggtccgcccgccgcggggcccgcggcgccgcccggaggccaccggcgactcgacctgtaaatgctctggacttgaatacggttgctctggatccagatcattatgctactggattgagagttcttctgcagaaggagctccgaaatagcgatgtaaaccaacttggaagaattgttctcccaaagaaggaggcagagtcttacctccccattctgttatcaaaggatggaaaaagtttatgtatgtatgatttgctaaatgcacaactgtggaccttcaagtacagatattggcccaacaatagaagcaggatgtatgtacttgaaaatactggagactatataaaagctcatgagcttcagcaaggagacttcattgtgatatacaaagacgacgagaacgaccgctttgttataggagcaaagaaggcgggatttgaactgactgccactgtgccacaaatccatgagcacatgcacatctctgccgccacattgccagctccacaagtgttccatgactatgcagcccccgttgcaccagaagctgacatgcttgcacttgtgccacaagccgatgagatattcgacgggatactcaactccctgccagagataccagtagccaacgtgaggtactccgacttcttcgacccgtttggtgactccatggacatggcaaatcccctcggctccaaccactccgtcaacctgactacgcatttccacgacgagaaggctgggagctcttcgtttccctacccaaagtctgggcctctgatgtgagatccgtgcagaaagaactgctgggtcggatcagggcatcatcaggcaacaccctgcgtgaagttcagaaaaaaatttcctcgctgacgccattgctgtacatcccaataattggtgtcctcattttgtatgttgtagtatatgattgaccagcggctgctgcttatgtgtaaaagggtaactctgcaataactgaacaccgcatcagatgcaaacgctaggctctgatgtttttcctgcaaaaaaaaaaaaaaaaaaaa

SEQ ID NO: 8466 - protein, 291 aa, Panicum virgatum
  misc_feature: Ceres CLONE 2002911
  misc_feature (1)..(105): Pfam Name: B3 Pfam Description: B3 DNA binding domain
  misc_feature: The sequence is a functional homolog of  SEQ ID NO 246 in the  10/225,066 US patent application
  misc_feature: The sequence is a functional homolog of  SEQ ID NO 2502 in the  10/374,780 US patent application
  misc_feature: Useful for making plants with modulated growth and phenotype characteristics
MAGISKRRTSPASTSSSSGDGMPRRITRKPRSARRGARGAARRPPATRPVNALDLNTVALDPDHYATGLRVLLQKELRNSDVNQLGRIVLPKKEAESYLPILLSKDGKSLCMYDLLNAQLWTFKYRYWPNNRSRMYVLENTGDYIKAHELQQGDFIVIYKDDENDRFVIGAKKAGFELTATVPQIHEHMHISAATLPAPQVFHDYAAPVAPEADMLALVPQADEIFDGILNSLPEIPVANVRYSDFFDPFGDSMDMANPLGSNHSVNLTTHFHDEKAGSSSFPYPKSGPLM

SEQ ID NO: 8467 - DNA, 1373 bp, Panicum virgatum
  misc_feature: Ceres CLONE 2003200
  misc_feature: Encodes the peptide sequence at SEQ ID NO. 8468
ataccacccagacgtatcctgcaaccagagccaacctgagaagccagccaacaagtgcccaagtgaggttgaagaagcggatcaaggtcaaggagtttttaatggcggaaggcacggcggcgcacggctgggctgccagggatgcctccggccacctctcccctttcaacttctcaaggagggtcccgagagacggcgacgtgacgatcaaggtgctcttctgcgggctctgccacacggacctccacatcatcaagaacgaatggggcaacgccatgtaccccgtcgttcccgggcatgagatcgtcggcgtcgccacgggcgtcggccccggcgtcaccaagttcaagtccggcgacacggtgggcgtgggctacttcgtcgactcgtgccgctcctgcgagagctgcggcaaggggttcgagagctactgcccccagctcgttccgacgtccggcggcgtggacttgatcgacggcgccgccacccagggcggcttctccgacgtcctcgtcgtcagcgagcactacgcggtccgggtcccggagagcctgccccccgacgcggcggcgccgctgctgtgcgccggcgtcacggtgttcagccccatggtgcggttcggcctcaacgcgcctggcaagcacctgggcgtcgtcgggctgggcggcctgggccacctgggcgtcaagttcggcaaggcgttcgggatgacggtcaccgtcatcagcacgtcgccggccaagcgcgaggaggctctcgaccgcctcggcgccgacgccttcctggtcagccgcgaccccgagcagatgaaggcggcggcgagcacgatggacggcatcatcgacacggtgtcggcggagcaccctgtcgcgccgctgctggagctgctgaagccgatggggcagatggtggtcgttggcttgccggtcaagcctctcgaggtgccccccttcagcctcgtcgccggagggaagcgcctggccgggagcgccggcggcggcatggaggattgccaggcgatgctggacttcgcgggcgagcacggcatcaccgcggacatcgaagtcgtcgggatggactacgtcaacacggcgatccagcgcctggagaggaacgatgtgaggtaccgcttcgtcgtcgacgtcgccggcagcaagctgggcgtcgctgcttagtcgccaggatttgtagttctgcttagtggcagattcaaaaattgaatattgaaggggcttatttttccttctcagtcttcttcctcctcccctttttctttttcctctactgccactcctgccgacatgtgaagttgtacgcacgtgaataaataaggacatatatttgttttgggttaaaaaaaaaaaaaaaaaaaa

SEQ ID NO: 8468 - protein, 357 aa, Panicum virgatum
  misc_feature: Ceres CLONE 2003200
  misc_feature (1)..(116): Pfam Name: ADH_N Pfam Description: Alcohol dehydrogenase GroES-like domain
  misc_feature (7)..(351): SWISSPROT Homolog: EC 1.1.1.255 Mannitol dehydrogenase
  misc_feature (9)..(353): SWISSPROT Homolog: EC 1.1.1.195 Cinnamyl alcohol dehydrogenase
MAEGTAAHGWAARDASGHLSPFNFSRRVPRDGDVTIKVLFCGLCHTDLHIIKNEWGNAMYPVVPGHEIVGVATGVGPGVTKFKSGDTVGVGYFVDSCRSCESCGKGFESYCPQLVPTSGGVDLIDGAATQGGFSDVLVVSEHYAVRVPESLPPDAAAPLLCAGVTVFSPMVRFGLNAPGKHLGVVGLGGLGHLGVKFGKAFGMTVTVISTSPAKREEALDRLGADAFLVSRDPEQMKAAASTMDGIIDTVSAEHPVAPLLELLKPMGQMVVVGLPVKPLEVPPFSLVAGGKRLAGSAGGGMEDCQAMLDFAGEHGITADIEVVGMDYVNTAIQRLERNDVRYRFVVDVAGSKLGVAA

SEQ ID NO: 8469 - DNA, 1390 bp, Panicum virgatum
  misc_feature: Ceres CLONE 2003287
  misc_feature: Encodes the peptide sequence at SEQ ID NO. 8470
aacgaacgctaaaaaagtaacagtttctgtactttattgacgctaccccgtccgaacctcaacctcgccatgtccgtgcagatcccgaccgaagtgcccgcgatggtctacgcctccgccaagtccctcgccagcaagggctcgtacacgccgaagccgctcgcgaagcacgacgtcgacttcgtcgtgacctacaacggcatctgcggttccgacatgcaccagatcgacaacaactggggcatggcccgctacccgctgatccctggtcacgaagtcgtcggccacgtcatcaacgtcggcgaggccgtgaaggacttccaagtcggcgacgttgtcggcctcggcgctcaggcgcaggcctgctacaactgcgagtggtgcaaccagggcctcgacacgctctgccagaagcgcgtcttcacgtactgcatggacaccgaggacgagacgggcaagcacccccaccagggtggcttcgcggcgtacctgcgtacggactcgcgccacgtcttccacattccgaaggagattgaggagaagtacgcgggcccgctgatgtgcgccggaaatgccgtcgcgccgccgttgttcgagtgggcgaagggcgaggacgcgaagggcaagcgcgtgggcatcatcggcatcggtggcctcggccacctcgcgatccagttcgccgccaagatgggcgcggacacctgggccctctcgcgctcttcggacaagaagaagttcgcggaagagctcggcgcgactggctaccttgacctctcgaatgccgaggaggtccagaaggcgcagggaagcttcgatttcctgctcatcacgatctcgggcggcaagttcgacatccccacgtacgcgacgctcatgcgccccacgggcacgatccacatcgtcggcacgccctccgaggacctgaagttcagcgtgatgccgctgctgttcaacaacctgaccctcaaggcgtcgcccgtcggcggcatcccgcgcatgcgtcagatgctcgccttcgcggcgaagcacggcgtgcggccgatcattgaggagttcccgcacagcaagtgcaacgaggcgatggagaaggttcgcgacggctcgatccgcttccgcgccgtgctgaagaacgatctcatctagccgtgagtttcaatggcccacccaagtgcgcatcgtacccatcaactgctcattccatccatcaggggccaccgttccttttcggagttttcatcataccacaatcacggcgtcgacaagccgcgccccgagcgcaggcaggcgccgcaccccccgcgacctccaacaaatcatcgagtgcgtcgtgtctctctcgagagtgtctttgtccaccacacgcgaaattcaaaaaaaaaaaaaaaaaaaa

SEQ ID NO: 8470 - protein, 357 aa, Panicum virgatum
  misc_feature: Ceres CLONE 2003287
  misc_feature (1)..(88): Pfam Name: ADH_N Pfam Description: Alcohol dehydrogenase GroES-like domain
MSVQIPTEVPAMVYASAKSLASKGSYTPKPLAKHDVDFVVTYNGICGSDMHQIDNNWGMARYPLIPGHEVVGHVINVGEAVKDFQVGDVVGLGAQAQACYNCEWCNQGLDTLCQKRVFTYCMDTEDETGKHPHQGGFAAYLRTDSRHVFHIPKEIEEKYAGPLMCAGNAVAPPLFEWAKGEDAKGKRVGIIGIGGLGHLAIQFAAKMGADTWALSRSSDKKKFAEELGATGYLDLSNAEEVQKAQGSFDFLLITISGGKFDIPTYATLMRPTGTIHIVGTPSEDLKFSVMPLLFNNLTLKASPVGGIPRMRQMLAFAAKHGVRPIIEEFPHSKCNEAMEKVRDGSIRFRAVLKNDLI

SEQ ID NO: 8471 - DNA, 894 bp, Panicum virgatum
  misc_feature: Ceres CLONE 2003310
  misc_feature: Encodes the peptide sequence at SEQ ID NO. 8472
aaaaaaatacattttcaatccattatttattcatagttattcacaatggctgtccctgctaaaaaactcttcgtcggtggtaactggaagtgcaacaacacccttgctgaaagcaagctcctcgttgaaaacgttattaacaagctcgaattcgacgaaaacaaagttgaggttattatctcccctattttcgtccaaatccctgctgtcctccacgctcttaccaacaagaacgttaaggttgctgcccagaactcctctgctactggacttggtgcttacaccggcgagattgccccggctcatctccctgatatcgatgttcactgggttatccttggtcactccgaaagaagaagatactatcacgaaactgatgagctcgttgcccaaaagactaaattggctttggacagcaacttgaacgtcatcctttgcatcggtgaaactttggaacaaagagaagccaacaagactcttgaagtcattgctgctcaattgaacgctgtcaagggaagcctcaagactgaagactatgctcgcattgttgttgcatacgaaccagtctgggctatcggaactggaaaaaccgcttccccagctcaagctgaagaagtccacaaatatattagagaatacttggctaaggagatctctcaacaagtctctgatgctaccagaatcatctacggaggttccgttactgatgccaatgctgaagaacttatcaagcaagctaatattgatggatttttggtcggaggtgcttcattgaagccaggattcgccaagattgtcgatgcttgcaaggctaagtaatcaggaagaaagtttattgttatgttatttgtgtcgaatgttatttcgtatacccaaaaaaaaaaaaaaaaaaaa

SEQ ID NO: 8472 - protein, 257 aa, Panicum virgatum
  misc_feature: Ceres CLONE 2003310
  misc_feature (103)..(268): Pfam Name: TIM Pfam Description: Triosephosphate isomerase
  misc_feature (6)..(256): SWISSPROT Homolog: EC 5.3.1.1 Triosephosphate isomerase
MAVPAKKLFVGGNWKCNNTLAESKLLVENVINKLEFDENKVEVIISPIFVQIPAVLHALTNKNVKVAAQNSSATGLGAYTGEIAPAHLPDIDVHWVILGHSERRRYYHETDELVAQKTKLALDSNLNVILCIGETLEQREANKTLEVIAAQLNAVKGSLKTEDYARIVVAYEPVWAIGTGKTASPAQAEEVHKYIREYLAKEISQQVSDATRIIYGGSVTDANAEELIKQANIDGFLVGGASLKPGFAKIVDACKAK

SEQ ID NO: 8473 - DNA, 1015 bp, Panicum virgatum
  misc_feature: Ceres CLONE 2003340
  misc_feature: Encodes the peptide sequence at SEQ ID NO. 8474
agagagagagaacaccagactagtttccctccctcgccgctgccaccgacgagcaccagaggaaccctagccgcctcggcccggatctaccacacgcggaacaaggcaccatgagcgcctccaggaaggtgttccaggccgctaggtccctcctctccgcctcccagcgctcctccgccgccgagggccgcaccgccgcgctcgcgtcgctcaccaacctgggcaggaagacgctcccgaccgcctacgcctaccacaagcagggatcccaccgcgcctcgtccggatggggcgccttcgccgccgccgtccccgctgcagtctacatgctccaggaccaggaggctcatgctgccgagatggagcgcaccttcattgctatcaagcctgatggcgtccaaagaggcctgatttctgagattgtgtctcgatttgagaggaaaggctacaagcttgttgccatcaagctgattgtgccatccaaagaattcgctgagaagcattaccatgatctcaaggaaaggcctttcttcaatggactttgtgactttctcagctctggccctgtacttgcgatggtttgggaaggagagggtgttatcaagtatggaaggaaactaattggtgctacagacccacagaaatctgaaccaggaaccatcaggggcgatcttgctgttgttgttggaagaaacatcattcatggaagtgatggcccggagacagcaaaggatgagattgctctgtggtttgagcccaaggagctggtctcttacaccagcaacgcggagaagtggatctatggggtgaactaaccgccattttttttctttttctctccatttttacataattgccaatagaccaaggccggatgtactaataaagttgcgaccgtcacttttgagttggattgtgaccttctggtgcagaaggcacaaggaaatgtacctcgaaatatagagcgtgcactgagtagtcgcgatgttcaaatcaaaaaaaaaaaaaaaaaaaa

SEQ ID NO: 8474 - protein, 234 aa, Panicum virgatum
  misc_feature: Ceres CLONE 2003340
  misc_feature (1)..(135): Pfam Name: NDK Pfam Description: Nucleoside diphosphate kinase
  misc_feature (5)..(234): SWISSPROT Homolog: EC 2.7.4.6 Nucleoside diphosphate kinase 4, chloroplast precursor
MSASRKVFQAARSLLSASQRSSAAEGRTAALASLTNLGRKTLPTAYAYHKQGSHRASSGWGAFAAAVPAAVYMLQDQEAHAAEMERTFIAIKPDGVQRGLISEIVSRFERKGYKLVAIKLIVPSKEFAEKHYHDLKERPFFNGLCDFLSSGPVLAMVWEGEGVIKYGRKLIGATDPQKSEPGTIRGDLAVVVGRNIIHGSDGPETAKDEIALWFEPKELVSYTSNAEKWIYGVN

SEQ ID NO: 8475 - DNA, 734 bp, Panicum virgatum
  misc_feature: Ceres CLONE 2003373
  misc_feature: Encodes the peptide sequence at SEQ ID NO. 8476
cttccttctcctcctttctcctcctcccccttgcacgatggctctcgctaccgccaccgaggttaagctgttcaaccgctggacgttcgacgatgtcaccgtctcggacatgtcgctgacggactacatcgccgtgaagcagaagcccaagtactacacattcctgccccacacggccggtcgttatgcccagaagcgtttcaggaaggctcagtgccccatcgtcgagcgcatgaccaactcgctcatgatgcacggaaggaacaacggcaagaagctcctcgccgtcaagatcatgaagcacgccttcgagatcatccacctcctcaccgacgccaacccgctccagatcctcgttgacgccatcatcaactcgggtccccgtgaggattccacccgtattggttctgccggtactgtgaggaggcaggccgtcgacgtgtcgcctctccgccgtgtcaacttggccatttacctcctgaccactggcgctcgcgaggctgccttcaggaacatcaagaccattgctgagtgcctggctgatgagctgatcaacgccgccaagggttcgtccaactcttatgccattaagaagaaggacgagcttgagcgtgtcgccaagtccaaccgttaagtcgtacgtgttcggctgtgcttcgagaagtaaagttaaacggcataataaaccctggtgcaactcaacaaaaaaaaaacaaaaaaaaaaaaaaaaaaaa

SEQ ID NO: 8476 - protein, 198 aa, Panicum virgatum
  misc_feature: Ceres CLONE 2003373
  misc_feature: Great-hit functional homolog of the protein sequence given in SEQ ID NO 9304
  misc_feature: Useful for making plants with modulated biomass
  misc_feature: Useful for making plants with modulated flowering time
  misc_feature: The plant flowers significantly late compared to wild-type.
  misc_feature: The plant is abnormally small.
MALATATEVKLFNRWTFDDVTVSDMSLTDYIAVKQKPKYYTFLPHTAGRYAQKRFRKAQCPIVERMTNSLMMHGRNNGKKLLAVKIMKHAFEIIHLLTDANPLQILVDAIINSGPREDSTRIGSAGTVRRQAVDVSPLRRVNLAIYLLTTGAREAAFRNIKTIAECLADELINAAKGSSNSYAIKKKDELERVAKSNR

SEQ ID NO: 8477 - DNA, 1541 bp, Panicum virgatum
  misc_feature: Ceres CLONE 2003470
  misc_feature: Encodes the peptide sequence at SEQ ID NO. 8478
aactcgaaaaaaacgcaaggccacatctctctccatcttgaccaaaaggaactcaccaaaccacaggcggagacaaaactgcgacgtcccggctcgaacggagggcggctctctgttcccgcttcctagccgccgggctccgcgtacctgctggccggctgaccacgccgccccgtgccccgtggccgacttggtagcaacgccttaaagcgtacgcgacagctgcgcgttctctgctgctcatcccggcaagcttcctctgcttctgatgacttcggcaatgggcgctccgctcgcatcgcgagttgccgccgtcgcggcgatcatggtgttcgtggcggtctcggcggcgtcggccttcccgaccgatttgccgccaggggtgccgccgttcccgaacccgtgggcggcgttccagaacctctccggctgccacatgggcgaggagcggcagggcctggcggggctcaaggactacctcagccacttcggctacctcccgccgccgccgccgtcgtccccgttcagcgacgcgttcgaccaggacctggagacggccatcgcgacgtaccagcgcaacttcgggctcaacgccaccggcgcgctggacccgcccaccgtcgcgcagatggtctctcctcgctgcggcgtggccgacgtggtcaacgggacgtccaccatggcgaggagctcggcggcggacccccacggcaggcacctgtacgcctacttccccggcgcgccgacgtggccgccgttccggcgggacctcaagtactcgatcaccgcgacgtcggcgacgtccatggaccggtccacgctgagcgacgtgttcgcgcgcgccttctccaggtgggccgcggccacgaacctgcggttcacggagaccgcgtcggagtccgacgcagacatcacgatcgggttctacgcgggctcgcacggcgacggcgagccgttcgacgggcccctgggcacgctggcgcacgccttctcccccacggacgggcggttccacctggacgccgcggaggcgtgggtggtcggcggcgacgcgtcctcccccggggcggtggacctggagtccgtggcggtgcacgagatcggccacctcctggggctcggccactcgtcggtgccggaggccatcatgtacccgacgatccggacggggacgaggaaggtggagctggaggcggacgacgtgcaggggatacagagcctgtacgggagcaaccccaacttcaagggcgtcacgccgacgtcgccggcgacgagcaaccgcgagatggacggcggcgccgccgcggggctccgcccggatagcgttttcattggagtagttgcggcagttggcctgctcctagcgccgtagacctctctggtccttgtcatttttgcagccgggccgccacgtcctccgttgcgtcgatttcttgctccattagttgattcatggatagttgattcttgtgtacataactatgattattacagaataatagcataccacagagattatataaaaaaaaaaaaaaaaaaaa

SEQ ID NO: 8478 - protein, 367 aa, Panicum virgatum
  misc_feature: Ceres CLONE 2003470
  misc_feature (2)..(165): Pfam Name: Peptidase_M10 Pfam Description: Matrixin
MTSAMGAPLASRVAAVAAIMVFVAVSAASAFPTDLPPGVPPFPNPWAAFQNLSGCHMGEERQGLAGLKDYLSHFGYLPPPPPSSPFSDAFDQDLETAIATYQRNFGLNATGALDPPTVAQMVSPRCGVADVVNGTSTMARSSAADPHGRHLYAYFPGAPTWPPFRRDLKYSITATSATSMDRSTLSDVFARAFSRWAAATNLRFTETASESDADITIGFYAGSHGDGEPFDGPLGTLAHAFSPTDGRFHLDAAEAWVVGGDASSPGAVDLESVAVHEIGHLLGLGHSSVPEAIMYPTIRTGTRKVELEADDVQGIQSLYGSNPNFKGVTPTSPATSNREMDGGAAAGLRPDSVFIGVVAAVGLLLAP

SEQ ID NO: 8479 - DNA, 868 bp, Panicum virgatum
  misc_feature: Ceres CLONE 2003488
  misc_feature: Encodes the peptide sequence at SEQ ID NO. 8480
acgggcacaatcattgcagagaggccacaccgataccagcagtagactagtagtctagccagccgcacagtttgctgtcgcgacgacatggccaccaccggcaagtcgctggccgccgccgggctcctggtcgccgccgtggcggtggccgtcctcgccggcgccgccccggcggcggcggtgtgcaacatgagcaacgagcagttcatgtcgtgccagccggcggcggcgaggacgacggacccgccggcgccgccgtcgaaggcgtgctgcgacgcgctgggcggcgccgacctcgggtgcctgtgcgggtacaagaactcgccgtggatgggcttgtacaacatcgaccccgagcgcgccatggagctgccggccaagtgcggcctcgccaagcccgccaactgctgagagatttatcgatcgataagagcttagcttgttgacgatcacctcgtgtgtgtgtgtgtcgatcccatccgtcgatcgatcgatctgaatggtcgcttgcttggatcttgggcgccggttcttcttttaactcgttgtgatatgtgctccaatgttttaaatcgccggctaagatgtttagcggcagggctaccgttacggtgtttagcgggctatagcagatatttagcgggctatatccggctttagcgagctaaatgccatagcgtctgtccttcctaatagctatagtcatctatagcggaagctatagccggctatttaaaactttgatgtgctctcgtgggtagtacgtgtgggttgcgtctgtcatcgtcgacggatgcatgtatccatgtgctctacctctctttatatatatgactgtgggtttccttaaaaaaaaaaaaaaaaaaaa

SEQ ID NO: 8480 - protein, 107 aa, Panicum virgatum
  misc_feature: Ceres CLONE 2003488
  misc_feature (1)..(75): Pfam Name: Tryp_alpha_amyl Pfam Description: Protease inhibitor/seed storage/LTP family
MATTGKSLAAAGLLVAAVAVAVLAGAAPAAAVCNMSNEQFMSCQPAAARTTDPPAPPSKACCDALGGADLGCLCGYKNSPWMGLYNIDPERAMELPAKCGLAKPANC

SEQ ID NO: 8481 - DNA, 1117 bp, Panicum virgatum
  misc_feature: Ceres CLONE 2003515
  misc_feature: Encodes the peptide sequence at SEQ ID NO. 8482
gactgagtccctggctccctctcgtttcgtctcggctcctcccctcccctcccctgccccagacaaatccaatccggaaccgacgccccccctcgcttcgccggcgagaggagagacgagcgacgctgcgctcgcgtccgcgtccgtccgcccctcccgcgccgaccacttcccgcaggcggagacgggcgggcggtcatcccgcgcccgacgccggtatgcagagccagatcgtgtgccacgcgtgccggaccgttctgctctacccgcggggggcgcccagcgtctgctgcgcggtgtgccaggccgtcaccacggtgccgccaccagggctagagatggctcagcttatatgtggtggttgtcgaactttgctgatgtatactcgaagtgcagatactgtaaggtgttcatgttgcaatacagtcaatcttgttagaccagtgaataatatagctcatgttaactgcggccactgccagacaactttgatgtatccatatggagcacattcagtaaaatgtgccatatgcaatcatatcactactaccggagtaaatacggtggcacccacaccatctgcaaggccagtatctaatggatctgcatatagtacctcatctacttctgttcctaaatctcagccccagaatgtaactgttgttgttgagaatcctatgacagttgatgataaaggaaaactagtgagcaacgttgtagttggagtcacaactgggaaaaactgatgtgctatctccatcattgttgtgtgttctaatcagaaactaggaaatactgtgtgtcacagtgctatcgagtggctggttgcatacttgcatggttgtccttgaacaaagatgcaccagatgtttctgggatcttgcaaggaaaccatgaaggtcaaaagctgtgttttgaatctatcgattcttttgtgtgtataagagctccgttagacttcagtgtgtgatagtatagttatgcaatacacatgcatttgtacacactttgtttgtagtttgtgctggtgttcatagttttttgctggtatacatgcacttgtaaagataaaaagctgttctaagggtatcttcaacaaaaaaaaaaaaaaaaaaaa

SEQ ID NO: 8482 - protein, 175 aa, Panicum virgatum
  misc_feature: Ceres CLONE 2003515
  misc_feature: Great-hit functional homolog of the protein sequence given in SEQ ID NO 9374
  misc_feature (1)..(25): Pfam Name: zf-LSD1 Pfam Description: LSD1 zinc finger
  misc_feature: Useful for making plants with modulated oxidative stress sensitivity
MQSQIVCHACRTVLLYPRGAPSVCCAVCQAVTTVPPPGLEMAQLICGGCRTLLMYTRSADTVRCSCCNTVNLVRPVNNIAHVNCGHCQTTLMYPYGAHSVKCAICNHITTTGVNTVAPTPSARPVSNGSAYSTSSTSVPKSQPQNVTVVVENPMTVDDKGKLVSNVVVGVTTGKN

SEQ ID NO: 8483 - DNA, 932 bp, Panicum virgatum
  misc_feature: Ceres CLONE 2003586
  misc_feature: Encodes the peptide sequence at SEQ ID NO. 8484
gtcccgtacagaacaaccgcgccacgtctcgtcccgtgcaatcgcgtagccgactagccgccgtacgtccttgcggccgaagaagacagcccgccgcgtgccgccatggcgtggcggcggctccagatggctctcgccctcgtcgtcgcggtcgcggcggcgacgctgtcctcggcgcagcagcagcagccggcggcggcggcggcgttcccggcgctgcccagctgcccgccggcgccgctcagcctgtccccgtgcatcggctacgtcttcggcgtcggctcggcgacgctcaccgcctgctgctcccagctccggggcttcctccgcgcgcaggcgccctgcctctgcgccgcgtccaagctcgcgcccagccccgtcggcctgctcctcggccaggcgcagaccatcatccccaacgtctgcgacctgcccaacccatgcgacgatgatgccgccgctggcgacggcgagggctccgcgccggcggcggcctccacgccgtcggtggcaggaacttcgcctccgtcgtccgagacgacgactccggcagccaccacacctgcgactgagccatcgtcgggcacgccggcggccaatccagacgcgtcaggagcgccaccggatccggccgaggattctcctgccgccgcaacggcgccggccggcgccgggtcgaagctcccccagctgctgcatgcagccggcgccacgaggtccagaggaatggctgcaggcactgtgctcgtcaccgtgtttctcgcttcaattgcaaccatgtatgcgtagctgtaacctgctaagccattgcaagttcgcaaccgcaaatgtaatgatgtaacatgtgatgtgatacattataagttgaagctgcatcctgtttttgtgcggttacaataaaaacgtttatccaaaaaaaaaaaaaaaaaaaa

SEQ ID NO: 8484 - protein, 227 aa, Panicum virgatum
  misc_feature: Ceres CLONE 2003586
  misc_feature (1)..(75): Pfam Name: Tryp_alpha_amyl Pfam Description: Protease inhibitor/seed storage/LTP family
MAWRRLQMALALVVAVAAATLSSAQQQQPAAAAAFPALPSCPPAPLSLSPCIGYVFGVGSATLTACCSQLRGFLRAQAPCLCAASKLAPSPVGLLLGQAQTIIPNVCDLPNPCDDDAAAGDGEGSAPAAASTPSVAGTSPPSSETTTPAATTPATEPSSGTPAANPDASGAPPDPAEDSPAAATAPAGAGSKLPQLLHAAGATRSRGMAAGTVLVTVFLASIATMYA

SEQ ID NO: 8485 - DNA, 1179 bp, Panicum virgatum
  misc_feature: Ceres CLONE 2003725
  misc_feature: Encodes the peptide sequence at SEQ ID NO. 8486
aactcaactcctccgcggcacaggcacagcacactcctccccctccgcttctctcgctccccgtctcgccgctttcccctccccccttcctcccggggcgccggggcctccagaatccacctcccgctcccgccgctgtacccggcgggttcgtacgagagcttggttaatgttttgctgctatctttgatggtagactcagttttccacaaccgcctggaaattttgttccagctccatagttagtaccaaccattttctttttgtccagcgggattactgggcaacttcaaagtgaattatgggtggattctgctgctgcctcagtactgaagattttgaggaatatgtccatcccagcaaccctatctataggcaatgcatgtcattaaggcatttgttccacaacatttttggcgggtatactgcaacattccagaggcttgaatctaggccaagtaacccagcccaagggactgctccgctgggatccgctaatccaagtgctagcataaatgacagttcgctagctgaaacttatcaccttgtttctagaccacccccctatgatactgatcccagatatgcccgtgttcaaagagagggactggtatcaaggcgtgagaagtctataaatctcgcacaagaagagtcagtagcccttagacgcaatggcagcagctctggtattgagcatttagctgctcagaagaaacgcagcagtactgaaaatgagggtgaatataaggtccatcgttccgaatcgatgaagagtttgtctgcaaaatcttatagtagcaactatgcggttgtcggttcagaagatgaggatgtgtgccctacttgtctggaagaatatacccccgacaatccgaaaattataactaaatgctgtcaccattttcatcttggttgtatttatgaatggatggagagaagtgatacatgtccaatttgttgcaaggaaatggagttttgcgagagcccatgaaaccattttgttttgcatcacacctcacatcagagcaaaggaaattgtctacagtatagaatgccggggaactgtaaataatagttatgtgctgtccaaatagatctctttctcgagatcagtttcttacatgtattgaaatgacgatcttactaaaattcgtgccagaaaaaaaaaaaaaaaaaaaa

SEQ ID NO: 8486 - protein, 229 aa, Panicum virgatum
  misc_feature: Ceres CLONE 2003725
  misc_feature (1)..(41): Pfam Name: zf-C3HC4 Pfam Description: Zinc finger, C3HC4 type (RING finger)
MGGFCCCLSTEDFEEYVHPSNPIYRQCMSLRHLFHNIFGGYTATFQRLESRPSNPAQGTAPLGSANPSASINDSSLAETYHLVSRPPPYDTDPRYARVQREGLVSRREKSINLAQEESVALRRNGSSSGIEHLAAQKKRSSTENEGEYKVHRSESMKSLSAKSYSSNYAVVGSEDEDVCPTCLEEYTPDNPKIITKCCHHFHLGCIYEWMERSDTCPICCKEMEFCESP

SEQ ID NO: 8487 - DNA, 1020 bp, Panicum virgatum
  misc_feature: Ceres CLONE 2003799
  misc_feature: Encodes the peptide sequence at SEQ ID NO. 8488
ggcacaccaccggccagcctccgcatcctagcttgtgaccgctcgagcggcgaaccggccatgaggaagctgcaagtcttggcggtgctggccctcgcgctgctcgccgcggccggcggcgccagcgggcagcagagcatcatcacgcggcaggtgttcgagagcatgctcagccaccgcggcgacagcggctgccagggcgccttctacacctacgacgccttcaccaaggccgcggccaggttccccgccttcggcaccaccggcgacgaccggacccgccggcgggagctcgccgccttcttcggccaaacctcccatgaaaccaccggtgggtggccaactgctcccggcgggccgttcgcctggggatactgccgcgtggaagaacagaagcagacggacccaccctactacggacgtggacccatacaactcactcacaaatacaactacgagcaggccgggcgggcgttgaaacgggacctggtgggcaacccgggcctggtgtcgcgcaaccccgtggtggccttcgagacggccctctggttctggatgacgccgcagggggccaagccgtcgtgccacgacgtgatcaccggccgctgggcgcccggcgccggcgaccgccgcgcggggaggctccccgggtacgggctgctcaccaacatcatcaacggcgggctcgagtgcggcaagggccggcccaccgccgaagagaacgacagggtcgggttctacaggaggtactgccaggtgctccgagtggctgaaggtgccaacctgtcctgcgcgaaccagacgccgtacgcacccgccggccgctagatcatgcgcaactcaaataataagcagtggtaataataatgaacagccaccgtaccaccactggctggttattactatagagggttgcttgtgagttgtgactacgcttgctatagccttcacatgcatgtatgagtggtgttggtatgaataaaggtagcaatgcaagcagaaaaaaaaaaaaaaaaaaaa

SEQ ID NO: 8488 - protein, 255 aa, Panicum virgatum
  misc_feature: Ceres CLONE 2003799
  misc_feature (1)..(231): Pfam Name: Glyco_hydro_19 Pfam Description: Chitinase class I
  misc_feature (16)..(251): SWISSPROT Homolog: EC 3.2.1.14 Endochitinase precursor
  misc_feature (19)..(250): SWISSPROT Homolog: EC 3.2.1.14 Endochitinase A precursor
MRKLQVLAVLALALLAAAGGASGQQSIITRQVFESMLSHRGDSGCQGAFYTYDAFTKAAARFPAFGTTGDDRTRRRELAAFFGQTSHETTGGWPTAPGGPFAWGYCRVEEQKQTDPPYYGRGPIQLTHKYNYEQAGRALKRDLVGNPGLVSRNPVVAFETALWFWMTPQGAKPSCHDVITGRWAPGAGDRRAGRLPGYGLLTNIINGGLECGKGRPTAEENDRVGFYRRYCQVLRVAEGANLSCANQTPYAPAGR

SEQ ID NO: 8489 - DNA, 1385 bp, Panicum virgatum
  misc_feature: Ceres CLONE 2003856
  misc_feature: Encodes the peptide sequence at SEQ ID NO. 8490
aatatttaaataaaaatttgcagaatgcaaacccagactgctctcccaaagggtcatttccttttcaccagtgaagccgtcaccaacggtcatcctgacaagctctgcgatttcatctcagactccgtcctcgatgcctgcttggcccaagaccccgaatccaaggtcgcttgtgagactgcctgcaagtccaacatggtcatggtcttcggtgaaatcaccaccaaggctaacgtctcctacgaaaagatcgtcagagatgccatcaagaacgtcggctacgactccctcgacaagggttgtgactacaagtcctgctctgttttggtcgccatcgaacaacaatccccagaaatcgccaactccgtccacgttgacaagaaggaagaagatgtcggtgctggtgatcaaggtttgatgatgggttatgcttctgatgaaactcccgaactcatgcccctctcccactctttggccctcaagatctgcgagaagctcaacgaattgagagtcactaaggccctctcctggttgagacccgatgccaagagtcaagtcaccgttgaatacaaaactgaaggaaagaatatcgtcccagtcagagttcacactgtcttggtctcctgccaacactcccccgatatcactcaagaagaaatcgctgcccaagtcaaggaacacgtcttcaagtcagtcatcccctccaagttcctcgatgagaacaccatctaccacatcaacccctcaggcagtttcattgtcggaggtccatgcggtgatgctggtcttactggaagaaagatcatcgtcgatacctacggtggttggggtggtcacggaggtggtgctttctccggcaaagaccccactaaggtcgacagatccgctgcttacgccgccagatgggttgccaagagtttggtccacgctggtttcgccaagagagccctcgtccaaattgcttacggtatcggtatagctgaccccatctccgtccacgtcgacacctacggaaccgttactgaaggctacactgaccacgacctcaatgtcatcgtcagcaagaacttcaacctcagacctggtggaatcatcaagcaactcggcctcaagagacccatctacagcaagttgagcgctttcggtcacttcggtagaaacgatgctgatttytactgggaaacccccaaggacttgacccacgagaagaagcattaaataggttttgttaamaaattcataaattccataaagttgtcgtaatgggggggtakggayttcatttttcaatttttyatatccaaaagtcgckgggwaaaagggtatttttttgaagtccaaaaaaattttttaaatttttgggccttcgggcaagggtttagggg

SEQ ID NO: 8490 - protein, 397 aa, Panicum virgatum
  misc_feature: Ceres CLONE 2003856
  misc_feature (1)..(142): Pfam Name: S-AdoMet_synt_C Pfam Description: S-adenosylmethionine synthetase, C-terminal domain
  misc_feature (12)..(395): SWISSPROT Homolog: EC 2.5.1.6 S-adenosylmethionine synthetase
  misc_feature (13)..(391): SWISSPROT Homolog: EC 2.5.1.6 S-adenosylmethionine synthetase
MQTQTALPKGHFLFTSEAVTNGHPDKLCDFISDSVLDACLAQDPESKVACETACKSNMVMVFGEITTKANVSYEKIVRDAIKNVGYDSLDKGCDYKSCSVLVAIEQQSPEIANSVHVDKKEEDVGAGDQGLMMGYASDETPELMPLSHSLALKICEKLNELRVTKALSWLRPDAKSQVTVEYKTEGKNIVPVRVHTVLVSCQHSPDITQEEIAAQVKEHVFKSVIPSKFLDENTIYHINPSGSFIVGGPCGDAGLTGRKIIVDTYGGWGGHGGGAFSGKDPTKVDRSAAYAARWVAKSLVHAGFAKRALVQIAYGIGIADPISVHVDTYGTVTEGYTDHDLNVIVSKNFNLRPGGIIKQLGLKRPIYSKLSAFGHFGRNDADFYWETPKDLTHEKKH

SEQ ID NO: 8491 - DNA, 1047 bp, Panicum virgatum
  misc_feature: Ceres CLONE 2003874
  misc_feature: Encodes the peptide sequence at SEQ ID NO. 8492
aggcctcccaccattgccagcagtgctctcgtgtaacaccaactagcagcgacgagtcggtagttgtagtttgcagtaaccggagctcgacgcaggccaccatgccggggctcaccatcggcgacaccatccccaacctggagctggactccacccagggccggatccgcatccacgacttcgtcggcgacggctacgccatcatcttctcccaccccgctgacttcacgccggtgtgcacgacggagatggcggcgatggcggggtacgcgcacgagttcgagaagcggggcgtgaagctgctgggcatctcctgcgacgacgtggcgtcccacaaggagtggatcaaggacatcgaggccttcaagccgggggccaagctgacgtacccgatcatggcggacccggaccgcagggccatcagggagctcaacatggtggacccggacgagaaggacgcgcgcggggtcagcctgccctcccgcgcgctccacgtcgtggggcccgacaagacggtgaagctgagcttcctgtacccggcgtgcacggggcggaacatggacgaggtgctccgcgccgtggactcgctgctgacggccgccaggcacaagggcaaggtggccaccccggccaactggaagcccggcgaccgcgccgtcatcgggcccagcgtctcagacgacgaggccaggaagctgttcccggacggcttcgagaccgccgacctgccctccaagaagggctacctccgcttcaccaaggtctagtcgtctagacgacgacccgtcgccggcggcgtgccgtgccttgctcttttgggtgatcctgatccgccggtgctgcatctgagaggttactggcctggtgtttgcgtgtgtgcgtgatggctcgatctgtgtgtatgcatgtgtgccgtgatgccaccgccgagcagctagctagcggtggtgtcagtagtaagtactccagtaactgtacctggaatcctggatggacttggctgaaatgcaacgtgtcgtgcctgtgtaaaaaaaaaaaaaaaaaaaa

SEQ ID NO: 8492 - protein, 221 aa, Panicum virgatum
  misc_feature: Ceres CLONE 2003874
  misc_feature (1)..(219): SWISSPROT Homolog: EC 1.11.1.15 Peroxiredoxin-6
  misc_feature (1)..(221): SWISSPROT Homolog: EC 1.11.1.15 Peroxiredoxin
MPGLTIGDTIPNLELDSTQGRIRIHDFVGDGYAIIFSHPADFTPVCTTEMAAMAGYAHEFEKRGVKLLGISCDDVASHKEWIKDIEAFKPGAKLTYPIMADPDRRAIRELNMVDPDEKDARGVSLPSRALHVVGPDKTVKLSFLYPACTGRNMDEVLRAVDSLLTAARHKGKVATPANWKPGDRAVIGPSVSDDEARKLFPDGFETADLPSKKGYLRFTKV

SEQ ID NO: 8493 - DNA, 1182 bp, Panicum virgatum
  misc_feature: Ceres CLONE 2003948
  misc_feature: Encodes the peptide sequence at SEQ ID NO. 8494
atatctctcaactctctcgacattgcaacagcaccacctaccctacccaaatcaatctcgtccagcacaccccattcttcactatgtctgaccagccgttcccccagcagactcacctgcacaccgtggctgagcaccgcgctgctgttttgacgtatcccgcaaacctgcgggaagctctccgtcaagccaaggaggatcccaagaagacgctgctgggtgtcgcacagggtatccccagcgtttttgtcacaaaggttatggcctctgccaagcccgacttcatctggatggacgttgaacacgccatcttcgaccgctcgaccctctatgactgcatccatgccgcgcaacatcactccgagggtaagacgatggtcgtcgtccgtgttcccaagcacgacgaggttagcttgtcaaccgccctcgacgccggtgccgccggtttcgtgatcccccacaccgaaaccgtccaagatatcaaagacaaggtcaaggatattttctacccgcccctcggccaacgctccttcagcccctggaccttcacccccggcatctccaaccagtcgctctacgcgggcgacgactggaacatgaagagctccaacaagcacatctgcatcatcgcgcagattgagagcgtcaagggcttggagaacctcgacgagatcgcgtccatgcccgaggtcgacgcgctcatgttcggcccaggcgactacagcgccgacgccggcatcgacttcaagctcggcgtgccgcccccgcaggcgttcatcgatgccatgaccaagtttgtgacgacggcgcacaagtacgggaagccgctattcggtgctgcgcaaggcccggccatgattccgatcatgctccagcaaggctacaagggcctggcggtcacctttgacgtttggggagtggccaacatggtcaaggacggcatggaggaggcgcgggccgtgatcgtgaagaacgttgatgagactgctgctgctaaggcgaacggttctaacggtaccgccgaggtgccgacccgggaagctccctcgtcgtaagggagcaactggagaaacgatagacgatacccctccacctcaattgtatgactagcagaagagaagcgttgtattttactagagctttagaataaagtttatgtagtaaaaaaaaaaaaaaaaaaaa

SEQ ID NO: 8494 - protein, 323 aa, Panicum virgatum
  misc_feature: Ceres CLONE 2003948
  misc_feature (1)..(239): Pfam Name: HpcH_HpaI Pfam Description: HpcH/HpaI aldolase/citrate lyase family
MSDQPFPQQTHLHTVAEHRAAVLTYPANLREALRQAKEDPKKTLLGVAQGIPSVFVTKVMASAKPDFIWMDVEHAIFDRSTLYDCIHAAQHHSEGKTMVVVRVPKHDEVSLSTALDAGAAGFVIPHTETVQDIKDKVKDIFYPPLGQRSFSPWTFTPGISNQSLYAGDDWNMKSSNKHICIIAQIESVKGLENLDEIASMPEVDALMFGPGDYSADAGIDFKLGVPPPQAFIDAMTKFVTTAHKYGKPLFGAAQGPAMIPIMLQQGYKGLAVTFDVWGVANMVKDGMEEARAVIVKNVDETAAAKANGSNGTAEVPTREAPSS

SEQ ID NO: 8495 - DNA, 1428 bp, Panicum virgatum
  misc_feature: Ceres CLONE 2003968
  misc_feature: Encodes the peptide sequence at SEQ ID NO. 8496
caatcgttcgcaatcccgtctctcctacgcacccccgcccaaccccgccgccctgcatcgccatcccggccgccgccctcgtccccatcccggccggcgccttggtgcgcatccacggccgacgcggcgcaagatccggccgctccggcgctccgacgcccgtcaggccaatagcggtgcgcggggctgcgtcctccccacccaacgcacagatcccgaagccgacgccttgctcgcgacgactgcacagtccacggtccacacgcacatgcaaagcgcggcgggtcgcatgcgcatctagatcctcgcgccattggaaccaacgccatcttctacccgggttcgggcgccgtaccccttcttattaccacgctgcttcgtcctctgctcctcgtagtctagcggacgggcggcgatggctgcggcggcgaggaatgcgggcgtcctcgcgctcttcgacgtcgacggcaccctcacagcgccgcgcaaggtggtgacgcctgagatgctagagttcatgaagcagctgcgccagcatgtcactgttggcgtggtgggcggatccgatctggtaaagattactgagcagctcggcaggacagttattactgactacgattacgtcttctctgaaaatggtctagttgcacacaagaacggagagctaattggaactcaaagtttgaaatcatttcttggagaagacaagctgaaggaatttattaacttcacccttcattacattgctgatttggacattccaattaaaagaggtaccttcatagagttccgaagtggaatgattaatgtttctccgattgggagaaactgtagccaagaagaacgtgatgaattcgagaagtacgataaggtgcataacattcgacctaaaatggtatctgtgcttcgtggaaagtttgctcacttgaacttgacattttctattggagggcagattagttttgatgtatttccccaaggttgggacaaaacttactgtttgagatatcttgaggaatttcaagaaatccatttctttggggataagacctataagggtggcaatgatttcgagatatttgaatctgaaagaacagttggccatacagttaccagccctgatgacacagcacagcagtgcagatctctgttcatggcaaagtaatcttcagcctatttacaacacattcattcactcgaattttatcatgtgctcaaggataagataatggcttaccagatctttcatttaaagcatccttttgcatttttcttaatggccacatcacttgctaccattttttttcccttccaagtccaaacaggttgtactgcttcacattcacagatgttcagactgcatgtgtacacttcgtgaaaataaatgaaaattacctatttttactgcaaaaaaaaaaaaaaaaaaaa

SEQ ID NO: 8496 - protein, 249 aa, Panicum virgatum
  misc_feature: Ceres CLONE 2003968
  misc_feature (11)..(246): SWISSPROT Homolog: EC 5.4.2.8 Phosphomannomutase
  misc_feature (11)..(246): SWISSPROT Homolog: EC 5.4.2.8 Phosphomannomutase 2
MAAAARNAGVLALFDVDGTLTAPRKVVTPEMLEFMKQLRQHVTVGVVGGSDLVKITEQLGRTVITDYDYVFSENGLVAHKNGELIGTQSLKSFLGEDKLKEFINFTLHYIADLDIPIKRGTFIEFRSGMINVSPIGRNCSQEERDEFEKYDKVHNIRPKMVSVLRGKFAHLNLTFSIGGQISFDVFPQGWDKTYCLRYLEEFQEIHFFGDKTYKGGNDFEIFESERTVGHTVTSPDDTAQQCRSLFMAK

SEQ ID NO: 8497 - DNA, 1459 bp, Panicum virgatum
  misc_feature: Ceres CLONE 2004186
  misc_feature: Encodes the peptide sequence at SEQ ID NO. 8498
agggccacgaagtaagctctaatctgcagcgaagaagctagtagctgcggtgaagctaagtaaaagttccagcatgacgcttaggctcttggccgaggtgagcccacaggacttgctcgtagctctttccgagctccaaacccacctccttggctacgtgaagtccatggcgctcaagtgcgctgtggatctcgacatccccgacgccatccaccgccgcggcggggcagccaccctcgccgacatcgcagccgactccaaggtgcacccttccaaggtgcaagacctccagcgcatgatggagctgctcagcgcttcgggcatcttcaccgtcgccgccgccggagaagacggtggcagcgccggtggtgacgccgtgtacgggctcaccacggcgtgccggttcctcgtcggccgctgcaacctgtcccctgtggtgccgttcatggcgagccccctcgtcgtctcctccttctacggcatgtccgactggttcaggagcgagccggcgaccgggtccctcttcgagctggcgcacggctgctcccggtgggagatggcgagcaaggatgccgcgttcaacgccgtcctaaacgactccctggtcgcggatagccagctcttcatggaggtcattattttcgacaagggccgccttttccgcgggctgaactcgctcgtcgacgtcggcggcggccatggcgcggcggcgcaggtcatcgcgagggcgttcccacgcatcaaatgcaccgtgctggaccgtactcacgtggtcagccaggccaccgccggcgagagcgaaaacttgcgttttgtcgctggtgacatgtttgagtctattccacctgcggacgctgtcttactcaagaacattctgcatgactggcgtgatgatgattgcgtaaagttacttcaacgttgcaagcaagccatccctgctaaaagtgacggaggaaaggtaataatcatagaaatggtgagaggttcagcacagggagattccaaaatcagcgagatggaagccatacagaacatgttcatgttacatatcaacggggtggaacgaggcataaatgagtggaaaaagatcttttctgatgctggattcagtgacgattacaagatcatgccggtattgggtccctattcagtaattgagctctacccttgaactgaatgatctgtgaactgcctactaaatattaatatataaatggaaggctataagatatgcatacctgaaatccattgttcaattctatgtgcgtctgatgaactcatctctacgtattgtcaataagcagcaggctacctcgtgaagcagcctctgtggctctgtagtcgtttcttctcttccatcattaatatgataataggtatgtttaatttgagcgtatcgaacaatgttgtttccaagatttgtaactttattttatggaaatatttattatatctcgtt

SEQ ID NO: 8498 - protein, 365 aa, Panicum virgatum
  misc_feature: Ceres CLONE 2004186
  misc_feature (4)..(242): Pfam Name: Methyltransf_2 Pfam Description: O-methyltransferase
  misc_feature (6)..(249): Pfam Name: Methyltransf_2 Pfam Description: O-methyltransferase
MTLRLLAEVSPQDLLVALSELQTHLLGYVKSMALKCAVDLDIPDAIHRRGGAATLADIAADSKVHPSKVQDLQRMMELLSASGIFTVAAAGEDGGSAGGDAVYGLTTACRFLVGRCNLSPVVPFMASPLVVSSFYGMSDWFRSEPATGSLFELAHGCSRWEMASKDAAFNAVLNDSLVADSQLFMEVIIFDKGRLFRGLNSLVDVGGGHGAAAQVIARAFPRIKCTVLDRTHVVSQATAGESENLRFVAGDMFESIPPADAVLLKNILHDWRDDDCVKLLQRCKQAIPAKSDGGKVIIIEMVRGSAQGDSKISEMEAIQNMFMLHINGVERGINEWKKIFSDAGFSDDYKIMPVLGPYSVIELYP

SEQ ID NO: 8499 - DNA, 1101 bp, Panicum virgatum
  misc_feature: Ceres CLONE 2004458
  misc_feature: Encodes the peptide sequence at SEQ ID NO. 8500
gtataccagcagacttgacttcacgaatccacccaaaatattgcctatttttcatcgacccatctcatgggtgaatcgaagcggaatggtgtccacgacccgacggcctccatgatgctccatggccgcgtagccattgtcaccggtggcgccggcggcatcggctctgcggtgtcgaagcacctcgcgtccctcggtgcgcgtgtggcagtggcgtacgtcggcgacccggcgcctgctctaaagctcgtgagcgacatcaactccaagcacgccggcgagagccagcagccgcgggccgtcgccgttgaggcagacgtgtcggacgcggcgcaggtgaaggcgctgttcgactcggcggccgcagcgttcggtggtgagctccacatcctggtgacgctggcggcggtgctggacttctcgtacccggcgctggtggacaccagcgaggcgacgtacgacgccatgttcggcaccaacacgcggggcaccttcctgtgctgccgcgaggcggccgggcggttggtccgtgacggccgcggccggatcgtgacgttctcctcgtcgggggtcgggtcgctgcgcccgggctacgcggtgtacgcggcgagcaaggcggcggcggaggtgatgaccaagatcctggcgcgcgagctgcgcggcacggggatcacggccaacgtggtggcgccggggtctacgggcacgcccatgttttacaacgggaagacgcccgatgaggcggagcgctacatcgccgaggcgccgctgggccggctgggcatgccggaggacatcgcgccgctcgtgggcttcctcgccagcgacgctggccactgggtcaatgcccaggtcctgcgctgcaacggtggcaccatctagccagtggaccttgctaggcggtgttaacgaactgctgctccgttttcactactgcgcgcacactgaaatgcacttttttaaataatgttttattcaataatgggtcatatttgtgcttatgttttatttgttctcctataacatttcatagtatttgatgttaagcactcatgcttatataaatgtcgatctgttcgtcaaaaaaaaaaaaaaaaaaaa

SEQ ID NO: 8500 - protein, 271 aa, Panicum virgatum
  misc_feature: Ceres CLONE 2004458
  misc_feature (1)..(182): Pfam Name: adh_short Pfam Description: short chain dehydrogenase
MGESKRNGVHDPTASMMLHGRVAIVTGGAGGIGSAVSKHLASLGARVAVAYVGDPAPALKLVSDINSKHAGESQQPRAVAVEADVSDAAQVKALFDSAAAAFGGELHILVTLAAVLDFSYPALVDTSEATYDAMFGTNTRGTFLCCREAAGRLVRDGRGRIVTFSSSGVGSLRPGYAVYAASKAAAEVMTKILARELRGTGITANVVAPGSTGTPMFYNGKTPDEAERYIAEAPLGRLGMPEDIAPLVGFLASDAGHWVNAQVLRCNGGTI

SEQ ID NO: 8501 - DNA, 926 bp, Panicum virgatum
  misc_feature: Ceres CLONE 2004544
  misc_feature: Encodes the peptide sequence at SEQ ID NO. 8502
acgccacattccgcgagcacgaccaaatcccccgctagtgccaagtgctactgcatctacaagtagcactcgcgaccactagtcccgccgctaccacttcacgtctgcaccaacacgacggcggcagcgaagccggcaggagcaatggcagcgactaggacgacggccatggcgcggtccccatgcccgctggccctcgcgctcgcggcgcttttactagccgccgccgcgcgcgccgacggcgccacgggcacggccgcgccggcgccggcgccgtcggcggactgcacgggcgcgctgctgagcctggcggggtgcctgagctacgtgcaggaggggagcacggcggcgacgcccgacccgacctgctgctcggggctccgggacgtggtgcgcggcgaggtggcctgcctctgccaggtgttccagggcggcccgaacctcggcatcccgctcaacatgaccaaggccctgcagctgcccgccgcctgcaaggtcaagacgccgcccgtcagcaagtgccacgtttctgttcctggtgtgcccagcgcgtctccagttcctgctccatctgccggggccccgttcttcagtcagtcaccgtcgtcgccagctccttcgggatcgccagcagggaccgggatcgcctccagcactccagctccctcgccggcgcgttctcgcgcggccagcctctcggcagcatcagcacagagctttttcacggcagcagctgctgccgctactctgctcgtgtaccgtatcttgtgagcccagctcaccagttgtgttcatcagttcagtccgttccctcgtcttaccagtaccagcgtatagcccctataccgagttgtatcttgtgagaattcccgttttggttgcgcctcttttggacgtgcattgtttaaaaaaaaaaaaaaaaaaaa

SEQ ID NO: 8502 - protein, 208 aa, Panicum virgatum
  misc_feature: Ceres CLONE 2004544
  misc_feature (1)..(78): Pfam Name: Tryp_alpha_amyl Pfam Description: Protease inhibitor/seed storage/LTP family
MAATRTTAMARSPCPLALALAALLLAAAARADGATGTAAPAPAPSADCTGALLSLAGCLSYVQEGSTAATPDPTCCSGLRDVVRGEVACLCQVFQGGPNLGIPLNMTKALQLPAACKVKTPPVSKCHVSVPGVPSASPVPAPSAGAPFFSQSPSSPAPSGSPAGTGIASSTPAPSPARSRAASLSAASAQSFFTAAAAAATLLVYRIL

SEQ ID NO: 8503 - DNA, 1266 bp, Panicum virgatum
  misc_feature: Ceres CLONE 2004706
  misc_feature: Encodes the peptide sequence at SEQ ID NO. 8504
aaacctcgacctcatccctagctcataccccctagtcatccgccacttcacggattctgccaaccacgaacaaaagtatacccgagttcgcaccatggcgcccccatcagagatcaatgccgtggtcatcacccagcccggaacggctgaagtcaagacggtacccctcccagagcttccggatgactacatcctcgtccgcaccacggccgtcgctctcaacccgacagactggaagcacgttcacgtgggcgtgagcaccgtagggacccgtgtaggctgcgactacgctggcatcgtcgagcaagtcgggcccaaagtgaacaagcccttcaaaaagggtgaccgtatctgcggaattgtccacggagccaactcgctgcggcctgatggcggtggttttgcggactacatcattgccaaaggcgacctgcagatcaaggtccccgacaacctgagcaacgaggacgccgccacgctgggcgtcggcatcagcacggtgggccaaggtctttaccaggcgcttcagctccccctccccggcaccgccgaggccgcctcctccagcaacccgcctccggagatccttatctacggcggcagcacggccaccggcttggtcggcatccagttcgccaagctgtcgggctaccgcgtcgtcaccacctgctcgccctccaacttcgagtacgtcaagtcgctgggcgccgacgcggcgttcgactaccggtcccccaccgtcgtggacgacatcaaggcgtggagcgccgacgccgacgcgctgacgctggcgtgggactgcatcgcccagggcgacgccccgatcatctccgcggcggcgctgagccggacccgcccgggacactaccgctcgctggtgagggtcgcggacgaggtggtgacggcggtgaatgataagctggataacggcgcgaggctggggtataccgtcataggggaggctattaataaggggcagccgatcccggcgattccggcggactatgagttcgggaagaagttctgggagctgtcgagagagttgttggcggaggggaagatcaagccggctaggacggaggttaaccgtggcgggaagggcttggagggtgtgttggttggattgcaggagatgaaggctgggaaggtcagtggcgttaagctggtgtataccctgtaagtggttatggtcaagctatcctttctcggacatagaacttgtaggttgaatgagagcacaagctgtaaaaaaaaaaaaaaaaaaaa

SEQ ID NO: 8504 - protein, 361 aa, Panicum virgatum
  misc_feature: Ceres CLONE 2004706
  misc_feature (1)..(88): Pfam Name: ADH_N Pfam Description: Alcohol dehydrogenase GroES-like domain
MAPPSEINAVVITQPGTAEVKTVPLPELPDDYILVRTTAVALNPTDWKHVHVGVSTVGTRVGCDYAGIVEQVGPKVNKPFKKGDRICGIVHGANSLRPDGGGFADYIIAKGDLQIKVPDNLSNEDAATLGVGISTVGQGLYQALQLPLPGTAEAASSSNPPPEILIYGGSTATGLVGIQFAKLSGYRVVTTCSPSNFEYVKSLGADAAFDYRSPTVVDDIKAWSADADALTLAWDCIAQGDAPIISAAALSRTRPGHYRSLVRVADEVVTAVNDKLDNGARLGYTVIGEAINKGQPIPAIPADYEFGKKFWELSRELLAEGKIKPARTEVNRGGKGLEGVLVGLQEMKAGKVSGVKLVYTL

SEQ ID NO: 8505 - DNA, 1334 bp, Panicum virgatum
  misc_feature: Ceres CLONE 2004852
  misc_feature: Encodes the peptide sequence at SEQ ID NO. 8506
agccagcgccaaaagcagctgccgattccactgcctgcctcctgcctgctgctgccgcaacacagcccagccagcaggagagcgagcgaggagagagggcggcggcggcagcagctcggtagcttgttggctcatgcagggcgcgtaccgctcttccagcgaggagtcggcggcgtcgccagcggctgcggcggcggcggcggcagcggcagccatggccccgctggcggcggccgcggcggccgcggtgaagatggaggagcaggcggcggcggcggcggcgatggcggccggcacgcaggcgccggcgccgctccagcagatgcagccgcggcggcagtaccgcggcgtgcgcatgcgcaagtggggcaagtgggtggcggagatccgggagccgcacaagcgcacgcgcatttggctgggctcctacgccacgcccgtggcggcggcgcgcgcctacgacacggccgtgttctacctgcgcgggcggtcggcgcggctcaacttccccgacgagatccccgcgctggcgcttgcggagggcggcggggagcccgcgcgcggcggcgacgccgacggcggcacgctgtccgcggcgtcgatccggaagaaggccatcgaggtggggtcgcgcgtggacgcgctgcagaccggcatgatggtcgcgccgccgcaccaccgcgagcggcagaggcaccaccaccaccacggccttccgcagctgcacgccgaggaagagcagcgccagcaggagcagaagcagcagcgcgccgcctggagcgggcgcgccaagaacccggatctcaaccgggcgccgagccccgagagctcggacgccgagtgaagcagcaggcaggcaggcgcgcgagcaaccaccgcaagactcaactcaactcaacgacgacgctgttcatcccgccccgcgacacgccatcaagggtaggtctccgtctccgtcctccgtggcggcgggcgggtgktcggtggcsccggcggggggacggaagggttttcgwtcgggtackttgtggawaacgcacgaggcagctggcttgggcggggtggggggrggrgrggrgggcagcgaggggggggcccggcccaaagggggggttttttggttcgaacttcagaaaggccagctgtaccggggataacaaaaacaagtctttttccttcctttgtttttccgggggcattccctttccttttttttccttttgggtttcgtccaagtaaaaaagtaaaccccccgggtttctttgccccccccctggggggtttaaacaaggattaaggaagccggatggggcggggcccccctcctttttttt

SEQ ID NO: 8506 - protein, 236 aa, Panicum virgatum
  misc_feature: Ceres CLONE 2004852
  misc_feature (1)..(65): Pfam Name: AP2 Pfam Description: AP2 domain
  misc_feature: The sequence is a functional homolog of  SEQ ID NO 154 in the  10/225,068 US patent application
  misc_feature: The sequence is a functional homolog of  SEQ ID NO 1716 in the  10/412,699 US patent application
  misc_feature: The sequence is a functional homolog of  SEQ ID NO 1952 in the  10/374,780 US patent application
  misc_feature: The sequence is a functional homolog of  SEQ ID NO 200 in the  11/375,241 US patent application
  misc_feature: The sequence is a functional homolog of  SEQ ID NO 4 in the  10/666,642 US patent application
  misc_feature: The sequence is a functional homolog of  SEQ ID NO 488 in the  10/374,780 US patent application
  misc_feature: The sequence is a functional homolog of  SEQ ID NO 489 in the  10/374,780 US patent application
  misc_feature: The sequence is a functional homolog of  SEQ ID NO 490 in the  10/374,780 US patent application
  misc_feature: The sequence is a functional homolog of  SEQ ID NO 572 in the  11/435,388 US patent application
  misc_feature: The sequence is a functional homolog of  SEQ ID NO 681 in the  10/666,642 US patent application
  misc_feature: The sequence is a functional homolog of  SEQ ID NO 682 in the  10/666,642 US patent application
  misc_feature: The sequence is a functional homolog of  SEQ ID NO 683 in the  10/666,642 US patent application
  misc_feature: The sequence is a functional homolog of  SEQ ID NO 988 in the  10/412,699 US patent application
  misc_feature: The sequence is a functional homolog of  SEQ ID NO 989 in the  10/412,699 US patent application
  misc_feature: The sequence is a functional homolog of  SEQ ID NO 990 in the  10/412,699 US patent application
  misc_feature: Useful for making plants with modulated growth and phenotype characteristics
MQGAYRSSSEESAASPAAAAAAAAAAAMAPLAAAAAAAVKMEEQAAAAAAMAAGTQAPAPLQQMQPRRQYRGVRMRKWGKWVAEIREPHKRTRIWLGSYATPVAAARAYDTAVFYLRGRSARLNFPDEIPALALAEGGGEPARGGDADGGTLSAASIRKKAIEVGSRVDALQTGMMVAPPHHRERQRHHHHHGLPQLHAEEEQRQQEQKQQRAAWSGRAKNPDLNRAPSPESSDAE

SEQ ID NO: 8507 - DNA, 939 bp, Panicum virgatum
  misc_feature: Ceres CLONE 2005099
  misc_feature: Encodes the peptide sequence at SEQ ID NO. 8508
aagcacaaggcttcatctccctcctcacaactaacgagaccaagctcctcacacagttcaatcacgatctctagcaatggcgaccaccactaagaacgccctggtgctcctcctcctggcgctcctccctctcgccgctctctcctcccgcgccggcccatccgcgcacaaaaggcacggtcacgggcccaagcacgcgcacccgtcacctccatcaccacttcctccggccccggtcgccgcgccacccgcgctggtgcgcgccacctgcaactccacggcctacccggacctgtgcatgtccgcgctgggcgccgacccgtccagcgccacggccgatgtgcgcggcctctcggccatcgccgtctcggccgcggccgccaacgcctcgggcggcgccgccgcggccgccgcgctggccaacgccaccgccccggagggcaccggaacggccgccgtgcaggcgctgctccgcacctgcgcctccaagtacggccaggcccgcgacgcgctgggcgccgccagggactccatcgccgcgcaggactacgacttcgcctccgtgcacgtcagcgccgccgccgagtacccgcaggtgtacagggcgctgttccggcggcagaggcccgggcagtacccggcggagctggcggccagggaggaggcgctcaggcagctctgctccgtcgcgctcgacatcatcgcgctcctcgccaacagcagctagctcatggctgatccgctgcacgctccaatcatcgttcattaacttattggctagtgagcctacgtgtaatgacacgtatgtcgtctctgtgattttggtagcatagcactagtgtactgcacttgttaatctttgtactgtcacattctgtcagtgtcagttaactacttgagaagaaatgttcttatatacaaaaaaaaaaaaaaaaaaaa

SEQ ID NO: 8508 - protein, 216 aa, Panicum virgatum
  misc_feature: Ceres CLONE 2005099
  misc_feature (1)..(157): Pfam Name: PMEI Pfam Description: Plant invertase/pectin methylesterase inhibitor
MATTTKNALVLLLLALLPLAALSSRAGPSAHKRHGHGPKHAHPSPPSPLPPAPVAAPPALVRATCNSTAYPDLCMSALGADPSSATADVRGLSAIAVSAAAANASGGAAAAAALANATAPEGTGTAAVQALLRTCASKYGQARDALGAARDSIAAQDYDFASVHVSAAAEYPQVYRALFRRQRPGQYPAELAAREEALRQLCSVALDIIALLANSS

SEQ ID NO: 8509 - DNA, 1088 bp, Panicum virgatum
  misc_feature: Ceres CLONE 2005215
  misc_feature: Encodes the peptide sequence at SEQ ID NO. 8510
agacacggtcacgctcccgccccgtatgctactgaacaaacactcacaaagacagcaacctccctcctgccgtctcagcgcgcgccatgaagctggaggtcgcggcggcgaggcagaggagccaggacgcggagcagaaggacaaggccgcgggcgtcctcggcattgagccgtggaagaaccacccggcgaggctccctgcccctctccccaaggcggacgccggcggcgccctggtgccgccgctcaacttcgccatggtcgacgacggcatcttccgctcgggcctcccggacgccgccaacttccgcttcctgctctccctcaacctgcgctccatcgtgtacctgtgcccggagccgtacccggaggagaatgcgtggttcctccggcagaacgggattgagcttcaccagttcggcatcgaagggagcaagagtggtctgacaatgccggaaaccctgttactacaggaaccactcgtctacatccctgaagaaacgatccgggaggcgctcaaagttattcttgacgtaagaaaccagccggtcctcatccactgcaagagaggcaagcaccggaccggctgcgtcgtcgggtgcctgaggaagctgcagaagtggtgcctatcctcggtcttcgacgagtacctccacttcgcggcggcgaaggcgaggagcaccgaccagcggttcatggagctgttcgacgcgtcgagcctgatgcacctgacggcctcccagtgaccacgagtgttgaccccaagcgagcggtttttcttggccgccgtcccgatcctgcaaccatgctgcatcgagagcgatctgtgtgttcccccctgttgtctctaaagcaacttcggcagagagaataatgctagagccgtgagtgttgtgtgagattggcaatggccttgggttttgctgcgtgagtgctgtagctgcttcgtgttcaactgatttcagattctgaaatggcgatggccgataatgaacaatggcggagtagatgattccgttgcatgattgatcgattcatcaggaacttgcaataaacctcctcctctagaaaaaaaaaaaaaaaaaaaa

SEQ ID NO: 8510 - protein, 219 aa, Panicum virgatum
  misc_feature: Ceres CLONE 2005215
  misc_feature (1)..(157): Pfam Name: Y_phosphatase2 Pfam Description: Tyrosine phosphatase family
MKLEVAAARQRSQDAEQKDKAAGVLGIEPWKNHPARLPAPLPKADAGGALVPPLNFAMVDDGIFRSGLPDAANFRFLLSLNLRSIVYLCPEPYPEENAWFLRQNGIELHQFGIEGSKSGLTMPETLLLQEPLVYIPEETIREALKVILDVRNQPVLIHCKRGKHRTGCVVGCLRKLQKWCLSSVFDEYLHFAAAKARSTDQRFMELFDASSLMHLTASQ

SEQ ID NO: 8511 - DNA, 619 bp, Panicum virgatum
  misc_feature: Ceres CLONE 2005275
  misc_feature: Encodes the peptide sequence at SEQ ID NO. 8512
acaacaagcagagcagagcctagcttcttcctgaacccaactccatcaaccaacgcaggctcgtcctagctagttccaccagcaacatgtcggacaagtgcggcaactgcgactgtgctgacaggagcaagtgcacgaagggcaacagctatggcgtcgtcgtagtcgacaccgagagcagccgcgtcgagcgccgcgaggaggaggaggtcgccgccggcgagaacgacggcaagtgcaagtgcggcaccagctgcggctgcggcgccagctgcaactgcggccactgaagaagcccgccgcgtcgtccatggcctgcgtgcacactccccatccagtacccatcctgtacctgtatgtacgtcgtcgatcacagcgtataaataaaattaaataaaccgccatgcccgtgttgaatacgtacgtacgtcgtgtacgtcctatgtgacctgctgcgtctccgctgctgtcgtgcatgtgaccagcaaccacctgtagctacctacctgctggctgcctctgttgtgtggcctagctggcgcgtatatactacgtgtctttgtgacgacgcatgcatgtacgtatctctgttatgtgcaatgaaatctactgtgtgctt

SEQ ID NO: 8512 - protein, 67 aa, Panicum virgatum
  misc_feature: Ceres CLONE 2005275
  misc_feature: Great-hit functional homolog of the protein sequence given in SEQ ID NO 9522
  misc_feature (1)..(62): Pfam Name: Metallothio_2 Pfam Description: Metallothionein
  misc_feature: Useful for making plants with modulated nitrogen use efficiency
MSDKCGNCDCADRSKCTKGNSYGVVVVDTESSRVERREEEEVAAGENDGKCKCGTSCGCGASCNCGH

SEQ ID NO: 8513 - DNA, 1065 bp, Panicum virgatum
  misc_feature: Ceres CLONE 2005840
  misc_feature: Encodes the peptide sequence at SEQ ID NO. 8514
aaaaaaagctcagctcgctcccctccaggctcccgcactgccgtgccgcctcgccatggaggccgccgccgccgccgccttgtcccctccccgcgtcgccctcgacgcgcgcgcgctcttctcccctccccgctccctccccgcctcgccctcatcgcagctccgcctcgccgcccgcccgcgcgcgctcgccgccgccaggccgcggttcctgagcccccaccgagaccccgccgccgacggcggccgcggcgccagggatgtcgtcgcgatggtggtgccgttcctgagggggaccgcgtgggagcagccgccgccggatttggcgtcgttcctgtacaagaaccggatcgtgtacctggggatgtgcctcgtgccgtcggtcacggagctcatgctcgccgagttcctctacctccagtacgacgacgccgagaagcccatctacctgtacatcaactccactggcaccaccaagaatggtgagaagttaggttatgagacagaagctcttgcagtatatgatgctatgaggtatgtaaaagttccaattttcactctctgtgtcggtaatgcatggggagaagctgctttgctcttagctgctggtgctaaaggtaaccgcgctgcacttccatcctcgacgataatgataaaacagccgattggtcgttttcaaggtcaggcaacagatgttgacattgcaagaaaagagatcagaaatgtcaagatagaaatggttaagctgctggcaaggcacattggtaaaccagcagaagagatcgctcgggatatcagacggcctaaatacttcagccccagtgaagctgtggaatatggcatcattgacaaggtgatatacaacgagaaaatccaggaagacggcggtgtcgtgtcagaactcaaaagatcaaatttgatatagtgttctttttaacaagtagagacatttttgtaagtttagtggcgacatgcgtttgtgtattggtgagtagctgccattcattagctggccatagagcacatataactggatagccaatgcaaagcacaagcgtttccttg

SEQ ID NO: 8514 - protein, 289 aa, Panicum virgatum
  misc_feature: Ceres CLONE 2005840
  misc_feature (1)..(202): Pfam Name: CLP_protease Pfam Description: Clp protease
  misc_feature (86)..(268): SWISSPROT Homolog: EC 3.4.21.92 ATP-dependent Clp protease proteolytic subunit 2
MEAAAAAALSPPRVALDARALFSPPRSLPASPSSQLRLAARPRALAAARPRFLSPHRDPAADGGRGARDVVAMVVPFLRGTAWEQPPPDLASFLYKNRIVYLGMCLVPSVTELMLAEFLYLQYDDAEKPIYLYINSTGTTKNGEKLGYETEALAVYDAMRYVKVPIFTLCVGNAWGEAALLLAAGAKGNRAALPSSTIMIKQPIGRFQGQATDVDIARKEIRNVKIEMVKLLARHIGKPAEEIARDIRRPKYFSPSEAVEYGIIDKVIYNEKIQEDGGVVSELKRSNLI

SEQ ID NO: 8515 - DNA, 772 bp, Panicum virgatum
  misc_feature: Ceres CLONE 2005974
  misc_feature: Encodes the peptide sequence at SEQ ID NO. 8516
atcccaagctctagcactcactcatcactactagcagcagcagcctctcatcatcagagtacactgtttgagcaagagagaatggctcgcctcgccgttgttgccctctgcgtcctggcggtgctggtggcagccgagactgcctctgctgcgatcagctgcggtgacgtgacgtcgtccattgcgccgtgccttgggtacgccatgggcagctcgtcggccccgtcggcgcagtgctgcagcggggtcaagtccctgaacagcaaggcgtcgtccaaggcggaccgtcagacggcgtgcagctgcctgaagaacatggccggcaggctcaggggcgtcagcatgggcaacgccgccagcatccccagcaagtgcggcgtcagcgtcagcatgcccatcaaccccaacgtcgactgctccaaggttaactgagaaggttctagctgtgttgttgcacatcgatcagcgtcatgtaccacctcgttgcagctgatgaatggcgtgcacgtgcctcctatgcgagtttaaattcatctttagtggtgatttgtctgttttcatgtgccttgttgctttcacgggttgcttctgttgccttgtatcagtaataaaaatgcaaccctcttgaacactaattgtattcatataacttatgtgtggtgccattttttttatccatgatgcattttagttttaaaaataaattaaaatgttgtattcatagtttcatcaattgaaaagaaaagttgcagaaaaaaaaaaaaaaaaaaaa

SEQ ID NO: 8516 - protein, 116 aa, Panicum virgatum
  misc_feature: Ceres CLONE 2005974
  misc_feature (1)..(86): Pfam Name: Tryp_alpha_amyl Pfam Description: Protease inhibitor/seed storage/LTP family
MARLAVVALCVLAVLVAAETASAAISCGDVTSSIAPCLGYAMGSSSAPSAQCCSGVKSLNSKASSKADRQTACSCLKNMAGRLRGVSMGNAASIPSKCGVSVSMPINPNVDCSKVN

SEQ ID NO: 8517 - DNA, 1091 bp, Panicum virgatum
  misc_feature: Ceres CLONE 2006104
  misc_feature: Encodes the peptide sequence at SEQ ID NO. 8518
ctctttcgctgctgaatcgaaccagaccagaccagaccgccaccgctccgcctcgcctcgccggctagcttttcgccgccgcggatctcggaccgccgctatggactccgcgcactcgtgctcctccgccgccgcaggcgaggccccgaccaccggtgagcaccggatggggaccaccatcgtcggggtctgctacgagggcggcgtcgtcctcggcgccgactccaggactagcactggaatgtatgtagccaaccgcgcttcagacaagattactcagctgacagacaatgtctatgtctgccgctctggatctgctgctgatacacaagttatttccgactatgtgcgttatttcctccaccaacacacaattcagcttgggcaaccagctactgttaaagttgcagccaacttgattaggttgctagcttatcagaacaagaacatgttgcaagctggcatgattattggaggatgggacaagtatgagggaggccaaattttttcagttccccttggcggaacaattctgcggcaaccatttgcaattggaggttcaggttccagttacctgtatgcgcttcttgatcatgaatggagagatggaatgagccaggaagaggcagagaaatttgtggtgaaggtagtttcccttgctatggcccgtgatggtgctagtggaggagttgttcgtacagttactataaatgcggatggtgtcaagaggaacttttaccctggtgacaaacttcctctgtggcatgaagagttggagcctcagagctcattgcttgatattcttgctgccgggaaccctgaccccatggtgcagtgaatttgctctccagcctcgcactcacctttgtgaaatttcctactgtatgacttgttcaagattttaagtggagaatttgagatagttcctgctggtacaccaaagtgttttttttcttattattaccatgccttagtaaattcctgttcggcagattgtgataggtgttctgaggtgtggttagtaatcagattgttgtgactcgagataaatggttagctgtttactgtgacaaaaaaaaaaagaaaaaaaa

SEQ ID NO: 8518 - protein, 245 aa, Panicum virgatum
  misc_feature: Ceres CLONE 2006104
  misc_feature (21)..(243): SWISSPROT Homolog: EC 3.4.25.1 Proteasome subunit beta type 6 precursor
MDSAHSCSSAAAGEAPTTGEHRMGTTIVGVCYEGGVVLGADSRTSTGMYVANRASDKITQLTDNVYVCRSGSAADTQVISDYVRYFLHQHTIQLGQPATVKVAANLIRLLAYQNKNMLQAGMIIGGWDKYEGGQIFSVPLGGTILRQPFAIGGSGSSYLYALLDHEWRDGMSQEEAEKFVVKVVSLAMARDGASGGVVRTVTINADGVKRNFYPGDKLPLWHEELEPQSSLLDILAAGNPDPMVQ

SEQ ID NO: 8519 - DNA, 669 bp, Panicum virgatum
  misc_feature: Ceres CLONE 2006342
  misc_feature: Encodes the peptide sequence at SEQ ID NO. 8520
aactaacgctaaaaaagtaacagtttctgtactttattgcctgccaaccatgcgccaagccctcctctgcgcgttcctcctcgcgaccatcgccgtcacgctggcgtcggcccaggccgacaaggcggaggtgacggacaaggtcttcttcgatattgctgtcgacggcaagcccgcgggccgcgtcgtcatcggcctcttcggcaaggtcgtcccgaagacgaccgacaacttcaaggctctttgcaccggcgagaagggcttcggctacaagggctcgtcgttccatcgcgtgatcaagaacttcatgatccagggcggcgacttcaccaacggcgacggcaccggcggcaagtcgatctacggcgccaagttcaaggacgagaacttcgacatcaagcacttcgtcggcgcgctgtcgatggcaaactctggtccggacacgaacggctcgcaattcttcatcaccacggccgagacgagctggcttgacggccgccacgtcgtcttcggtaagatcgtcgagggcatggacatcgtgcgcaagatcgagaaccagaagacgtcgagccgcgacaagcccaacaagccggtgaccatcgccgacgctggtgtgttgtaatcgatcgatttccgacccatcctgcgctggactgggcgtgcgacttc

SEQ ID NO: 8520 - protein, 190 aa, Panicum virgatum
  misc_feature: Ceres CLONE 2006342
  misc_feature (1)..(160): Pfam Name: Pro_isomerase Pfam Description: Cyclophilin type peptidyl- prolyl cis-trans isomerase/CLD
  misc_feature (4)..(190): SWISSPROT Homolog: EC 5.2.1.8 Peptidyl-prolyl cis-trans isomerase B precursor
MRQALLCAFLLATIAVTLASAQADKAEVTDKVFFDIAVDGKPAGRVVIGLFGKVVPKTTDNFKALCTGEKGFGYKGSSFHRVIKNFMIQGGDFTNGDGTGGKSIYGAKFKDENFDIKHFVGALSMANSGPDTNGSQFFITTAETSWLDGRHVVFGKIVEGMDIVRKIENQKTSSRDKPNKPVTIADAGVL

SEQ ID NO: 8521 - DNA, 859 bp, Panicum virgatum
  misc_feature: Ceres CLONE 2006368
  misc_feature: Encodes the peptide sequence at SEQ ID NO. 8522
aacgaacgctaaaaaagtaacagtttctgtactttattgatccccccgtcctcaatgccgaaccccgttgtttacttcgacatcaccatcggtggcgccaacgctggccgcatcgagatggagctctacgccgacaccgtgcccaagactgcggagaacttccgcgctctgtgcactggcgagaagggcgtcggccgcagcggcaagcccctccactacaagggttccgcgttccaccgcgtgatccagggcttcatgtgccagggtggcgacttcacccgcggcaacggcactggcggcgagtcgatctacggcgagaagttcgctgacgagtccttcgctggcaaggccggccgccacaccggcctcggctgcctgtcgatggccaacgctggccccaacacgaacggctctcagttcttcctgtgcgtcgcgccgactgactggctcgacggcaagcacgttgtgttcggcactgctctgccccagagcttcgccgtgctgaaggccatcgaggccgtcggcagccgctcgggtgcgacgtcgcagcccgtcgtcatcgtcgactgcggccagctctcctaaacaaaaaatggaggaggacaaagtcacgggggcacttcccgtttcttcttttcgtcgtgcttttctcttgacccggctgttccccgtttgctcgtttcgatgatgcgtaccgcagctcgtgagcttgtcatcttgacaggcgcgcgcgaagtcgcgttgcgtcactcgaaacgaaggaggggggtagtgcgtggggctaatcaaaaccacatcagtgaaccattcaacacatcacaaaatctctccacccatccaaaaaaaaaaaaaaaaaaaa

SEQ ID NO: 8522 - protein, 176 aa, Panicum virgatum
  misc_feature: Ceres CLONE 2006368
  misc_feature (1)..(170): Pfam Name: Pro_isomerase Pfam Description: Cyclophilin type peptidyl- prolyl cis-trans isomerase/CLD
  misc_feature (1)..(176): SWISSPROT Homolog: EC 5.2.1.8 Peptidyl-prolyl cis-trans isomerase
MPNPVVYFDITIGGANAGRIEMELYADTVPKTAENFRALCTGEKGVGRSGKPLHYKGSAFHRVIQGFMCQGGDFTRGNGTGGESIYGEKFADESFAGKAGRHTGLGCLSMANAGPNTNGSQFFLCVAPTDWLDGKHVVFGTALPQSFAVLKAIEAVGSRSGATSQPVVIVDCGQLS

SEQ ID NO: 8523 - DNA, 674 bp, Panicum virgatum
  misc_feature: Ceres CLONE 2006796
  misc_feature: Encodes the peptide sequence at SEQ ID NO. 8524
agtctccaggtgacaactttaaacactacatctgacgtcacgaaaacccaatttttttcgcaatctaaacaaggcctcagtggttctctgtttgctaattcaactctaccatgagttactattcagctcaaatggaggtgtcagtactgtccccacgcgtggccttcctcgatcaccagcgctcgcttctcaccgtcggcaacagccatctcaagcaaagaattgcggcgctcgcccaagacaagatcttcaaagatgctcatcaagaggcgctgaagaaggagatcgagcggctacgccaactgttccaccagcagcagatcaaggccaccaccggtggcgccgacatcgccactgccgcctcgatgcaggccaggcaagagctgctcgcgtgcgagggtgctgccattcgatagcggaggtgatcgtcgatcggcgcaacgcatgccaacttgcattgtgctggttttttgggggacagttcatcgtgtgcaaagacacacctgttagtagtttaaaaatttgtgcagtctgatatgatggttttatttgttaccttttgatttgtatgtgatgtaatttgctcatcctagccaaaaatgggctgggatgggggaatctttgtgaatgtattgtttggacggcctcacatttgagttggtaaagaatttccg

SEQ ID NO: 8524 - protein, 101 aa, Panicum virgatum
  misc_feature: Ceres CLONE 2006796
  misc_feature (30)..(65): Pfam Name: bZIP_2 Pfam Description: Basic region leucine zipper
MSYYSAQMEVSVLSPRVAFLDHQRSLLTVGNSHLKQRIAALAQDKIFKDAHQEALKKEIERLRQLFHQQQIKATTGGADIATAASMQARQELLACEGAAIR

SEQ ID NO: 8525 - DNA, 1602 bp, Panicum virgatum
  misc_feature: Ceres CLONE 2006924
  misc_feature: Encodes the peptide sequence at SEQ ID NO. 8526
gtttttggtggatctgaatcaccacccttcctctgatctgctctccctccccttctccgaagcagaggaggggcgtctccgattccccatggccaccaccaaggttcttgacaggctcaccgtgccggcctcgcctccggcgcccggcggcgtgctcccgctcaccttcttcgacgtcccctggctcttcaccggccccgtggagcgcgtcttcttctacccctacccgcacacggcggagcaattcaccgcccgcctcctgccgcccctcgtgtcctccctctccgccgcgctgcactggttctacccgctgctcggccgcgtccgcccgggcccggacgggtacgagttcttctccgcgggtggggatgccggcgagggcgtcgagctcaccgtcgccgagagctccgacgacttcgacgagctgtccggcggcggcccgagggacgtcgcccggctgtacgcgctggtgccgcagcttccccggacggaagacgggaccttcgctctcgcggcggcgcaggtcacggtgttcgccggccgggggatcgccgtcggcgtgtccatccaccacgtggcctgcgatgactccagctacatgcacttcgtgaagacctgggccggccagtgccgggtggccgccggcgaggagtccacccaaggcgcgctgccaccgccgccgttcttggaccgtggcgtggtcgccgatcccgagggacttgccgccaggacgctcgacgaaatgcgtcagctggcagccaacgccccgcctcctccgccgccgccgccaccgccgccgaagctggtcatcgcgtcgttcgcgctcacccgcgaccgcatcgataagctgaagcagcgcatcgtcgccgagagcgtccactgctcggcgttcacggtggcgtgcgcgttcgcgtgggcctgcctggcgcgggtcgacggcggctgcgcggacgcggcgcggcgcgcgcacctgctgttctcggtggaatgccgccggcgcctggcgccgccgatcccgcaggagtacctcggcaactgcctccgcccgtgcttcgtggaggtgggcctgggcgagctgctgggcgccgacggcgttgtggccgccgccgcggcgatcggcgcgtccatcagggcgctggacgacggcgtgctggccggcgccggcgggtggttccacaagatcctgtccctggtcccgcagcggccgatgtcggtgggcggctcgccgcggtacggcgtgtacgagaccgacttcgggctcggccggccgaagaaggtggagctggtgtccatcgacaagacgcccggcacggtgtcgctggcggagggccgcgacgcgcaggccgggatcgagatcggcgtggtgctgccggaggccgagatggcgcgcttcagctcctgcttcgccgacggattggagcagctgtgactgtgagcgcgacacaccttggcttgcaatggctggtttggtgctgctcgtcaagttgtttatccgcatgcaaattgcaattgctggtgacataatttggctgttaaagaatagtaatatatatagataatccaaggaagtgtatatttgagcaaaaaaaaaaaaaaaaaaaa

SEQ ID NO: 8526 - protein, 446 aa, Panicum virgatum
  misc_feature: Ceres CLONE 2006924
  misc_feature (1)..(192): Pfam Name: Transferase Pfam Description: Transferase family
MATTKVLDRLTVPASPPAPGGVLPLTFFDVPWLFTGPVERVFFYPYPHTAEQFTARLLPPLVSSLSAALHWFYPLLGRVRPGPDGYEFFSAGGDAGEGVELTVAESSDDFDELSGGGPRDVARLYALVPQLPRTEDGTFALAAAQVTVFAGRGIAVGVSIHHVACDDSSYMHFVKTWAGQCRVAAGEESTQGALPPPPFLDRGVVADPEGLAARTLDEMRQLAANAPPPPPPPPPPPKLVIASFALTRDRIDKLKQRIVAESVHCSAFTVACAFAWACLARVDGGCADAARRAHLLFSVECRRRLAPPIPQEYLGNCLRPCFVEVGLGELLGADGVVAAAAAIGASIRALDDGVLAGAGGWFHKILSLVPQRPMSVGGSPRYGVYETDFGLGRPKKVELVSIDKTPGTVSLAEGRDAQAGIEIGVVLPEAEMARFSSCFADGLEQL

SEQ ID NO: 8527 - DNA, 1770 bp, Panicum virgatum
  misc_feature: Ceres CLONE 2006926
  misc_feature: Encodes the peptide sequence at SEQ ID NO. 8528
aacgccttcttcttctcctccttccccctcgacttcgagggtttttttttctttcttttttccctttttctttttattttttcttttattttttcctttgttcttccccgtcggggttttccgcccctgacgaaaccctaataaccggtggggggcgatcgccgtcgccggcggcatgaatcagcagcaacggatgaagcaggctgcggcggcggcggcggcggtggccgcgcagcagcagcagctgatgcagcaggccctgctcctgcagcagcagcagcagacgcagccgcctgtgttccccgggcaccacccgcaccccggcctcctcgccgcgccgcagatagagcccatagctagtggaaaccttcctcctggatttgattcaagtacatgccgcagcgtgtatgttggcaatatccatcttcaagtgacggatgcagtactgcatgaagtcttccaaagtattggtccagtagaaggttgcaagctcatcagaaaagaaaagtcgtcttttggtttcgttgactactatgaccgccgatctgctgccctagcaattgtatctctcaacggcagacaactgtatggtcagccaataaaagtcaattgggcatatacaagtactcagagagaagatacttcaggtcattttaatatttttgttggggatctttgcccagaaatcactgatgccacgttatttgcttttttctctggatactctacctgctcagatgctagggttatgtgggaccagaaaacaggacgatccagagggttcggttttgtttctttcaggaatcagcaggatgctcaaaatgcaataaatgacttgaatgggaagtggcttggcaaccgccaaattcgttgcaattgggcaacgaaaggtgctaatgctgatgaagagaaacaaagtgcggacaccaaggtagaccagacaaatggttcaacagaagctggaaaggagtatccgaatgaagacaatcctgaaaataaccctctctgtaccactgtttatgttggtggtcttcctcatgaggcgaccaacaatgatgtgcacctgtttttccattcacttggggctggttcaatcgaagaagtccgtgtaacacgtgacaagggctttggctttgtgagatacagcactcatgaggaagctgcactggcaattcagatgggcaatggccaactgtttggtgggaggccaatacggtgctcttgggggaaaaagccaaccccaccagggacaacatcttcgccgcttcctcctccggcgccggctccattcccagctggtgtgtctgcaactgacttcctggcctaccagcgcctggccctgaacaagattgccgcgaacccagccctaatgggccagcacggcctgaagcaggctgtccttgggatggatgctggagccagccaggccatctacgatggtggctaccagggtgtcaacgcggctgcggcagccgctgcatcccagcagcagaaccagcagctcatgtactactagagtgacgacctgtctcttgaagaggaaggcgaggataatgcctccagtacaaccctatacatatacttactagtatcaaagtagatgaagccttaccagggccttttttttttctttttaatttcccttaatcttctcgttataccatctaagtaactcccctgtatgccagctatatacacatcaccgaatatatgtactcttaagtctgggtgtcactctggcattttagtacaaaaggttgattcctctgc

SEQ ID NO: 8528 - protein, 446 aa, Panicum virgatum
  misc_feature: Ceres CLONE 2006926
  misc_feature: Great-hit functional homolog of the protein sequence given in SEQ ID NO 9221
  misc_feature: Useful for making plants with altered Lignin content
MNQQQRMKQAAAAAAAVAAQQQQLMQQALLLQQQQQTQPPVFPGHHPHPGLLAAPQIEPIASGNLPPGFDSSTCRSVYVGNIHLQVTDAVLHEVFQSIGPVEGCKLIRKEKSSFGFVDYYDRRSAALAIVSLNGRQLYGQPIKVNWAYTSTQREDTSGHFNIFVGDLCPEITDATLFAFFSGYSTCSDARVMWDQKTGRSRGFGFVSFRNQQDAQNAINDLNGKWLGNRQIRCNWATKGANADEEKQSADTKVDQTNGSTEAGKEYPNEDNPENNPLCTTVYVGGLPHEATNNDVHLFFHSLGAGSIEEVRVTRDKGFGFVRYSTHEEAALAIQMGNGQLFGGRPIRCSWGKKPTPPGTTSSPLPPPAPAPFPAGVSATDFLAYQRLALNKIAANPALMGQHGLKQAVLGMDAGASQAIYDGGYQGVNAAAAAAASQQQNQQLMYY

SEQ ID NO: 8529 - DNA, 1674 bp, Panicum virgatum
  misc_feature: Ceres CLONE 2006990
  misc_feature: Encodes the peptide sequence at SEQ ID NO. 8530
ccttcagatccaggcatccttccgccgcgcctccgcctccgcctccgcctccgcctctcccttccctcgccggcgtcctcgcccgtccccgccgggccgacgcgcggtagaggccgtccgcgcttggattgacttcgtagttcttcctctgctgcaagcccccgttatcagccatgtttggacgcatgccaaagaagagcagcaacagcaccaagtactatgaggttcttggtgtttctaagactgcaacccaggatgagctgaagaaagcatacaggaaagctgccataaaaaaccatcctgacaagggcggtgaccctgagaagtttaaggaattgtctcaagcatacgatgttcttagtgacccggaaaagagggagatctatgaccagtatggagaagatgcacttaaagagggaatgggaggaggcagcagcagtgatttccatagcccgttcgacatatttgagcaactttttccgggttctgggacctttgggggaggtggctctagagtgcgcagacaaaagcggggtgaagatgtggtgcatactatgaaggtttctttagaggatctgtataatggaacaaccaagaaactatctttgtcacggagtgttttgtgctcaaagtgcaaggggaaaggatccaagagtggggcatcaggaacttgccatggttgtcgtggggctggaatgaggacaatcacaagacagataggccttggcatgatccaacagatgaacactatttgctctgaatgcaaaggaacaggtgagatcataagtgagaaggataaatgctcaggctgtaaaggaagcaaggtagtccaggagaagaaggtcttggaggtccatgtggagaaaggaatgcagcatggccaaaagattgtattccagggtcaagctgacgaagctcctgacacggtgacaggagacattgtttttgtgttgcaacttaaagaccatccaaagtttaagaggaagtatgatgacttgtatgttgagcacacaatctccctcaccgagagtctgtgtggcttccagtttgtgctgactcatcttgatggtcggcagcttctgataaaatctaatcctggagaggttataaagcctggtcagcacaaggccataaatgatgagggtatgccccagcatggtcgccctttcatgaagggccgtctttttgttgaattcaacgttgagtttcccgagcctggtgcactctcccctgcccaatgccaatcacttgagaagatccttccaccaaagccagggagccagctgtcggacatggagctggatcagtgcgaggagaccaccctgcatgatgtcaacatagaagaggagatgaggcgcaggcagcatcagaggcggcaggaagcatacgatgaagacgaggaggaatctggaccaagggtgcaatgtgcccagcagtgatctcggttcattggaatctccaaaagttacccgtcagatttattggtattgattctattttggcaaagatttaaaccagtttgaacttgaagcgtgtaggtatagctagtagagccggaaaaggagagctcataatgttgtcagtctctgtttgaacatccctggctacccaccgggattcagaacctggtctttttttttgttgaaagatttcagaacctggtcgttgggctac

SEQ ID NO: 8530 - protein, 421 aa, Panicum virgatum
  misc_feature: Ceres CLONE 2006990
  misc_feature (1)..(59): Pfam Name: DnaJ Pfam Description: DnaJ domain
  misc_feature (1)..(87): Pfam Name: DnaJ_CXXCXGXG Pfam Description: DnaJ central domain (4 repeats)
  misc_feature (1)..(127): Pfam Name: DnaJ_C Pfam Description: DnaJ C terminal region
MFGRMPKKSSNSTKYYEVLGVSKTATQDELKKAYRKAAIKNHPDKGGDPEKFKELSQAYDVLSDPEKREIYDQYGEDALKEGMGGGSSSDFHSPFDIFEQLFPGSGTFGGGGSRVRRQKRGEDVVHTMKVSLEDLYNGTTKKLSLSRSVLCSKCKGKGSKSGASGTCHGCRGAGMRTITRQIGLGMIQQMNTICSECKGTGEIISEKDKCSGCKGSKVVQEKKVLEVHVEKGMQHGQKIVFQGQADEAPDTVTGDIVFVLQLKDHPKFKRKYDDLYVEHTISLTESLCGFQFVLTHLDGRQLLIKSNPGEVIKPGQHKAINDEGMPQHGRPFMKGRLFVEFNVEFPEPGALSPAQCQSLEKILPPKPGSQLSDMELDQCEETTLHDVNIEEEMRRRQHQRRQEAYDEDEEESGPRVQCAQQ

SEQ ID NO: 8531 - DNA, 1793 bp, Panicum virgatum
  misc_feature: Ceres CLONE 2007067
  misc_feature: Encodes the peptide sequence at SEQ ID NO. 8532
gtgagctagcggagcgattgttccgccccctccctaggtctcaactcgaacccgacatatccctggctgctgttgtgtgttgattcaggatgaggacctccaccgcttctcttctcgctttcgccgtccccgccttggcaaccgccggcggcggacctggccacggacatgacggcccgaagggacccggctgcggaggtggcccgggtggccccaagcctgccctcgtcaactcggagaagctgcaggccttgatcaacatcgaggacttggtcgccggttcccaggatcttcaagacatcgccaacgctcacggcggcaaccgcgcttttggcggtggcggccacaacgccactgttgactacctctacgaggcgctaacggctctcgactactacgacgtggtcaagcagcctttcaccgaaatctactcggagggcaagggctcgctcactgtcgacggcgaggacatccaggccgataccctgacttacacccccggcggtgaagctaccaagccgctcgtggccgtcgccaacctaggttgcgatgccgctgattaccccgccgaggtctcgggcaatatcgccttcatctcgcgtggcacctgcccctttagccaaaagtccatcaacgccaaggcggccggcgctgtggcggctatcatctacaacaacgaggccggcgaattggcgggcactctgggtgagccgttcaaggagtatgcccccgttgtgggcatcagccaagaggattccaaggtgattctggagaagctggcccagggcgaggtgaccgccacggtcaagattgatgcgttggttgaggagcgcgtgagctacaacgtcattgctgagacgaagggcggtgaccacaacaatgtgctcgttctcggtgggcacactgactctgtgcctgccggcccgggtatcaacgacgatggttccggtacgattggtatcctcaccgtcgccaaggcacttgccaagttccgtgtcaagaacgccgtgcgcttcgccttctggagcgccgaggagttcggcctgctcggctcgtacttttacatgaactcgatcaatggctccgacaccgaggtggccaagatccgcgcctacctcaactttgacatgatcgccagccctaactacatttacggcatctacgacggcgacggcaacgccttcaacctcacgggccccgccggctccgatgtcatcgagaaggattttgagaacttcttcaagagcaagaacagcccgtcggtgcccaccgagttctcgggccgttccgactacgccgccttcattgagaacggtatcccctcaggcggcctattcacgggcgccgaggtgctcaagaccgaggaggaggccaagctgttcggcggcgaggccggcgtcgcatacgacatcaactaccacaagattggcgacgacatcaacaacctggcgctggatgcgtacctcctcaacacccaggccattgccgactcggtggccaagtatgccctcagcttcaagaccctgcccccggtggagacgaagacgaggaggtgggatgccgaccgcgcccgcatgctcaagcgcagcggagggtctcacggccatgctgggcatacccattcgggaccttgcggtggcggcgccgagatctagagtgttcatagttgtgtaatttactgagggtgcgggatatgatttatgataatcaatgtatattggatgacgagtagcaaagaatactccctcggactgatggcccgtgacctggaacaaaaaaaaaaaaaaaaaaaa

SEQ ID NO: 8532 - protein, 521 aa, Panicum virgatum
  misc_feature: Ceres CLONE 2007067
  misc_feature (1)..(196): Pfam Name: Peptidase_M28 Pfam Description: Peptidase family M28
MRTSTASLLAFAVPALATAGGGPGHGHDGPKGPGCGGGPGGPKPALVNSEKLQALINIEDLVAGSQDLQDIANAHGGNRAFGGGGHNATVDYLYEALTALDYYDVVKQPFTEIYSEGKGSLTVDGEDIQADTLTYTPGGEATKPLVAVANLGCDAADYPAEVSGNIAFISRGTCPFSQKSINAKAAGAVAAIIYNNEAGELAGTLGEPFKEYAPVVGISQEDSKVILEKLAQGEVTATVKIDALVEERVSYNVIAETKGGDHNNVLVLGGHTDSVPAGPGINDDGSGTIGILTVAKALAKFRVKNAVRFAFWSAEEFGLLGSYFYMNSINGSDTEVAKIRAYLNFDMIASPNYIYGIYDGDGNAFNLTGPAGSDVIEKDFENFFKSKNSPSVPTEFSGRSDYAAFIENGIPSGGLFTGAEVLKTEEEAKLFGGEAGVAYDINYHKIGDDINNLALDAYLLNTQAIADSVAKYALSFKTLPPVETKTRRWDADRARMLKRSGGSHGHAGHTHSGPCGGGAEI

SEQ ID NO: 8533 - DNA, 2098 bp, Panicum virgatum
  misc_feature: Ceres CLONE 2007104
  misc_feature: Encodes the peptide sequence at SEQ ID NO. 8534
gattaagctccacaaatcagggcgcgcgaggcctgattaggaagcaaagatccaagacaattcagtgctccatgcacatatcttcttgcaagcttgcatgcatgaagcccatgagttgccacgagcaggagcacccggagctcgccgccgccatgagcaacaacggcttcgactggctcgaggactccatctccttcctcgccggagatgtagacatcgccggcggctatgggtggtggtcgaatcccgcggaggcgcagcaggatgacattggcagcgtcgtggcgcagacgctctcgccgccggcgccacagccgacgaccagctcgcccctggcgcacgcgtccccaaacatcgcgtatccgccggtgtcgtcgccttcggagacttcatccaagaagcgcaagtctccggcgcacaaagcttccaacaatagcgtcagcaatcaacgccgccgcgccgagcaggacaggccaggtgccggcggcggcaagaagggcggttccaagggcggcggagcgggatccgaccgggacacgaggtgggcggagcagctgctgaacccgtgcgcggccgccgtcgaggccggcaacctgtcgcgcgcgcagcacctgttctacgtgctcggcgagctcgcctccttctccggcgacgccaaccaccgcctggtcgcgcacgggctgcacgcgctgtcccgcaggctccccgccgccgtgggcacggcggccgcggcgtccgtgcgggtgccgccctgcgagtgccccacgccggcgttcgcgggcgccgagccgcggctgttccgcgcgtcgctcatcaggttccacgaggtgagcccgtggttcgcgctccccaacgcgctggccaacgccgccatcgcgcaggccgcggcgcgcggcgcggcggagccccggccgctccacgtcgtcgacctcggggtctcccacggcgtgcagtggccgacgcttctcgagtccctgacccgcctgcccggcgggcgcgcgccgccctctgtccgcctcaccgtcgcgggccccacggcgacccctcctgcgcccttctcggcctcgcctccgggctacgacttctcgccgcacctcctccggtacgccaagtccatcaacctgcatctcgccatcagccgtgcaggctccctagactccgtgcacggcttcacggcggccggcgaggcgctcgtcgtctgcctccagttccggctcggccacgccgccgccgacgagcgggcagacatcctgagcaaggtccggggcctcaacccggagctggtggtgctctcggagctcgacgccgggggcgacggcaccgcggcgggcgagttcacggcgaggctggagctgctgtggcggttcctggagtcgacgtccgcggcgttcaaggggagggacggggaggagaggcgcctgctggaggccgaggcgggcacgtccgtcacggccgacgcggcgggagagggcagggacgcgtggcgggagcgcatggcggccgccgggttcgaggaggcggcgttcgggggcgaggcggtggagtcggccaggtccttgctgaggaagtacgacggcgggtgggagatgtcggcatcgggcgccgccggcgcggtggcgctgcggtggaaagggcaaccggtttcgttctgctcgctgtggcggccggcgtgcagcggctgactgaccctctggagccggtcggtctgcgcttccatggcgatggcatcggcacgacggatgatctcggccgcgcactgcggctgggtgggtggtgcaagggaacgttgctgatgtcgcctgcatggcggagccaggctcaggcatcaccggccgccggcggtgtacgggaagcgacggcgaaatcagtgtagcattttcgcctttgttttgaagaagaaagctactgcagttgtcagtggccatttttgtacagattgattcctttgttgatttctctgccctatgcactgcacgcgtaattattcttgaagtatcaccagtttagcaagtagcaagatgcatgtatgctcagaacgtgttaagcatgcatgcaggagtaccaatcaagagcatgtgcaagtaccaagatcgctgtt

SEQ ID NO: 8534 - protein, 536 aa, Panicum virgatum
  misc_feature: Ceres CLONE 2007104
  misc_feature (3)..(324): Pfam Name: GRAS Pfam Description: GRAS family transcription factor
MHISSCKLACMKPMSCHEQEHPELAAAMSNNGFDWLEDSISFLAGDVDIAGGYGWWSNPAEAQQDDIGSVVAQTLSPPAPQPTTSSPLAHASPNIAYPPVSSPSETSSKKRKSPAHKASNNSVSNQRRRAEQDRPGAGGGKKGGSKGGGAGSDRDTRWAEQLLNPCAAAVEAGNLSRAQHLFYVLGELASFSGDANHRLVAHGLHALSRRLPAAVGTAAAASVRVPPCECPTPAFAGAEPRLFRASLIRFHEVSPWFALPNALANAAIAQAAARGAAEPRPLHVVDLGVSHGVQWPTLLESLTRLPGGRAPPSVRLTVAGPTATPPAPFSASPPGYDFSPHLLRYAKSINLHLAISRAGSLDSVHGFTAAGEALVVCLQFRLGHAAADERADILSKVRGLNPELVVLSELDAGGDGTAAGEFTARLELLWRFLESTSAAFKGRDGEERRLLEAEAGTSVTADAAGEGRDAWRERMAAAGFEEAAFGGEAVESARSLLRKYDGGWEMSASGAAGAVALRWKGQPVSFCSLWRPACSG

SEQ ID NO: 8535 - DNA, 1887 bp, Panicum virgatum
  misc_feature: Ceres CLONE 2007233
  misc_feature: Encodes the peptide sequence at SEQ ID NO. 8536
ctgactggcttcgctgggtcgttggaatacgaggccaagattcccgcggggatcccgtgtgcgttcggcacctaccccattcccaacgccctgtcttcctccataggcccctcattcccttcgcctccaactgtctcctcaacctattgccccgccaaggcgccaaccacgcagcagcagctagttgctgggtggttctggtgtccatggcggggaagcagcagaatgttgcaatattcaccaccgcgagcctgccatggatgactggtacggccgtcaatcccctgtttcgggccgcatacctcgccaaggctggaaactgggaggttacgctggtggtgccgtggctgtccaatggggatcagattcttgtttatcctaacaagatgaagttcagttcgccggcagagcaggaagcctacgtgcggcggtggcttgaggagcggattggggtgttaccaaggttcaatataaagttctatcctgggaagttttcaactgagaaaaggagcattctacctgttggggacatcagtcagaccatatctgatgacaaagcagatattgcagtgctagaagagccagaacatcttacatggtaccatcatggacggaggtggaaaaccaagttccgaaaagtcataggtgttgttcatacgaactatttggaatatgtgaaaagagagaaaaatggatatatcagtgcatttatcttaaaacacatcaattcttgggttacagacatctattgccataaggttataagattgtctgcagcaactcaggatgtccctaggtctgcgatttgtaatgttcatggagttaaccccaaatttattgaaattggcaaattgaaacatcagcagctatgccaaaaggagcaggcattcttcaagggtgcatactatattggaaagatggtatggagtaaaggttacacagagcttcttcatctgcttcataagcaccaaatggagttatctggccttaaaatggagttgtatggcagcggggaagattctgatgaagtaaaagcatcagctgagcgattgagcttagatattagagtctatccaggccgcgaccatggagattcaatatttcatgactataaggttttcgtaaacccaagcacaacagatgtggtatgcacaacgactgcagaagctttggcgatgggaaagattgtgatctgtgcaaaccatccttcaaatgaatttttcaaaaggtttcctaattgtcacatgtataataccgagaaagagtttgtcaggctaacaatgaaagcattgggagaagatccagtcccactgtcagatgaattgaggcatgagctttcctgggaggctgcgacagaaagatttgttagagttgctgatattgcaccaactgtgtctgtcgggcaaaaagcaccctcttcaaagcattttatgcgcatctccacgctggaactgcagaagaacatggaagaggcttcagcatttttccataacaccatctctgggattgaaactgcccgatgtgtgttcggtgcaataccaaataccctgcagccggatgaacagcaatgcaaggaacttgggtggaatttgcactgatagcattaccttctcttgcgatgctgaactaaccagtccagttggtggctcaggaactaactcagcaacagaaaaacctgtcattcaaaagggatctcagattgttcagacaggttcttacagagtttttttttctggtgtggcggcactcaatttttcttggcaaatcagaggcgttctgaagttcctgttgtaatgcagaactgcatatctagcaattgtaaatctaaagcaggtgaagtgcaaatccgtgttatatgttggcttccaaaaaaaaaaaaaaaaaaaa

SEQ ID NO: 8536 - protein, 463 aa, Panicum virgatum
  misc_feature: Ceres CLONE 2007233
  misc_feature (1)..(103): Pfam Name: Glycos_transf_1 Pfam Description: Glycosyl transferases group 1
  misc_feature (3)..(459): SWISSPROT Homolog: EC 2.4.1.241 Digalactosyldiacylglycerol synthase 2, chloroplast
  misc_feature (4)..(459): SWISSPROT Homolog: EC 2.4.1.241 Digalactosyldiacylglycerol synthase 2, chloroplast
MAGKQQNVAIFTTASLPWMTGTAVNPLFRAAYLAKAGNWEVTLVVPWLSNGDQILVYPNKMKFSSPAEQEAYVRRWLEERIGVLPRFNIKFYPGKFSTEKRSILPVGDISQTISDDKADIAVLEEPEHLTWYHHGRRWKTKFRKVIGVVHTNYLEYVKREKNGYISAFILKHINSWVTDIYCHKVIRLSAATQDVPRSAICNVHGVNPKFIEIGKLKHQQLCQKEQAFFKGAYYIGKMVWSKGYTELLHLLHKHQMELSGLKMELYGSGEDSDEVKASAERLSLDIRVYPGRDHGDSIFHDYKVFVNPSTTDVVCTTTAEALAMGKIVICANHPSNEFFKRFPNCHMYNTEKEFVRLTMKALGEDPVPLSDELRHELSWEAATERFVRVADIAPTVSVGQKAPSSKHFMRISTLELQKNMEEASAFFHNTISGIETARCVFGAIPNTLQPDEQQCKELGWNLH

SEQ ID NO: 8537 - DNA, 1624 bp, Panicum virgatum
  misc_feature: Ceres CLONE 2007289
  misc_feature: Encodes the peptide sequence at SEQ ID NO. 8538
cagccagccaccccgcttctctttgctctagccaccgctgccaccccagagtagccgggccagctgcgcgccaacacaaacaagcaagcgccatggtgtacgagcaggaggaggaggtgttgccgggcgcggtgcacgggcaccggctgtccaccgtcgtgccgagctcggtgacgggcgaggtggactacgcgctgtccgacgccgacctcgccttcaagctgcactacctgcgcggggtctactactacccggccggggacatcacgcggggcatcacgaccaaggtgctcaaggatcccatgttcccctggctcgacgactacttccccgtcgccggccgcgtccgccgcggcgacgccgacgacgccccgcgcccctacatcaagtgcaacgactgcggcgtccgcatcgtcgaggccaagtgcgaccgcgacatggccgagtggctccgcgacgacgcgcccgggcgcatctcacagctctgctacgataaggtgctcgggccggagctcttcttctcgccgctgctctacgtccagatcacaaacttcaaatgcggcgggctggccctcgggttcagctgggcgcacctcatcggcgacgtggcatcagccgccacctgcttcaacaggtgggctcagatcctgagcggcaagaagccggaacccaccgtcctcaccccggagaacaaaccgctgcaaggccactccccggccgccgccaccgcgccgccgcgctccgtcaagcaggtcgggcccatcgaggaccactggatcgtccccgcgggccgcgacatggcctgctactccttccacgtcgcggagcccaccctcaagaagctccagcagcaggcgatgccggcggccggcaccttcgagctggtcgccgcgctgacgtggcagacggtggcgaggatcaggggcggcgtggatgccgtgaccgtggtgaagaacgacgtgacagccaggagcggcagggctctggggaacgagatgaaggtcgggtacgtggaggcgtcggggtcgtcgccggcgaagaccgacgtggccgagctggcggcgctgctggcgaatggcgtcgtcgacgagaccgccgccgtggcggcgttccccggcgacgtcctcgtgtacggcggggcccacctgacgctcgtggacatggagcaggtggacgtgtacgggctggagatcaaaggccagcggccggtccacgtggagtacggcatggacggcgtgggggaggaaggcgccgtgctggtgcagcccgacgccgacggccgcggccggctcgtcaccgccgtgctgcccagggatgagatcgatagcctccgcgccgcgctcgggaccgcgctgcaggtcgcctgagctcgccgcgttgtttcgaatgaaaactctagctacgttactcatacggtttggtgagcgtagtagtgtgattaggcgcatgtttttcttattggtgatgtgatgtaagatgagcgccaatactgtgaacgtttgagaagtttctgtatcggatgatgtttcgtaataagtttgctcgaatagcctatgcagaatgtaccaagagtttacacaggacactttgaaaaataatagtttaaaaaaaaaaaaaaaaaaaa

SEQ ID NO: 8538 - protein, 424 aa, Panicum virgatum
  misc_feature: Ceres CLONE 2007289
  misc_feature (1)..(119): Pfam Name: Transferase Pfam Description: Transferase family
MVYEQEEEVLPGAVHGHRLSTVVPSSVTGEVDYALSDADLAFKLHYLRGVYYYPAGDITRGITTKVLKDPMFPWLDDYFPVAGRVRRGDADDAPRPYIKCNDCGVRIVEAKCDRDMAEWLRDDAPGRISQLCYDKVLGPELFFSPLLYVQITNFKCGGLALGFSWAHLIGDVASAATCFNRWAQILSGKKPEPTVLTPENKPLQGHSPAAATAPPRSVKQVGPIEDHWIVPAGRDMACYSFHVAEPTLKKLQQQAMPAAGTFELVAALTWQTVARIRGGVDAVTVVKNDVTARSGRALGNEMKVGYVEASGSSPAKTDVAELAALLANGVVDETAAVAAFPGDVLVYGGAHLTLVDMEQVDVYGLEIKGQRPVHVEYGMDGVGEEGAVLVQPDADGRGRLVTAVLPRDEIDSLRAALGTALQVA

SEQ ID NO: 8539 - DNA, 1608 bp, Panicum virgatum
  misc_feature: Ceres CLONE 2007362
  misc_feature: Encodes the peptide sequence at SEQ ID NO. 8540
atcctacatcaccacttcttccattcttgccgatcttattgatcgctctcgttccgtaccgcgagcgggaattccaattgagtttaatacaccgccaggaggtttctgttccagactccggcacttccttcctccttatctccccccaacaacaaaacctcgaccatgtcgcgctacctccggccagcggccaggctcgctgccacggctcgtgcctccgccattcgccctaccgcgacctctcccttctttcccagagccgccgctgtacccagcttacaaaaacggacatatgccgatgcctccggtgtgaaggagtatacagtccgtgaggctctgaacgaggcgctcgcggaggagctcgaggccaactcgaaggtgttcgtgatgggtgaggaagttgcccagtacaacggcgcatacaaggttaccaagggcctactagaccgtttcggcgagaagcgggttattgacactcccatcacggagagtggctttaccggtctggccgtcggcgccgccctgagcgggctgcaccctgtgtgcgaattcatgaccttcaactttgccatgcaggccatcgaccaggtcgtcaactcagccgccaagaccctctacatgtccggcggtatccagccctgcaacatcaccttccgtggccctaacggcttcgcctccggcgtcggtgcccagcactcgcaagattactcggcctggtacggcagcatcccgggtctcaaggtcgtctccccgtggtcggccgaggacgccaagggcctgctcaaggccgccatccgcgaccccaacccggtggttgttctcgagaacgagctgctgtacggccaggcattccccatgtccgaggccgcgcagaaggacgacttcgtgctgccgttcggcaaggccaagattgagcgcgccggcaaggacctgaccatggtgaccctctcgcggtgcgtcggccagtcgctggtcgccgccgagaacctcaagaagaagtacggcgtcgaggtcgaggtcatcaacctgcgcagcatcaagccgctcgacatcgagtccatcgtcaagtcggtcaagaagacccaccgcctgatggcggtcgagtccggcttcccggccttcggcgtcggcgccgagatcctcgccctcaccatggagtacgcctttgactacctcgacggccccgcccagcgtgtcactggcgccgacgtccccaccccgtacgcccagaagctggaggagatgagcttccccaccgaggcgctcatcgagcagtacgccgccaagatgctccgtctctaaaagggagggggcggttgagtttgtgtattggattaggagtggctttcgtgggagtgtgtagggaggggagcgggagttatttcagcctagggtggaaatggaacagacaaaaaagctgaagtgacaaggggatccttgagccttgccctaccgcattttttctcttttgtgcctgcaacagacgtcatgggccgggtttagctgaagcaggttggtaatgggcgaatagacaggttgggaattccgtgtacttgtacgtttctgtcttcagtcttgccttgctttgaaaaaaaaaaaaaaaaaaaa

SEQ ID NO: 8540 - protein, 378 aa, Panicum virgatum
  misc_feature: Ceres CLONE 2007362
  misc_feature (1)..(178): Pfam Name: Transket_pyr Pfam Description: Transketolase, pyrimidine binding domain
  misc_feature (9)..(378): SWISSPROT Homolog: EC 1.2.4.1 Pyruvate dehydrogenase E1 component subunit beta, mitochondrial precursor
MSRYLRPAARLAATARASAIRPTATSPFFPRAAAVPSLQKRTYADASGVKEYTVREALNEALAEELEANSKVFVMGEEVAQYNGAYKVTKGLLDRFGEKRVIDTPITESGFTGLAVGAALSGLHPVCEFMTFNFAMQAIDQVVNSAAKTLYMSGGIQPCNITFRGPNGFASGVGAQHSQDYSAWYGSIPGLKVVSPWSAEDAKGLLKAAIRDPNPVVVLENELLYGQAFPMSEAAQKDDFVLPFGKAKIERAGKDLTMVTLSRCVGQSLVAAENLKKKYGVEVEVINLRSIKPLDIESIVKSVKKTHRLMAVESGFPAFGVGAEILALTMEYAFDYLDGPAQRVTGADVPTPYAQKLEEMSFPTEALIEQYAAKMLRL

SEQ ID NO: 8541 - DNA, 1821 bp, Panicum virgatum
  misc_feature: Ceres CLONE 2007412
  misc_feature: Encodes the peptide sequence at SEQ ID NO. 8542
actctcctttcccgatcgccagtacaccatccagagcagtgcagcacgggggcgggccgcgggcggttgctcacttgctcctgctccccctcccgctcgaaccatcagctcgcagtgcagccatggcaaccggccgcgccgcgctgctcctcctcctcctcctcaccaccccgctgctgctcctcctcctcgccccgccggcagagggcctcgtccgcatcccgctgaagaagcggccggccgacaccaacggccgcctccacgccgagcggcgcggcggctaccccggcagcagcagcggcgatgacgccgccgccgcgttgaacaaggccgaggccgaggaggagggcgacatcgtggcgctgaagaactacctcaacgcgcagtactacggtgagatcggcatcggcgcgccgccgcagacgttcaccgtcatcttcgacaccggcagctccaacctctgggtgccctcctccaagtgctacgcatcgatcgcttgctatttccacgagaggtacaaggccggccgatcaaactcttataagaagaatggaaaacctgcttctatacgctatggtactggtgcaatttatggctattttagtctggatagtgtgaaaatcggtgatgtagttgtgaaaaatcaggatttcattgaagctacaagggagacaagtgttactttcatggttggaaaattcgacggtattcttgggcttggattcaaggaaatctctgttggagctgctgtacctgtctggtacaacatggttttctcattctggttcaaccgacatgctgatgaagggcagggaggtgaaattgtgtttggaggaattgatcctaatcactacaagggaaatcacacgtatgtccctgtcactaggaagggatactggcagtttggtatgggtgatgtcctgattggaggaaagtccacaggattctgtgcttctggctgtgcagcaatagcagattctggaacttcattgcttactggtcccacagccataattactcagataaatgaaaagattggtgctgctggggtagtcagccaagaatgcaaggcaattgtttctcagtatgggcaacggatcatagatcagcttgtagcaaagacacagccggcaaagatatgctcttcagttggtctatgtacttttgatggagctcatggtgttagtactggtatttggagtgtggtagatgatggagctagggaatcaaatggtctcttcaatgaagctatgtgcaatgcctgtgaaacggctgttgtatggatacaaaaccagcttgcacagaaccaaactcaggatgtggtgttgcagtacattaatcaactgtgtgaaaagcttcctagtcctatgggacaatcatcagtggactgcagcagaattgcatccatgcctgacattgcctttaccatcgggggtagaaagttcgcactcaaaccagaacaatatatcctgaaggttggtgaaggacatgctgctcagtgcatcagtggtttcacagctatggacattcctcctccccgtggccctctctggatcttgggtgatatattcatgggagcctaccacaccgtctttgactacggcaacctgaaggttggctttgcagaggcggcatgatgtggccctctgaggcgtcccgaggaaccctaccctacagaatttgcatttcagctcgggggtgatgtcctgcaagcgtgtatgtataggctttacatcctcaataatgcttgtgagatctgagatatagacctgtctgtttcaactggctaatatatttatcgaggcgggtttcaagctgatt

SEQ ID NO: 8542 - protein, 504 aa, Panicum virgatum
  misc_feature: Ceres CLONE 2007412
  misc_feature (1)..(423): Pfam Name: Asp Pfam Description: Eukaryotic aspartyl protease
  misc_feature (1)..(425): Pfam Name: Asp Pfam Description: Eukaryotic aspartyl protease
  misc_feature (1)..(424): Pfam Name: Asp Pfam Description: Eukaryotic aspartyl protease
  misc_feature (1)..(420): Pfam Name: Asp Pfam Description: Eukaryotic aspartyl protease
  misc_feature (2)..(422): Pfam Name: Asp Pfam Description: Eukaryotic aspartyl protease
  misc_feature (4)..(504): SWISSPROT Homolog: EC 3.4.23.40 Phytepsin precursor
MATGRAALLLLLLLTTPLLLLLLAPPAEGLVRIPLKKRPADTNGRLHAERRGGYPGSSSGDDAAAALNKAEAEEEGDIVALKNYLNAQYYGEIGIGAPPQTFTVIFDTGSSNLWVPSSKCYASIACYFHERYKAGRSNSYKKNGKPASIRYGTGAIYGYFSLDSVKIGDVVVKNQDFIEATRETSVTFMVGKFDGILGLGFKEISVGAAVPVWYNMVFSFWFNRHADEGQGGEIVFGGIDPNHYKGNHTYVPVTRKGYWQFGMGDVLIGGKSTGFCASGCAAIADSGTSLLTGPTAIITQINEKIGAAGVVSQECKAIVSQYGQRIIDQLVAKTQPAKICSSVGLCTFDGAHGVSTGIWSVVDDGARESNGLFNEAMCNACETAVVWIQNQLAQNQTQDVVLQYINQLCEKLPSPMGQSSVDCSRIASMPDIAFTIGGRKFALKPEQYILKVGEGHAAQCISGFTAMDIPPPRGPLWILGDIFMGAYHTVFDYGNLKVGFAEAA

SEQ ID NO: 8543 - DNA, 1539 bp, Panicum virgatum
  misc_feature: Ceres CLONE 2007508
  misc_feature: Encodes the peptide sequence at SEQ ID NO. 8544
atcatcaaggtcaacacttcatctcaagccccattcttcggttcagatctcgtcaagatgcatttctccgtcgccctcctggctcttctgcccgctgctcttgcggcccccaccgctgagcccatccagaagcgcgcccctatcatcgccgccagggtgggccaggtcgtcccggacaagtacctcatcaagctgagggagggtaccagcgacgacgccctcgaggctgccattagcaagctcggcaaggccaaggcggaccacgtctaccgcggcaagaagttcaggggcttcgctggcaagctcgaggctgccctcttggacgagatccgtcttctccccgaggtcgaatacgttgaggaagatgctatcttcagcatcaacgcctacgtctcgcagagcggtgccccttggggtatcagccgcctctcgcacaagaccgcgggctccaccacctacgtctacgacagcagcgctggtgagggcacctgctcttacgtgatcgacaccggtatctacaccgcccactcggactttggcggccgtgctacctttgccgccaactttgtcgacagctccaacactgacggcaatggccacggcacccacgttgccggcaccatcggctccaccacctacggtgtcgcgaagaagaccaagctctacgccgtcaaggtcctcggcgctgacggctccggcagcacctctggtgtcgttgctggcatcaactacgttgccaccgacgcccccaagcgcagctgccccaagggtgttgttgccaacatgtcccttggtggtggctactcggcctccatcaaccaggccgccgccgctctcgtccaggccggtgtcttcctcgccgtcgccgccggcaacgacaacgccaacgccgccaactactcgcctgcctccgaggcttccgtctgcaccgttggcgccaccgacagcagcgaccgcaaggccagctactccaactacggcagcgtcgtcgacatccaggcccctggcaccaacatcctgagcacctggatcggtggccgcaccaacaccatctccggcacctcgatggcttccccccacattgccggcctcggcgcctacctcctggccctcgagggctccaagacccccgccgctctctgcaactacatcaagacctccgctatctcgggtgccatcagcggcctccccagcggcaccaccgaccgccttgccttcaacggcaacccctcggcttagatctgaggttgcaatgagacaccacctacctactaggtatctaataccaaaatggggattggagggggcggccagggacgggctgccagatgatgtgatgaccttgcagagatggacctttgggaagggtgccatatgacggaaccatggggacgaagggaaaatggcgcgtccggggaggaatgggcttcttgttcaaagttatgactgcatttacaggatgattgggttggccagccatcgtcttgtttagtagatgagggaatgacatttcatctgcaaaaaaaaaaaaaaaaaaaa

SEQ ID NO: 8544 - protein, 393 aa, Panicum virgatum
  misc_feature: Ceres CLONE 2007508
  misc_feature (1)..(260): Pfam Name: Peptidase_S8 Pfam Description: Subtilase family
  misc_feature (1)..(388): SWISSPROT Homolog: EC 3.4.21.64 Proteinase K precursor
MHFSVALLALLPAALAAPTAEPIQKRAPIIAARVGQVVPDKYLIKLREGTSDDALEAAISKLGKAKADHVYRGKKFRGFAGKLEAALLDEIRLLPEVEYVEEDAIFSINAYVSQSGAPWGISRLSHKTAGSTTYVYDSSAGEGTCSYVIDTGIYTAHSDFGGRATFAANFVDSSNTDGNGHGTHVAGTIGSTTYGVAKKTKLYAVKVLGADGSGSTSGVVAGINYVATDAPKRSCPKGVVANMSLGGGYSASINQAAAALVQAGVFLAVAAGNDNANAANYSPASEASVCTVGATDSSDRKASYSNYGSVVDIQAPGTNILSTWIGGRTNTISGTSMASPHIAGLGAYLLALEGSKTPAALCNYIKTSAISGAISGLPSGTTDRLAFNGNPSA

SEQ ID NO: 8545 - DNA, 1282 bp, Panicum virgatum
  misc_feature: Ceres CLONE 2007623
  misc_feature: Encodes the peptide sequence at SEQ ID NO. 8546
accaatgcaaagatcatcttgatctgcaaggaagatcttgtcgtagcataccatatgctatggctgaggctgagatcaagataggtcaggttgatgacgtccaggagctgcaccgggcgggcctggagacggtgccggagcgctacatcagggacggggacgaccgtccgggtggcgacaacgtctgcgctctcgcgcacatcccggtgatcgacgtcggcgagctcacgcgcgacgacgagctgaacaagctcaagctcgcctgcgaggaatggggtttcttccaggttgtgaaccatggcattgaggacgagctgctggacgagatggaggagctgacgagggagttcttcatgctgccgctggaggagaaggagaagtaccccatggcgccgggaggcatccagggctacggccacgccttcgtcttctccgaggatcagaagctggactggtgcaacatgctggcgctgggcgtggagcccgccttcatccggcagcccaagctttggccgacgaccccggccaagttcaaggagaccctggagaggtactccgcggagatcaggggcctgtgccggcggctgctcgcccacatcgccgagacgctgggcctggcgccgggcacgttcggcgacatgttcggcgaggcggtgcaggcggtgcggatgaacttctacccgccgtgcccgcggccggagctggtgctggggctgagcgcgcactccgacgggagcgcggtcaccgtgctccagcaggacatgtcctgcgccggcctgcaggtgctcaaggacggcgcctgggtgcccgtccaccccatcccacacgccctcgtcatcaaccttggcgactcgctcgaggttctgacgaacggcaggtacaagagcgtggagcaccgggcggtgaccaacagcgagcaggaccggctgtcgctggtgacgttctacgcgccggcctacgacgtcgagctgggcccgctgccggagttcgtcaccgacgaggtgccgtgccggtaccggaggttcaaccacggcgagtacagccgccactacgtcaccagcaggctcgagggcaagaagacgctcgagttcgccaagattgatcagaccactaccactgctcctgaagacccctgtagttgcatatagttaatagtttgatagtgcttggaaattgcagacagataagtcctgatgagtgatgagccagaattaccaaccacttcactgagcagttcagaagtatgcagtgccgtataccgtaaaaaaaaaaaaaaaaaaaa

SEQ ID NO: 8546 - protein, 362 aa, Panicum virgatum
  misc_feature: Ceres CLONE 2007623
  misc_feature (1)..(102): Pfam Name: 2OG-FeII_Oxy Pfam Description: 2OG-Fe(II) oxygenase superfamily
MAEAEIKIGQVDDVQELHRAGLETVPERYIRDGDDRPGGDNVCALAHIPVIDVGELTRDDELNKLKLACEEWGFFQVVNHGIEDELLDEMEELTREFFMLPLEEKEKYPMAPGGIQGYGHAFVFSEDQKLDWCNMLALGVEPAFIRQPKLWPTTPAKFKETLERYSAEIRGLCRRLLAHIAETLGLAPGTFGDMFGEAVQAVRMNFYPPCPRPELVLGLSAHSDGSAVTVLQQDMSCAGLQVLKDGAWVPVHPIPHALVINLGDSLEVLTNGRYKSVEHRAVTNSEQDRLSLVTFYAPAYDVELGPLPEFVTDEVPCRYRRFNHGEYSRHYVTSRLEGKKTLEFAKIDQTTTTAPEDPCSCI

SEQ ID NO: 8547 - DNA, 1846 bp, Panicum virgatum
  misc_feature: Ceres CLONE 2007624
  misc_feature: Encodes the peptide sequence at SEQ ID NO. 8548
gtaccctaccgacacaaccatacaagttggccatggggggctttgtcctagtatgccttgtgatatcctccatggatgtcctcggcgccgtcgccagcagcgtcctgccaccgccgccgatgtatgtgttgggggactcgacgatggacgttggaaacaacaacttcctaccggggccattcgttcccagagccaacatgtcctactacggcatcgacttcccaggcgttcctaccggaaggtacagcaacggcttcaacatcgctgacttcatcgcaaagagcatgggattcgtgggtagccctccgccttatctgatgctggcgccaagcacaggccttctggtctccaccgctctcgaaactggcgtcaactatgcttccggaggatctggcatccttgacatcactaacgccgggcaacagaacatcccactgtcgaggcaggtgcagtacttcaacgacaccagggctaagatggtcgctgccgtgggctccgctgcggcggtggatgccctgctcgccaggtccatgttcctcatcagcgtcggcaacaacgacctcttcgggtcgcctgctgcgcagcagcagagtgacgccgccgcgttcttggcacacctcatctcaaactactcggccaccatcacggagctgtacgcgatgggcgccaggaagttggccgtcatcaactcggggctcatcggttgcgtgccggcggagcgggcgttccaaccgttgggagcgtgcgccgagggcgtgaacctgctcgccgccggcttcaacgtcgccctccggtcgctgctcgccaccgacctcgcccatagcctgccgggcctcgtatactccctcgccgactccttcgtcctcatgaaggacttccttgccgacccgccggcgtcggggttcgccgacatcgccagcgcgtgctgcggcgatggcttcctgctcgcgcgggcactccagtgcctgcccacctccaaggtctgccccaccagatccgagcgcgaccagcacgtcttctgggatccctaccacttttcccagcgggcctgtttcctcacggcccaggcattctacaacgggccggccaagtacaccaagcccatcaacttcatgcagctggcgcagtcctccacttgataatatgaaaaaactaacaaccgaccggtccctacgtctaaccatcacgcgacgcatggcctgcttatgacctaataaagtatcgaagcccatattcattctcctcgtccgcacgttctcccctctagtacagttagctccggagtctattaaacataaaaggttttggactaaaaaatattttatctccttcatacgatctctatttkgatacccgattmcaccattatgttctacacgccaagacgaacaaaactagcccccactggtatatgtttgggcgatgttttccactagtagcaacttatgtgtaaatttaaatttgaaggttattaaagaacttgctccaatatacatatataagttgctactaggtcttttcaaaaataagttgctactgtgtctttcaaaaataagttgctattaggtgtatacgggcaacttaggtacaggccccccccctagccccttcacgcaacccccacgtggcccataccctcccttcagcgactcttcatcccttatgcccttccaattcgagactcatttggtacatgtaagtgccattgatttacccaagattcgctctggtgccctccattctttatggggcaatttatgtgaggagtggcttttttttagcaacttatgggtatcgacttggtgggggtgataaattacgggtataacaacttttattttgtgtc

SEQ ID NO: 8548 - protein, 368 aa, Panicum virgatum
  misc_feature: Ceres CLONE 2007624
  misc_feature (1)..(318): Pfam Name: Lipase_GDSL Pfam Description: GDSL-like Lipase/Acylhydrolase
MGGFVLVCLVISSMDVLGAVASSVLPPPPMYVLGDSTMDVGNNNFLPGPFVPRANMSYYGIDFPGVPTGRYSNGFNIADFIAKSMGFVGSPPPYLMLAPSTGLLVSTALETGVNYASGGSGILDITNAGQQNIPLSRQVQYFNDTRAKMVAAVGSAAAVDALLARSMFLISVGNNDLFGSPAAQQQSDAAAFLAHLISNYSATITELYAMGARKLAVINSGLIGCVPAERAFQPLGACAEGVNLLAAGFNVALRSLLATDLAHSLPGLVYSLADSFVLMKDFLADPPASGFADIASACCGDGFLLARALQCLPTSKVCPTRSERDQHVFWDPYHFSQRACFLTAQAFYNGPAKYTKPINFMQLAQSST

SEQ ID NO: 8549 - DNA, 1629 bp, Panicum virgatum
  misc_feature: Ceres CLONE 2007888
  misc_feature: Encodes the peptide sequence at SEQ ID NO. 8550
acaatccaacaccaaaagcatcaacatatatcatcgatagcttatctcatatatcatctgattgaccatcatcagcttaattattaatagtacatgggctctctgagaggaggcggcggcggggcggcggaggtgaaagccattccgacggtggacgcggacgaggcatgcgccctcctcagcgccgcaacgcaccagtacctcgatgtcaggatgtgggaggattttgacaagggtcatgtcgccggtgcacgaaatgttccctactacctttccgtcactccacacgggaaggagaagaacccccactttatagagcaggtctctgcgctctatgccgaggaccagaacttgatcgtgggttgccgctccggcattcgctccaagctcgccacggtagaccttatcagcgcgggcttcaagaatgtgaggaacctagaaggcggatacctttccttgctccgaagtgcaaatcaacaccaccacccatcagctgcttaattaatcccattattgctacagctacttattaaccatgcatcactactatatttatatgatgattgagagcatacatatattcgtttgctctcgcattgctacctcgattgccatcgatatggatctgtatatgcaataattttatgaggaaggacaatgtaataacgaccaaagagtatttagacattcttgtgatctccatcctccatatatattgacattgaggtcccgatcgattgaaaaaaacacgaggaagaaggttctagcgactcggtagcaacgaagcaagcgccatggggaacaagcggcagctgatctgcctcgccgccgccgccgtcgccgccgcggccatcctcctgacagcgtcggcaaagaagaccggcgacgtcaccgagcttcagatcggcgtcaagtacaagccagagtcatgcaccctgcaagcacacaaaggtgataaaattaaggtccattatcgtgggacactcactgatggatcagtatttgattctagctatgacagaggtgacccgtttgaatttactcttggaaatggccaagtgataaaaggttgggaccaaggattactaggtatgtgcgtcggtgaaaagcggaagctaaagatacctgcaaagatgggttatggtgagcgaggctccccaccgaagattccaggtggagcaactctgatcttcgacacggagcttatctctgtcaatggaaagacatctggtgatgcaaaggcagaaagcaatagcgagctttaacacattgaagagtttcatcttgaacgtgtagcagcttcactaatagtggctcgcgcgagttcacttgatgaaagggttgttgtgttatgatttagatgttacaaatgcaagtctggttaagctctatgatctatgtcagcgactgttcatatactgtggaaacttttttcgcttggttggatgagaattcgatttgcgttgttgccacggtcttcgacacaacctgctccttcttgcattactgttgctgtcgacgcaggtcgacgccttctaaatctcaaatgtaaccagtgttagaaattcaaaccagatatttttcacatgagaagtattcagtgattgccaaaaaaaaaaaaaaaaaaaa

SEQ ID NO: 8550 - protein, 156 aa, Panicum virgatum
  misc_feature: Ceres CLONE 2007888
  misc_feature (1)..(95): Pfam Name: FKBP_C Pfam Description: FKBP-type peptidyl-prolyl cis-trans isomerase
  misc_feature (20)..(146): SWISSPROT Homolog: EC 5.2.1.8 FK506-binding protein 2-2 precursor
  misc_feature (20)..(152): SWISSPROT Homolog: EC 5.2.1.8 FK506-binding protein 2-1 precursor
MGNKRQLICLAAAAVAAAAILLTASAKKTGDVTELQIGVKYKPESCTLQAHKGDKIKVHYRGTLTDGSVFDSSYDRGDPFEFTLGNGQVIKGWDQGLLGMCVGEKRKLKIPAKMGYGERGSPPKIPGGATLIFDTELISVNGKTSGDAKAESNSEL

SEQ ID NO: 8551 - DNA, 1816 bp, Panicum virgatum
  misc_feature: Ceres CLONE 2007960
  misc_feature: Encodes the peptide sequence at SEQ ID NO. 8552
gttccacacacaccaaatccccaacgccgacgagcagccaccatggacgcctccctcttcatctccgtcggcctggcggcggtcctgatcccgctctccctcgcgctgctcaaccggctccgcctcggccgcctcccgcccggcccgcggccctggcccgtgctggggaacctgcggcagatcaagccgatccgatgccgctgcttccaggagtgggcggagcggtacgggcccatcatatccgtctggttcgggtccggcctcaccgtcgtcgtctccacctcggagctcaccaaggaggtgctcaaggagcacgaccagcagctcgcggaccggccgcggaaccgctccacgcagcggttcagccgcaacgggcaggacctgatctgggccgactacggcccgcactacatcaaggtgcgcaagctctgcaacctcgagctcttcacgcccaagcgcctcgaagcgctgcgccccatccgcgaggacgaggtcaccgccatggtcgagtccgtccaccgtgccgccaccgccccgggtaatgaaggaaagccattggtagtgaggaaccacctttccatggtggccttcaacaacataacaaggctggcatttgggaagcggttcatgaatgcaaacggtgagattgatgaacaagggcgtgaatttaagactatcgtgaacaatgggatcaggataggtgcatctctctctgttgctgagtttatttggtatttgagatggttgtgtccacttaatgaggagctttacaagactcacaatgagaggagggaccgcctgacaatgaagatcattgaagagcatgctaaagctctccaggagagtggtgccaaacagcactttgtggatgctcttttcaccctcaaacagcagtatgatcttagcgaagacacagttattggacttctatgggacatgatcactgctggaatggacacaacagtcatctcagtcgagtgggcgatggcagagctggtcaggaaccccagggtgcagaagaagctgcaagaggagctggaccgtgtcgtcggccgtgaccgcgtcatgtcggagaccgacttccagaacctcccctacctgcaagccgtcgtcaaggagtcgctccggctgcacccgccgacgccgctcatgctccctcacaaagccagcacgaacgtcaagatcggtggttacaacatccccaagggcgccaacgtgatggtgaacgtctgggctgtggcgcgtgaccccaaggtgtggagcaacccgctggagtacaggccggagcgcttcctggaggagaacatcgacatcaagggcagcgacttcagggtgctgccgttcggcgcgggccggcgggtgtgccccggcgcgcagctcggcatcaacctcgtggcctccatgatcgggcacctcctgcaccacttcgagtggtcgctgccgagcggcaccagaccggaggacgtcaacatgatggagtcccccgggctcgtcacgttcatgggcacgccgctgcaggccgtcgccaagccgcgcctggagaacgaggagctgtacaagagggtccccgtcgagatgtgagctgcctgccgccgctttgaattcactcctcgatcggcttgggcttttcttcttcctgctgctggttatatactgctgccgctttcctcgccaaaaaaaaaaaatactgctttcagctaggtgcttcatagagtgttgtataatgtgtggtgtttagttgcatttttaatctcataaaaatggcacacgcggatccttcaaatgatgattatacactcaccttctttccttatag

SEQ ID NO: 8552 - protein, 512 aa, Panicum virgatum
  misc_feature: Ceres CLONE 2007960
  misc_feature: Great-hit functional homolog of the protein sequence encoded by LOCUS At2g40890
  misc_feature: Great-hit functional homolog of the protein sequence given in SEQ ID NO 9261
  misc_feature: Useful for making plants with altered cell wall content and/or composition
  misc_feature: Useful for making plants with altered lignin content
MDASLFISVGLAAVLIPLSLALLNRLRLGRLPPGPRPWPVLGNLRQIKPIRCRCFQEWAERYGPIISVWFGSGLTVVVSTSELTKEVLKEHDQQLADRPRNRSTQRFSRNGQDLIWADYGPHYIKVRKLCNLELFTPKRLEALRPIREDEVTAMVESVHRAATAPGNEGKPLVVRNHLSMVAFNNITRLAFGKRFMNANGEIDEQGREFKTIVNNGIRIGASLSVAEFIWYLRWLCPLNEELYKTHNERRDRLTMKIIEEHAKALQESGAKQHFVDALFTLKQQYDLSEDTVIGLLWDMITAGMDTTVISVEWAMAELVRNPRVQKKLQEELDRVVGRDRVMSETDFQNLPYLQAVVKESLRLHPPTPLMLPHKASTNVKIGGYNIPKGANVMVNVWAVARDPKVWSNPLEYRPERFLEENIDIKGSDFRVLPFGAGRRVCPGAQLGINLVASMIGHLLHHFEWSLPSGTRPEDVNMMESPGLVTFMGTPLQAVAKPRLENEELYKRVPVEM

SEQ ID NO: 8553 - DNA, 1803 bp, Panicum virgatum
  misc_feature: Ceres CLONE 2008223
  misc_feature: Encodes the peptide sequence at SEQ ID NO. 8554
ttggtctcctttgatcctataactgatggcccagtaagcctctggctgccagtcttgattgcgtttcgcctgatggcgtctcaagatcatgaggtccatggcatgagcgcccacgagatgagcggcaactgctgcaagagatgcagccactgcgactcgcattactactggcatcatctggatgatcggcagaagcatttcttcaagctcatgctcggcgatttccagcagcagatgatcgtaccggagaaatttgctaagaatttcagaggccagatctctggagtggtcaagctggaagctcctgatggaaacttatacaaagtcaatgtttcacaagatctgaacaagttagttttcaggtatgggtggggggcattttgcagcgcttatgaactggagcagggtgacatgctggtgttcagatacagtggggactcccacttcaaggtcctcatctttgatcagagtggatgcgagaaagaattcttccgcgtcgtcatgaatcccacttgcagtgtccgacgacggggaattcctcatgaacaatctccatcaggggaagggttagcgcggcatcgaaccgatgaactgaaccacagcagaaaagcttcaaagatgactccagcagactcaccttcacagagatcaactgaagaaatggcatatccagaggatactgtaaagcccatggattcaggtgtatttcagacatcctccgaatcgcgcgctatcttagcaaagggctgcatcctgactagtgtgcagaaggcgaaactcgatgcatttcagaagaaaattaggcctgggaatccactgtatgtcacaaacatgaacaagaccaatctgtctaatggatatatggtcatttgcaaggactactctgataagtacctcccacatgaagatcaagccatcacgctgtgtcaccctcctggtagcaggaaacgggatgcaaatctgaagatctctgctgaaggcgcgtacatcttctccaatggctggcggagcttggctcgcgaccacgagttgcaggatggcgatgcctgcgcattcgaagcatcgacgagcgaggggcgagtgacactgtcggtgcatcctcttcaaggaagctacaatccaccagaatcaggcgcttcagcacccctggagctagacatccattcaggttacatggtgagcaaacacacaaatctaacgccggagcagaagaagagagtccttgagaaactacgggaaattcaggctaaaaccttcgtcttcgtgacggccaaaaagcgtggcaacgacagcatgtgcttcaacaaggacttcgccatggagcacctaccccgggtgccgcagacggtgcggctgcggcggccgggcgtgagctgcagctgggaggctcagctgcaggtcaggaacgagggcaaggtgcacctgctccgccgcgggtggaagcagtttgtcgacgacaacgcgctgcggcagggcgacctgtgcttgttccagccgctcggcggcggcggctgcgaggacgacggcgagctcgccatgaacgtccacatccttcgcggacactgatccagcggctgcagcaagaagctgaatcatgatgtacgatttagtgtactgcaactgcagcaagacatgaaactttttttttttttttgaaactgcaagacatgaacttgacaaactctcatctgagagatcaaaaaccattttacttgtgcctgtttgacaattcaataatggtgaagggtgatcatcccctgacactgacagaggaaatgaagttaaaaaaaaaaaaaaaaaaaa

SEQ ID NO: 8554 - protein, 497 aa, Panicum virgatum
  misc_feature: Ceres CLONE 2008223
  misc_feature: Great-hit functional homolog of the protein sequence given in SEQ ID NO 9655
  misc_feature (2)..(94): Pfam Name: B3 Pfam Description: B3 DNA binding domain
  misc_feature: Useful for making plants with modulated flowering time
MASQDHEVHGMSAHEMSGNCCKRCSHCDSHYYWHHLDDRQKHFFKLMLGDFQQQMIVPEKFAKNFRGQISGVVKLEAPDGNLYKVNVSQDLNKLVFRYGWGAFCSAYELEQGDMLVFRYSGDSHFKVLIFDQSGCEKEFFRVVMNPTCSVRRRGIPHEQSPSGEGLARHRTDELNHSRKASKMTPADSPSQRSTEEMAYPEDTVKPMDSGVFQTSSESRAILAKGCILTSVQKAKLDAFQKKIRPGNPLYVTNMNKTNLSNGYMVICKDYSDKYLPHEDQAITLCHPPGSRKRDANLKISAEGAYIFSNGWRSLARDHELQDGDACAFEASTSEGRVTLSVHPLQGSYNPPESGASAPLELDIHSGYMVSKHTNLTPEQKKRVLEKLREIQAKTFVFVTAKKRGNDSMCFNKDFAMEHLPRVPQTVRLRRPGVSCSWEAQLQVRNEGKVHLLRRGWKQFVDDNALRQGDLCLFQPLGGGGCEDDGELAMNVHILRGH

SEQ ID NO: 8555 - DNA, 1797 bp, Panicum virgatum
  misc_feature: Ceres CLONE 2008277
  misc_feature: Encodes the peptide sequence at SEQ ID NO. 8556
accaccaacctcccagcgcgctcccacacctctgccatcctctttgactccgcgtccctattctccctgcctgcctgccaagaatcctgctagctcccacctccacaccctcccgactcgagcctccatctctccccgctgctcctgagtcctgagccgccgagcgtggagggaaggcgcggaggcagaggtgcggacggcagactaatggggacggggagggcgcgggcgctgcccctggcgctcgccttgctcctcgcctgctccgacgtcgccgtcgtcgcggcgcagggcaccgagcggatccaaggaagtgctggtgatgtgctagaagatgatcctgttggaaggctcaaggtatatgtctatgagttgccgcccaagtacaacaagaatattttggcaaaagattcaagatgcctcaagcacatgtttgctacagagatcttcatacatcgcttcctactgtcgagtgcagtccggacattaaatccagaagaagccgattggttctatactccagtatacacaacatgcgaccttacaccatggggccatcccttgaccaccaagtctccacgtatgatgagaagtgcgattcagtacatttccaagcgttggccctactggaacaggacagagggagcagatcatttctttgtcacaccacatgactttggagcatgcttctatttccaggaagcaaaggctattgagcgaggtgtccttccggtgctgcgccgtgctacgctggtccagacttttgggcagaagcatcatgtgtgcctcaaggaaggctccatcaccatcccaccatatactcctcctcataagatgagaactcacctcattccaccagagacccctcggtcaatctttgtctattttcgtggtttgttctatgatacttcaaatgatcctgagggtggttactatgcaaggggcgcccgtgcctcagtgtgggagaacttcaagaacaacccgatgttcgacatctcgacagaccacccaccaacctactatgaggacatgcagcgttctgtcttctgcttgtgcccactgggctgggccccatggagcccccgtttggtggaggctgtggtgtttggctgcatccccgtgatcatcgccgatgacattgttcttccctttgcggacgcgataccatgggaggagattggtgtctttgtggccgaggatgacgtcacgaagctggacaccatcctgacctccataccgatggaggagatccttcggaagcagaggctgctcgcaaacccatccatgaagcaggccatgctcttcccacagcctgctgaacccagggacgccttccaccagatcctgaacgggctcgcacggaagctgccgcatggtaagggcgtgttcctgaagcccgggcagaaggtgctgaactggactgagggagacccggccgatatgaagccgtggtaggtataaacatatagtggcatggaaccatcaccattcgccatggctggtattcttttgtaaacgacacaaccatacgagaggctgatcatacagttgacgatgatgctgatgagtgaaccacagcattaaatgtaaagctccttcccttcctcctactacctgcttctttttgagggaatgtgcctgtcttgtctgtatggccatacctgctttgaccttttagtttaattttagcattttatagatgatagatggtggatcatgtaatgtatgaccgtgtattatattatacagttgctggtttacaatggaggaagtagctaaaaaaaaaaaaaaaaaaaa

SEQ ID NO: 8556 - protein, 415 aa, Panicum virgatum
  misc_feature: Ceres CLONE 2008277
  misc_feature: Great-hit functional homolog of the protein sequence encoded by LOCUS At1g27440
  misc_feature: Great-hit functional homolog of the protein sequence encoded by LOCUS At5g61840
  misc_feature: Useful for making plants with altered cell wall content and/or composition
MGTGRARALPLALALLLACSDVAVVAAQGTERIQGSAGDVLEDDPVGRLKVYVYELPPKYNKNILAKDSRCLKHMFATEIFIHRFLLSSAVRTLNPEEADWFYTPVYTTCDLTPWGHPLTTKSPRMMRSAIQYISKRWPYWNRTEGADHFFVTPHDFGACFYFQEAKAIERGVLPVLRRATLVQTFGQKHHVCLKEGSITIPPYTPPHKMRTHLIPPETPRSIFVYFRGLFYDTSNDPEGGYYARGARASVWENFKNNPMFDISTDHPPTYYEDMQRSVFCLCPLGWAPWSPRLVEAVVFGCIPVIIADDIVLPFADAIPWEEIGVFVAEDDVTKLDTILTSIPMEEILRKQRLLANPSMKQAMLFPQPAEPRDAFHQILNGLARKLPHGKGVFLKPGQKVLNWTEGDPADMKPW

SEQ ID NO: 8557 - DNA, 1866 bp, Panicum virgatum
  misc_feature: Ceres CLONE 2008621
  misc_feature: Encodes the peptide sequence at SEQ ID NO. 8558
aacagcggcagtgccgtcgcgtcgtctcccactcccacctcccccgcccgccgttcaaatctctccctgcaacccagcagggcagccagccagacagaaccgaagcatgacgtcggagccgaaggcctcgcggctcctcctcctcgcgctcctcctcgtcggcgccgcggccgccgcggggggccacgacgacgcggtggcgcggcggacgatggaggagttcgccgggttccccgcctccgatggcgacgagggcccgtccaccgcgttccgcgtcgactccgagggcctgcagcgtcagattgatgaactggcgtcgttctcggactcgcccgcgccgtccgtgacccgcgttctgtacagcgacaaggatgtgcaggctcgaaggtatatcaaagggataatgaatgatctcggccttgcagttcgggaagatgctgttggtaacatattaggccgctgggagggttccgaagctggactaggagcagttggaactggttctcatgttgatgccattccattctcaggaaaatatgacggtgttgttggtgttcttggtgctcttgaggcaattagtcttctaaaaagatctggtttccagccaaaaagatctttggaggtcattatgtttacatcagaggagcctacacgatttggaattagctgcttgggaagccgcttaatggcaggtattgaggtactagcacaatccctcagaaaagtagttgacaatcagaatgtgtcatttttagatgctgcagaatctgctgggtataagatggatccaaaagacctgcaaagtgtgttcctaaagaaaaacagttactctgcttttatagaattgcacattgaacagggtcccatcttggagaaggaaggtatccccattggcattgttactgctattgctgctcctgcaagcattacggtggaatttgaagagaatgggggtcatgcaggggcagtgctcatgcctgcaagaaatgatgctggactggcagcagctgagctggcattagcagttgagaaacatgtcctggaatcaggatcaattgatactgttggcactgttggtattctgcagctacatccaggagcaatcaatagcatcccaagtaaatcacacctagaaattgatgtaagagatattgatgagaaaagaaggaatgaagtcattgagaagattcgccgatctgcaacagagatatcaaagaaccgtggagttgtgctttcagaattcaagatcatcaaccaggatccccctgctctatctgaccaatcagttgttgaggcaatggaatttgctgcaaaacagttgaacctggagtataaaaagatgattagcagagcttaccatgattctctcttcatggccagagtatcaccaatgggtatgatcttcatcccctgttacaaaggttacagccacaagcccgaggagtatgcatcgccagaggacatggcaaatggggtcaaggtccttgccttgacaatggctaagctatccctggagtgacaagtgagcatgcggggaaatcaagtagcaccgccaaacaacctgtgttcttgccaataataagctgcacaacagtggcgtcatcttccccgcaccaggcctgcatatacaccatcatttataggatttagggtcaaagctgtcagctggatacaccatggctgcaatcctgcagtgtggcacctccctagatgcttgataggcgaacaattcactgaaaatgtgcacagatatgtaaggatcactggatctgaatgaaagtaccgtctaatgctggtagggtactctgaaaattctgaaacaataagcagctggggcctctttcagaaaaaaaaaaaaaaaaaaaa

SEQ ID NO: 8558 - protein, 470 aa, Panicum virgatum
  misc_feature: Ceres CLONE 2008621
  misc_feature (2)..(337): Pfam Name: Peptidase_M20 Pfam Description: Peptidase family M20/M25/M40
  misc_feature (2)..(337): Pfam Name: Peptidase_M20 Pfam Description: Peptidase family M20/M25/M40
  misc_feature (2)..(339): Pfam Name: Peptidase_M20 Pfam Description: Peptidase family M20/M25/M40
MTSEPKASRLLLLALLLVGAAAAAGGHDDAVARRTMEEFAGFPASDGDEGPSTAFRVDSEGLQRQIDELASFSDSPAPSVTRVLYSDKDVQARRYIKGIMNDLGLAVREDAVGNILGRWEGSEAGLGAVGTGSHVDAIPFSGKYDGVVGVLGALEAISLLKRSGFQPKRSLEVIMFTSEEPTRFGISCLGSRLMAGIEVLAQSLRKVVDNQNVSFLDAAESAGYKMDPKDLQSVFLKKNSYSAFIELHIEQGPILEKEGIPIGIVTAIAAPASITVEFEENGGHAGAVLMPARNDAGLAAAELALAVEKHVLESGSIDTVGTVGILQLHPGAINSIPSKSHLEIDVRDIDEKRRNEVIEKIRRSATEISKNRGVVLSEFKIINQDPPALSDQSVVEAMEFAAKQLNLEYKKMISRAYHDSLFMARVSPMGMIFIPCYKGYSHKPEEYASPEDMANGVKVLALTMAKLSLE

SEQ ID NO: 8559 - DNA, 856 bp, Panicum virgatum
  misc_feature: Ceres CLONE 2008759
  misc_feature: Encodes the peptide sequence at SEQ ID NO. 8560
attgacagccctccccggctccccctcacggctcagggcctcagccctcgggctcatctctgtttctttcccccttcttctctgactctctccgtcctccttccctggcggcgccgactggtcgagcggcggcgcgcccttcgtcacctcctggcccagcccttcgccagcgacgagcatccaccagatggcagatagagagagacgaacagtgtttgtcactgtggggaccacatgttttgattctcttgtcatggcagtggattctccagaagtgaaaaaagctttgttgcaaaaaggttatactgaccttcttattcaaatgggccgagggacatacgttccatctaaggtgtcagaagatgcaacccttcaagttgatcatttcatgttttcaccaagcattgctgacaatatgagaacagcttccctagttattagccatgcaggttcaggaagtatattcgagacgctacgactcggcaaacctctaattgttgttgtaaatgaagatttgatggacaatcaccagagtgagctagcagaagagttggctgaaaggaagcacctcttctgtgcacacccacaaacactgggagagaccatcggagcaatggacctagggacactcgttccttatgtgccaggggatgccgaaccagttgtcaccctgatcaacaaatttcttggatttccagttgactgacaagtgaagataagcagtaacgccccttatctggtcaaactaaatggactgactgattgactcacatggcgagctgatgatttcatattgttgtacagtaatagaaagatgatctttcttgtcattgagcaaaaaaaaaaaaaaaaaaaa

SEQ ID NO: 8560 - protein, 172 aa, Panicum virgatum
  misc_feature: Ceres CLONE 2008759
  misc_feature: Great-hit functional homolog of the protein sequence given in SEQ ID NO 9271
  misc_feature (2)..(160): Pfam Name: Glyco_tran_28_C Pfam Description: Glycosyltransferase family 28 C-terminal domain
  misc_feature: Useful for making plants with altered oil content
MADRERRTVFVTVGTTCFDSLVMAVDSPEVKKALLQKGYTDLLIQMGRGTYVPSKVSEDATLQVDHFMFSPSIADNMRTASLVISHAGSGSIFETLRLGKPLIVVVNEDLMDNHQSELAEELAERKHLFCAHPQTLGETIGAMDLGTLVPYVPGDAEPVVTLINKFLGFPVD

SEQ ID NO: 8561 - DNA, 674 bp, Panicum virgatum
  misc_feature: Ceres CLONE 2008840
  misc_feature: Encodes the peptide sequence at SEQ ID NO. 8562
aaggccggaacgaaaccaaccccctcgtcgtcctagaagctcccgcgtcccctccccctagcctccgctctccaatggcgccctccctcctcgccgccgccgccgccgccgccgcctcgcccttcctcgtcgccggcagcaattgcagccgccggccgctgagcgccgcccccacccgccgggccgggctgcgcgttgccgcgctcaagtacgaccctgccaaggtggcgccgcagtccgaccgggtgctcgtccgtctccagcagatccctgagaaatctgctggaggtgtattgctacctaagtctgctgttaagtttgagaggtatctgatgggtgagattctatcggtcggttctgatgttagtgaagttgaggctggaaagaaggttctattttcagatatcaatgcttatgagatggacctaggtaccgatgagaagcactgtttctgccgggaatcggatctgttagctgttgttgaatgaattttaccctaaaatttcagacttgggcgacagtgcaccaagcctccaagtgaacgggcttgacctttgtcccaactttgttgtatgccatttgaatgttcatgaattccacaaactgatgagtgttagttaccactgaattttgaccgccataagcagtaatgaaattacgcttctttcctttac

SEQ ID NO: 8562 - protein, 137 aa, Panicum virgatum
  misc_feature: Ceres CLONE 2008840
  misc_feature (1)..(87): Pfam Name: Cpn10 Pfam Description: Chaperonin 10 Kd subunit
MAPSLLAAAAAAAASPFLVAGSNCSRRPLSAAPTRRAGLRVAALKYDPAKVAPQSDRVLVRLQQIPEKSAGGVLLPKSAVKFERYLMGEILSVGSDVSEVEAGKKVLFSDINAYEMDLGTDEKHCFCRESDLLAVVE

SEQ ID NO: 8563 - DNA, 970 bp, Panicum virgatum
  misc_feature: Ceres CLONE 2008897
  misc_feature: Encodes the peptide sequence at SEQ ID NO. 8564
aattagccgtagcatcatgttcttatccatacgaccgatcgaccgcgacgacacgcttgatgcaaaccgtgcggttgcaccgatgcgcacgtctccaaggcaaagctagctcatcagggcagcaatggaaccgccggccggcgacggcgacggtgacgcgcaggaccggcagcgacgggacgacggagacgcccccgcggccgcggcgccggtcgtgtggctgcggccgctgggcctggcggacgcggacgccttcatggcgtgggcgtcggacgaccgcgtgatgcggttcctgaagcggccgctctgcgccacccgggagcaggcggtggcgcagatccgggacaccgtgctgggccacccgtggttccgcgccgtctgcgtcggcggccgccccgtggggcaggtctccgtgtggccgtacgccgacgagggcggccgcagggccaacctcggctacgccctggcgcgggaccactggggccggggcatcgccgccgccgccatcaggatggtggtggggagggtgttcgacgacctgccggggctggagcggctggaggcggtgacggacgtggagaacgtgcggtcgcagcgggtgctggagaaggccggcttccagagggagggggtgctccgcaggtacatcgccggacgcggcggcggccaggccagggacgccgtgatctacagcttcatgtcgtccgaccgaccgcctgtgaggccgtgactcgcaatggtcgcagtggctcgagttcagaagaattccctgttacaagagagccagaatggtagtgtactgatgttgtgacttgtgaaaaaggagggaaacagtgcacgcatcttgaatccaacattgtaacgcaattagaaatatctgttttcttccatcaagtcccaatttgcattttctaaataaaaaaagagcactgtgcacgcagtctcaacagaaaaaaaaaaaaaaaaaaaa

SEQ ID NO: 8564 - protein, 201 aa, Panicum virgatum
  misc_feature: Ceres CLONE 2008897
  misc_feature (2)..(80): Pfam Name: Acetyltransf_1 Pfam Description: Acetyltransferase (GNAT) family
MEPPAGDGDGDAQDRQRRDDGDAPAAAAPVVWLRPLGLADADAFMAWASDDRVMRFLKRPLCATREQAVAQIRDTVLGHPWFRAVCVGGRPVGQVSVWPYADEGGRRANLGYALARDHWGRGIAAAAIRMVVGRVFDDLPGLERLEAVTDVENVRSQRVLEKAGFQREGVLRRYIAGRGGGQARDAVIYSFMSSDRPPVRP

SEQ ID NO: 8565 - DNA, 1883 bp, Panicum virgatum
  misc_feature: Ceres CLONE 2009001
  misc_feature: Encodes the peptide sequence at SEQ ID NO. 8566
accattcgtccccctcacgtcccgtcgcgccgcccccttcgtcctggggcgccctcctcctccatggccaccgcgccccgacgccgctgctaggttgctggtagaggaggaggaggagtccggggcagcaggcagcgcgcgagctcgatcgcgtgccggggccgagctggagccgatggtgctggatctcaatgccgccgactcgccgacgcccgggtcggcctcggccacctcgagctccagcggcgccgggggcttcttccggttcgacctgctcggcgggagccccgacgaggagggctgctgctcgccctcgccgcccgtcgtcacgcgccagctcttcccgtcgccgcacccggacgccgcctccgtcgccgccgcctcgccgccgccggacgggccgccgcccccggaggcgtcggggccctgggcgcgccgcgcggcggatttcgcgccttcgtcgcccgcggccgggaagaagagccgccgggggcccaggtcccggagctcgcagtacaggggcgtcaccttctacaggaggaccggccgctgggagtcgcacatctgggactgcgggaagcaggtctacctgggtggattcgacaccgcgcacgccgcagcaagggcctatgaccgggctgcgatcaagttcaggggcctcgacgcagacatcaacttccatctgaaggactatgaggctgacttgaagcagatgaagaattggaccaaggaggagtttgttcacatactccggcgtcaaagcactgggtttgcgagggggagctcaaagtaccggggtgtgactcaacacaagtgtggtcgatgggaagctcggatgggtcagcttcttgggaagaagtacatctacctcgggttgtttgacagtgaaatcgaagcagcaagagcatatgacagggcggccattcgtttcaatggtcccgacgctgttactaattttgattctagttcctatgatggagatgttccacttccacctgaaatcgagaaagatgtggttgatgaggacatccttgatttaaatttgaggatttcacaacctaatgtgcactttccgaaaagtgattgtatcctgactgggtttggagtaaactgtaattctcctgaagcttcaagttcaattgtttctcagccaataagccctcagtggcttgcacatccccacagcacattggttccaccccagcagccacatctgtatgcatctccttctccaggcttctttgtgaacctcagggaggaggcaccagcagccacggagaagcgcccggagccggggccgggtccccaggcgtcgttccctccttgggcgtggcaaatgcagggctcccctgcgccgttgctccccgccgctactgcagcatcatcaggattctctaccgccgccggcgcgccggcgccgtccggcccccgcccgttcgccggccgccgcggccaccaccaccagctccgcttccccccgaccgcctgacgggcgagctcctcctcctgccctgccctgccccgcccctatccatcccgagacgggcgcctggcctgaccggtgcccgtccgtcgctggtctggcctggtcggtgacaggggggccggccattggttgggggaccaggggacggactgaggcagagtccttcctctgtctccccagctggtcactaccgtcgaagctccggcgctcatggctccctcaagtccggatcttcgttttgggaagcggattcatggaccgtggccccgtttgatttggactaggaaagtttggagtagaaattttatcaactttgaccattaattacggtgtaaaataaagtcggtttataaaactaatttcagaactcttgcgttaaaaaaaaaaaaaaaaaaaa

SEQ ID NO: 8566 - protein, 437 aa, Panicum virgatum
  misc_feature: Ceres CLONE 2009001
  misc_feature: Great-hit functional homolog of the protein sequence given in SEQ ID NO 9590
  misc_feature (1)..(64): Pfam Name: AP2 Pfam Description: AP2 domain
  misc_feature: Useful for making plants with modulated biomass
MVLDLNAADSPTPGSASATSSSSGAGGFFRFDLLGGSPDEEGCCSPSPPVVTRQLFPSPHPDAASVAAASPPPDGPPPPEASGPWARRAADFAPSSPAAGKKSRRGPRSRSSQYRGVTFYRRTGRWESHIWDCGKQVYLGGFDTAHAAARAYDRAAIKFRGLDADINFHLKDYEADLKQMKNWTKEEFVHILRRQSTGFARGSSKYRGVTQHKCGRWEARMGQLLGKKYIYLGLFDSEIEAARAYDRAAIRFNGPDAVTNFDSSSYDGDVPLPPEIEKDVVDEDILDLNLRISQPNVHFPKSDCILTGFGVNCNSPEASSSIVSQPISPQWLAHPHSTLVPPQQPHLYASPSPGFFVNLREEAPAATEKRPEPGPGPQASFPPWAWQMQGSPAPLLPAATAASSGFSTAAGAPAPSGPRPFAGRRGHHHQLRFPPTA

SEQ ID NO: 8567 - DNA, 1819 bp, Panicum virgatum
  misc_feature: Ceres CLONE 2009006
  misc_feature: Encodes the peptide sequence at SEQ ID NO. 8568
attctcacgaccagcagataccccaaaaccgcctttttcaccgccagaatgtctgctcctgcccacaagttcaaggtcgctgacctgtccctcgccgccttcgggcgcaaggagattgagttggccgagaatgagatgcctggtctcatgtcgatccgcaaaaagtatgccgctgaccagccgctcaagggcgcccgcattgctggctgcctgcacatgaccattcagactgctgtcttgattgagactcttgtttccctcggcgctgaggtcacatggtcctcgtgcaacatctttagcactcaggaccacgctgccgccgccattgccgcggctggcgttcccgtctttgcctggaagggcgagactgaggaggagtacaactggtgcttggagcagcagctcgttgctttcaaggatgacaagaagctcaacttgatcctcgacgacggcggtgatctgacccagctggtgcacgccaagtaccccgagatgctgaaggactgctacggtgtgtccgaggagacgaccacaggtgtccaccacctgtaccgcatgctcaagaacggcaaactgctggttcctgccatcaacgtcaacgactccgtcaccaagtccaagttcgacaacctttacggctgccgcgagtcgctggtcgacggcatcaagcgcgccactgacgttatggttgctggcaagatcgccgttgttgctggcttcggcgacgtcggcaagggctgtgctgtggctctccgcgacatgggcgcccgtgtgctcgtcactgaggttgatcccattaacgccctccaggccgccatggctggttacgaggtgaccaccatggagaaggctagcaaggttggccagatctttgtcaccaccactggctgccgcgatatcctggttggcaagcacttcgaggccatgcccaacgacgccattgtttgcaacattggccacttcgacgttgagatcgatgtcgcttggctcaaggccaacgcccaatccgttcagaacatcaagccccaggtcgaccgcttcctcatgaagagcggtcgccacatcatcctgctggccgaaggtcgccttgtcaaccttggctgcgccactggccacagctcattcgttatgtcgtgcagctttaccaatcaggtgctggctcagatcatgcttttcaagagcaacgacgaggcgttcgctaagaagtacgtcgagtttggcaagagcggcaagcttgagaccaaggtctacgtcctgcccaagatcctcgatgaggaggttgctcgtctccacttggctcacgtcaacgttgagctcactaccctgaccaacgttcaggctgagtacctcggcctggatgttgagggcccttacaagaccgaccactaccgctactaatttcacaagcggtgtctgctcgcgcgcctagagctcgctgcgtgatgcggacttttttctttacgatagatcttcaacaatttgcatcctggacacgtctcattgggcatgtttaggacgggtttcggggcattgtttttcaacaggcatgacttgcatggtacattgggtttaggcggggtgtaaaaggcaaagggggtctggtacacattttcaacaaaagtacggcgttggctttggctcatgatatcccacctacacccaccggacggcgtttaacagagaacttatcgcgttggtgcgccggagcacttctctaaattcgggcaaacagagaagatcaagtggctccgtcaaccggggcccaatagaatatatagcgacaatggtcgctcacccacaaaaaaaaaaaaaaaaaaaa

SEQ ID NO: 8568 - protein, 449 aa, Panicum virgatum
  misc_feature: Ceres CLONE 2009006
  misc_feature (3)..(426): Pfam Name: AdoHcyase Pfam Description: S-adenosyl-L-homocysteine hydrolase
  misc_feature (3)..(427): Pfam Name: AdoHcyase Pfam Description: S-adenosyl-L-homocysteine hydrolase
  misc_feature (3)..(428): Pfam Name: AdoHcyase Pfam Description: S-adenosyl-L-homocysteine hydrolase
  misc_feature (3)..(431): Pfam Name: AdoHcyase Pfam Description: S-adenosyl-L-homocysteine hydrolase
  misc_feature (184)..(461): Pfam Name: AdoHcyase Pfam Description: S-adenosyl-L-homocysteine hydrolase
  misc_feature (184)..(461): Pfam Name: AdoHcyase Pfam Description: S-adenosyl-L-homocysteine hydrolase
  misc_feature (154)..(464): Pfam Name: AdoHcyase Pfam Description: S-adenosyl-L-homocysteine hydrolase
  misc_feature (155)..(465): Pfam Name: AdoHcyase Pfam Description: S-adenosyl-L-homocysteine hydrolase
  misc_feature (1)..(434): Pfam Name: AdoHcyase Pfam Description: S-adenosyl-L-homocysteine hydrolase
  misc_feature (3)..(427): Pfam Name: AdoHcyase Pfam Description: S-adenosyl-L-homocysteine hydrolase
  misc_feature (1)..(449): SWISSPROT Homolog: EC 3.3.1.1 Adenosylhomocysteinase
  misc_feature (8)..(449): SWISSPROT Homolog: EC 3.3.1.1 Adenosylhomocysteinase
MSAPAHKFKVADLSLAAFGRKEIELAENEMPGLMSIRKKYAADQPLKGARIAGCLHMTIQTAVLIETLVSLGAEVTWSSCNIFSTQDHAAAAIAAAGVPVFAWKGETEEEYNWCLEQQLVAFKDDKKLNLILDDGGDLTQLVHAKYPEMLKDCYGVSEETTTGVHHLYRMLKNGKLLVPAINVNDSVTKSKFDNLYGCRESLVDGIKRATDVMVAGKIAVVAGFGDVGKGCAVALRDMGARVLVTEVDPINALQAAMAGYEVTTMEKASKVGQIFVTTTGCRDILVGKHFEAMPNDAIVCNIGHFDVEIDVAWLKANAQSVQNIKPQVDRFLMKSGRHIILLAEGRLVNLGCATGHSSFVMSCSFTNQVLAQIMLFKSNDEAFAKKYVEFGKSGKLETKVYVLPKILDEEVARLHLAHVNVELTTLTNVQAEYLGLDVEGPYKTDHYRY

SEQ ID NO: 8569 - DNA, 1637 bp, Panicum virgatum
  misc_feature: Ceres CLONE 2009045
  misc_feature: Encodes the peptide sequence at SEQ ID NO. 8570
gcacatgacattatttatctcctcaagccagcagcagcctgccttctccttccttagcttcgtccacctcttgctcatctctccctctctctctctcgctcctcccctccccattcccctataaagccttcacttacgcgaccactcatgggctctcttctctctctgagacagcatcagcagcttcctcttgctatagctagctaggttgtagccggccggccctggccctggccctggtctggccacacacagctctgcatcacttgggaggagctccttgcttgcaactgtgtgctagctcgctgttgctcctgccgccaagccgccaaggccaagctgctgctctgtgagtggccgccggccggcatggacaacatcactcacaactcgagcagcagcagctcatgggatttggacatgagcctcggcagccaccaccaccccctcctcttcgacagccacaccaacccggcgccgccgccgccgccattaccgttccatctctccaccacctcccatcaccaccaccaccctcctccgcaccaccaccaccaccatctagatccttccccgtcttcctccctcttcccgccgccgcaccaccaccgcctccaccacctcggcctcgacatcgagccctccccccaccaccggcaccaccatgagtacgagcagcatcagcaggagcccgccggccaccacgagcaggaggagatgaggcagcagcagcaggaggccggcgtggcccaggacgagcgcggcggcggcggcgaggacgtggaggaggagctcggcgccatgaaggagatgatgtaccggatcgccgccatgcagccggtggacatcgacccggccaccatcaagaagccgcggcggcgcaacgtgcgcatcagcgaggacccccagagcgtggcggcgcggcaccggcgcgagcggatcagcgagcgcatccgcatcctgcagcgcctcgtcccggggggcaccaagatggacaccgcctccatgctcgacgaggccatccgctacatcaagttcctcaagcgccaggtgcaggagctccagcaccagccgccgccgccgcagcagcagcaatacccggccgccgccgccgccgccgccgccggcggaggcggcgtagcagcagccgggcccagcacctccgtcgtgggcccgccggggcgacccggcggcgggccgttcctcccgttgggtcccgggccgctcatcgactgggccgggctggtgaggcccgtggatatccacgggccgacatcgtcgtcgtcctcgtcgtcgatgggcagcgcacacgcggccctgggcttcgggttcagcagcgccggccagagcagccatggtggaatgcactgatgatgatgatctatcgagctaggggaaaggaagcttgattagcttgcttgtagcagctagcggattaactaggaatcgtggatgatggatggattatttggtggatgatggatcatggataccatgacgtactagagaggtaattttgatttgatctttaatttgatttttctagctgtgtgatcgatcgagggtagctagtgtatgtcttctcttccctggtgttaatccatgccatgttttatgaaaaaaaaaaaaaaaaaaaa

SEQ ID NO: 8570 - protein, 333 aa, Panicum virgatum
  misc_feature: Ceres CLONE 2009045
  misc_feature (1)..(48): Pfam Name: HLH Pfam Description: Helix-loop-helix DNA-binding domain
  misc_feature: The sequence is a functional homolog of  SEQ ID NO 1208 in the  10/666,642 US patent application
  misc_feature: The sequence is a functional homolog of  SEQ ID NO 1658 in the  10/374,780 US patent application
  misc_feature: The sequence is a functional homolog of  SEQ ID NO 1679 in the  10/412,699 US patent application
  misc_feature: The sequence is a functional homolog of  SEQ ID NO 1831 in the  11/479,226 US patent application
  misc_feature: The sequence is a functional homolog of  SEQ ID NO 296 in the  10/374,780 US patent application
  misc_feature: The sequence is a functional homolog of  SEQ ID NO 8 in the  10/225,066 US patent application
  misc_feature: The sequence is a functional homolog of  SEQ ID NO 914 in the  10/412,699 US patent application
  misc_feature: Useful for making plants with modulated growth and phenotype characteristics
MDNITHNSSSSSSWDLDMSLGSHHHPLLFDSHTNPAPPPPPLPFHLSTTSHHHHHPPPHHHHHHLDPSPSSSLFPPPHHHRLHHLGLDIEPSPHHRHHHEYEQHQQEPAGHHEQEEMRQQQQEAGVAQDERGGGGEDVEEELGAMKEMMYRIAAMQPVDIDPATIKKPRRRNVRISEDPQSVAARHRRERISERIRILQRLVPGGTKMDTASMLDEAIRYIKFLKRQVQELQHQPPPPQQQQYPAAAAAAAAGGGGVAAAGPSTSVVGPPGRPGGGPFLPLGPGPLIDWAGLVRPVDIHGPTSSSSSSSMGSAHAALGFGFSSAGQSSHGGMH

SEQ ID NO: 8571 - DNA, 1804 bp, Panicum virgatum
  misc_feature: Ceres CLONE 2009218
  misc_feature: Encodes the peptide sequence at SEQ ID NO. 8572
aaattatttcgaatcagggatattttactaggcatgattaagaatttcaagactcttgtctccagaggtatcagaaccgccaagttccccttggctgctcccctcggctgcaacttccactcctcccaagcatacaacaagaagctcaatttcggagaatctttcgccgtccttgaggaaaagatctctaaaatcagtcagttgaataacatccaagaattcggtaccgttatctcaatcggtgatggtattgccagagtcttcggtctctccaacgtacaagccggtgaaatggttcagttctcctctggtgtcagaggtatggccttgaacttggaaactgacaatgtcggtgtcgtcgttctcggtaacgatagagaaattcaagaaggtgacgtcgtcaagagaactggtgccatcgtggatgtccccatcggagaggaaatgttgggcagagtgttcgatgccctcggtaaccccattgatggtctcggcccagtcagaactgaaagaagacaaagagttgaaatcaaggctcctggtattatccccagaaagtccgtgcacgaacctatgcaaactggtcttaaggccgtcgattgcttggtccccattggaagaggtcaaagagaactgatcattggtgatagacaaaccggaaagaccgctattgccatcgattgtatcatcaaccaaaagaaaaacttcgaaaccaacgatcttaagaagcaacttttctgtatctacgtcgctatcggccaaaagagatccaccgtcgccaacatcgtcaagatccttaaggacaacggtgccatgagatacactatcgtcgtcgccgccactgcctccgaagctgctccccttcaattcttggctccctactccggatgcgccatcggagaatttttcagagatagcggaagacacgctttgatcatctacgacgatctttccaagcaagccgtcgcttatagacaaatgtctcttcttttgagaagacctccaggaagagaagcctacccaggtgatgtcttctatctccactctcgtctcctcgaaagagctgccaagatgagtgaagatttcggtgctggctcccttactgccctccccgtcattgaaacccaagctggtgatgtgtctgcttatatccccaccaacgttatttccattactgatggtcaaatcttcttggaaaccgaacttttctataagggtatcagacctgccattaacgtcggtctttccgtcagcagagtcggttctgccgcccaaattaaggccatgaagtccgtcgccggtagactcaagttggaactcgcccaatacagagaagtcgctgccttcgctcaattcggttccgatttggatgctgccacccaacaacttcttaacagaggtgctcaattgactgaactcttgaagcaaaaacaatacgtccccatgcctgctgaagaacaagtttgcgtcgtctacgctggtgtcagaggttacctcgacaagttggtcacttccgaaatctccaagttcgaacaaatgttcttaaatcacttgagaaccaacgctccccacattctcgaaaccatcagaaagaccggtgagcttactaaagaaatcgatgctgaattgaagactttggtcgaaaccttcatccccgaatctggcctcgctcttaagtcctaagtgatgtgtgtttttcatcgttaaaactttatattgaataacgtaagcttagtgagtttctaatccgaatgaacctactcttacagaaagcaatagcatacaaaaaaaaaaaaaaaaaaaa

SEQ ID NO: 8572 - protein, 549 aa, Panicum virgatum
  misc_feature: Ceres CLONE 2009218
  misc_feature (1)..(225): Pfam Name: ATP-synt_ab Pfam Description: ATP synthase alpha/beta family, nucleotide-binding domain
  misc_feature (8)..(540): SWISSPROT Homolog: EC 3.6.3.14 ATP synthase subunit alpha, mitochondrial precursor
MIKNFKTLVSRGIRTAKFPLAAPLGCNFHSSQAYNKKLNFGESFAVLEEKISKISQLNNIQEFGTVISIGDGIARVFGLSNVQAGEMVQFSSGVRGMALNLETDNVGVVVLGNDREIQEGDVVKRTGAIVDVPIGEEMLGRVFDALGNPIDGLGPVRTERRQRVEIKAPGIIPRKSVHEPMQTGLKAVDCLVPIGRGQRELIIGDRQTGKTAIAIDCIINQKKNFETNDLKKQLFCIYVAIGQKRSTVANIVKILKDNGAMRYTIVVAATASEAAPLQFLAPYSGCAIGEFFRDSGRHALIIYDDLSKQAVAYRQMSLLLRRPPGREAYPGDVFYLHSRLLERAAKMSEDFGAGSLTALPVIETQAGDVSAYIPTNVISITDGQIFLETELFYKGIRPAINVGLSVSRVGSAAQIKAMKSVAGRLKLELAQYREVAAFAQFGSDLDAATQQLLNRGAQLTELLKQKQYVPMPAEEQVCVVYAGVRGYLDKLVTSEISKFEQMFLNHLRTNAPHILETIRKTGELTKEIDAELKTLVETFIPESGLALKS

SEQ ID NO: 8573 - DNA, 1704 bp, Panicum virgatum
  misc_feature: Ceres CLONE 2009325
  misc_feature: Encodes the peptide sequence at SEQ ID NO. 8574
cctcctctccctctccttctctctctctctacctctgctgctgcagctgcagtgggttgtcatcctcctccggcccctatcggattcctgaaacgtgagagttggtgggtcgggtaggtgcttaactacatccatccggagaacatcggacggagcgcgcccaaccaagctatctccggcctctgactttctcgggcggaggaggcgcagcagcgcgggcacgatgatgagcttcaggagccacgaggggttcgggcaggtccccgccggcgccacctccaacggagccgcggtgccgtggtgggcgccggcgcctcagctgctgctgtacggcgacgcgctgggccaggggaaggtgccgccggagcaggcgccgtgccgggaggcacggttccaggtcgtgccgggagcgcaggcgccgctgggtcctccggtgcagccgccagcgaaggctgctgccgagaggggcctccctgaagtcctcaagttctccgtggcgcaaggtaaaggggagaaaggttctgagcactctgccagtgttgctttgccatccccatttgcgatctacaatggtcgttttgagctgggccttggtcaatctacggtttctgttaatagtccttatgttgaccaacactgtggcctgctttcttcctatccagtgggagcaatgcctggagggtgcatgcgcataccacttaatatgccaacagaagcaccaatatatgtgaatgctaagcaatatgaaggcattcttcgtcgacgccgtgcccgtgccaaagcagagagggaaaataggctggtgaaagccaggaagccatatctccatgagtctcgccatctgcatgcactgcgtcgcgcaagaggctctggtgggcgtttcctgaacacaaagaaagagtccaacacgaaggatgctggtggagacggcaaggcaatgttcagcaacccgcttatgcgccaggtggcatctccaagttcagagatccagcagtcagacctgggcaacccgagcagcgtctccagtctgtcgggatcagaggtgtcaagcatatatgatcatgaagatgtggatcacttccacagctttgatcacatccgcactccttttttcaccccgctcccgagcatcatgggcagtgagcatggggtcggtaaccccttcaagtggccaatagcctctgaaggctgttgtgacctcctcagagcatgactagaggggttaccggacagccgaatgctaggaactggcgacaaccagcagatgctgctggatgttaccagctccgggccagggattgtccctcccatcgtttggctgtcggtaggcaattcattcttggctgaaggcattgtggttgtctctgctcatcgcctaattctcctagaatttctatttctgggatcttgtgatgagtggaacacccgtgcccccaaaaatgctggtagtactaagcttccagcatcaaactcgttttgcactagcaggtttcagtgttgttttttgaataaagcctgaaactttggactcgtttgaagtttcagaggtactggaagtggattatgtttggaatttgattgtgtgtcaagacttggctttgttagtgatgaattgtgatgtgcttgaagcttgtgtggacatggtttgtaatatgtggtttgttgaaagtttgaactcggtaatgtaatgatgtatttgactag

SEQ ID NO: 8574 - protein, 329 aa, Panicum virgatum
  misc_feature: Ceres CLONE 2009325
  misc_feature: Great-hit functional homolog of the protein sequence given in SEQ ID NO 9219
  misc_feature (1)..(57): Pfam Name: CBFB_NFYA Pfam Description: CCAAT-binding transcription factor (CBF-B/ NF-YA) subunit B
  misc_feature: Useful for making plants with altered alkaloid content
MMSFRSHEGFGQVPAGATSNGAAVPWWAPAPQLLLYGDALGQGKVPPEQAPCREARFQVVPGAQAPLGPPVQPPAKAAAERGLPEVLKFSVAQGKGEKGSEHSASVALPSPFAIYNGRFELGLGQSTVSVNSPYVDQHCGLLSSYPVGAMPGGCMRIPLNMPTEAPIYVNAKQYEGILRRRRARAKAERENRLVKARKPYLHESRHLHALRRARGSGGRFLNTKKESNTKDAGGDGKAMFSNPLMRQVASPSSEIQQSDLGNPSSVSSLSGSEVSSIYDHEDVDHFHSFDHIRTPFFTPLPSIMGSEHGVGNPFKWPIASEGCCDLLRA

SEQ ID NO: 8575 - DNA, 1944 bp, Panicum virgatum
  misc_feature: Ceres CLONE 2009458
  misc_feature: Encodes the peptide sequence at SEQ ID NO. 8576
ctacattgatcatatataggcaagctacttatatgatatgtggtacgttcctttctagtaccagctgctgctccgagtttctgtcctgctgtttcccaatcttccttcttcttgttcccagagagctacatggtctagttgttgttcctcaagcacatgccgctctagtttcttcttgcacaaaacactccgattgttgcaggtttactaccaattttccagtattcagctcctgttccttgcataaactttgctgggccgatgtccaagaccgagagcagaaagctgtccgacgactatgaagtcgtggatgttcttggccgaggtgggttctcgatagtgagaaggggggtgagcaagtcggaagggaaggcccaggttgccatcaagaccctgcgcaggctcggtccggcgacgatggggacgaagcaagggctcaagggtggcctccctatgtggaagcaggcgtccatctccgacgcgctgctcaccaacgagatcctcgtcatgcggaggatcgtcgagaacgtcgcgccgcaccccaacgtcatcggcctgcacgacgtgtacgaggacgcgcacggcgtgcacctggtcctcgagctgtgctccggcggcgagctgttcgacaggatcgtggggcgcgaccggtactcggagttcgacgcggcggccgtggttcgtcagattgctagaggcctggaggctctccacaaggcgaacatcatccacagggacttgaagccggagaactgcctgttctctgacgcaaatgaggattccacgttgaagatcatggatttcgggctgagctctgttgaggatttcagcgacccgattgtgactctgttcgggtccatagattacgtctcgccggaagctctctcaaggcaagatgtttcagctgcaagtgatatgtggtctgttggggtgatcctgtatattcttttatctggatgcccaccatttcatgccgcaacgaatcggggaaagcagcaaaggatcctgcatggggagttcagttttcaggaccatacatggaaaacaatatcttcaccagccaaagaattgatttccagtcttctttctgtggagccttacaagaggccgacagcaagtgatcttctgaggcatccttgggtaataggggactgcgcaaagcaagacctcatggatgcagaagtggtatcaaaactgcagaggttcaacgctagaaggaaactgcgggcggcggcgatagccagcgtccttagcagcaaggtggcattgaggacaaagaggctgaggaaccttttaggaacccatgacctcagctcagaggagctggacaatctacgggttcattttgcccgaatatgcgcagacggggagaacgcgacgctggcggagttcgagcaggtcctgaaggcgatgaagatggacccgctgatccctctggccccgcgcgtgttcgacctcttcgacaacaaccgcgacggcaccgtggacatgagggagatcctctgcgggttctccagcctcaggaactcccgaggcgacgacgccctccggctctgcttccagatgtatgacaccgatcggtcaggctgcatcagcaaggaagagctggcgtcaatgctgcgagcactgccggaggactgcctcccgggggacatcacggagccggggaagctggacgagatgttcgacgagatggacgccaacagcgacggcaaggtgaccttcgacgagttcaaggcggcgatgcagaaggacagctccctccaggacgtcgtcctctcctccctgcggccggcgccgtagatcatcggggattcgtctttctttttgttcttcttggagaaacagaacactttttgacgccgtgctattctgtctgaacttttgtgtccctcccgggcggctgtgttggttggttaggaaacgcgctcagacttggtcctc

SEQ ID NO: 8576 - protein, 513 aa, Panicum virgatum
  misc_feature: Ceres CLONE 2009458
  misc_feature (1)..(510): SWISSPROT Homolog: EC 2.7.11.17 Calcium and calcium/calmodulin-dependent serine/ threonine-protein kinase
  misc_feature (6)..(511): SWISSPROT Homolog: EC 2.7.11.17 Calcium and calcium/calmodulin-dependent serine/ threonine-protein kinase DMI-3
MSKTESRKLSDDYEVVDVLGRGGFSIVRRGVSKSEGKAQVAIKTLRRLGPATMGTKQGLKGGLPMWKQASISDALLTNEILVMRRIVENVAPHPNVIGLHDVYEDAHGVHLVLELCSGGELFDRIVGRDRYSEFDAAAVVRQIARGLEALHKANIIHRDLKPENCLFSDANEDSTLKIMDFGLSSVEDFSDPIVTLFGSIDYVSPEALSRQDVSAASDMWSVGVILYILLSGCPPFHAATNRGKQQRILHGEFSFQDHTWKTISSPAKELISSLLSVEPYKRPTASDLLRHPWVIGDCAKQDLMDAEVVSKLQRFNARRKLRAAAIASVLSSKVALRTKRLRNLLGTHDLSSEELDNLRVHFARICADGENATLAEFEQVLKAMKMDPLIPLAPRVFDLFDNNRDGTVDMREILCGFSSLRNSRGDDALRLCFQMYDTDRSGCISKEELASMLRALPEDCLPGDITEPGKLDEMFDEMDANSDGKVTFDEFKAAMQKDSSLQDVVLSSLRPAP

SEQ ID NO: 8577 - DNA, 639 bp, Panicum virgatum
  misc_feature: Ceres CLONE 2009636
  misc_feature: Encodes the peptide sequence at SEQ ID NO. 8578
acgtcgaagaaaaccaggactagaagcgatcggacatcggggtaaggcgagcaaggcacggcgaggcgacgacagcgccatgagctaccagaaggtcccggagtcctacccgccgccagggtactcgcagccgtacccgccgccgggcagtcagtatccacctccccaggctccaccgcaggggccttactacccgccgcagcagcagccacctccggggtaccagggctacttcaacgacgggcagcagccctacggatatccgccaccgcatggtgggcatcaccaccacggccaccaccatcactatgatgaccaccatcatcaccaccatcaccatggtcaccaccatcaccacgaggaggatgactgctgcctcggcttcctgaaaggatggttggccgctctttgctgctgctgcatactggacgagtgctgcggctgctgtttctgacgtatatgcctttgaagcctcctcgtgtctggcatccttggacagcaaaatttgtctctgtatttaacttgctatgattgttggatagtataaaagtgaatcttagttgtcttaaggacagcaaaatttgtctctgtatttaacctgggtacgatgataagtgagcaagggtcgggtcgtcacct

SEQ ID NO: 8578 - protein, 124 aa, Panicum virgatum
  misc_feature: Ceres CLONE 2009636
  misc_feature (125)..(156): Pfam Name: Cation_efflux Pfam Description: Cation efflux family
  misc_feature (45)..(70): Pfam Name: HATPase_c Pfam Description: Histidine kinase-, DNA gyrase B-, and HSP90-like ATPase
MSYQKVPESYPPPGYSQPYPPPGSQYPPPQAPPQGPYYPPQQQPPPGYQGYFNDGQQPYGYPPPHGGHHHHGHHHHYDDHHHHHHHHGHHHHHEEDDCCLGFLKGWLAALCCCCILDECCGCCF

SEQ ID NO: 8579 - DNA, 1036 bp, Panicum virgatum
  misc_feature: Ceres CLONE 2009665
  misc_feature: Encodes the peptide sequence at SEQ ID NO. 8580
aacctcacacacgtctgcgcagtgcgcggcgcggttcgctccgcgttccgatctcgggcggtgcttgccagcagcgcgcggcgcgatggactccgtcggcggcggcggcgccgaggtcgtctacagctgcggctacttccggctgtacagggacggccgcgccgagcgcgcccgcgccgcgtgccacacggcgcccgccggcttcgacgccgagacaggcatcacctccaaggacgtcgtcatcgacgctgccacgggcgtcgccgcgcggctctacctaccgagcgtccggcaggttgcggccacggcgaagctcccggtcctcgtcttctaccacggcggctacttcgtcgtcggctcgccctcgaaccccctcttccaccgctacgtcaactcgctggccgctgccgcccgcgtcgtcgccgtctccgtccgctaccgcctcgcgccggagcacccgctcccggcggcctacgacgactcctgggccgcgctcacctgggtggcgtccggcgcggacccatggctgacggaccacggcgacctcggccggctcttcctgtccggtgtcagcgccggcgcgaacatcgcccacaacatggccgtcgccgcgggcgtgggcggcctgcgcgccgggacgctggcgtgcgtccaaggcgtgatcctgctccacccgtcgttcgccggcgagcagaagggggaagaagaggacggggagttctagcgagcgaacaaggacaggtgggcggtgatcttccctggcgcgagcggcgggctcgacgacctgatgatcaacccgatggcggccggcgcgccgagcctggccaagatggctgtcaagaggctggtggtaaggacgaaaacgtatcggatacggacggatattactaatatcgtatttgttttcatatttgtattcgaatacggagtcggatatggatagtgttagtttttgtcgaataaaattgtaatggatatcgacatcataaaaatataatttttgagcattcgaatagaaaaaaaaaaaaaaaaaaaa

SEQ ID NO: 8580 - protein, 212 aa, Panicum virgatum
  misc_feature: Ceres CLONE 2009665
  misc_feature (1)..(133): Pfam Name: Abhydrolase_3 Pfam Description: alpha/beta hydrolase fold
MDSVGGGGAEVVYSCGYFRLYRDGRAERARAACHTAPAGFDAETGITSKDVVIDAATGVAARLYLPSVRQVAATAKLPVLVFYHGGYFVVGSPSNPLFHRYVNSLAAAARVVAVSVRYRLAPEHPLPAAYDDSWAALTWVASGADPWLTDHGDLGRLFLSGVSAGANIAHNMAVAAGVGGLRAGTLACVQGVILLHPSFAGEQKGEEEDGEF

SEQ ID NO: 8581 - DNA, 1827 bp, Panicum virgatum
  misc_feature: Ceres CLONE 2009711
  misc_feature: Encodes the peptide sequence at SEQ ID NO. 8582
acgagtcccatctcttgatcttcccttccatcctctcccttccgttgccggcggaggaaacaaacgaaccagccagcggacccgatccccacccccgacgccaaggccgccgccgggagccgcttcctcttcccccggccccccgcggcgagacgaccgcgccggcgcccgtccgatccgagcacgcgtgtccccctttgttctattataagctatagatgattccatgggaactccagacgaaatgatggcatactcttccctgtccaaaatcgataccagccagaaccagagagctgctctgtccaatggagctgctggaaacaactatccagctcacgattatctctatgagccatcatttgaaccagacttcccagagtacgattcacgggatgacccattcaccccaacacgggctagtacaaaagttgatctgaagagtgttcttggaggactggtttcaatcgtcacgggtgcaaacaagagtgaggatgatgcatcacggaagcaaagtttcagcacagacatctcgtttcttggatctgacaagaatggcgatttcgatgtgcatccatccgtctgtgttccaagtgcaccgccgctacttgaagcaaacgctttgcaatatagtgcatacagggaggtgttgcttgcggatccaccagattggttgccagatagctctgctaatgcgtgcctgcagtgcaacttgcctttcacagctctgactcgtggaaggcaccattgccggttctgtggaggtatattctgcaaagattgttccaagggaaggtgtttgctgcccatgaaattcagaattcgtgatcctcagagagtttgtgatgcttgctacgagaggctcgatccacttcagggcttattgatcaactataatagtaactccatgcagccagcaaaacacgatgtcacggattggacaagcactagaagctggttgaacatgcctgtcggtgtatcaatggagtatgaaatatacaaggccacaaacacaatgaagaaatattgtcaggttgcaaggttaaaccctgagaagtccatcccatcatctattctcaagggagcaaagggacttgcaattctaacagttgccaaggcgggtgcagttgtaacatacaaagttggcactggtcttgtagttgctcgcagatcagatggatcatggtctgccccgtcagcaattttatctgttggactgggatggggagtacagattggtggagaactgacggactttatcattgtgcttcatgaccgtaaagctgttaaggcattcagcagtcgcattcatctttctcttggggcaggattaagtgctgcagctgggccaataggcagagcctttgaggcagatgttcgggccagtgagaaaggttctggaatatgctacacttacagctgcagcaaaggtgcgttcgttggggtttcactggaagggaatgtcgtgacaaccagatcagacaccaatcttcgtttctatggcgatgcttacctgaccacaactgacatcctgtttgggagagtggagaggccccgagccgcccagcccctgtactcagctctagacgatcttttctccagaatggtctgctagtccatttagattggtgcaatactctgctgcatgcccacggtcgttagcttgcagccatgagccatgtacataaacagagcataccaggaaaatcctaaaaaaaagaaagatgccaggaaaaaaaaagtgtacagcttttgttggatggtttgcactttcactgcagtacttgatatccagtcgacacttgtaaatattagcagaatatttgg

SEQ ID NO: 8582 - protein, 462 aa, Panicum virgatum
  misc_feature: Ceres CLONE 2009711
  misc_feature (1)..(69): Pfam Name: FYVE Pfam Description: FYVE zinc finger
MGTPDEMMAYSSLSKIDTSQNQRAALSNGAAGNNYPAHDYLYEPSFEPDFPEYDSRDDPFTPTRASTKVDLKSVLGGLVSIVTGANKSEDDASRKQSFSTDISFLGSDKNGDFDVHPSVCVPSAPPLLEANALQYSAYREVLLADPPDWLPDSSANACLQCNLPFTALTRGRHHCRFCGGIFCKDCSKGRCLLPMKFRIRDPQRVCDACYERLDPLQGLLINYNSNSMQPAKHDVTDWTSTRSWLNMPVGVSMEYEIYKATNTMKKYCQVARLNPEKSIPSSILKGAKGLAILTVAKAGAVVTYKVGTGLVVARRSDGSWSAPSAILSVGLGWGVQIGGELTDFIIVLHDRKAVKAFSSRIHLSLGAGLSAAAGPIGRAFEADVRASEKGSGICYTYSCSKGAFVGVSLEGNVVTTRSDTNLRFYGDAYLTTTDILFGRVERPRAAQPLYSALDDLFSRMVC

SEQ ID NO: 8583 - DNA, 989 bp, Panicum virgatum
  misc_feature: Ceres CLONE 2009870
  misc_feature: Encodes the peptide sequence at SEQ ID NO. 8584
atcgaggaggggaccccagccataagtggatatcctcccttcctgggtgcctcatcctttcctcctccctcgcgtggtttgtgacccatggaggagaaccaagagaagtctgctgaggggagcggcggcggcggcggacgggggccggttcgaacgatctgcgtcttctgtggcagcaggccggggaaccggccgtccttcagcgcagccgcgctcgacctcggaaagcaactggtcgagaggcagatcaacctggtgtacggcggcggcagcggcggcctgatgggcctggtgtccaaggccgtctacgagggcggccgccacgtcctcggggtcatccctagcgcgctcctgcctgaagaggtgtcaggggagacattgggggaggtgaaagtggtcagggacatgcatgagcgcaaggcagaaatggcgaagcacgccgacgccttcatcgcgctgccaggcggttacgggacgatcgaagaactgttggagatcatagcgtgggcgcagctggggatccacaacaaaccggtggggctgctcaacgtggacggctactacaacagcctgctctcgctgttcgacaagggcgtcgaggagggcttcatcgacgccaaggcgcggaacatcttcgtcctcgcggacaccgccgcggagctcctcaccaagctcaccgaggcgaggctggcggccgaggacgaggatgccgccgccggaggaggaggagaagaagaagagaaggccgccgccgccgctggcgtcaagaggaaaagaagctactagaacattatcatcatgtgtttctcaggccatctatggatccatccatatatgctcttctgttgtttccttgatttggagcttgttgttttaatttctactgtactctcctagatttcattcccgcaatgtgtggatccggcaaccagctagcaagcagttgctaattaattaaccttgcgaagcaaaaaaaaaaaaaaaaaaaa

SEQ ID NO: 8584 - protein, 232 aa, Panicum virgatum
  misc_feature: Ceres CLONE 2009870
  misc_feature (1)..(134): Pfam Name: Lysine_decarbox Pfam Description: Possible lysine decarboxylase
MEENQEKSAEGSGGGGGRGPVRTICVFCGSRPGNRPSFSAAALDLGKQLVERQINLVYGGGSGGLMGLVSKAVYEGGRHVLGVIPSALLPEEVSGETLGEVKVVRDMHERKAEMAKHADAFIALPGGYGTIEELLEIIAWAQLGIHNKPVGLLNVDGYYNSLLSLFDKGVEEGFIDAKARNIFVLADTAAELLTKLTEARLAAEDEDAAAGGGGEEEEKAAAAAGVKRKRSY

SEQ ID NO: 8585 - DNA, 924 bp, Panicum virgatum
  misc_feature: Ceres CLONE 2010009
  misc_feature: Encodes the peptide sequence at SEQ ID NO. 8586
accagagccgccgttctctcttggcggtgtctctccggcggagcagggagcagcggctcgtccctcaccgcgcgaggagctggcacctggcgtggagggcgcaggagaagacagaggatgagggccgtggtgcagcgcgtcctctcggccagcgtcgaggtggaggggcgagtagtgtcggcgatcggccctggactcctcatactcgtcggcgtccacgaggcggacaccgactccgacgccgactacatttgtcggaaggtcctcaacatgaggctatttcctaatgagaagactgggaaagcatgggatcaaagtgttatgcagcgtagctttgaagtcctattagtcagtcagtttacattatatggcatcctgaagggtaacaagccagattttcatgtggctatgccacctgcaaaagcaaaaccgttctatgcttctctagtcgaaaaatttcagaggtcatactcggccgattcagtgaaagatggcatttttggagcaatgatgaaggtttctttggtaaatgatggcccagtgacaatgcaagtcgattcaccctcactgcaaggcgctgctcagtcaagcaacgacgatgatggtttgcttagagatggtgaagcaagagtacctaaagagacatgctaaattccctgatcaatgttctccgttacattatgctcatgcagaattttgactttggggttggagctgaaagaagacatatgctgtgcttctctctgacttgttgatccctgaggaatatcaatcttgatttttgttacaagttgacatggatcctgtcatttgcactcaaatttatgtaaaccttttagatgtttgtcattggaagtcacttccaacattgtaacaggcagtccagactaattgcttgttatccaaaaaaaaaaaaaaaaaaaa

SEQ ID NO: 8586 - protein, 177 aa, Panicum virgatum
  misc_feature: Ceres CLONE 2010009
  misc_feature (1)..(147): Pfam Name: Tyr_Deacylase Pfam Description: D-Tyr-tRNA(Tyr) deacylase
MRAVVQRVLSASVEVEGRVVSAIGPGLLILVGVHEADTDSDADYICRKVLNMRLFPNEKTGKAWDQSVMQRSFEVLLVSQFTLYGILKGNKPDFHVAMPPAKAKPFYASLVEKFQRSYSADSVKDGIFGAMMKVSLVNDGPVTMQVDSPSLQGAAQSSNDDDGLLRDGEARVPKETC

SEQ ID NO: 8587 - DNA, 985 bp, Panicum virgatum
  misc_feature: Ceres CLONE 2010121
  misc_feature: Encodes the peptide sequence at SEQ ID NO. 8588
cctggcccgacgacgcccccatttcgaggctcctccttgcgattccaatccccgcccgcctcctccgcctccgcgtccgcctcgcgcagggtttggcttatagtagtcatggaacacaaggagacgggctgccagcaaccggagggcccaatactatgcatcaacaactgtggcttctttggcagtgcggccaccatgaacatgtgctccaagtgccacaaggagatgataatgaagcaggagcattcccagctggctgcctcctccattgatagcattgtcaatggcggtgatggtgggaaaggccctatcatagctgcaaccgcagaggtggcggttgctcaagttgaggagaagactattgttgtgcagcctccatttgtagctgaaaccagcgaggctgctgccattatccccaaggccaaggaaggtccgaaccggtgcgcaacctgtaggaagcgggttggtctgacgggattcaactgccgatgcggtaacatgtactgtgcgttgcaccgctactccgacaaacatgactgccagtttgactaccagactgcagctagggatgcgattgccaaggccaatcctgtggtgaaggcggagaagcttgaaaagatctgaagggggcaatggggaacgaaatgggttgcgatctgcaagattcaatcatgcatctttgctgctttatcattgaacatcccattcttgtttgctgccacatccctgagtcgttcaacactatgatgctcacgcatcctggcagctgcaagaagtcatcctcagtcgagtccaaaatggtttgcgtgttggctatgttgtgtaagcttattcagttattcatggtggtttcagtcggtattgtggcatttccatttaggtagctctgtaatgtactactgtctcatgcgtgttacattccaatcagtaatagtaatcagcaatggtctgcaatatttcctcttaaaaaaaaaaaaaaaaaaaa

SEQ ID NO: 8588 - protein, 171 aa, Panicum virgatum
  misc_feature: Ceres CLONE 2010121
  misc_feature (1)..(41): Pfam Name: zf-AN1 Pfam Description: AN1-like Zinc finger
MEHKETGCQQPEGPILCINNCGFFGSAATMNMCSKCHKEMIMKQEHSQLAASSIDSIVNGGDGGKGPIIAATAEVAVAQVEEKTIVVQPPFVAETSEAAAIIPKAKEGPNRCATCRKRVGLTGFNCRCGNMYCALHRYSDKHDCQFDYQTAARDAIAKANPVVKAEKLEKI

SEQ ID NO: 8589 - DNA, 713 bp, Panicum virgatum
  misc_feature: Ceres CLONE 2010184
  misc_feature: Encodes the peptide sequence at SEQ ID NO. 8590
aaagcacacagccacaaacactcacatacttgaggactatactagctggcacatccaagtttagcttatctacttttcaccttcaagctcgatccagagaaaccaagaagacgacggcgatggcggagagggtgtcgaggctgtcgacggagaaggcggtggtgatcttcacgaggagccagtgcccgatgtgccacacggtgtcgagcctcttctccgagctcggcgtgtgcgcggcggtgcacgagctggacaaggacccgcgcggccgcgacatggagcgggagctcgcccgccgcctcggccgcgcgctgccggttcctgctgtcttcgtcggcggcaacctcgtcggttccaccgacaaggtcatgtcgctgcacctcgccggcaagctcgtgcccatgctgaaggccgccggcgccatatggctctgaagtctgaatcctacatccatcggcgacagcaactatatatataaatctctcgctccgatccagtattgttcagttctccaatatagttcccaaatcccaacaagaatatatgataagttttgttcagcggctagtgtaaccacttgcagggctgataagggtctggaatgaccagtccgtgtctttgaatgtacatggacatatgtaaacctgacctttccaggattttcagagtgagatatgatgtggactttgagttaaaaaaaaaaaaaaaaaaaa

SEQ ID NO: 8590 - protein, 104 aa, Panicum virgatum
  misc_feature: Ceres CLONE 2010184
  misc_feature (1)..(65): Pfam Name: Glutaredoxin Pfam Description: Glutaredoxin
MAERVSRLSTEKAVVIFTRSQCPMCHTVSSLFSELGVCAAVHELDKDPRGRDMERELARRLGRALPVPAVFVGGNLVGSTDKVMSLHLAGKLVPMLKAAGAIWL

SEQ ID NO: 8591 - DNA, 756 bp, Panicum virgatum
  misc_feature: Ceres CLONE 2010291
  misc_feature: Encodes the peptide sequence at SEQ ID NO. 8592
caccagagggcagcgggcgaagcgcagcccaggcgcgaacccggagacgagcccgcgccgccgtcctccccgatcgcctctgccccgccgatctgctcccaagagcaagaggtcccgtgtcccaggccggagtagatccatggctctgccgtcgaggctggcgcagctgcaggcgaaggcgtgcgaggcgacgcggttcgccgcgaagcacgggtgcgcgtaccagcgatcgctcgtcgagaagaacaagaagtacgtcgtggagccccccaccatcgagaagtgccaggagctctccaagcagctcttctacacccgcctcgccagccttcctggtcgctacgaagcattctggaaagagcttgatcaagtgaagcagctgtggagaaacagaaatgatctgaatgttgagcacgctggcgttgccgcgctctttggcattgagttgtacgcttggttctgtgtcggtgagatcgttggcagaggatttactctcacaggataccacgtctgaatgctaagcaacaaaatcagtccccttttggctgatataatgacttgttaggcagcccattttttttttttgaccagatgcgcagttttgttttagagatattcttgatgctgtatggaatgcacgcatctcggtgaaaccgaacaataatctgctgcatcgtggtttatgtctacggtacattacttttttccttctaatattattgatgccgttgctcttaaaaaaaaaaaaaaaaaaaa

SEQ ID NO: 8592 - protein, 124 aa, Panicum virgatum
  misc_feature: Ceres CLONE 2010291
  misc_feature (1)..(115): Pfam Name: ATP-synt_G Pfam Description: Mitochondrial ATP synthase g subunit
MALPSRLAQLQAKACEATRFAAKHGCAYQRSLVEKNKKYVVEPPTIEKCQELSKQLFYTRLASLPGRYEAFWKELDQVKQLWRNRNDLNVEHAGVAALFGIELYAWFCVGEIVGRGFTLTGYHV

SEQ ID NO: 8593 - DNA, 2092 bp, Panicum virgatum
  misc_feature: Ceres CLONE 2010348
  misc_feature: Encodes the peptide sequence at SEQ ID NO. 8594
gcttccccagacagttcgagactctgcccaacgtcagcaccccggaccccagacgatcaaagacacactcggagccgcagaccagcaacgcttcctgtctgtggaatacccagtacaaagttgactcgcacactctacaccaaggacgacgctcccagatcagcacagagagacgccgattctcgatcaacgtcgacgacgattttccccggctgcatgcattttgtgcagctcgattgggagaacacaacggacagcataaggcagatattaggcgcttgagaactccgcgtggaggacggtcacatgcagcgggcaaagtctgcagtggatttctccagcctgctgaacccagaggtcgcggccgagaggaatccgatcttgccgcttcagcagcaaccggtgcaaagccaagaacaacagcccgaagccgacatggctgccgtcggcatgatccgccccaacggaccccttcccgcgggtggcccccctgccgagcagcccaccgagctcccgcggccttacaagtgcaccatgtgtgacaaggcgttccaccggttggaacaccagacccggcacatccgcacccacaccggggagaagccgcacgcctgccagttcccgggctgcagcaagcggttttcgcggtccgacgagctgacccgccactcgaggatacacaacaaccccaactcgcggagaggccacaagggccatgcccagcacgccagcatggtccacaggatgccgcccgagatcatggcgccgcccccgggacccaagatgatccgctcggcgccgcccaccgccctaccctcgcccaacgtctcgccgccgcactacagctcttacaacctcaacctgccgccgccgttgaaccttggggggccgtacaaccgcaacgccctgggcagccagagcgggccggacatggccatgctggcccgggccgccggccagattgagcgggacaacgcgcccggcccgcaccactacccgccttcgaggcagcatccctactacagcggtggcctgcactcggcgcggaacccgctgcccggtctcggggcgtaccacatgtcgcgctcgcacgcgaacgacgaccatgacgaccactacgcgcacgcctaccggcagccaaagaggtcgagacctaactcgcccaactcgacggcgccttcgtcccccacgttttctcacaattcgctgtctccgacgccggaccacaccccactcgccacgccggcccactcgccccgtctccggccctacagcgggatcgagctgcccccgttccgcaaccttagtttgcaccacactcccgccctcgccccgctcgagcccgcgcccgagggtcttgccccgcctccgcagcccgcgccaaggagtagtggcatctccctgaccgatatcatcagccggcctgacggcacgcagcggaaactgcccgtacccaaggtcgccgtccacgacctcctgggcccgaccgacgggttccctcctagcggcaggagctcgtcgtccaacagcatcgccggcggtgacctctacgacaggttgtgattgtgacgagcgggcaccgcgacattcgcttttcaacagcctccgaagacatgactcatgatgactgtgggcaaactatagaggatatataagcactcggcgtttgttggtttttctgtttggcgtgttcccggttgggacgcaactctactcctaatattggcttgacagccttggaaatcaacacagcggacatttctgggattcgggacacttagacatcaccacttcttcttttgggcggatagacttgttttcttttctacatgcagttcctccaatgcggagcaacgacacaaaacactaccttgttttctttgtttctcggcggggattggcggggctccagagaatgcgacagcatcagcaaactcgtttcatatgtggcgaaaaaacttgatagacggttgggcaagcggttcactgggatttggcagcgaggtcttcgcattctgttgtgtatttttcacattgcttttatctaggtatttaccttggtaatacccaccaaacccttctgatgggatgc

SEQ ID NO: 8594 - protein, 418 aa, Panicum virgatum
  misc_feature: Ceres CLONE 2010348
  misc_feature (1)..(25): Pfam Name: zf-C2H2 Pfam Description: Zinc finger, C2H2 type
MQRAKSAVDFSSLLNPEVAAERNPILPLQQQPVQSQEQQPEADMAAVGMIRPNGPLPAGGPPAEQPTELPRPYKCTMCDKAFHRLEHQTRHIRTHTGEKPHACQFPGCSKRFSRSDELTRHSRIHNNPNSRRGHKGHAQHASMVHRMPPEIMAPPPGPKMIRSAPPTALPSPNVSPPHYSSYNLNLPPPLNLGGPYNRNALGSQSGPDMAMLARAAGQIERDNAPGPHHYPPSRQHPYYSGGLHSARNPLPGLGAYHMSRSHANDDHDDHYAHAYRQPKRSRPNSPNSTAPSSPTFSHNSLSPTPDHTPLATPAHSPRLRPYSGIELPPFRNLSLHHTPALAPLEPAPEGLAPPPQPAPRSSGISLTDIISRPDGTQRKLPVPKVAVHDLLGPTDGFPPSGRSSSSNSIAGGDLYDRL

SEQ ID NO: 8595 - DNA, 1047 bp, Panicum virgatum
  misc_feature: Ceres CLONE 2010366
  misc_feature: Encodes the peptide sequence at SEQ ID NO. 8596
aaaatatctcgccgttcccatggacatagaccacttcgccgacatcgaccttgacgccctactcgcctccttctccggcgatcccgccgccgtctccgacctcatcgtaccctcccctcctccgccggcgccggcgacggcgcacgatgcggaggcggggtcgccggagtcggtgacctcccgggcgagcccgcccggggaggtggctctgacggagatcgagaggttcctgatgcaggagggggatgcggagttgggaagggaggtcgaggggttcagcgtggatgagttcttcgacgcgctgtacgacggcggggagggggagggaaaggagagcgaggctggtggaagcacggatggtggctccggaggggatgaggtggtggatgttgtgacgccggagacgcagacggtggaggtggatggcgatgatcccgtcagcaagaagaagaggaggcaaatgaggaacagagattctgccatgaaatcgagggagaggaagaagtcctacgtcaaggatttggagacgaagagcaagtatttggaagcagagtgccgtcgtctcagctatgcacttcagtgctacgcagctgagaacatggtactgcgccagagcttgttgaaggataggcctgttggtgctcccacagccatgcaggagtctgccgtactcacggaaaccctgccgctggtttcgctgctatggctggtgggcatcatgtgcctgttcctgatgcccggtctgcccaaccgaagtccagctgctccaagcagcgccggaagagatctcgggatggtagccggaaagacaagcagtgaaaacccagagatagtggaacttatcctccatggaaggcgctgcaagggcacaaaggcaaaaatcaagctagcattaccatttcatccagtagctgcttgctaggcattccataggcctcttgcaagcctccagtatgtagtgtacttgccaagcttaacatgccgctatatatgtgtcatgcaggcatgcagcagccagttgatatccaaaaaaaaaaaaaaaaaaaa

SEQ ID NO: 8596 - protein, 300 aa, Panicum virgatum
  misc_feature: Ceres CLONE 2010366
  misc_feature: Great-hit functional homolog of the protein sequence encoded by LOCUS At1g42990
  misc_feature (1)..(55): Pfam Name: bZIP_2 Pfam Description: Basic region leucine zipper
  misc_feature (1)..(65): Pfam Name: bZIP_1 Pfam Description: bZIP transcription factor
  misc_feature: Useful for making plants with modulated nitrogen use efficiency
MDIDHFADIDLDALLASFSGDPAAVSDLIVPSPPPPAPATAHDAEAGSPESVTSRASPPGEVALTEIERFLMQEGDAELGREVEGFSVDEFFDALYDGGEGEGKESEAGGSTDGGSGGDEVVDVVTPETQTVEVDGDDPVSKKKRRQMRNRDSAMKSRERKKSYVKDLETKSKYLEAECRRLSYALQCYAAENMVLRQSLLKDRPVGAPTAMQESAVLTETLPLVSLLWLVGIMCLFLMPGLPNRSPAAPSSAGRDLGMVAGKTSSENPEIVELILHGRRCKGTKAKIKLALPFHPVAAC

SEQ ID NO: 8597 - DNA, 1087 bp, Panicum virgatum
  misc_feature: Ceres CLONE 2010471
  misc_feature: Encodes the peptide sequence at SEQ ID NO. 8598
aactcactccggcctccagctattgcagagcgagctccgagtccagcggctaacccaccagcttccctgttctcactggctagctagctagccagccaggcagagcaagcccccggtggacgcacacgagacgctagcttagcttcgtcgtcaagcttactagcctccgatcctgctgcctgcgagaagtgttgctttgcttgatcccgccggcagcgacgtacgacgacgacgagagagctgagcgagcgaggatgtcgagccggaggtcgtcgcgtggcaacatctccgaggacgagatcaacgagctcatctccaagctccaggccctgctccccagctcccgccgccgcggctccggccaggcgtcgacgacgaagctgctcaaggagacctgcagctacatcaagagcctccaccgggaggtggacgacctgagcgaccggctctcggacctcatggccaccatggacagcaacagccccggcgcggagatcatccgcagcatactccgctcctgatcgcgccttcgtgcgccgcgggtagcgccggcctgctcgccggccggccgcgaggggaggtcaacggcgactactacgacggccgcgcgcggccattctccggccggccacgtgcgggctcaattagctagctagggtatatataaaatatatatatctacaaatatgtgtatctttctcttcttcctttcactacctgtcgatctccctagatctgagatcatgtggctagccccataccaaaatgtactagctgcacgcacgcgtatgctgatctccctgctaagcttcaccgggtagctaggacactagcgccagggcctaagcaagctaagctttatccacgcaccccctcctctcactttagctcgccgacccccctctccccctctccatggcgctccatgtgatctctctgtcctccgcgctagctaactcttcttttgatgccccgcttgtatcgttatccgtggcttggatcgagttggctagctctcttcagacaaccgaccgaccactattacctagagcaaattgattatcatcaaaaaaaaaaaaaaaaaaaa

SEQ ID NO: 8598 - protein, 88 aa, Panicum virgatum
  misc_feature: Ceres CLONE 2010471
  misc_feature: Great-hit functional homolog of the protein sequence encoded by LOCUS At1g26945
  misc_feature (1)..(49): Pfam Name: HLH Pfam Description: Helix-loop-helix DNA-binding domain
  misc_feature: Useful for making plants with modulated nitrogen use efficiency
MSSRRSSRGNISEDEINELISKLQALLPSSRRRGSGQASTTKLLKETCSYIKSLHREVDDLSDRLSDLMATMDSNSPGAEIIRSILRS

SEQ ID NO: 8599 - DNA, 1486 bp, Panicum virgatum
  misc_feature: Ceres CLONE 2010586
  misc_feature: Encodes the peptide sequence at SEQ ID NO. 8600
aacaaccaccctgcgtcctcacaaagcctcttcttgtagcctcagcaacaccaccacgcaacccaatccactcttccacattcagagagctccagctccaatggccgccggtgaaggcaagcgcgagacgcgcacggccagcgcggcggcaatgcacgcgtgcgtcggcgtcctccggctcatctgcgtggcgtgcgcgatcgaccggctgtcggggaccgggagcgccccggcggcgctggctgcgctcatggcggcggcggcgctggcggcgtggcggttcgcgaacgccgcccgccccccgccgccgacgccgtgcgggacgcccgggggcccgccggtgacggcgccgagggcgcggatgcgggacgggcggtacctggcgtacgcggagtccggggtgagccgggacagggcgcgcttcaaggtggtctactcgcacggcttctccggcggccgcatggactcgccccgcgcctcccaggagctgctggaggagctgggggtgtacatggtggcgttcgaccgtgccgggtacggtgagagcgacccggacccgcggcggtcgctccggagcgcggcgctggacgtggaggacctcgccgacgcgctggggctcggcgacaggttccacctcgtctgctcctccctcggcagccacgccgggtgggcggccatcaggtacatcccgcaccggctggccggggtggccatgatggcgccggtggtcaactaccgctggcgcgggctgccgcgggggctggcccggcagctctaccggaagcagccggcgggcgaccggtggtcgcttcgcgtcgcctactacgcgccgtggctgctgcactggtggatgagccagccatggctgcccacctccaccgtcatcgacggctccgggaccttccccaacgagctcgacgagaagaaccgcgtcatggcgctctccaacgggatgttccaccagagggcgaggctggcgacgcagcaggggatccaggagtctttctaccgcgacatggcggtcatgttcgggaggtggccggagttcgagccgacggacctcgaggagccgccgttcccggtgcacgtgttccagggcgacgaggacggcgtcgtgccggtgcagctgcagcgccacatatgccggcggctcggctgggtcaactaccacgagctccccggcgtggggcacttcttgtcggcggtgccagggctcggcgacaggatcgtcagcacgctcctggcggcgccgtcgccggcgtaacagctcgaggacggcagcgtctttcgcatcttgcatgtgctagtatatgactgatctgctgtaggtacaagtctagaagcaaaggctgaaggcatttcctgtgagctcaggcgcaggtttagcctctactgtatttgcacaaagaaactgacgagcagaaggggctttttatatatcatgagaagggtatttgactcggtgtaaaaaaaaaaaaaaaaaaaa

SEQ ID NO: 8600 - protein, 387 aa, Panicum virgatum
  misc_feature: Ceres CLONE 2010586
  misc_feature (1)..(230): Pfam Name: Abhydrolase_1 Pfam Description: alpha/beta hydrolase fold
MAAGEGKRETRTASAAAMHACVGVLRLICVACAIDRLSGTGSAPAALAALMAAAALAAWRFANAARPPPPTPCGTPGGPPVTAPRARMRDGRYLAYAESGVSRDRARFKVVYSHGFSGGRMDSPRASQELLEELGVYMVAFDRAGYGESDPDPRRSLRSAALDVEDLADALGLGDRFHLVCSSLGSHAGWAAIRYIPHRLAGVAMMAPVVNYRWRGLPRGLARQLYRKQPAGDRWSLRVAYYAPWLLHWWMSQPWLPTSTVIDGSGTFPNELDEKNRVMALSNGMFHQRARLATQQGIQESFYRDMAVMFGRWPEFEPTDLEEPPFPVHVFQGDEDGVVPVQLQRHICRRLGWVNYHELPGVGHFLSAVPGLGDRIVSTLLAAPSPA

SEQ ID NO: 8601 - DNA, 682 bp, Panicum virgatum
  misc_feature: Ceres CLONE 2010702
  misc_feature: Encodes the peptide sequence at SEQ ID NO. 8602
agcatctcaaacagatcaccagagagaagagagaactcctcgagagagatacagagaaagagcgagcgcagagttaaacagagagctgaaattcaactagtcctgcttgctcttcttccatggagagagttgcatccagctgcgtcggcctcctggctcaaaggagggcctactccgtggccgcggccatggcgaagggagccgggcggagggccgacgagaagacggcggcggctgcggcggccaagcgcgtgatgggcaagaaggaagtgaacaccgctgccgcggcggcggcggagaagacggcgtgggtgccggacccggtgaccgggtactaccgcccggcgggtggcgccaaggaggtggacgcggcggagctgcgctccaagatgctgacgcaggccgccaactgatgaatcgaagtcactttgacttcgcgaaccaagactccatgagttaccagccgaggtagcttgtcttgctttgagattttcgcgctcgttgatcgccggggcaccgtggcctagagcatgagggcgctgtatctttgcagcatatagtagtttcgtcggcgactgcttcatctgatttacgttttgggacatacaatttgcaatcttcttgcctgctggctcgtgaccttcttgactactatacagtccaaaaaaaaaaaaaaaaaaaa

SEQ ID NO: 8602 - protein, 97 aa, Panicum virgatum
  misc_feature: Ceres CLONE 2010702
  misc_feature: Great-hit functional homolog of the protein sequence given in SEQ ID NO 9715
  misc_feature: Useful for making plants with modulated nitrogen use efficiency
MERVASSCVGLLAQRRAYSVAAAMAKGAGRRADEKTAAAAAAKRVMGKKEVNTAAAAAAEKTAWVPDPVTGYYRPAGGAKEVDAAELRSKMLTQAAN

SEQ ID NO: 8603 - DNA, 1790 bp, Panicum virgatum
  misc_feature: Ceres CLONE 2010784
  misc_feature: Encodes the peptide sequence at SEQ ID NO. 8604
atataaagctcttggtgaggtgtgtagctatgtgcaattgtgcatgtgcagtacaagccgaaagagcacatcttgagagacacagatctcaacacactccacagtaacgtctttcacattacacatacacctgcagcagtctcattaccactgttgccatgccaacatcgcgacgagaagcaggacaagaacccgaccaccccaccaccaccatcctacgccgcggcggaggcggcggtggtggcggcgccggcggggacgacgccgccgccggcgacgtcgacggcgccgcgccgaggcaggtgtgggtgcccggcccggtcatcgtcggcgccggcccgtcggggctggcgacggcggcgtgcctcaaggcgcgcggcgtgccgtcgctggtgctggagaaggacgcgtgcgtggcggcgtcgtggcggcaccgcacgtacgagcggctccggctgcacctgccccggtgcttctgcgagctccctctcgcgccgttcccgccgggcacgccgccgtacccgacgcgggaccagttcgtcgcctacctcgacggctacgcgcgggccttcggcatcgagcccaacctcggcgcgcgcgtccgcagcgccgcctacgacgccaccatcggattctggagggtcgccgtggacgagggcggcggcggcgccacggccgcggccacggagttcgtgtcgcggtggctcgtcgtggccaccggcgagaacgcggagcccgcgtggccggagggcgtggaggggatggacggctaccgcggcgtggccatgcacacgagcagctacaagaagggggacgagttcaggggcaagaatgtgctcgtcgtcggctgcggcaactccggcatggaggtcagcctcgacctctgcaacaatggtgccaaggcctccatggttgtcagggacaagcttcatgtgttgcccagggagatactaggcatttcgacatttggcctctctgtgttccttctcaggtggctccccgtaaagcgggttgactctgtgctgctcttcttctcaagattgatccttggagacactgaaaaatacggcctcccacgaccaaagatcgggccacttcaaatcaagagttcaactggtaaaacaccagtactcgacataggagctttgagaaaaataaaaactggagaaataaaggtggtcccagcaatcaaccggttcacagagaatggtgttgagttcatagatgggcacagagaggactttgatgctgtcatcttcgcaaccgggtacaaaagcaacgtgccttcatggctcaaggaggaggaattcttcagtcatgttgatgggttcccaaggaagccattcccacacagttggaggggcaagaatggcctctacgccgcggggttcaccaggaagggcctcatgggcacctcctatgacgctctcaggatcgctggtgacatcgtggaccagtggaccgaggcctttgcaagccccactgctgctcacagaagctgcagtgaccacggtgcttgagacgcacatcattatgacccgtccccataggtgataggtattggtgccgatctctagaatggttatgtttatgatgtcataaatcaaatcttcagctgttaatttttgtttccattttagtttctgtacctgtgagaacttgtgactggagtgcatgatgtgtgtgtatgtgtgataaactctttatgtaatcataagttcataaccgcggcagtggaatataattaaggtgtgtgtagtcttgttgttcaaaaaaaaaaaaaaaaaaaa

SEQ ID NO: 8604 - protein, 453 aa, Panicum virgatum
  misc_feature: Ceres CLONE 2010784
  misc_feature (4)..(44): Pfam Name: FMO-like Pfam Description: Flavin-binding monooxygenase-like
  misc_feature (1)..(36): Pfam Name: DAO Pfam Description: FAD dependent oxidoreductase
MPTSRREAGQEPDHPTTTILRRGGGGGGGGAGGDDAAAGDVDGAAPRQVWVPGPVIVGAGPSGLATAACLKARGVPSLVLEKDACVAASWRHRTYERLRLHLPRCFCELPLAPFPPGTPPYPTRDQFVAYLDGYARAFGIEPNLGARVRSAAYDATIGFWRVAVDEGGGGATAAATEFVSRWLVVATGENAEPAWPEGVEGMDGYRGVAMHTSSYKKGDEFRGKNVLVVGCGNSGMEVSLDLCNNGAKASMVVRDKLHVLPREILGISTFGLSVFLLRWLPVKRVDSVLLFFSRLILGDTEKYGLPRPKIGPLQIKSSTGKTPVLDIGALRKIKTGEIKVVPAINRFTENGVEFIDGHREDFDAVIFATGYKSNVPSWLKEEEFFSHVDGFPRKPFPHSWRGKNGLYAAGFTRKGLMGTSYDALRIAGDIVDQWTEAFASPTAAHRSCSDHGA

SEQ ID NO: 8605 - DNA, 728 bp, Panicum virgatum
  misc_feature: Ceres CLONE 2010807
  misc_feature: Encodes the peptide sequence at SEQ ID NO. 8606
cgcatcgcattctcgctctgttgtgtgactgattgccaagaaggaaacgctctctgcttgtgttccagcctctgaatctcgtgtgaggatgtcgtgctgcggaggcaactgcgggtgcggctccggctgcaagtgcggctccggctgcggagggtgcaagatgtacccggacatggctgagcagggcaccaccaccaccaccacccagactgtcatcatgggcgttgcaccaaacaacaaggggcatgccgagggcgggttcgaggccggcgccggagccgagaacggcggctgcaagtgcggcgacaactgcacctgcaacccctgcacctgcaagtgaggagctcatggccatggccggaccggaggagatctcggaaggacaaaaaagctagtatagcagtgttgtgtatgtgcgtcgttcgtttgtctgaaagtgtgggtggcatgcttagtaacagtgttgcgcgtgctgctagtagatggtactgatgaggaacaataataatgatggtgctgagatgtcgtcggcgtcgccgccgccgtcgtgtccttcctccccggccggtcgggcacctgtggcggtgctctagcagtgtgttgtgtgtgcagcaggccatgctctgatctttgtggtgtatgtgtgcggcctgctgcttagtgtccctagtgtcatgtgtaaccatccatctatatctatctacatccatcttgtgtactaaaaaacc

SEQ ID NO: 8606 - protein, 83 aa, Panicum virgatum
  misc_feature: Ceres CLONE 2010807
  misc_feature (1)..(80): Pfam Name: Metallothio_2 Pfam Description: Metallothionein
MSCCGGNCGCGSGCKCGSGCGGCKMYPDMAEQGTTTTTTQTVIMGVAPNNKGHAEGGFEAGAGAENGGCKCGDNCTCNPCTCK

SEQ ID NO: 8607 - DNA, 1772 bp, Panicum virgatum
  misc_feature: Ceres CLONE 2010819
  misc_feature: Encodes the peptide sequence at SEQ ID NO. 8608
acaggaaggaaggcgagagcttcccgtcccctcccctcccgcagaggctgtaaagggcagctccctcgtggcctgtcgccgcccgcctccactccactcctctccggactcgccggcctggatctgccgctgggctctcatcgctcctgccctgaggggagaccgccgccgcagatgctgcccaccaaccgcggcaggccgcagcagaggccgccgccgcccagatcttggtccttcctctcagagatggtggacttctccgatcccaagcgcaggccgcgctacctcaccaagctcgtcatggccgcgctcctcaccgccatgtgcgtcctcatgctcacccagccgccatgccacaggagggccagccccagcgtgttctccatccgtcaacctggggtcacgcacgtgctgctcaccgggggcgccggctacattggctcgcacgccgctcttcggctgctcaaggactccttcagagtcaccatagtggacgcttacaatacaaactttgggcatcccactctccaggataatctttcgagaggaaatattggcgcgatcaaggttcttcagaacttgttcccagagcctgggcggctgcagttcatacaagctgatttaggagatccaaaagcagttaacagaatatttgcagagaatgcatttgatgctgtcatgcactttgctgctgtcgcttatgttggagagagcacacttgaacctctgaggtactatcataacatcactgcaaacactttagtggtgctggaagctatggcaacacacaatgtgaaaactctgatctactctagcacatgtgctacttacggagaacctgacaagatgcctatcactgaagaaactccccagtttccgatcaacccatatggtaaggccaagaagatggcagaggatatcattttggatttctcaaagtccaagaaagcagatatggctgtcatgattctaagatacttcaatgtcattggctctgacccggaaggaaggctgggtgaggctcctagacctgaattgcgtgagcatggtcgcatatcaggtgcatgcttcgacgcagcactgggtataatcccaggtttgaaggttaagggtaccgactacgaaactcctgatggcacttgtgtaagggattacattgatgtcactgacctggtcgacgcccatgttaaggcactcaacaaggcagaaagaggcagagttggcatatacaatgttggcacgggaaaaggtcggtcagtaaaggagttcgttgaggcctgcaagaaggcgaccggagtcgatatcaaggttgactacttcccccgcagaccaggtgactatgccgaggtgtacagcgaccccgccaagatcaaccgggagctgaactggacggcacaacacaccgacctccacgagagcctcagggtggcgtggacatggcagaaggcgcaccggagtgggtacgagccaccccaggccatgattttgtgaagatggtgatgggcctcgtagcaagcaaccagctggctggagcataggtgaacataaaagtattattagagacttctccttgaggacccatagtcgctcgctcacatatggtgaattatatacacatagtgttcatggtcattcgttcgattcttgagggttcatatttattgaaggctttagctgatcattgtaatagcataatactccatattcattgtaagttatagaataaaattccaataagctcgttttgagatgaaaaaaaaaaaaaaaaaaaa

SEQ ID NO: 8608 - protein, 438 aa, Panicum virgatum
  misc_feature: Ceres CLONE 2010819
  misc_feature: Great-hit functional homolog of the protein sequence encoded by LOCUS At2g34850
  misc_feature (1)..(264): Pfam Name: Epimerase Pfam Description: NAD dependent epimerase/dehydratase family
  misc_feature (65)..(430): SWISSPROT Homolog: EC 5.1.3.5 UDP-arabinose 4-epimerase 1
  misc_feature: Useful for making plants with altered cell wall content and/or composition
MLPTNRGRPQQRPPPPRSWSFLSEMVDFSDPKRRPRYLTKLVMAALLTAMCVLMLTQPPCHRRASPSVFSIRQPGVTHVLLTGGAGYIGSHAALRLLKDSFRVTIVDAYNTNFGHPTLQDNLSRGNIGAIKVLQNLFPEPGRLQFIQADLGDPKAVNRIFAENAFDAVMHFAAVAYVGESTLEPLRYYHNITANTLVVLEAMATHNVKTLIYSSTCATYGEPDKMPITEETPQFPINPYGKAKKMAEDIILDFSKSKKADMAVMILRYFNVIGSDPEGRLGEAPRPELREHGRISGACFDAALGIIPGLKVKGTDYETPDGTCVRDYIDVTDLVDAHVKALNKAERGRVGIYNVGTGKGRSVKEFVEACKKATGVDIKVDYFPRRPGDYAEVYSDPAKINRELNWTAQHTDLHESLRVAWTWQKAHRSGYEPPQAMIL

SEQ ID NO: 8609 - DNA, 974 bp, Panicum virgatum
  misc_feature: Ceres CLONE 2010979
  misc_feature: Encodes the peptide sequence at SEQ ID NO. 8610
gtgcatcggacacttgtgccgtcccctccgtgaacaattcctgacctcacggctcttggccaccatccaggcgataaaaagagcgagcggatgtgtttcgcacacaaacaggatcaagaacaagcaagaaggaaggatcagtcgaagcaatctatagaagcaacaatgcaagaacgccggatcaacctgccggccgtggtcgccgcggtcctcctcctgggcaccggcgcggcgccgtgctgcgcgcaggcggcgatggtgatgagcatcgaggaggcgtgccagaaggcggcgagcgtgagcgcgggcgtgagctacgagcactgcgtgtcgtcgctggcgtcggacgcccggagccgcgacgtggcggacctgcacaagctggcggtggtggcggcgcggatggccgtggaccacgcggcgacgacggaggcgaggatggagggcctgaacgaggtggaggagtcgccgcacgcgcgcgcgcggctgcaccattgccgggagctctacagcgccgccgccgacgtgctgcgcgacgcgctggacaacctccgggcgcgcatctacggcaaggcgtcgcagcagctggccgccgcgctgggcgccgccgagagctgcgaggacgtctggaagggcgaggaccgcgtccccgtcgccacccacgacagggagtacgcccgcatggcggtggtcgcgctcgacctcaccaccggcatcgcctcctgaatccggcctggtcgccattatttattactgtcgcttcttcgatcatcatcaacgcatcacgaacgccgccattgccgccatggcttgctgcgtccaatgcaaagccatcacaagtctagctcatcggatcggagtcctctcttctaccacattaattacatatgtatgtgatcgatcttgtatgtctagagtatttctttagctgttgttaatctttatttttctccggaaaaaaaaaaaaaaaaaaa

SEQ ID NO: 8610 - protein, 211 aa, Panicum virgatum
  misc_feature: Ceres CLONE 2010979
  misc_feature (1)..(157): Pfam Name: PMEI Pfam Description: Plant invertase/pectin methylesterase inhibitor
MCFAHKQDQEQARRKDQSKQSIEATMQERRINLPAVVAAVLLLGTGAAPCCAQAAMVMSIEEACQKAASVSAGVSYEHCVSSLASDARSRDVADLHKLAVVAARMAVDHAATTEARMEGLNEVEESPHARARLHHCRELYSAAADVLRDALDNLRARIYGKASQQLAAALGAAESCEDVWKGEDRVPVATHDREYARMAVVALDLTTGIAS

SEQ ID NO: 8611 - DNA, 1790 bp, Panicum virgatum
  misc_feature: Ceres CLONE 2010984
  misc_feature: Encodes the peptide sequence at SEQ ID NO. 8612
aactacgttgcttataaggagttcgatcgagcagctcggagaaggccgacgacgaccaagaagaggccgatccgaccctgggagctcgcgcgcgcacacagtacgcggccatgggtgaggaagcggcggccgtgccccccgccgtggcggcagcggcggccccgccgcacctgctgctgatatgcttcccggggcagggccacgtgaaccccatgctccgcctggcgaagcgcgtcgcggccaagggcctcctcgtgaccttctcctcgttggccagcgtgggcgcgaggctggcggccgccgcgggggtgtcggccggcggcgacggcgtgcccgtgggccggggccgcgtccggttcgagttcctggaggacggcgaccccgggtcccacctggacgacctcatgcggcacctcgagacggccgggcccccggcgttcgcggcgctgctgcggcgccaggcggaggagggccggcccgtggcgtgcgtggtggtgaacccgttcatgccgtgggcgagcgacgtggccgccggcgaggggatcccgacggcggtgctgtgggtgcagtcgtgcgcggtgttctcgctctactaccaccacgtgcacggcctggtggagttcccgcccgaggacgacccggaggcgcggttccagctcccgggcctgccggagatgtccgccgccgacgtgccgtcgttcctgctcccgtccaacccgttcaagctcctcgccgacgcgatcatcacgcagttccgcaccatcgagcgggcctcgtgggtgctggtgaactcgttcgcggagctggagccggacgtggtggccgcgctgcccggcgtgacgccgcgcccgccggagctcatccccgtggggcctctcatcgagctccagcagggtcaggaggacgacgaggtgcgcggggacctgatcaaggccgccgacgactgcgtggagtggctggacgcgcagccgccgcggtccgtggtgtacgcgtcggtgggcagcgtggtggtgctgtcccccggcgaggtcgcggagatggcgcacgggctggcgtcaacggggcggccgttcctgtgggtggtgcggccggacacgcagccgcacctgcccgaggggttcctggactccgtgtccgggcgcggcgcggtggtggcgtggagcccgcaggagcgcgtgctggcgcacccgtcgacggcgtgcttcctgacgcactgcgggtggaactcgacgctggagacggtggcggcgggggtgcccgtggtggcgttcccgcagtggggggaccagtgcacggacgcgcggttcctggtggaggagctcgggatgggcgtgcgcctgcgcggcgcgcggcgggaggccgtgcgcgaggccgtggaggccgccgtggcggggccctgcgcgggggacatgctcgcgagcgccaggcggtggagcgctgcggccagggccgccgtggcgcccggcgggtcctcggacgcccacgtccaggcgttcgtggacgaggtggcgcggcgggcgcgtggtggcggggcggctaaggcccgggcccaggcgcagccccctcccgccgtcgtcacggaggcctagcggagccgagcctcgagcctgagcagcaggtcgcgtcgtgacttgagctcagagagagggtaatagtgctggctagggtaaaccaaagccactcgcaggtacggagccaggaagtcgattttttcgggatcaatcatataaatttatataaaaatttaatcaaaatttaaatttctaatataaaaaaaaaaaaaaaaaaaa

SEQ ID NO: 8612 - protein, 492 aa, Panicum virgatum
  misc_feature: Ceres CLONE 2010984
  misc_feature (1)..(105): Pfam Name: UDPGT Pfam Description: UDP-glucoronosyl and UDP-glucosyl transferase
MGEEAAAVPPAVAAAAAPPHLLLICFPGQGHVNPMLRLAKRVAAKGLLVTFSSLASVGARLAAAAGVSAGGDGVPVGRGRVRFEFLEDGDPGSHLDDLMRHLETAGPPAFAALLRRQAEEGRPVACVVVNPFMPWASDVAAGEGIPTAVLWVQSCAVFSLYYHHVHGLVEFPPEDDPEARFQLPGLPEMSAADVPSFLLPSNPFKLLADAIITQFRTIERASWVLVNSFAELEPDVVAALPGVTPRPPELIPVGPLIELQQGQEDDEVRGDLIKAADDCVEWLDAQPPRSVVYASVGSVVVLSPGEVAEMAHGLASTGRPFLWVVRPDTQPHLPEGFLDSVSGRGAVVAWSPQERVLAHPSTACFLTHCGWNSTLETVAAGVPVVAFPQWGDQCTDARFLVEELGMGVRLRGARREAVREAVEAAVAGPCAGDMLASARRWSAAARAAVAPGGSSDAHVQAFVDEVARRARGGGAAKARAQAQPPPAVVTEA

SEQ ID NO: 8613 - DNA, 1667 bp, Panicum virgatum
  misc_feature: Ceres CLONE 2010992
  misc_feature: Encodes the peptide sequence at SEQ ID NO. 8614
ggacgatatggggatcatggaaggctatccaagaaaaccaagcacccaacaccagtctcaaatggacgcactcccagccggcgcaagcagcagcagcagcagcagcgccacccatgcaccgccggcgcctcaccacgttacgtccaagaagaggcactactccgaccgcaccaagatcctcctcctcttcctcctcaccaactccgtctccatcctcctgtccgtctccttctcccacgtcaccggcgtagggagcggcggcggcggctcggcgctcgacttcgcgctcagcgtgctctcctccagccaaagcctcgccgtcgacctccaccgccgcgtcgaggccaccgacgcgatcatcaagcggctcatctccaactccggcaggatgaagcgggaggagcccccgccccagctgacgcccgaggaggagctcaagctcgcgctcggcccgcacacgctcccgttcagctacaccccgaacctcgactccgacaagctgtacccggcggtcggcgccgcgtgccaccgccaccgcggcgagctcaggaggtacatgacgtacaacgtgaccggcgactgcccgtccgacgcggcgctcgccgagagcctgatgctgcggggctgcgagccgctgccgaggcgccggtgccgggcgcgcggccccgccgggttcccggacccgacgccgttcccggagagcctgtgggccatcccgccggacaagtccgtctcgtgggggccctactcgtgcaagaactactcgtgcctcgtgggccgcgcccgccgcccggggacggggagccacgaccacgactgcgaggcctgcttcgacctcgccggcaaggagcagcgccgctgggtcggggacggcggcggggagctcgactacgacatcgacaccgtgctggcgtccaagccgcggggcacgatacgggtcgggctcgacatcggcggcggcacgggcacgttcgcggcgcgcatggccgagcgcggcgtcaccgtggtgacgacgaccctcgacctcggcgcgccgttcggggccttcgtggcgtcccgcgggctcgtcccgctccacctcggcgccgtcgccgggcggctcccgttcttcgacgggacgctggacgtcgtgcactcggcgcacgtgctgggccggtggatccccggcgaggtgctggacctggagctgtacgacatctaccgcgtgctccggccgggcgggatattctggctggaccacttcttctgcaccgggaaggagatgacggaggtgtacgtgcccatcatcgagaaggtcgggttccggaagctccggtggaacaccggcaggaagctcgacaaggggcccaacgccgacgagtggtacatctcggctctgctggagaggcccatgatgtgaaacttcagacagagccggagcagtgcggtgattagtattaacggatgaaataatgctacttagatgggatgggatgcgacgcgaccggtcgtgtaaccccatcgtttaaaggttgtttaatttcttcggtgtcagaaatcctcttttattaatgcaagtttggaatcttggaagattcagaactgcatcactggtctgtggactctgcattgacacgcttcttcagaatgaagtgtttctcttttccgaaaaaaaaaaaaaaaaaaaa

SEQ ID NO: 8614 - protein, 463 aa, Panicum virgatum
  misc_feature: Ceres CLONE 2010992
  misc_feature (1)..(95): Pfam Name: Methyltransf_11 Pfam Description: Methyltransferase domain
MGIMEGYPRKPSTQHQSQMDALPAGASSSSSSSATHAPPAPHHVTSKKRHYSDRTKILLLFLLTNSVSILLSVSFSHVTGVGSGGGGSALDFALSVLSSSQSLAVDLHRRVEATDAIIKRLISNSGRMKREEPPPQLTPEEELKLALGPHTLPFSYTPNLDSDKLYPAVGAACHRHRGELRRYMTYNVTGDCPSDAALAESLMLRGCEPLPRRRCRARGPAGFPDPTPFPESLWAIPPDKSVSWGPYSCKNYSCLVGRARRPGTGSHDHDCEACFDLAGKEQRRWVGDGGGELDYDIDTVLASKPRGTIRVGLDIGGGTGTFAARMAERGVTVVTTTLDLGAPFGAFVASRGLVPLHLGAVAGRLPFFDGTLDVVHSAHVLGRWIPGEVLDLELYDIYRVLRPGGIFWLDHFFCTGKEMTEVYVPIIEKVGFRKLRWNTGRKLDKGPNADEWYISALLERPMM

SEQ ID NO: 8615 - DNA, 880 bp, Panicum virgatum
  misc_feature: Ceres CLONE 2011074
  misc_feature: Encodes the peptide sequence at SEQ ID NO. 8616
cgaggccaaggccaccagcccaccaccacaccgaacgaaccaggccaggcggcggcagagcggaagcggcgccgagcagcaagcaaccggcccctctcctccgccgcgtccacggatcatggccatggccgcctcctcccggctgttgtgggcgtcccgtgccgccgcctacctcaggatctccaccttccccagggccttctccaccgtgctgaaggatctgaagtatgctgatactcatgagtgggtgaaggttgagggtgattcagcaactgttgggattactgaccatgcccaggatcatttgggtgatgttgtgtatgtggagctgccagaagttggcatcggtgtatctcacggagagaactttggcgctgttgaaagtgtgaaggcaaccagtgatatcaactcaccagtatctggagaggtcgttgaagtaaatgagaaactaggcgaggaacctggattggtgaatgcaagtccatatgacaagggatggattatcaaggttaagctcagtgattcaggtgagctcaattcactgatggatgatgagaagtactcgaaattctgtgaggaagaagacaaacattgaagaaataaaagtgtcttctgaacatcaaggacatgtgtttcaagctttatcgatgcttttggtctctgagaccgttgcaatttggcaaaggttcatcgcatgcaataaattagtttaggtttgcctcttcaagggcctgggaaatccgagttgtaaaggacatgattgagtatcgtttcctctttctagctgtaacactcgtcagttttcatttgactgtctttgcttcattccttggtatacagagttacagattgtttggtccaaaaaaaaaaaaaaaaaaaa

SEQ ID NO: 8616 - protein, 158 aa, Panicum virgatum
  misc_feature: Ceres CLONE 2011074
  misc_feature (1)..(121): Pfam Name: GCV_H Pfam Description: Glycine cleavage H-protein
MAMAASSRLLWASRAAAYLRISTFPRAFSTVLKDLKYADTHEWVKVEGDSATVGITDHAQDHLGDVVYVELPEVGIGVSHGENFGAVESVKATSDINSPVSGEVVEVNEKLGEEPGLVNASPYDKGWIIKVKLSDSGELNSLMDDEKYSKFCEEEDKH

SEQ ID NO: 8617 - DNA, 672 bp, Panicum virgatum
  misc_feature: Ceres CLONE 2011200
  misc_feature: Encodes the peptide sequence at SEQ ID NO. 8618
actggtcgcttctcatcgtttatcacatagacaatggtgaaggctgtcgctgtcctcgctgtctgtgatgtcaagggtaccattttcttttctcaagagggaggtggtccaaccaccgtgaccggaagtatctctgggctcaagccggggctccatgggttccatgtgcatgcgcttggtgacaccaccaatggctgcatgtccactgggccacacttcaatcctgctgctaaggagcatggtgcaccagaagatgagaatcgccatgccggtgatcttgggaatgtgacagctggagaagatggtgttgctaatgtcaatattactgactgccagattcccctcactgggccacactcaatcattggccgagctgtagttgtccatgccgatccagatgaccttggcaagggtggacatgagcttagcaagagcacgggaaatgctggtggccgtgttgcttgtggtatcattgggctccagggctagatgctgtggcttcattggtgaacattccggtcttgctgcttcatttcccttatattggatacataattggctactcttaataatcgcctgatcaatagtcagagcgctattcctatcattccgtgtatgaacattgcacaaccatcatttttctttagtgcgatgcgaagtggctgttttggg

SEQ ID NO: 8618 - protein, 151 aa, Panicum virgatum
  misc_feature: Ceres CLONE 2011200
  misc_feature (1)..(150): Pfam Name: Sod_Cu Pfam Description: Copper/zinc superoxide dismutase (SODC)
  misc_feature (1)..(151): SWISSPROT Homolog: EC 1.15.1.1 Superoxide dismutase [Cu-Zn] 2
  misc_feature (1)..(151): SWISSPROT Homolog: EC 1.15.1.1 Superoxide dismutase [Cu-Zn] 4A
MVKAVAVLAVCDVKGTIFFSQEGGGPTTVTGSISGLKPGLHGFHVHALGDTTNGCMSTGPHFNPAAKEHGAPEDENRHAGDLGNVTAGEDGVANVNITDCQIPLTGPHSIIGRAVVVHADPDDLGKGGHELSKSTGNAGGRVACGIIGLQG

SEQ ID NO: 8619 - DNA, 1799 bp, Panicum virgatum
  misc_feature: Ceres CLONE 2011217
  misc_feature: Encodes the peptide sequence at SEQ ID NO. 8620
aaccctcatcatccatcacgcaaccacagccaccatgtatgccaagttcgcgaccctcgccgccctcgtggcaaccgcctctgctcaggccgtctgctccctgacggccgagacgcacccttcgatgcggtggtccaagtgcacgtctggcggcagctgcaccaacgtccagggttctatcaccatcgacgccaactggcggtggactcaccagacctcggcggcgaccaactgctacgacggcaacacctgggacacctcctactgcagcgatgctgtttcttgcgccaccaagtgctgcattgacggtgccgagtactcgagcacctacggcatcaccaccagcggtgactccctgaacctgaagttcgtcaccaagggccagtactcgaccaacatcggctcgcgtacctacttgatggagagcgacaccaagtaccagatgttcaaactgctcggcaacgagttcaccttcgacgttgacgtctccaacctcggctgcggcctgaacggcgccctgtacttcgtgtctatggacgccgatggtggtctctccaagtactccaccaacaaggctggtgccaagtacggcaccggctactgcgacgcccagtgcccccgtgatctcaagttcatcaacggcgaggccaacgtcgagggctgggacagctcgaccaacgaccctaacgccgggtccggcaagtacggcagctgctgctccgagatggacatctgggaggccaacaacatggctactgccttcaccccccacccttgcaccaccatcggccagtcgcgctgcgagggcgacagctgcggtggtacctacaactccgaccgctacgccggtgtgtgcgaccccgatggatgcgacttcaactcgtaccgccagggcaacaagaccttctacggcaagggcatgaccgtcgacaccaccaagaagatcaccgtcgtcacccagttctacaagaactcggccggcgagctctccgagatcaagcgcttctacgcccagaacggcgtcgtcatccccaactcggagtcgaccattgccggcgtcgagggcaactccatcacccaggactggtgcgacaggcagaaggccgtcttcggcgacgagggcgacttcaacgccaagggcggcatggtccagatgggcaaggccctcgccggcgacatggtgctcgtcatgtccgtctgggacgaccacgccgtcaacatgctctggctcgactccacctggcccatcgacggcgccggcaagctcggtgctgagcgcggtgcctgcgccaccacctcgggtgtccccgccgaggtcgaggcccaggtgcccaactccaacgtgatgttctccaacatccgcttcggccccatcggctccaccgttgctggcctgcccggcggcggcaccaaccccggcacccccggcaccagcaccagcaccagcgtcccctccaagacctcctccgtctcgaccggccctactggcggcgccaagtccccccactacggacagtgcggtggcaacggctacaccggcccgactgagtgcgaggctccctggacctgcaagaagtccaacgactggtactcccagtgcctctaagcgactcgcaacccgctcgtgatgggctcgagtcggattgatgatgatgatgatgaaggggggataatgaacgcgccgcatgtatcggcatccttcagctgtacatagtttctgatgcatcgtggggcttttcatcgcttcatagtatatacattgttgcattcatggtctcgaaaaaaaaaaaaaaaaaaaa

SEQ ID NO: 8620 - protein, 523 aa, Panicum virgatum
  misc_feature: Ceres CLONE 2011217
  misc_feature (8)..(427): Pfam Name: Glyco_hydro_7 Pfam Description: Glycosyl hydrolase family 7
  misc_feature (8)..(436): Pfam Name: Glyco_hydro_7 Pfam Description: Glycosyl hydrolase family 7
  misc_feature (1)..(428): Pfam Name: Glyco_hydro_7 Pfam Description: Glycosyl hydrolase family 7
  misc_feature (2)..(432): Pfam Name: Glyco_hydro_7 Pfam Description: Glycosyl hydrolase family 7
  misc_feature (2)..(440): Pfam Name: Glyco_hydro_7 Pfam Description: Glycosyl hydrolase family 7
  misc_feature (2)..(433): Pfam Name: Glyco_hydro_7 Pfam Description: Glycosyl hydrolase family 7
  misc_feature (3)..(435): Pfam Name: Glyco_hydro_7 Pfam Description: Glycosyl hydrolase family 7
  misc_feature (2)..(432): Pfam Name: Glyco_hydro_7 Pfam Description: Glycosyl hydrolase family 7
  misc_feature (6)..(427): Pfam Name: Glyco_hydro_7 Pfam Description: Glycosyl hydrolase family 7
  misc_feature (6)..(434): Pfam Name: Glyco_hydro_7 Pfam Description: Glycosyl hydrolase family 7
  misc_feature (1)..(523): SWISSPROT Homolog: EC 3.2.1.91 Exoglucanase 1 precursor
  misc_feature (3)..(523): SWISSPROT Homolog: EC 3.2.1.91 Exoglucanase 1 precursor
MYAKFATLAALVATASAQAVCSLTAETHPSMRWSKCTSGGSCTNVQGSITIDANWRWTHQTSAATNCYDGNTWDTSYCSDAVSCATKCCIDGAEYSSTYGITTSGDSLNLKFVTKGQYSTNIGSRTYLMESDTKYQMFKLLGNEFTFDVDVSNLGCGLNGALYFVSMDADGGLSKYSTNKAGAKYGTGYCDAQCPRDLKFINGEANVEGWDSSTNDPNAGSGKYGSCCSEMDIWEANNMATAFTPHPCTTIGQSRCEGDSCGGTYNSDRYAGVCDPDGCDFNSYRQGNKTFYGKGMTVDTTKKITVVTQFYKNSAGELSEIKRFYAQNGVVIPNSESTIAGVEGNSITQDWCDRQKAVFGDEGDFNAKGGMVQMGKALAGDMVLVMSVWDDHAVNMLWLDSTWPIDGAGKLGAERGACATTSGVPAEVEAQVPNSNVMFSNIRFGPIGSTVAGLPGGGTNPGTPGTSTSTSVPSKTSSVSTGPTGGAKSPHYGQCGGNGYTGPTECEAPWTCKKSNDWYSQCL

SEQ ID NO: 8621 - DNA, 1686 bp, Panicum virgatum
  misc_feature: Ceres CLONE 2011348
  misc_feature: Encodes the peptide sequence at SEQ ID NO. 8622
ggaagacctctcaaacccttctctttcccatctctcctgtgcttcaccttctccttcataacatccctttctctcctcctcctcctccccctaccctgctcatagcacacagctcttctctgctgcctgttggagttcgttgttctctcctccatgcaagcactcacttgtttggttttttaatttcttccttgtttgcttctttcttcatccaaaacttttaaaacaggcagaatcataaacaatccccctctttaaaaatcattgcttccttttccaacacttccttttaacctaaaaacaaaacaccgctctgttgcaatttgagtattttttctctcttttttccctgcttttctagtttttaaattttgcttgctagctacatcagtacatgagctagcagagaaccacatggcgggactcgacctcggcaccgccgcgacgcgctacgtccaccagctccaccaccttcaccccgacctccagctgcagcacaactacgccagtaagcagccggagccctccgacgacgaccccaatggcagcggcggcggcaacagcaacaacggtgggccgtacggtgagcacgacggcgggtcatcctcatccggcccagctggagatgccccgggcggcggcagcggcgggaacggggagatggtagcccgccggccccgggggcgcccaccgggctcgaagaataagccgaagcccccggtgatcatcacgcgggagagcgccaacacgctgcgcgcccacatcctggaggtggggagcggttgcgacgtgttcgagtccgtctccacgtacgcgcgccggcggcagcgcggcgtctgcgtcctgagcggcagcggcgtggtcaccaacgtgacgctgcggcagccgtcggcgccgacgggcgccgtcgtgacgctgcacgggaggttcgagatcctgtcgctctcgggctccttcctccctccgccggctccccccggcgccaccagcctcaccatcttcctcgcgggggggcaggggcaggtggtcggcgggaacgtcgtcggcgcgctctatgctgcgggccccgtcatcgtcatcgccgcgtccttcgccaacgtcgcctacgagcgcctcccactggaggaggaggcccaggcagctccacccggcctccagatgcagccgcccggcggtgccgatggcgcaggaggcatgggcggtggcccgttccctcccgacctgtcggctgccggccttccgttcttcaacctgccgctcaacaacatggccggtggcggatcgcagctcccgcctggtgccgatggccatgggtgggctggtgcacggccaccgttctgacaagtactccgatccatggggggtataattcaaggtgtttgagaacaggagatggcaagaagaaagcaatgaacggcaccaggattgatgaaggcagcttgcagaaggttagcgcacgcacgcatgcttgcaaggatatctaccatttctatctcgatctctgtacaatttcgtagtgtttgctcggtctctttgattatgtcttctccttgttcttccttcttttcgttttcttctctcgtgtctcttgaaacttaatttgtggtgtacccttgcttgtcttaatttttaatctggcttttaataagtcgtaaccttttagtttaaaaaaaaaaaaaaaaaaaa

SEQ ID NO: 8622 - protein, 308 aa, Panicum virgatum
  misc_feature: Ceres CLONE 2011348
  misc_feature: The sequence is a functional homolog of  SEQ ID NO 1403 in the  10/374,780 US patent application
  misc_feature: The sequence is a functional homolog of  SEQ ID NO 1404 in the  10/374,780 US patent application
  misc_feature: The sequence is a functional homolog of  SEQ ID NO 1406 in the  10/374,780 US patent application
  misc_feature: The sequence is a functional homolog of  SEQ ID NO 1408 in the  10/374,780 US patent application
  misc_feature: The sequence is a functional homolog of  SEQ ID NO 1412 in the  10/374,780 US patent application
  misc_feature: The sequence is a functional homolog of  SEQ ID NO 1414 in the  10/374,780 US patent application
  misc_feature: The sequence is a functional homolog of  SEQ ID NO 1416 in the  10/374,780 US patent application
  misc_feature: The sequence is a functional homolog of  SEQ ID NO 1417 in the  10/374,780 US patent application
  misc_feature: The sequence is a functional homolog of  SEQ ID NO 16 in the  10/669,824 US patent application
  misc_feature: The sequence is a functional homolog of  SEQ ID NO 16 in the  10/870,198 US patent application
  misc_feature: The sequence is a functional homolog of  SEQ ID NO 18 in the  10/669,824 US patent application
  misc_feature: The sequence is a functional homolog of  SEQ ID NO 18 in the  10/870,198 US patent application
  misc_feature: The sequence is a functional homolog of  SEQ ID NO 1840 in the  10/412,699 US patent application
  misc_feature: The sequence is a functional homolog of  SEQ ID NO 2080 in the  10/374,780 US patent application
  misc_feature: The sequence is a functional homolog of  SEQ ID NO 258 in the  10/225,066 US patent application
  misc_feature: The sequence is a functional homolog of  SEQ ID NO 26 in the  10/669,824 US patent application
  misc_feature: The sequence is a functional homolog of  SEQ ID NO 26 in the  10/870,198 US patent application
  misc_feature: The sequence is a functional homolog of  SEQ ID NO 28 in the  10/669,824 US patent application
  misc_feature: The sequence is a functional homolog of  SEQ ID NO 28 in the  10/870,198 US patent application
  misc_feature: The sequence is a functional homolog of  SEQ ID NO 304 in the  11/435,388 US patent application
  misc_feature: The sequence is a functional homolog of  SEQ ID NO 306 in the  10/714,887 US patent application
  misc_feature: The sequence is a functional homolog of  SEQ ID NO 32 in the  10/669,824 US patent application
  misc_feature: The sequence is a functional homolog of  SEQ ID NO 32 in the  10/870,198 US patent application
  misc_feature: The sequence is a functional homolog of  SEQ ID NO 348 in the  11/435,388 US patent application
  misc_feature: The sequence is a functional homolog of  SEQ ID NO 350 in the  10/714,887 US patent application
  misc_feature: The sequence is a functional homolog of  SEQ ID NO 350 in the  11/435,388 US patent application
  misc_feature: The sequence is a functional homolog of  SEQ ID NO 352 in the  10/714,887 US patent application
  misc_feature: The sequence is a functional homolog of  SEQ ID NO 352 in the  11/435,388 US patent application
  misc_feature: The sequence is a functional homolog of  SEQ ID NO 354 in the  10/714,887 US patent application
  misc_feature: The sequence is a functional homolog of  SEQ ID NO 388 in the  11/435,388 US patent application
  misc_feature: The sequence is a functional homolog of  SEQ ID NO 390 in the  10/714,887 US patent application
  misc_feature: The sequence is a functional homolog of  SEQ ID NO 390 in the  11/435,388 US patent application
  misc_feature: The sequence is a functional homolog of  SEQ ID NO 392 in the  10/714,887 US patent application
  misc_feature: The sequence is a functional homolog of  SEQ ID NO 54 in the  10/669,824 US patent application
  misc_feature: The sequence is a functional homolog of  SEQ ID NO 54 in the  10/870,198 US patent application
  misc_feature: The sequence is a functional homolog of  SEQ ID NO 728 in the  10/412,699 US patent application
  misc_feature: Useful for making plants with modulated growth and phenotype characteristics
MAGLDLGTAATRYVHQLHHLHPDLQLQHNYASKQPEPSDDDPNGSGGGNSNNGGPYGEHDGGSSSSGPAGDAPGGGSGGNGEMVARRPRGRPPGSKNKPKPPVIITRESANTLRAHILEVGSGCDVFESVSTYARRRQRGVCVLSGSGVVTNVTLRQPSAPTGAVVTLHGRFEILSLSGSFLPPPAPPGATSLTIFLAGGQGQVVGGNVVGALYAAGPVIVIAASFANVAYERLPLEEEAQAAPPGLQMQPPGGADGAGGMGGGPFPPDLSAAGLPFFNLPLNNMAGGGSQLPPGADGHGWAGARPPF

SEQ ID NO: 8623 - DNA, 1954 bp, Panicum virgatum
  misc_feature: Ceres CLONE 2011358
  misc_feature: Encodes the peptide sequence at SEQ ID NO. 8624
attggaggggtctgcgttttgccccagctcacgggcaccaccagtgtgatctggactttccaaagcccgggacggggaggggacggcgatcccagatcacacagaggacaggggagatcggcccgccacacgtcgccatcgccgtgatcgatcaccgccgcctcggcgtctcctcccccacatacccaccggaaccaccgtcccgacctctcgccagcgataagcaaatccccctccccgtcctctcgtctacaaagccctctttctttacgacccccaagcaccccctgcggccctgcccctctcctcccgcccacccgcgccactccctctccgaccgccgccgccgccgccttccggaatccagatggcgtccgcggccgcgcacccggcctcgctctccctcacggcccgcgcggccaccagggccgccgccgccgcagcagcagccccgctgcgcagggggggcctcgcggcggcgtgccagccggcgcggtcgctggcgttcgcggcgggggacgcgcggctcgcggtccacgtcgcgtcgcggtgccgccgggcgtcgtccgcgcgcgggacccgcgccatggccaccatggccaagaagagcgtcggggacctcacggaggccgacctcgagggtaagcgcgtcttcgtgcgcgccgacctcaacgtgccgctcgacgagaaccagaacatcaccgacgacacccgcatccgcgccgccgtccccaccatccagtacctcatcggcaagggcgccaaggtcatcctctccagccacttgggtcgccctaagggtgttactcccaagtttagcttagctcccattgtaccacggctgtctgagcttcttggtattcaggtgcaaaaggctgacgatgttattggccctgaagttgagaaattggtgtctgccatgcccaatggtagtgttacgctcctcgagaacgtaagattttacaaggaagaggagaagaatgacccagagttcgcgcagaagcttgcctcccttgcagatctttatgttaatgatgcatttggaacggcccacagggcacacgcatcaactgagggagttaccaagttcttgaagccttctgttgcagggttccttttgcagaaggagcttgactaccttgttggagctgtttcaagccctaaacgtccatttgctgccatcgtgggtggctcaaaggtgtcatccaagatcggagttattgaatccctgttggaaaagtgcgatatccttcttttgggtggtggtatgatcttcacattttacaaggcacaaggactttctgttggttcttcattggtcgaggaagacaaacttgagctcgcaacatctctgcttgcaaaggcaaaggaaaagggtgtctcccttatgttgccaactgatgttgtcattgctgataagtttgcccctgatgctaacagccagactgttccagcatcttcaattcctgatggttggatggggctggacattggcccggattctattgcttcattcaatgcagccctggacacaacccagacaatcatctggaacgggcccatgggtgtttttgaattcgacaagttcgctgttggaactgaggctgttgcgaagaagttggcagaacttagcggcaagggtgtcacaaccatcattggaagtggagactccgttgcagccgttgagaaggtgggagttgctgatgttatgagccacatttcaacgggaggtggtgccagcttggaattgttggaaggaaaggagcttcctggagttgttgcgttggatgaagccaccactgtgactgtatgaagctaagttctcaatttgtttcaccttcatcttcgtgtaccgtgtaaacttgctacattcttgctcgctccttgtcagccgctcgaaatgtaagagatcaatgctttatagagctactggaaattgtttgaataactacac

SEQ ID NO: 8624 - protein, 481 aa, Panicum virgatum
  misc_feature: Ceres CLONE 2011358
  misc_feature (1)..(298): Pfam Name: PGK Pfam Description: Phosphoglycerate kinase
  misc_feature (1)..(396): Pfam Name: PGK Pfam Description: Phosphoglycerate kinase
  misc_feature (2)..(397): Pfam Name: PGK Pfam Description: Phosphoglycerate kinase
  misc_feature (1)..(397): Pfam Name: PGK Pfam Description: Phosphoglycerate kinase
  misc_feature (2)..(396): Pfam Name: PGK Pfam Description: Phosphoglycerate kinase
  misc_feature (1)..(476): SWISSPROT Homolog: EC 2.7.2.3 Phosphoglycerate kinase, chloroplast precursor
  misc_feature (1)..(481): SWISSPROT Homolog: EC 2.7.2.3 Phosphoglycerate kinase, chloroplast precursor
MASAAAHPASLSLTARAATRAAAAAAAAPLRRGGLAAACQPARSLAFAAGDARLAVHVASRCRRASSARGTRAMATMAKKSVGDLTEADLEGKRVFVRADLNVPLDENQNITDDTRIRAAVPTIQYLIGKGAKVILSSHLGRPKGVTPKFSLAPIVPRLSELLGIQVQKADDVIGPEVEKLVSAMPNGSVTLLENVRFYKEEEKNDPEFAQKLASLADLYVNDAFGTAHRAHASTEGVTKFLKPSVAGFLLQKELDYLVGAVSSPKRPFAAIVGGSKVSSKIGVIESLLEKCDILLLGGGMIFTFYKAQGLSVGSSLVEEDKLELATSLLAKAKEKGVSLMLPTDVVIADKFAPDANSQTVPASSIPDGWMGLDIGPDSIASFNAALDTTQTIIWNGPMGVFEFDKFAVGTEAVAKKLAELSGKGVTTIIGSGDSVAAVEKVGVADVMSHISTGGGASLELLEGKELPGVVALDEATTVTV

SEQ ID NO: 8625 - DNA, 1897 bp, Panicum virgatum
  misc_feature: Ceres CLONE 2011526
  misc_feature: Encodes the peptide sequence at SEQ ID NO. 8626
ccccagagagacgcctcaacccaccccaccccacaagaacacgaagccacatccccattccactccacggtgaggttgagcgatcagaccagatcatccgcgacgcagcaacaggtttgttctctgaactctctgattctttttagcagcagggacgctcgcacagcacgagaaaggtccggttcaagaaggctcttcctttgggtttattagaatcctcagaggaagattgttcttgggtttggatttttttctcacctcatcacacctctcctaggaggaacagagatccagagaacctttttttctcttctggattcttgccgcctttttggccttcgaaagggttcttttgcaatacccttcttgttcaccaaccgtttttctttgcacaaacctcgctgtttctctacttttattgaggaacaacactgatttccaaacctattttctactttgattttgcataaaaaagctccttttatttcttcccgttttcagttctcccctgcctcttcttctagctccatccaaagcttctccatctattcataatggccgcagccatagatatgtacaagtactacaacactagtgcacaccagatcgccgcctcctcttcttcggatcaggagctcgcgaaagcactcggaccttttataacgagtgcttcctcctcttcatctccctccccctaccactactactcgtcctcttcctccatcacccaagattcttacttgcctacaccctcctatgccaacttcgccacctcgcctcttcctgccaccgccgccacctcgtcgtcgtctttctcgcagcttccgccactgtacccgtcgccgtacgctactgctgcttcggcggtgtcgggtgtgactgggaccatgggcctgaaccagctcggtccggcccagatccaacagatccaggcccagctcatgatgcagcagcagcagcggggcctgcacgcggcgtacctaggcccgcgggcgcagccgatgaagcagtccgggtcgccgcccctggcgccggcgcagtcgaagctgtaccgcggcgtgcgccagcgccactggggtaagtgggtggcggagatccgcctccccaagaaccgcacgcggctgtggctgggcaccttcgacacagctgaggacgcggcgctcgcctacgacaaggcggcgttccgcctccgcggggacatggcgcgcctcaacttccccgccctccgccgcggcggcgcgcacctggcaggcccgctccacgcctctgtggatgctaagctcacggccatctgccagtccctcgccgggtccaagagcggctcccccgacgccgagtcatcggccgcgtccccgccggactcgcccaagtgctcggcgtcgacggagggggaggaggagtcggtctccgccggctccccaccttccccgatgcaggtgccgcccgtcccagagatggcgaagctggacttcacggaggcgccgtgggacgagacggaggccttccacctgcgcaagtacccgtcctgggagatcgactgggactccatcctctcatgaagaactgcaactgttatagtagtagtagcaaagattcagtcagtccagctcaatgacagctctgtgtaattttcatttgggtttttgcagctgcggtggctcgatggcattttagacatcggccatggcggctgcaagtagcagtgagtaactagcagctagtaagtcgcccagtgttgtgatgatgtagcagtcagtacgtgttaatctcctggttgagctgccggttgttttttctcacggcacggccagtcgagaaggtcaagtgtaatcccttgttattgttatatgttgcagcttaatccatgtagcttacgcaaaaaaaaaaaaaaaaaaaa

SEQ ID NO: 8626 - protein, 334 aa, Panicum virgatum
  misc_feature: Ceres CLONE 2011526
  misc_feature (1)..(65): Pfam Name: AP2 Pfam Description: AP2 domain
  misc_feature: The sequence is a functional homolog of  SEQ ID NO 116 in the  11/479,226 US patent application
  misc_feature: The sequence is a functional homolog of  SEQ ID NO 1288 in the  10/374,780 US patent application
  misc_feature: The sequence is a functional homolog of  SEQ ID NO 1434 in the  10/412,699 US patent application
  misc_feature: The sequence is a functional homolog of  SEQ ID NO 1712 in the  10/412,699 US patent application
  misc_feature: The sequence is a functional homolog of  SEQ ID NO 1948 in the  10/374,780 US patent application
  misc_feature: The sequence is a functional homolog of  SEQ ID NO 256 in the  11/375,241 US patent application
  misc_feature: The sequence is a functional homolog of  SEQ ID NO 6 in the  10/412,699 US patent application
  misc_feature: The sequence is a functional homolog of  SEQ ID NO 722 in the  10/225,066 US patent application
  misc_feature: The sequence is a functional homolog of  SEQ ID NO 906 in the  11/435,388 US patent application
  misc_feature: Useful for making plants with modulated growth and phenotype characteristics
MAAAIDMYKYYNTSAHQIAASSSSDQELAKALGPFITSASSSSSPSPYHYYSSSSSITQDSYLPTPSYANFATSPLPATAATSSSSFSQLPPLYPSPYATAASAVSGVTGTMGLNQLGPAQIQQIQAQLMMQQQQRGLHAAYLGPRAQPMKQSGSPPLAPAQSKLYRGVRQRHWGKWVAEIRLPKNRTRLWLGTFDTAEDAALAYDKAAFRLRGDMARLNFPALRRGGAHLAGPLHASVDAKLTAICQSLAGSKSGSPDAESSAASPPDSPKCSASTEGEEESVSAGSPPSPMQVPPVPEMAKLDFTEAPWDETEAFHLRKYPSWEIDWDSILS

SEQ ID NO: 8627 - DNA, 904 bp, Panicum virgatum
  misc_feature: Ceres CLONE 2011799
  misc_feature: Encodes the peptide sequence at SEQ ID NO. 8628
actactccccaactagtctccacctgacaggctccctccctccccgagcgaccccgggaggcggaggcggagatccctaggccggcggccaagatggcggccacgctggccctcgcggttgttcttgccgtcgcgtctctccacgctgaggcggtgtggctggacgtgccgcagtcggggaccaagtgcgtgtcggaggagatccagtccaacgtcgtcgtgctctccgactactccatcatgtacgagtcccacccctactcccaccccaccatcgccgtcaaggttacttcaccattcgggaacaccttacatcacaatgagaatgctacagttggtcaatttgcattcacaactgctgaagctggaaactatcttgcatgcttctggatagatagtgcagagaaaggatcaggcgtatctgtgaatcttgactggaagattgggtttgcaacaaaggactgggatgctattgctaagaaagaaaaaattgagggtgtagagctagagcttcggaaacttgaagttgcagtacaagctattcatcagaatttgatctacctcaaagcaagggaagcagagatgcgaactgtgagtgagaaaacaaacgcaagggttgcctggttcagtattctgtcgctgggtgtctgcattgcagtatcaatcttgcaattgtggcatcttcaagggttcttcagaaagaagaagctcatttagatctgctcgtctgatgttgcactgtgcctcaatgttgttgatctttgaagggggacgattttgtcttatttggaacgtttcacaccagtgatggctgatgagcaagttgtactgcttgtaatttaactacgtttgaatggaatatctatgtttctaggaggttttgcaaaaaaaaaaaaaaaaaaaa

SEQ ID NO: 8628 - protein, 207 aa, Panicum virgatum
  misc_feature: Ceres CLONE 2011799
  misc_feature: Great-hit functional homolog of the protein sequence encoded by LOCUS At1g09580
  misc_feature: Useful for making plants with altered cell wall content and/or composition
MAATLALAVVLAVASLHAEAVWLDVPQSGTKCVSEEIQSNVVVLSDYSIMYESHPYSHPTIAVKVTSPFGNTLHHNENATVGQFAFTTAEAGNYLACFWIDSAEKGSGVSVNLDWKIGFATKDWDAIAKKEKIEGVELELRKLEVAVQAIHQNLIYLKAREAEMRTVSEKTNARVAWFSILSLGVCIAVSILQLWHLQGFFRKKKLI

SEQ ID NO: 8629 - DNA, 799 bp, Panicum virgatum
  misc_feature: Ceres CLONE 2011941
  misc_feature: Encodes the peptide sequence at SEQ ID NO. 8630
aatcagccagcttagttattaggcatcacagaagcaagcaagtacgggttccgggatcatcagtgtgacagtgtcagtgtgtgtgtgtgtgtgtgtgtgtgtgtgtgtgaggtgacgaggatgaggggtctccttgtgctcgccctcctgctcgccgccgcggcgtgcctcgccgagggcgcgggcgagtgcggggcgacgccgccggacaggatggcgctgaggctggcgccgtgcgcgtcggcggcgcagaacccgagcgccgcgccgtctggcgcctgctgcagcgccgtgcgcaccatcgggaagcagagcccccagtgcctgtgcgccgtgatgctgtccaacaccgccaagagctccggcatcaagcccgaggtcgccatcaccatccccaagcgatgcaacctcgccgaccgccccgtcggctacaagtgcggagcttacactttgccatgagtagtaaggactgcacgcggctggtgcgtggcatgttcatggatcaccgaagtacaagcacgaagccgtgtccgtgtgtgtgtctctgtgtgtgtaaccaataataaacgacagttgcgagtaccatccatgtgcggaactctagtatgttgagtgattgagtctatccttagagatgtatactttttttttgagattacacagtacaactcagacactcacaacgcacgcaatacttattactactcatgtggtcacgttcagggtccagagatgtagtcctgcattgtcgaaataaaactaatctctccttttcttttaaaaaaaaaaaaaaaaaaaa

SEQ ID NO: 8630 - protein, 112 aa, Panicum virgatum
  misc_feature: Ceres CLONE 2011941
  misc_feature (1)..(83): Pfam Name: Tryp_alpha_amyl Pfam Description: Protease inhibitor/seed storage/LTP family
MRGLLVLALLLAAAACLAEGAGECGATPPDRMALRLAPCASAAQNPSAAPSGACCSAVRTIGKQSPQCLCAVMLSNTAKSSGIKPEVAITIPKRCNLADRPVGYKCGAYTLP

SEQ ID NO: 8631 - DNA, 904 bp, Panicum virgatum
  misc_feature: Ceres CLONE 2012134
  misc_feature: Encodes the peptide sequence at SEQ ID NO. 8632
atttccactcactccgtcgggttcgacccaccacctcgaaagaagcggaaattgcaagcgagtccacggaccggatcccctccagcaccgccgccaagcgatggggatctcgagcatgccggcgccgcgggacagcctgatggcgtacctgctctacaacacggtggtctcgatcgccgcgctggccgacctggtgcgggccgcgctggtgttcctcgatctccaggacgcgctgctgccgggcgacgacggagaccagctatccgccgcggcggcgggacccgccggcggcgccgcggctggttccgcccccgcgggggccggtctcgcggccgagaggttcaggaccagcttccgcccggcgcggttcggggcgacgggatgcgaggcggcggactgccgcgtgtgcctggcgcggttcgagccggaggcggtggtgaaccggctcccatgcggccacctcttccacagcgagtgcctcgagaagtggctccgctacgaccgcgccacgtgcccgctctgtcgcgcccgcttcctccccctcgccgacgagcctccgccgccgccgttggccgtggaggcttattagggagatagagagagagagaatctgaagctgcgctccggctgtgtgctgcaacatctgtgtggccttccgtgtgagcgtagcagattagtaggtattagatgtgttgctctcgcttccttttcttttcttttctttttttttttgcctctgggaagttggttttgtacgccttgtggtgtcgctgtagcgtgtaaatatttgccgcagagagaggagtgctcctacgggtgtagcactttttttacgagctcgttcgtgtgcatggctttcccatcaaggaaaaaaaatatcatccaaaaaaaaaaaaaaaaaaaa

SEQ ID NO: 8632 - protein, 162 aa, Panicum virgatum
  misc_feature: Ceres CLONE 2012134
  misc_feature (1)..(42): Pfam Name: zf-C3HC4 Pfam Description: Zinc finger, C3HC4 type (RING finger)
MGISSMPAPRDSLMAYLLYNTVVSIAALADLVRAALVFLDLQDALLPGDDGDQLSAAAAGPAGGAAAGSAPAGAGLAAERFRTSFRPARFGATGCEAADCRVCLARFEPEAVVNRLPCGHLFHSECLEKWLRYDRATCPLCRARFLPLADEPPPPPLAVEAY

SEQ ID NO: 8633 - DNA, 817 bp, Panicum virgatum
  misc_feature: Ceres CLONE 2012187
  misc_feature: Encodes the peptide sequence at SEQ ID NO. 8634
tacccggttcgctctcttttagtagttggtgtagtgagctaagccagtgatcagtactagaaacctttgccggagcggaagcagaaggaagaggaagatgctggagaagctgtgggacgacgtggtggcggggcctcacccggagacggggctcgagaagctccgcaaggccaccaccgcccgcccgctcgtcatcgacaaagtagacgcggacgccggaggtgcagcctacaagaggacgcagtcgatgccgtcgaccccgacgacgccggggaccccgtcgtcgtcgacgacgccgcgcggcgccagcaacgtgtggcgcagcgtgttccaccccgggagcaacctggcaaacaagagcatgggcgccaacctcttcgaccgcccgcagcccaactcacccaccgtctacgactggctctacagcgacgagaccaggagcaaccaccgctagatcggatcaggcgggacgagatcgacggaggagcggtggccggccggtccctgtcaggccctcatgtttgctggtccttgtggttatctaaaacgcataccgctacgttgctgtccgaggctcaagacttttgctccccttttctttcgtagtactatgatacgatagcgagtaattttatttcaaacaaaaaaaagtgtgtaatgagtaagcatgcttactcaactggccgctggtagtgacaggcgggcccggtgacgggaaccctcctctgcgtgtgtagtagtgtgtactgtcttctctgatccgtttgtaaatactgctataatgaactatcgagcgcaaaaaaaaaaaaaaaaaaaa

SEQ ID NO: 8634 - protein, 118 aa, Panicum virgatum
  misc_feature: Ceres CLONE 2012187
  misc_feature (1)..(121): Pfam Name: Auxin_repressed Pfam Description: Dormancy/auxin associated protein
MLEKLWDDVVAGPHPETGLEKLRKATTARPLVIDKVDADAGGAAYKRTQSMPSTPTTPGTPSSSTTPRGASNVWRSVFHPGSNLANKSMGANLFDRPQPNSPTVYDWLYSDETRSNHR

SEQ ID NO: 8635 - DNA, 652 bp, Panicum virgatum
  misc_feature: Ceres CLONE 2012330
  misc_feature: Encodes the peptide sequence at SEQ ID NO. 8636
agtgccacccaacgcagaagccaaacttccccaatctccgcgccgccgccgttcccgtcgtcgtccgccgtcccggtcgctccctcgccgtcgcccaccgaccccgaccttcctcgtcactaccggtccaccgggggcggcgccatgtcccagaacaacccctcccagctcctcccctcagagctgatcgaccgctgcatcgggtccaagatctgggtgatcatgaagggggacaaggagctcgtcggcaccctctgcggcttcgacgtctacgtcaacatggtgctggaggacgtcaccgagtatgaatacacggctgaagggcgtcgcattacaaaacttgaccagatactgctgaatggcaacaacatagccattttggttcctggtggttcaccacccgatgtgtaatgagcttgtgcttcccagtgacgatttgaggcgaaggcagcttggtgaactctgcaccttatgttggtcagaagcattgaatgttttctcacctcaaacgtgtctctcctgttcgtgattgtaccgaaattcgttagcaagtctgtcaacttggaagctctctcctgtattgaacttactgacctctcggtagagggacttgcatatgcttatatgattggctatgctaattccgatgctc

SEQ ID NO: 8636 - protein, 88 aa, Panicum virgatum
  misc_feature: Ceres CLONE 2012330
  misc_feature: Great-hit functional homolog of the protein sequence given in SEQ ID NO 9368
  misc_feature: Useful for making plants with modulated drought sensitivity
  misc_feature: Useful for making plants with modulated cold sensitivity
MSQNNPSQLLPSELIDRCIGSKIWVIMKGDKELVGTLCGFDVYVNMVLEDVTEYEYTAEGRRITKLDQILLNGNNIAILVPGGSPPDV

SEQ ID NO: 8637 - DNA, 1716 bp, Panicum virgatum
  misc_feature: Ceres CLONE 2012466
  misc_feature: Encodes the peptide sequence at SEQ ID NO. 8638
agggcgcccgaggcgtggaccaggcccacgcggcaccgccgctggccaccggctcctttgatttcgtcttccttccccttcttccttccttgtgggagacacgggcggaggaggcgctgcagctgctgcgacatctccgtccaccgttccccccaaccgtactccaccaaaccagctggttgcgtcagattccggcgacgtgcctcgtgcgcatcgacgcccggttgctgatttaaagctctgctctgacggctgaccgcacaccttgcgcccgtagaccgagttcagcttcagttcctgctccgatcgatcgagaatgtcaagcctcgaggagccgcttggtcttggagacctgccgaagttgagtattaacagacttggaagcttctcccagccaagtgcttatcgtagggcagcggctgatgaccgcaacactcgcgagtacaacatcacctgcaatggtggcacgccgatggttttccatgccaattcccatgcatggcatcagcaatgccgtcaggccgattcctcatgtgatgcggtggagcttagagatctccctcggaaggttatgtgggatctgccaagctttgtgaagattgttgaagttggaccccgagacggcctgcaaaacgaaaagggcaatgtaccaacatctgtaaagatacagctgatacacaaattagtggctgcaggtctatcagtagttgaagccacaagttttgtatccccaaaatgggtgccacagctagctgatgcaaaggaagtcctcaaaggaatccagcagatgccaaatgtacggtatcctgtgttaactcctaacctcagaggatttgaggctgctgttgcagctggtgcaaaggaaattgcggtttttgcgtctgcctctgaatccttctctaagtcgaacattaactgtaccattgacgaaagccttgttcggtaccgtgatgttactgctgctgccaagaaacatggactccttatccgtgggtatgtttcgtgtgtgattggttgccctgttgaaggtgcaatcgatccatcaaaggtggcatatgtagcgaaggagctttataacatgggctgctcagagatttcacttggcgatacaattggtgttggtacaccaggtagtgtagttgctatgcttgaagctgtcatgtcctttgttccagcggacaagattgccgttcatttccatgatacatacggccaggcccttgccaatatcctagtctcccttcaaatggggatcagcatagtagactcctcagtttcaggcctcggaggctgcccctatgcaaagggcgccaccggcaatgtcgccactgaggatgtcgtgtacatgctccatggcctggggatagagaccaacgtcgacctcaacaagctcatggaggctggcgattacatctccaagcatctaggaaggccactgggctccaagactgctgccgctctgcgcaagctaaccacctgagtccctgaagatcatttcaggcactcccaaaagcatgtatatcagctgctgtcatcacacgtatttacttatacaagtcgtatgaatgtccgaaggccttgcttttgtttgtatttgggtaaaagtcgcagaaaacatggatctacgtaaagttgtattctatccttaggtgatcctgcatagtcaggacatcatggaggaaactgtgttcacaataaaaaaaaaaaaaaaaaaaa

SEQ ID NO: 8638 - protein, 387 aa, Panicum virgatum
  misc_feature: Ceres CLONE 2012466
  misc_feature (78)..(385): SWISSPROT Homolog: EC 4.1.3.4 Hydroxymethylglutaryl-CoA lyase, mitochondrial precursor
MSSLEEPLGLGDLPKLSINRLGSFSQPSAYRRAAADDRNTREYNITCNGGTPMVFHANSHAWHQQCRQADSSCDAVELRDLPRKVMWDLPSFVKIVEVGPRDGLQNEKGNVPTSVKIQLIHKLVAAGLSVVEATSFVSPKWVPQLADAKEVLKGIQQMPNVRYPVLTPNLRGFEAAVAAGAKEIAVFASASESFSKSNINCTIDESLVRYRDVTAAAKKHGLLIRGYVSCVIGCPVEGAIDPSKVAYVAKELYNMGCSEISLGDTIGVGTPGSVVAMLEAVMSFVPADKIAVHFHDTYGQALANILVSLQMGISIVDSSVSGLGGCPYAKGATGNVATEDVVYMLHGLGIETNVDLNKLMEAGDYISKHLGRPLGSKTAAALRKLTT

SEQ ID NO: 8639 - DNA, 1632 bp, Panicum virgatum
  misc_feature: Ceres CLONE 2012639
  misc_feature: Encodes the peptide sequence at SEQ ID NO. 8640
gtgtttttcatgttttctcttggacgcacctctcgtctttttgcgccttctggaaccagaagctattcatcggtgcgtgaggccaggaacttcattaacggaaaatgggtcaattctaaaacgactgaatggatcgatttagttcaacctgcaaccaataaacttattgtccgtgttcctcaatctactcaagaagaaatgcaagctgctactgatgctgccagtgttgctttctcaacctggaaaaacgtcccgctacctactcgtgttagaacaatgttcgagtacagagatcgagtcgtgaaaaatttagataaaatagctgaaagcattactcatgagcttggaaaaaccaaagctgacgctaaaggtgatgttcttcgaggaattgaagttttagaacatgctgcaagctctgctactcttttattaggtgacgcttcccaaaacgttgctacaaatatcgatgtacacagctatcagatgccattaggagtcagtgcaggaatttgcccattcaacttccctgctatgattccaatgtggatgtacccaactgcaattgctgctggatgtactatggtcttaaagccatctgagaaagatccaggggcagctgaacttttaactgaattatcagaaggaatctggcctcctggtgttctgaacattgtacacggaggaaagaaaactgttgactttctctgtgatgcacctgcaattcaagcaatctcatttgttggaagtggacacgtcggaaactacattatggaccgtggatcaagaaatggaaagcgtgttcaatcaaacatggctgcaaagaatcatggaatcattatgcctgacgcacgtaaagaaagaaccctcgatgcaattgctgcagctgcatttggagcaactggacaaagatgtatggctctccctgttgcaatcttcgttggagaagcacaagactggatcccagacttagttgcaagagcatcaaaattaaaagttggacctggacacatggatgttgacattggacctgttgtatcaaaagaaaacaaaaaaagaatcgaatctcttattcaacaaggaatcgatcaaggtgcaaaattgcttttagatggaagaaatccatctgttccttctggatttgaaagtggaaattatcttggtcctacaattttggatggagttactccaaaaatggcatgttatgttgaagaaatctttggacctgttctctcagttatgagagttgataaccttgaagaagcaattgctcttcttaataccaacccatatggaaatggttgtgctatgtttacagcatctggagctgctgctagaaagttacaaatggagacaaatgttggacaaattggaattaatcttccaattccagttcctcctcctttttttagttttactggatctaaggcatcatttattggaagccataacttttatggaagaaatggaattaaattttttacacaaacaaagacagttatgacaaactggtgggatgatgatatgtcaactggagtacgatgtgctatgcctgtacttggtcgtgaagctgaaactgacagcaagaaaaactaaataaaatccttttttctccaaaaaaaaaaaaaaaaaaaa

SEQ ID NO: 8640 - protein, 527 aa, Panicum virgatum
  misc_feature: Ceres CLONE 2012639
  misc_feature (1)..(465): Pfam Name: Aldedh Pfam Description: Aldehyde dehydrogenase family
  misc_feature (1)..(466): Pfam Name: Aldedh Pfam Description: Aldehyde dehydrogenase family
  misc_feature (1)..(470): Pfam Name: Aldedh Pfam Description: Aldehyde dehydrogenase family
  misc_feature (13)..(518): SWISSPROT Homolog: EC 1.2.1.27 Methylmalonate-semialdehyde dehydrogenase [acylating], mitochondrial precursor
  misc_feature (27)..(514): SWISSPROT Homolog: EC 1.2.1.27 Methylmalonate-semialdehyde dehydrogenase [acylating], mitochondrial precursor
MFSLGRTSRLFAPSGTRSYSSVREARNFINGKWVNSKTTEWIDLVQPATNKLIVRVPQSTQEEMQAATDAASVAFSTWKNVPLPTRVRTMFEYRDRVVKNLDKIAESITHELGKTKADAKGDVLRGIEVLEHAASSATLLLGDASQNVATNIDVHSYQMPLGVSAGICPFNFPAMIPMWMYPTAIAAGCTMVLKPSEKDPGAAELLTELSEGIWPPGVLNIVHGGKKTVDFLCDAPAIQAISFVGSGHVGNYIMDRGSRNGKRVQSNMAAKNHGIIMPDARKERTLDAIAAAAFGATGQRCMALPVAIFVGEAQDWIPDLVARASKLKVGPGHMDVDIGPVVSKENKKRIESLIQQGIDQGAKLLLDGRNPSVPSGFESGNYLGPTILDGVTPKMACYVEEIFGPVLSVMRVDNLEEAIALLNTNPYGNGCAMFTASGAAARKLQMETNVGQIGINLPIPVPPPFFSFTGSKASFIGSHNFYGRNGIKFFTQTKTVMTNWWDDDMSTGVRCAMPVLGREAETDSKKN

SEQ ID NO: 8641 - DNA, 1736 bp, Panicum virgatum
  misc_feature: Ceres CLONE 2012653
  misc_feature: Encodes the peptide sequence at SEQ ID NO. 8642
agagagagcacaaccccgtagccgccgccgcgccgccatcccctctcgtcgccctcctcgccagctggggttatttatacgggcgccatcgcgcgacccccgcggcattaggtggcgcacgctcccctcgttcccgcacccgcgctgtgacacggaagggcatggcctcctcagcggcggcggcggcggctccggcgcgtgccgggttggctccccagaatggaatctttggatctaattcgaagccatttgctggtttcatgctcaagacagctcagcaggttcgacccctgtcactccatgtgaggggatccgttgcctcttcaacaaggaagctgttctcccctaaggcagcagcagcagctaaatcaggggacagggtgcgcattgcagtcctaggggccagcggttatactggagctgagattgtccgtattctggcgaaccaccctcagtttcagataaaagtgatgactgcagatagaaaagctggtgaacaatttggatctgtatttcctcacttgatatcacaggacctgccaagactgattgcggtaaaagacgccgacttttcaggtgttgatgctgttttttgttgcttgccacatggtactacccaggaaattatcaaaggcttacctcggcacttgaagattgttgatctctctgcggactttcgactgcgtgacatcaatgagtatgctgaatggtatggccattcgcacagggcaccagaactgcaggaagaggctgtgtatggtttgaccgaacttcatcgagatgacataagaaatgcacaattggttgcaaatccagggtgttatcccacatccattcaactcccgcttgttcctctggtgaaggcaaaattgatcaagttgaccaacattatcattgatgcaaaatctggggttagtggtgcaggacgtggggctaaggaagcaaatctttacactgaaattgccgaaagtatccacgcttatggaataacaagccaccgacacgttcctgagattgagcaaggacttaccgatgctgctcaatcaaaagttaccatcagttttactccacatctgatgtgtatgaaacgtgggatgcaatctactatgtatgttgaattggcgtctggagtgactgccaatgatttgtacgaacacctcaagtctacttatgagggtgaagaatttgtcaaactgttagatggtagcagtgctcctcacacgagccatgttgcaggatcaaactactgtatcatgaatgtctatgaggatagaattcctggaagggccatcatcatctctgttatagataatcttgtgaagggagcatctggtcaggctgtgcagaaccttaatctgatgatggacctgcctgagaacatggggctgcaataccagcccctgtttccttgatctttcatgtcaatacttcatccatgatgacagcttgggagcacagcttcccttccatcagagtactgtttggaggcaaggagcccccattagaatgtaatcaagtcaaacttgctcggaagtgtagcttggctcgtgtcatttttttagagaagacaacttagcagtgcaatgatagtatagtattaggtgagtggcttggttccaataaaatcacaagcattgttgtttcttataattatcaaggaatcaatagttagggtgtgttctgtattattttcgacagatgtcactacagctatttttgtgaaggttgaaatggcc

SEQ ID NO: 8642 - protein, 416 aa, Panicum virgatum
  misc_feature: Ceres CLONE 2012653
  misc_feature (1)..(159): Pfam Name: Semialdhyde_dhC Pfam Description: Semialdehyde dehydrogenase, dimerisation domain
  misc_feature (75)..(416): SWISSPROT Homolog: EC 1.2.1.38 N-acetyl-gamma-glutamyl-phosphate reductase
MASSAAAAAAPARAGLAPQNGIFGSNSKPFAGFMLKTAQQVRPLSLHVRGSVASSTRKLFSPKAAAAAKSGDRVRIAVLGASGYTGAEIVRILANHPQFQIKVMTADRKAGEQFGSVFPHLISQDLPRLIAVKDADFSGVDAVFCCLPHGTTQEIIKGLPRHLKIVDLSADFRLRDINEYAEWYGHSHRAPELQEEAVYGLTELHRDDIRNAQLVANPGCYPTSIQLPLVPLVKAKLIKLTNIIIDAKSGVSGAGRGAKEANLYTEIAESIHAYGITSHRHVPEIEQGLTDAAQSKVTISFTPHLMCMKRGMQSTMYVELASGVTANDLYEHLKSTYEGEEFVKLLDGSSAPHTSHVAGSNYCIMNVYEDRIPGRAIIISVIDNLVKGASGQAVQNLNLMMDLPENMGLQYQPLFP

SEQ ID NO: 8643 - DNA, 1841 bp, Panicum virgatum
  misc_feature: Ceres CLONE 2012688
  misc_feature: Encodes the peptide sequence at SEQ ID NO. 8644
gattgggaattgggatcacaggtggatccaattcgtctcgcaattgccaccgccgtttaattcgccggtggcgtcacccatcacccagtagctcccttccttcctccgacgaggccaacctttagcacccagttccatatcgccgtcgcaacccctggcagaaatattccatgcatcgcaggcgtttcccaccctataaaaccccgtgtaatcccccgccctgatgcaccggcggcacacacggcggagttcggattattcctcggccgactcggctcatctctcaagtctccggtctcctgctagcctgcctgtaactgtgcgattctgaagggagattacgttgagcaggatgaatgcattggcagcaaccagcaggaacttcaagcaggcagctaaactgctcggcctcgactcaaagctagagaagagcttgctcatcccattcagggagatcaaggttgaatgcacaatcccaaaagatgatgggactttagcgtcctatgttggttttagggttcaacatgacaatgctaggggacctatgaagggtggaatcagataccaccatgaggttgatcctgatgaggtcaatgccttggcacaactaatgacatggaaaacagccgtggccaacataccgtatggaggagctaaaggtggaataggatgcagtcctggagaattgagcatctctgagcttgagcggcttacccgagtttttactcagaaaatccatgacttaattggcatccatactgatgtcccagctccagacatgggcacgaactcacagacaatggcatggatacttgatgagtactcaaaattccatggttactcacctgctgtggtcacaggaaagcctgttgaccttggaggatcattggggagagatgcagctactggaaggggagttctgtttgctactgaagctttgcttgcagagcatggcaaaggcattgcaggccagcgtttcgttatacagggattcggtaatgttggttcctgggcagctcaactgatcagtgaagccggtggcaagatcattgctattagtgatgtcacaggcgcagtcaagaacgtcaatggccttgacatcgcccagttagtgaagcactcggcagataacaaagggatcaagggcttcaacggaggagatgcgatcgatcccaactcactgctcactgaagattgtgacgtcctcatcccggcagcacttgggggagtcataaacaaagacaatgctaatgacattaaagcaaagtacatcatagaggccgccaatcaccccacagaccctgaggcagacgagatcctgtcaaagaaaggcgtcctcatcctgcctgacatactcgcgaactcgggcggtgtcaccgtgagctacttcgagtgggttcagaacatccaggggttcatgtgggacgaggagaaggtgaacgcggagctccggacgtacatgacgcgcgccttcggggacgtcaaggccatgtgccggagccacaactgcgacctccgcttgggcgccttcactctcggcgtcaaccgcgtcgcgcgcgccaccgtgctcaggggatgggaagcctgatgatctcgtcctgacccatgccatgtgtctcgaatgtttttcttgagcctaatttttcttttcgttaccgatcaagggaggtctgagaaaaacttcagctaataattacaagatgtgtgtatctcttgttggagatcaatctagagaaaaaaaacagcattaataaatctgtaattcgtagctgagaaagatgcttgtacgtttgcaagcagcaatgccatttgatttctcgcaaaaaaaaaaaaaaaaaaaa

SEQ ID NO: 8644 - protein, 411 aa, Panicum virgatum
  misc_feature: Ceres CLONE 2012688
  misc_feature (1)..(131): Pfam Name: ELFV_dehydrog_N Pfam Description: Glu/Leu/Phe/Val dehydrogenase, dimerisation domain
  misc_feature (1)..(233): Pfam Name: ELFV_dehydrog Pfam Description: Glutamate/Leucine/Phenylalanine/ Valine dehydrogenase
  misc_feature (1)..(411): SWISSPROT Homolog: EC 1.4.1.3 Glutamate dehydrogenase
  misc_feature (1)..(411): SWISSPROT Homolog: EC 1.4.1.3 Glutamate dehydrogenase B
MNALAATSRNFKQAAKLLGLDSKLEKSLLIPFREIKVECTIPKDDGTLASYVGFRVQHDNARGPMKGGIRYHHEVDPDEVNALAQLMTWKTAVANIPYGGAKGGIGCSPGELSISELERLTRVFTQKIHDLIGIHTDVPAPDMGTNSQTMAWILDEYSKFHGYSPAVVTGKPVDLGGSLGRDAATGRGVLFATEALLAEHGKGIAGQRFVIQGFGNVGSWAAQLISEAGGKIIAISDVTGAVKNVNGLDIAQLVKHSADNKGIKGFNGGDAIDPNSLLTEDCDVLIPAALGGVINKDNANDIKAKYIIEAANHPTDPEADEILSKKGVLILPDILANSGGVTVSYFEWVQNIQGFMWDEEKVNAELRTYMTRAFGDVKAMCRSHNCDLRLGAFTLGVNRVARATVLRGWEA

SEQ ID NO: 8645 - DNA, 1142 bp, Panicum virgatum
  misc_feature: Ceres CLONE 2012819
  misc_feature: Encodes the peptide sequence at SEQ ID NO. 8646
aggctttgaagacttgaaccctgcccctctcctcccccctccccctcgcgcaacccgcacgcgattcccccaccttccttccccgctttgccctcgccaagaccgtgagtacaggtgccgcggcgatgaggtcggccgtggcccgtttgatccgctcctcctccgcttccgcctccgcctcccgtctcagctcatcaccggttttgctggaaactgggaaagcattctccagcaatgccacgcccagtgatccgaagcacatcgaggagccttttaaggtggaggaggcagaaactgtgaaggtgaaaccaccttctccagaaaagctgctagtgctaggaggaagtggttttgttggatcacatgtttgcaaagaggctttggacaaaggatttgttgtctctagtcttaatcgatctggaaagccatctgtaagtgaatcatgggctgacaaagttatatggaaccaaggcaacctcctggaaccagcttcattgaaggatgctatggatgatgtttctgcagtgatatcttgtgttggaggttttgggtcaagttcattcatgtacaagattaatgggactgcaaacatcaatgccattagggctgcagctgagaaaggtgtaaagagatttgtatatgtgtcggctgcagacttcggtttagtgaattacttactgaaaggttattacgatggcaagagagctgcagaagctgaattgctgtcaaaattcacatatggaggagtgatactgaggcctggttttattcatggaactcgtcgagtgggcagtgtaaagatacctcttagtgttgttggcgcccctatggaaatggtgctccaaaacgcaaagccattgaccagactaccagttgttggcccgctgttgacacctccagtgagtgttacctcggtggcgaaggttgcggtgagagcagcgacagatccggtgttcccccctggcatcgttgatgtccatgggatcatgcgatacagcgagcaaaagtaaacagtcgcatgtacaggatgatgtatacatgtgcccgtgcttaccagatctacctggcgcttgtatcttctcgaaatgaataattggaaagccaacatgtgacctttttacagccgtttattggttagttcc

SEQ ID NO: 8646 - protein, 294 aa, Panicum virgatum
  misc_feature: Ceres CLONE 2012819
  misc_feature (1)..(107): Pfam Name: Epimerase Pfam Description: NAD dependent epimerase/dehydratase family
MRSAVARLIRSSSASASASRLSSSPVLLETGKAFSSNATPSDPKHIEEPFKVEEAETVKVKPPSPEKLLVLGGSGFVGSHVCKEALDKGFVVSSLNRSGKPSVSESWADKVIWNQGNLLEPASLKDAMDDVSAVISCVGGFGSSSFMYKINGTANINAIRAAAEKGVKRFVYVSAADFGLVNYLLKGYYDGKRAAEAELLSKFTYGGVILRPGFIHGTRRVGSVKIPLSVVGAPMEMVLQNAKPLTRLPVVGPLLTPPVSVTSVAKVAVRAATDPVFPPGIVDVHGIMRYSEQK

SEQ ID NO: 8647 - DNA, 905 bp, Panicum virgatum
  misc_feature: Ceres CLONE 2012825
  misc_feature: Encodes the peptide sequence at SEQ ID NO. 8648
gggactcaagccagcatccatttcttcgttttggttagcagtataagcaggcactagcactacttgtagtaagctggccatggccccaaccgtgatggcttcatcggcgacctcggttgctccattccagggcctcaagtccaccgctggactccccgtcagccgccgctccagcagctccggcatcgtcagcaacagcgggatgaggatcaggtgcatgcaggtgtggccggtggacaacaacaagaagttcgagaccctgtcgtacctgccgccgctgtccaccgaggagctcctgaagcaggtggactacctgatccggtccaactggatcccctgcctcgagttcagcagcgtcggcttcgtctaccgtgagaactccaactccccggggtactacgacggccgctactggaccttgtggaagctgcccatgttcggctgcaccgacgccacccaggtgtacaaggagctcgaggaggccaagaaggaataccccaactcctacatccgcatcctcggcttcgacaacatcaagcagacccagtgcgtcagcttcatcgcatacaagcccccgggcgccaactaagcttaccaggcgtcagtcagctcactcctcatggtgagcgcgaccgtcaagtgtctatactctatactcggcttcggcttgggcaactttgacgctgcgtttggagtcaccttgcttaattatttcctaatttttttttcctttaatttcttggtcaagactgtgtgtatggagtatgtacatgtatcaacgtaggctgagaggagcatgcatatgcatatgtgaatgctagcgccggctacacatatacgcatgcacatcgtataatatatacagtgcacacaattcctccacccaaaaaaaaaaaaaaaaaaaa

SEQ ID NO: 8648 - protein, 169 aa, Panicum virgatum
  misc_feature: Ceres CLONE 2012825
  misc_feature (1)..(109): Pfam Name: RuBisCO_small Pfam Description: Ribulose bisphosphate carboxylase, small chain
  misc_feature (1)..(167): SWISSPROT Homolog: EC 4.1.1.39 Ribulose bisphosphate carboxylase small chain A, chloroplast precursor
  misc_feature (1)..(167): SWISSPROT Homolog: EC 4.1.1.39 Ribulose bisphosphate carboxylase small chain, chloroplast precursor
MAPTVMASSATSVAPFQGLKSTAGLPVSRRSSSSGIVSNSGMRIRCMQVWPVDNNKKFETLSYLPPLSTEELLKQVDYLIRSNWIPCLEFSSVGFVYRENSNSPGYYDGRYWTLWKLPMFGCTDATQVYKELEEAKKEYPNSYIRILGFDNIKQTQCVSFIAYKPPGAN

SEQ ID NO: 8649 - DNA, 1835 bp, Panicum virgatum
  misc_feature: Ceres CLONE 2012925
  misc_feature: Encodes the peptide sequence at SEQ ID NO. 8650
ccccctacccaccaccaccaccgccattagcctcctgattcccgcgccacctagtcccgaacccccgtcccatgcccgcggcagccactgaggcgcgagtgagtgagcagagcgaggcctgatgcggcagcggcagcagggggaggagcaccaggagctgttcgtgcagtggaggccctgcgacaagaagaggtcttaggcctcgagccgagtccgtccgcggatccactcatccactcggggcgcacgtgaaggcgccgtcttttcggctcgccgccgccgtcttttcggaagatgagcgtgtccgtggggaagacccgggtggggaggtacgagctgggccggaccctcggggagggcaccttcgccaaggtcaagttcgccaggaacgtcgagaccagcgagaatgtcgccatcaagatcctcgacaaggagaaggtgctcaagcacaagatgatcgcccagataaagcgtgagatctcgaccatgaagctcatcaggcatcccaacgtcatccggatgtatgaggtgatggctagcaagacaaagatttacatagtgatggagcttgtcaccggtggtgaacttttcgacaagattgcttcccgtggaaggctgaaagagaatgatgcgaagaagtatttccagcaggtgatcaatgctgtcgattactgccacagcagaggcgtctaccaccgtgatctcaagcctgaaaaccttctgcttgatgctagtggcacactcaaggtgactgattttggattgagtgcactatctcaacaagtccgagaggatggtctgctgcacacaacatgtggaactcctaattatgttgctcccgaggttataaacaacaaagggtatgatggagccaaggctgatctgtggtcatgtggggtgattctttttgtcctcatggcagggtacctcccgtttgaagattcgaaccttatgtcgctttacaagaagatcttcaaggcagatttcagttgcccgtcttggttctccacaagtgcgaagaagctcatcaagaagatattagatcctaatcccaacactaggataacaattgcagagcttattaacaatgagtggttcaagaaggggtatcagcctcccagatttgagacagtggatgttaatttagatgatgtcaactccatttttgacgaatctggcgacccagcacagcttgttgttgagaggcgagaagagagaccatcagtgatgaacgcttttgagctcatctctacatctcaaggcctcaatctcggcacactctttgagaagcaaacgggctctgttaagaaagaaacaagatttgcatcaaggcttcctgcaaatgagatactgtcgaaaattgaagcagccgcaggacccatgggcttcaatgtgcagaagcgcaactacaagctgaagctgcaaggagagaacccgggaaggaaaggtcagctggccattgcaacagaggttttcgaggtgacgccttcgctgtacatggtggagctgcgcaagtccaacggcgacaccctcgagttccacaagttctaccacaacatctcaaacgggctgaaggacgtgatgtggaagccggatggcagcatcgttgaaggcgacgaggcgcggcaccggaggacagcgtgatggatctgcaaccaagtttttttagaagtagcgctgcagataaactagtcagggaactggtggaactaagaagcttgtgactgctctctgtttaaggtgttttctgtgtagatgcgctttcatcagactaaaagtatggataatgcgaatgaaagaatgtgcagagttttcaaaaaaaaaaaaaaaaaaaa

SEQ ID NO: 8650 - protein, 449 aa, Panicum virgatum
  misc_feature: Ceres CLONE 2012925
  misc_feature (7)..(443): SWISSPROT Homolog: EC 2.7.11.1 CIPK-like protein 1
  misc_feature (9)..(444): SWISSPROT Homolog: EC 2.7.11.1 CBL-interacting serine/threonine-protein kinase 24
MSVSVGKTRVGRYELGRTLGEGTFAKVKFARNVETSENVAIKILDKEKVLKHKMIAQIKREISTMKLIRHPNVIRMYEVMASKTKIYIVMELVTGGELFDKIASRGRLKENDAKKYFQQVINAVDYCHSRGVYHRDLKPENLLLDASGTLKVTDFGLSALSQQVREDGLLHTTCGTPNYVAPEVINNKGYDGAKADLWSCGVILFVLMAGYLPFEDSNLMSLYKKIFKADFSCPSWFSTSAKKLIKKILDPNPNTRITIAELINNEWFKKGYQPPRFETVDVNLDDVNSIFDESGDPAQLVVERREERPSVMNAFELISTSQGLNLGTLFEKQTGSVKKETRFASRLPANEILSKIEAAAGPMGFNVQKRNYKLKLQGENPGRKGQLAIATEVFEVTPSLYMVELRKSNGDTLEFHKFYHNISNGLKDVMWKPDGSIVEGDEARHRRTA

SEQ ID NO: 8651 - DNA, 1738 bp, Panicum virgatum
  misc_feature: Ceres CLONE 2012969
  misc_feature: Encodes the peptide sequence at SEQ ID NO. 8652
agttaccaaacacaatcacaccttgtcctgcggattaagctctgccaacgtcgctaatggcggtggtttacctgctgttagccgcgctaatcgcctcctgccatgcacaagccgcgcctggcgatcgtccctggccggcctccctcgccgcgctcgcggcggagggcaagctccggaccgacagcaacgccaccgtgccggcctccatggacttcggcaacatcacctccgcgctcccggcggccgtactctacccgtcgtccccggccgacctcgccgcgctcctcggcgcggcgcacgccacccccgggtggccgtacaccatcgcgttccgcggccgcggccactccctcatgggccaggccttcgcccccggcggcgtggtcgtcaacatgccgtccctcggcggcagcgccgccgccccgcgcgtcaacgtgtcggcggacggccggtacgtggacgccggcggcgagcagctgtggatcgacgtgctgcgcgcgtcgctggcgcgcggggtggcgccgcggtcgtggacagactacctctacctcaccgtcggcgggacgctctccaacgccggcgtgagcggccagacgttccgtcacggcccccagatatctaacgtgttggagctggacgtgatcaccggccgcggggagacggtgacgtgctccaaggagctccacgctgacctgttcgacgccgtcctcggcgggctgggccagttcggcgtgatcacccgagcccggatcgcgctggagccggcgccggcgcgggcgcggtgggtgcgcctcgtgtacacggacttcgccaccttcaccgccgatcaggagcggctcatccggccgctgcccggcggcgcgttcgggccgttgagctacgtcgaggggtcggtgttcgtgaaccagagcctcgcctccgacctcaagaacacgggcttcttctccgacgccgacgtcgccagggtcgtcgcgctcgccaaggagaggaacgtcaccgccgtgtacagcatcgaggccaccctcaactacgacaacgccacggcttctgcctcggtggatcaggtgctcaagcccgtgctggacgggctcaggttcgagccggggttcgcgttcgagcgcgacgtggcgtacgtggagttcctggaccgggtgcacggcgaggaggtggcgctggacaagatcgggctgtggcgagtcccccacccctggctcaacatgttcgtgccggggtcgcgcatcgccgacttcgaccgcggcgtcttcaagggcatcctgcaaggcaccgacatcgtcggccccctcatcgtctaccccgtgaacaaagccaagtgggacgacggcatgtcggcggcgacgccggcggaggacgtgttctacgtggtgtcgctgctcttctcgtcggtggcggacgacctggcgaagctgcaggcgcagaaccggaggatcctgcggttctgcgacctcgccgggatccagtacaagagctacctggcgcgctacacggaccgcggtgactgggtccggcacttcggcgccgacaagtggaaccggttcgtggagatgaagaacaagtacgaccccaagaagctgctgtcccccggccaggacatcttcaactgacccatgcatcgccactaactcgggtcgcaaatgctttcttgggttaataatgtgaattctcagccgttaatttgtatagatagatgatctattgcaaaaaaaaaaaaaaaaaaaaa

SEQ ID NO: 8652 - protein, 521 aa, Panicum virgatum
  misc_feature: Ceres CLONE 2012969
  misc_feature (1)..(288): Pfam Name: Cytokin-bind Pfam Description: Cytokinin dehydrogenase 1, FAD and cytokinin binding
  misc_feature (1)..(521): SWISSPROT Homolog: EC 1.5.99.12 Cytokinin dehydrogenase 1 precursor
  misc_feature (41)..(521): SWISSPROT Homolog: EC 1.5.99.12 Cytokinin dehydrogenase 4 precursor
MAVVYLLLAALIASCHAQAAPGDRPWPASLAALAAEGKLRTDSNATVPASMDFGNITSALPAAVLYPSSPADLAALLGAAHATPGWPYTIAFRGRGHSLMGQAFAPGGVVVNMPSLGGSAAAPRVNVSADGRYVDAGGEQLWIDVLRASLARGVAPRSWTDYLYLTVGGTLSNAGVSGQTFRHGPQISNVLELDVITGRGETVTCSKELHADLFDAVLGGLGQFGVITRARIALEPAPARARWVRLVYTDFATFTADQERLIRPLPGGAFGPLSYVEGSVFVNQSLASDLKNTGFFSDADVARVVALAKERNVTAVYSIEATLNYDNATASASVDQVLKPVLDGLRFEPGFAFERDVAYVEFLDRVHGEEVALDKIGLWRVPHPWLNMFVPGSRIADFDRGVFKGILQGTDIVGPLIVYPVNKAKWDDGMSAATPAEDVFYVVSLLFSSVADDLAKLQAQNRRILRFCDLAGIQYKSYLARYTDRGDWVRHFGADKWNRFVEMKNKYDPKKLLSPGQDIFN

SEQ ID NO: 8653 - DNA, 1786 bp, Panicum virgatum
  misc_feature: Ceres CLONE 2013060
  misc_feature: Encodes the peptide sequence at SEQ ID NO. 8654
ccataacacgcaaaagccaagaaaatcaagtaatcatcaacccttccttgccctttagccagctgctgggcctcgatcggcgacgtcatcactcaggatgagtagccaaggacaagcagcggcgcccctcgcccggggagacgcggacggtgacgccggcggcggcaccaaggccgcggcacacttcgtgttcgtcccgcttaacgagcgcggccacctgatcccggccgtcgacaccgcgctgctgctggccacccacggcgcggtctgcaccatcgtcgggcccccgtccacgacctcgaaggtgcgccagaccgtcgagtccgcccagcagtccgggctgccggtccggctcgtcgacttccccctcgactacgccgcggccggcttgccggagggggcggactacgcggaccgcatcgagggcacgtacatgatgaactactaccgcgcggtggggctcctccgcgcgccgatcgagcgctacctccgcgcgcacgacccgtacccgacctgcatcatcgccgacatcttcaacccctggaccacggagctcgccgccggcctcggggtcccgcggctcagcttcttcagcatctgcgccttcaccatcctgtgccagcacaacctcgaaaggttcaacgcgtacgacggcgtcgaggaccccaacgcgccggtcgtcgtgccgggcatcgagaggaaggtcgtggtgacgcgggcgcaggcgccgggcttcctccgcgggatcccgatccccgattgggtggagctggcggactacatcgagcgcgcgcgcgccgaggccgacggcgtggtcatgaacacggtcctggagatggagccggagtacgtcgccggctacgcggaggcccgggggatgaatgtttggaccgtcgggccggtgtcgctgtaccaccacggcgccgcgacgctggcgtcgaggggggacagcgcccccgccatcggcgccgcggagtgcctccgttggctcgacggcaaggagcccggctccgtggtctacgtcagcttcgggagcatcgcgcaggcgggcccgaagcagctcctggagctcgccctcgggctggaggcgtcggggcaccccttcatctgggtggtccggaacgccggcgggtacgacgaggcggtgcgcggctcgctggcggagctggaggcgcgcgtcgcggggcgcggcctgctcgtcagggggtgggcgccccaggcggcgatcctgtcccacgccgcggtgggcggcttcgtgtcccactgcgggtggaactcgacgctggaggccatcgcggccgggctgccgctggtgacgtggccgcacttcacggaccagttcctgaacgagaagatggccgtggaggtgctgggcatcggcgtcagcgtcggggtcaaggagcccctggcgttccaggcctcgaacaaggagactctggtggggcggggcgtggtggagaaggccgtgagggacatcatgggcggcggggaggaggccgagaggcggcggcagcgggcgcgcgagctcgccgccaaggcgagggccgccgtgcaggagggcgggtcgtcgcacgccaacctgctggatctggtcaagcgtttcgggaagggcgctgcagccgcgcctagtgacaagtctagcgcagcgtcatgagtgaccaattaaaccgggagtgccaccaccaccagcagaatcagagagaacttggacaattatattgttggtgtcagcaaatctgattaataaattcgtattgttttgcatcaaaaaaaaaaaaaaaaaaaa

SEQ ID NO: 8654 - protein, 518 aa, Panicum virgatum
  misc_feature: Ceres CLONE 2013060
  misc_feature (1)..(127): Pfam Name: UDPGT Pfam Description: UDP-glucoronosyl and UDP-glucosyl transferase
MSSQGQAAAPLARGDADGDAGGGTKAAAHFVFVPLNERGHLIPAVDTALLLATHGAVCTIVGPPSTTSKVRQTVESAQQSGLPVRLVDFPLDYAAAGLPEGADYADRIEGTYMMNYYRAVGLLRAPIERYLRAHDPYPTCIIADIFNPWTTELAAGLGVPRLSFFSICAFTILCQHNLERFNAYDGVEDPNAPVVVPGIERKVVVTRAQAPGFLRGIPIPDWVELADYIERARAEADGVVMNTVLEMEPEYVAGYAEARGMNVWTVGPVSLYHHGAATLASRGDSAPAIGAAECLRWLDGKEPGSVVYVSFGSIAQAGPKQLLELALGLEASGHPFIWVVRNAGGYDEAVRGSLAELEARVAGRGLLVRGWAPQAAILSHAAVGGFVSHCGWNSTLEAIAAGLPLVTWPHFTDQFLNEKMAVEVLGIGVSVGVKEPLAFQASNKETLVGRGVVEKAVRDIMGGGEEAERRRQRARELAAKARAAVQEGGSSHANLLDLVKRFGKGAAAAPSDKSSAAS

SEQ ID NO: 8655 - DNA, 1909 bp, Panicum virgatum
  misc_feature: Ceres CLONE 2013179
  misc_feature: Encodes the peptide sequence at SEQ ID NO. 8656
gaccccggatctgcgagcaacctgagcagtcgccgccctccctgccaagctcctccgccggcccgatttgtgtccctgccctcgtcgagttggatctgcgccgccggcccttccgtcccccgagaccaagcagcgccggcgcccctgccttgtcccccaactgaagcaacgccgcggtccctgtcctcccgccgaccggagctgcgctggtgcaaggagttaatcctgattctcagaaaaacgaggtccagaaaagcggaaacaaatagggccctcgacttccccatcgccgccacccgccgccgctctcgaagatgcttgacatcaacctcttccgcgccgacaagggcggcaacccggacatcatccgcgagtcccagcgcagccgattcgcgcccatcgagctcgtcgacgaggtcatcgcgctcgacaaggcatggcgcgaaaggcagttcgaggtggacaagatccgccaggagctcaacgccaccagcaagaagatcggcaagctcaaggctagcaagcaagaagaggaagcaaagaagctgatggagagtacggacgagatcaagaagaggctggctgccaaggaagctgaggtgcaggaggccaagagcaccctcgacgccaagctcaccacgattggcaacatcgtgcatgcgtccgtgcccatcagcgacgacgaggcaaacaatgccattgtacggacatggggagagaagagagtggaggaaaatttgaagaatcacgtggatctttgcaggatgcttgacattgttgcactggagaagggtgctgacgtggctggtggtaggggttactatttgaaggatgaaggtgtcctcctgaacctggcattgataaatttcgggctaactttcctgcgaaaacaaggctttaagccaatgcaaactccttttttcatgagaaaggaaactatgggaaaatgtgcccagctggcacagttcgatgaggagctttacaaggtaacaggtgacggtgaggataaatacctcatagccacatctgaacagccattgtgtgcttatcatttaggtgaccgaatttacccttctgagcttccaataaaatatgctggctactccacttgcttccgaaaagaagctggttcgcatggaagggacacagctggcatcttcagagtccaccaatttgaaaagattgaacagttctgtgttacaagcccaaatggcaatgattcttgggaggtgcatgaagagatgttaaaaaattcagaagatttctatcaggagattggcctaccatatcaggtcgtctctattgtctctggtgcacttaatgatgctgcagctaaaaaatatgatttagaagcatggttccctgcatcgaaaaccttcagagaattggtgtcctgttcaaattgcactgactttcaagcaaggaggcttggaattggttacggacagaaaaaaaatgacgagcagtccaaacagtttgttcatatgctcaattctacgttgactgccactgagaggacactgtgttgtattctggaaaacttccagaaggaggatggtgttgaagtgccaaaggcgctgcaaccgtacatgggtggaatagagttccttcctttcaagcaacctctggatgtcaaacaagctgctgactcgaaatcaaacaagtccaaatcaaagggaaatgctgcttgaggtggatgaggaacaaagtcaaaatgcatgcgatgcggaagtgatagacattgtgcatccttgtattaattttggggggtaacagtacttgtagcatgatcatgacgttgcaatttttctgtacccattttggtttgttggtttaccacactatctgatgacgtacttgcacactgatattgcatagggtttcttgcaatctagaatgtttgagcacc

SEQ ID NO: 8656 - protein, 458 aa, Panicum virgatum
  misc_feature: Ceres CLONE 2013179
  misc_feature (1)..(434): SWISSPROT Homolog: EC 6.1.1.11 Seryl-tRNA synthetase
  misc_feature (1)..(453): SWISSPROT Homolog: EC 6.1.1.11 Seryl-tRNA synthetase
MLDINLFRADKGGNPDIIRESQRSRFAPIELVDEVIALDKAWRERQFEVDKIRQELNATSKKIGKLKASKQEEEAKKLMESTDEIKKRLAAKEAEVQEAKSTLDAKLTTIGNIVHASVPISDDEANNAIVRTWGEKRVEENLKNHVDLCRMLDIVALEKGADVAGGRGYYLKDEGVLLNLALINFGLTFLRKQGFKPMQTPFFMRKETMGKCAQLAQFDEELYKVTGDGEDKYLIATSEQPLCAYHLGDRIYPSELPIKYAGYSTCFRKEAGSHGRDTAGIFRVHQFEKIEQFCVTSPNGNDSWEVHEEMLKNSEDFYQEIGLPYQVVSIVSGALNDAAAKKYDLEAWFPASKTFRELVSCSNCTDFQARRLGIGYGQKKNDEQSKQFVHMLNSTLTATERTLCCILENFQKEDGVEVPKALQPYMGGIEFLPFKQPLDVKQAADSKSNKSKSKGNAA

SEQ ID NO: 8657 - DNA, 1599 bp, Panicum virgatum
  misc_feature: Ceres CLONE 2013226
  misc_feature: Encodes the peptide sequence at SEQ ID NO. 8658
atctcagtcgcgcgtttgtcacccgcgcccccaaacagggcctatggaaaaggcgggggtaggtgaggaaaagacgctcgattctcatgccgcgttgaaggaaagcgaagttcatgtgtattctgcgcttctcagaggcttcctcgaccgccatcgtggccccatcttctccgccgccggtgctcgccatggtttcctcggccgcagctgctcgccgcctcctactcctccgccaccaccgccaccttctacccagacgctacatctcttcctcgtccgcagccgatggcctcggcgacaacggcggcggcggcggccgcctcaagatcttcgaccgcgacctgaagcgccggcaccgagaccgcgcggcgtgggcgatgcgggagaccgacgggttcgtggatgccgtcgctgagaacctcctagaccgccttgaggactgcaggaaggcgttcccctccgcgctctgcctcgggggttctgccggtgccgtccgccgcttgctccacggccgcggtggaattgagaagctgatcatgatggacatgtcgcccgacatggtgaggaagtggcgagaatcagagaatgctaacgatgacggaccagagacgcactttgttgtcggtgatgaggagttccttccaatcaaagagagctcaaaggatttgataataagctgtcttgggcttcattggacaaatgatcttcctggagcaatgatacagtgtaggctggcgttgaaacctgatggcctttttctcgctgcaattcttggtggagaaacactgaaggagcttagaattgcatgcaccattgcacaaatggaacgagaggggggcatcagtcctcgaatgtcacctttggcacaagtccgtgatgcaggaaaccttttgacaagggcaggcttcacccttccaggagttgatgttgatcagtatactgttaaatacaacagtgctttggaacttgttgaacatcttagagcaatgggggaaacaaatgctctgtttcaaagaaatcctgtgttaaaaagggatacagccttggcaactgcagcaatttaccagtcaatgtttgggttagaggacggatctattccagcaacatttcaagtaatgtacatgactggctggagggagcatccatcacagcaaaaggctaagagaaggggttccgcgaccatatcatttagtgacatacagaaagaatttgctcccagtgagaactgagctttgctgcttcaaaatgtcagtattccctaacccccttgatctaaaaagaaaaacaatacatggggaaagaaaagaactcttccaacagctaccccgaagcttcatatttcttttattcaaaaaagcttcatatttctgagggttcacatttgcagaaagcaagtgcgcttctgttggttgtatcaattttctgtgggaaatcatttaatctgtatcaaccatgatcctgctgcgaatagtagtgcatggagaaccaatgttgcctgttcatactgagtttgaggaagcccagaaagccagaacatgtgaaatgttacaagacactaccactgttattgtcgtgacttaaaaaaaaaaaaaaaaaaaa

SEQ ID NO: 8658 - protein, 371 aa, Panicum virgatum
  misc_feature: Ceres CLONE 2013226
  misc_feature (2)..(101): Pfam Name: Methyltransf_11 Pfam Description: Methyltransferase domain
  misc_feature (20)..(61): Pfam Name: Methyltransf_12 Pfam Description: Methyltransferase domain
MCILRFSEASSTAIVAPSSPPPVLAMVSSAAAARRLLLLRHHRHLLPRRYISSSSAADGLGDNGGGGGRLKIFDRDLKRRHRDRAAWAMRETDGFVDAVAENLLDRLEDCRKAFPSALCLGGSAGAVRRLLHGRGGIEKLIMMDMSPDMVRKWRESENANDDGPETHFVVGDEEFLPIKESSKDLIISCLGLHWTNDLPGAMIQCRLALKPDGLFLAAILGGETLKELRIACTIAQMEREGGISPRMSPLAQVRDAGNLLTRAGFTLPGVDVDQYTVKYNSALELVEHLRAMGETNALFQRNPVLKRDTALATAAIYQSMFGLEDGSIPATFQVMYMTGWREHPSQQKAKRRGSATISFSDIQKEFAPSEN

SEQ ID NO: 8659 - DNA, 1554 bp, Panicum virgatum
  misc_feature: Ceres CLONE 2013301
  misc_feature: Encodes the peptide sequence at SEQ ID NO. 8660
ttctcggatctcaccaatttctgtcctgacgccatggccagcatccccaaggccctcgtcgtcttcttcgccgtcgccgtgttcctctgcggcggccacgcgcaccgcaaggaccatacagcgagcgtctacgacgtgacggagtacggagcggcgccgagcaaccgagacaacagagacgctttcttggccgcgtggcgcgcggcgtgcggctccaccgccggcaactcgacgctcgtgttccccaagggcacattcgccgtcggcgccgtgcagttcgaggggccgtgcgcgaacggcgacgcgcccgccgtggtgatccacggcgtgctccagccgtgcgcgggcggcagtggctgccacctctcggacgatgcctggatcacgttcagcagcctgacaaacctcctcgtcaccggcgacggcaccctcgacggtcagggtcatcggaacggcaaggccaagtccaagacaacgaccctggttttcgaggacgtgacgaactcgacgttgaggggcctggcgttcgtgaacagccggggattccacgtgaacctgcgccgctgcacccgggtcgtggccgagggcctcggcatccacgcgccggccgccagccgcaacacggacggcgtccacgtgggccactctcgccacgtccgcatcctcgactcggtcatcggcagcggcgacgactgcgtgtccatcggccccggctccgtcgacgtcgtcgtcagcggcgtcacctgcggccccggccacgggctcagcgtggggagcctgggcaaggacgacggcgagcaggacgtgagcgggctggtcgtgaggaactgcacggtgaagggcaccacgaacggggtgcgcatcaagacgtggccggggtcgccgccgagccgcgcgtccaacatcaccttcgaggatatcgccatggccaacgtcaccaaccccatcatcatcgaccagcgctactgcccccacgaccgctgctccgacgccgacaagccgtcgctggtgcagatcagcgacgtgacgttccggcggatcgagggcacgtccagcggcccgctggcggtgcggctgctgtgcagcgaggagcggccgtgcaccggggtgcgcctcgacggcatcaacctcacctgcggcgacgtcccgtgccgctccgagttctccaacgtgcgggggccgctcgccccggtggtggcgcaggcgccgagcccggcccccgccgcgcgccgggaggaggaagaggctgacgtgacatccagcgtcactcaacagctaggcaggttgactcggtggttaccgtttactgtcagaggatgagttcagatttgaaggggcaacgaaactagggagggtaaatttttagttttttttttgtcctcgatgatggatgggctactgacctagtacttctagattacaagtacaagtactcgtttaggtctggaacggacagcatctttaaggaaaaaatgcctctttgtcaatccttcagttccttttattcatcagagagtaaaaacagttacacttgaaaaaaaaaaaaaaaaaaaa

SEQ ID NO: 8660 - protein, 428 aa, Panicum virgatum
  misc_feature: Ceres CLONE 2013301
  misc_feature: Great-hit functional homolog of the protein sequence encoded by LOCUS At3g07850
  misc_feature (1)..(331): Pfam Name: Glyco_hydro_28 Pfam Description: Glycosyl hydrolases family 28
  misc_feature: Useful for making plants with altered cell wall content and/or composition
MASIPKALVVFFAVAVFLCGGHAHRKDHTASVYDVTEYGAAPSNRDNRDAFLAAWRAACGSTAGNSTLVFPKGTFAVGAVQFEGPCANGDAPAVVIHGVLQPCAGGSGCHLSDDAWITFSSLTNLLVTGDGTLDGQGHRNGKAKSKTTTLVFEDVTNSTLRGLAFVNSRGFHVNLRRCTRVVAEGLGIHAPAASRNTDGVHVGHSRHVRILDSVIGSGDDCVSIGPGSVDVVVSGVTCGPGHGLSVGSLGKDDGEQDVSGLVVRNCTVKGTTNGVRIKTWPGSPPSRASNITFEDIAMANVTNPIIIDQRYCPHDRCSDADKPSLVQISDVTFRRIEGTSSGPLAVRLLCSEERPCTGVRLDGINLTCGDVPCRSEFSNVRGPLAPVVAQAPSPAPAARREEEEADVTSSVTQQLGRLTRWLPFTVRG

SEQ ID NO: 8661 - DNA, 1947 bp, Panicum virgatum
  misc_feature: Ceres CLONE 2013389
  misc_feature: Encodes the peptide sequence at SEQ ID NO. 8662
accatccaaagatccacgtgcaccatccacctctcacgaagccatgaacgtcgccgccggtctcgtcgggtacccgggcctcgcgtccggcgccgccgtggaggcgaaccccgtggagagctgccgcaagggcgacaaggtgaacgagaacctggtgaagtgcacggaccccaaccgggagttcccgtgcccgccgccgtcgcccgccaaggccgtcgacttcacgccggagagcacggtgaagcgcgtccggcagccggcgcacctcctgagcccggagaaccaggagaagtacaaggaggccatcgccaagatgaaggcgctgccggcggcgcacccgctgagcttcgcggcgcaggcggcgatccacgagtcctactgcgacggccactaccgctacgacccggcggagaagaaccggcccttcaacgtgcacttctcctggatattcgcgccgtggcaccgcatgtacatccacttctacgagaaggccctcgggcagctcatcggcgacgacaccttcgcgctgccctactggaactgggacgcgccggccggcatggtggtgccgccgctcttccgggaccccttcggcaacccgctctacaacaaaaaccgcgagcagtcgcgcctcgacaagctcgtcgacctcgacttcctcaacgcccccaccgacgccccgctcatccctttcgacggccccaaagacgacaagtacgaggcacttgttaacaagaacctctgcaccatgtaccagcagcaaattcggggcggcaagggcgcgcgggcgttcctgggcgagaagctgtgcagcgacgcggacgcccggctgaaggagatcaacgcgcgttcgaagaagagaggcgggcagaaggtgaagagggacaagaccaagagccagggctcgctggagcggatggcgcacacggccctgcacgtctgggtcgggcgctccggcccgccggaggggacgacctgctccgccgacaccggcggcgtgctggggcacaacggcgcctacacctgcaacaacgacatgggcttcctgggctcggcaggccgggacccgctcttctactcgcaccactccaacgtcgaccgcatgtggcacatctggtccaccaagctcggcggcgagggcttcaaggacccggagtggctcgacgccagcttcgtcttctacgacggcgtcgagaacccgcggccggtgcggatcaagttccgcgacgtgctcgacacgcgcaacctcgggtacacgtacgacgccgagtcggagaaggagctgccgtgggtggccagcaagatcaacccgctggtgccgcgcggcaagggggcgccgcgggcggcggcgccggcgaaggccctggcgtacccgctgacgctggccgctggcgaggtcgtggaggtggccggcgtggcggtgccggcgaagcaggcggggcagcagcgggtgctggtgatccaggggatcgagtacgaccccaacgtggagaacaagttcgacgtggccatcggcgtgcccggggaccaggccagcaaggtggggcccgaccacaccgagtacgccggcagcttcgccgtcgtgccgagttccaaggccggcggcggcacgctggaggggaggatcacgctcttcgtcgacgacgtgctggacgatgtcatgggcgaccgcgacaccaccgtcgacgtcgtgctcgtgccgcgcacggacgaggagatcaagctccaccttcccccgacgatcgagaaccagagccagaactagtacgtagtactggtcgctcatcgtccaataatgcatcgtgcacagtgcgatgcatggtgtgtccggatgcgtgcagctaagaataaaaatgtcgtgtcgtgtcgtgtgctcgtatcgtacgtgtaataagagaataattcctttgtttttgctctagtctcaaataaagggatgtgccatcc

SEQ ID NO: 8662 - protein, 573 aa, Panicum virgatum
  misc_feature: Ceres CLONE 2013389
  misc_feature (1)..(222): Pfam Name: Tyrosinase Pfam Description: Common central domain of tyrosinase
MNVAAGLVGYPGLASGAAVEANPVESCRKGDKVNENLVKCTDPNREFPCPPPSPAKAVDFTPESTVKRVRQPAHLLSPENQEKYKEAIAKMKALPAAHPLSFAAQAAIHESYCDGHYRYDPAEKNRPFNVHFSWIFAPWHRMYIHFYEKALGQLIGDDTFALPYWNWDAPAGMVVPPLFRDPFGNPLYNKNREQSRLDKLVDLDFLNAPTDAPLIPFDGPKDDKYEALVNKNLCTMYQQQIRGGKGARAFLGEKLCSDADARLKEINARSKKRGGQKVKRDKTKSQGSLERMAHTALHVWVGRSGPPEGTTCSADTGGVLGHNGAYTCNNDMGFLGSAGRDPLFYSHHSNVDRMWHIWSTKLGGEGFKDPEWLDASFVFYDGVENPRPVRIKFRDVLDTRNLGYTYDAESEKELPWVASKINPLVPRGKGAPRAAAPAKALAYPLTLAAGEVVEVAGVAVPAKQAGQQRVLVIQGIEYDPNVENKFDVAIGVPGDQASKVGPDHTEYAGSFAVVPSSKAGGGTLEGRITLFVDDVLDDVMGDRDTTVDVVLVPRTDEEIKLHLPPTIENQSQN

SEQ ID NO: 8663 - DNA, 1551 bp, Panicum virgatum
  misc_feature: Ceres CLONE 2013416
  misc_feature: Encodes the peptide sequence at SEQ ID NO. 8664
attccattcaaaaggcaaccgcttgcttggctggctagcccaggtgccttctcgctgcccgccgcggcgccgccaacctccacttccagaagcagagagggccgccgcgagagatctcaccgtccccagccaccacctcctcctcctcctcgtactagctgctcgtacccgcgttcggactcccactccaacccgaaggccgaaacctgtagccgcgccacccccgcgccggacccaatccggggacgccacgctcgccgcgcgccgccgccacctcgtatcagttgctgcgtgcgaggtgtgttagcccatgccctggatgaccaagttgctgctccagcttcaggcggcggcggcggacaggaggcacggcctcggcctcagcctcggcttcggcccggggcgcggccgtcgccacccgcagacgccccgccacgctcccgccgccggcagattctccccggcaacggcatgcctcaccctctgcctcctcgccgtcgccgccacgctcgcggtcgcgctgcaccgccaaagccccgaccccgccgcctcgccgcgcggcttctcggtggtgatcaacacgtggcggcgccacgcgctcctgcggaggtccgtcgcgcactacgccgcctgcgcgggcgtcgaggccgtccacgtcgtgtggagcgagccgcggccgccgccggagatcctgcgccggggcgtcctcgtcaacggcacccggcgcggcaccgtgcggttcgagatcaacgaggccgacagcctcaacaacaggttcaggcccatccggggcctcggcacggacgccgtcttctccgtcgacgacgacctcatcgtcccgtgctccacgctccggttcgccttcgacgtgtggcagagcgcgccatctgccatggtgggctttgtgccgcggatgcactggcttgctgacccgagaggcagtacaaaggaataccgatatggaagctggtggtcagtttggtggacaggcacatacagcatggttctttccaaagcgagtttcttccacaggcagtacttggatctgtatacaaacaacatgctaccgtcaattcgcaaatatgtgcatgaaaataggaattgtgaggatattgcaatgtcttttcttgttgcaaatcattctggagctccaccaatatgggtacaaggaaggatatttgagattggatcgaccggcatcagcagtttgaagggccatagtttgcagagatccagatgcctcaacacatttgctgccatgtatggccacatgcctcttgtagccaccacagtcaaggctgttgacagccgcaggaactggttctggtgacatgcctcttgtttggccctgttatctcctttttgtttcattttttaattttacttaggtgctgcctagccatattacaaggctagcgtgtttgtgcataattcatcatcagcacctaagaacacaggttggattgtacacgctgaaagtagaacacagtgaccatattcaaattcacattattgatggagttagtactgtaaaaaaaaaaaaaaaaaaaa

SEQ ID NO: 8664 - protein, 339 aa, Panicum virgatum
  misc_feature: Ceres CLONE 2013416
  misc_feature (1)..(267): Pfam Name: EXTL2 Pfam Description: EXTL2, alpha-1,4-N-acetylhexosaminyltransferase
MPWMTKLLLQLQAAAADRRHGLGLSLGFGPGRGRRHPQTPRHAPAAGRFSPATACLTLCLLAVAATLAVALHRQSPDPAASPRGFSVVINTWRRHALLRRSVAHYAACAGVEAVHVVWSEPRPPPEILRRGVLVNGTRRGTVRFEINEADSLNNRFRPIRGLGTDAVFSVDDDLIVPCSTLRFAFDVWQSAPSAMVGFVPRMHWLADPRGSTKEYRYGSWWSVWWTGTYSMVLSKASFFHRQYLDLYTNNMLPSIRKYVHENRNCEDIAMSFLVANHSGAPPIWVQGRIFEIGSTGISSLKGHSLQRSRCLNTFAAMYGHMPLVATTVKAVDSRRNWFW

SEQ ID NO: 8665 - DNA, 1659 bp, Panicum virgatum
  misc_feature: Ceres CLONE 2013742
  misc_feature: Encodes the peptide sequence at SEQ ID NO. 8666
acatctcagtagctgaacctagcaagtcacagtacgccatggcctctgttccgaagcttctgctcctcctcctgtgcagctatcacactttcgttgctcacgcaggaggtgatcgcagctacaagcttctgtccattggctctctcaattctgactccgtctgctcccagcccaaagcgactccatcgtcgataggcgtcacggtgccgttgcaccaccggcacggcccgtgctcaccggcgccctccaagaaggtgccagcattggaggagatgctccggcgtgaccagctccgagctgactacatccaacgtaagtactccgccgccaagggcggcgccggcgatgtccagcagtcggacgccaccgtaccgaccacgctgggcacgtccctgaacacgttggagtacgtgatcaccgtaggcatcggctcgccggccgcgacccagaccatgctcatcgacaccggcagcgacgtgtcgtgggtgcagtgcaaaccgtgctcgcagtgccactcccaggcggacccgctcttcgaccccagctcgtcgagcacctattcctcgttctcttgcagctctgccacctgcgcgcagctcggccaggaggggaacggctgctcgcgctcccagtgccagtacattatcacctacggcgacggctcgagcaccaccggcacctacagctccgacacgctcgcgctgggctccaacaccgtcaggaacttccagttcgggtgcagccaggtggagtcgggcttcaacgaccaaaccgacgggctcatggggctcggcggcggcgcgcaatcgctcgcgtcgcagacggcggggacattcggcagggccttctcctactgcctcccgccgactccgggctcctccgggttcctcacgctcggcgccggaacttccggcttcgtcaagacgccgatgctccggagcagccaggtccccacgttctacggcgtccgccttcaggcgatcagggtgggagggaaacagctcagcatacccacctcggtcttctcccccgggacggtcatggactccggcacggtcatcacgcgcttgccgcggacggcctactcggcgctgtcgtcggcgttcaaggccgggatgaagcagtacccgtcggcaccgcccagcggcatcctcgacacgtgcttcgacttcagcggccagtccagcatcagcataccgaccgtcgcgctggtgttctccggcggcgcggtcgtcgacctcgacccgaacgggatcatactgagcagctgcctcgccttcgcgggcaacagtgacgacagctccctcggcatcatcggcaacgtgcagcagcggacgttcgaggtcctgtatgacgttggcgggggcgctgtgggcttcaaggctggggcgtgctgatgatcgccgagcacaagaacattattgacacgacggggaggaagcaagcaggtgggcttctcctctcgaggtgtttgtggctgcgaggtaacagacatgaagtgggacaaaccatcagctattcaactatagtactccgatttgaattatttttgtgattgcgacgtgatgcaaatgtgcaaactaccaaccaaaagataattgtaattttcttctgatattatatgaataaagattaataatatactatgttgcttttctc

SEQ ID NO: 8666 - protein, 452 aa, Panicum virgatum
  misc_feature: Ceres CLONE 2013742
  misc_feature (1)..(336): Pfam Name: Asp Pfam Description: Eukaryotic aspartyl protease
MASVPKLLLLLLCSYHTFVAHAGGDRSYKLLSIGSLNSDSVCSQPKATPSSIGVTVPLHHRHGPCSPAPSKKVPALEEMLRRDQLRADYIQRKYSAAKGGAGDVQQSDATVPTTLGTSLNTLEYVITVGIGSPAATQTMLIDTGSDVSWVQCKPCSQCHSQADPLFDPSSSSTYSSFSCSSATCAQLGQEGNGCSRSQCQYIITYGDGSSTTGTYSSDTLALGSNTVRNFQFGCSQVESGFNDQTDGLMGLGGGAQSLASQTAGTFGRAFSYCLPPTPGSSGFLTLGAGTSGFVKTPMLRSSQVPTFYGVRLQAIRVGGKQLSIPTSVFSPGTVMDSGTVITRLPRTAYSALSSAFKAGMKQYPSAPPSGILDTCFDFSGQSSISIPTVALVFSGGAVVDLDPNGIILSSCLAFAGNSDDSSLGIIGNVQQRTFEVLYDVGGGAVGFKAGAC

SEQ ID NO: 8667 - DNA, 2025 bp, Panicum virgatum
  misc_feature: Ceres CLONE 2013919
  misc_feature: Encodes the peptide sequence at SEQ ID NO. 8668
ttttaatcaccagataaaacggcaccaaaaagaaaaagtaattaacacaccaccgtactttttcagaacaagtagttccttattcaaatgaacatgatcagatccagatcgtccagaattctggcgacaggtacagtaatgacaagctggctgctctaattgcacgatagcaacagaaacagtatcttaatcttccactctagtagctcgctctactgctctctatataaacagccccttcctcacgctgtcacacaagacatactgtgtaacagccgtcacaagttcacttgcacgcctgcacaccactgcacgggcgcagatcgatcgacatgggctctgtcgccgccgaccggccgcacgccgtgtgcgtgccgttcgcggcgcagggccacgtcacgccgatgctgaagctggccaaggtcctccactgctggggcttccacgtcaccttcgtgaacacggagtacaaccaccgccgcctcctccgctcccgcgccgccggcgcgctcgacggcctcccgggattccgctttgccgccatcccggagggcctgccgccgtccgacgtcgacgccacccaggacgtgccgtcgctctgccgcgccaccatggagaactgcctcccgcacttcaggagcctcctcgcggagctcaacgcctccccggacgcgccgccagtcacctgcgtcgtcggcgacaacgtcatgagcttcaccgtggaagccgccagggagatcggcgtgccgtgcgcgcttctctggacgtccagcacctgcggctacgtgggctaccgctactaccgcaccctcatcgacgagggcgtcttccctctcaaagaggagcagctgacgaacgggttctttgacacgccgttggacaacgcgcccgggttgagcaagcacacccggttcaaggacctcccaagtttcatccgctcgacggaccccgacgagttcatggtccacttcgccctcaaggtgacggagcagatagccagcgcggacgccgtcatcctcaacaccttgtacgagctcgagcaggaggcggtcgacgccatgcgcgccatgatcccgcctgccgagtccatctacgccgtcggcccgctcgccttgctcgccgagcagatcgtgccccagggcggccagctcgacgcgctgggctccagcctctggaaggaggacgtgtcctgcctcgactggctcgacggcagggagcccggttctgtggtgtacgtgaactacgggagcatcacggtgatgacgaacgaggagctggtggagttcgcgtgggggctggccaatagcggacacgccttcctgtgggtcatccggccggacctcatcaacggcgacgccgccgtgctgccgccggagttcctggaggccatcaggggccgcggccacctggcgacctggtgcccgcaggaggcggtgctgcggcacgaggcggtgggcgtgttcctgacgcactccgggtggaactcgacgctggagagcctttgcgccggggtgccgatgctgtgctggcccttcttcgcggagcagcagaccaactgccggtacaagtgcgcggagtggggcgtggccatggagatcggtcaggacgttcggcgggaggccgtggaggggaagatacgggaggccatgggcggggagaaagggaaggagatgcggcgccgcgcggcggagtggcgggaggccgccgtgcacgcgacgcgccccggcgggggctcgtacgccagcctcgagaagctggtggccgacgtgctcctgtcgggtggcaagaggtcttaattcattgccacaggggctgtcctgccaccagtgtgtgttcgtgatccgtgaaatgaatacggcgcaaccgagtgtcaattcaatctgcagctgcgcgtgaaccctaatgcgagtaaataaagtgctctttgtattgcattagtgaaagaagagaaattattttccttgccaaatagagtgtggtatgcactgtcagatgattattgcaatacataaggcttacaaaatt

SEQ ID NO: 8668 - protein, 487 aa, Panicum virgatum
  misc_feature: Ceres CLONE 2013919
  misc_feature (2)..(121): Pfam Name: UDPGT Pfam Description: UDP-glucoronosyl and UDP-glucosyl transferase
MGSVAADRPHAVCVPFAAQGHVTPMLKLAKVLHCWGFHVTFVNTEYNHRRLLRSRAAGALDGLPGFRFAAIPEGLPPSDVDATQDVPSLCRATMENCLPHFRSLLAELNASPDAPPVTCVVGDNVMSFTVEAAREIGVPCALLWTSSTCGYVGYRYYRTLIDEGVFPLKEEQLTNGFFDTPLDNAPGLSKHTRFKDLPSFIRSTDPDEFMVHFALKVTEQIASADAVILNTLYELEQEAVDAMRAMIPPAESIYAVGPLALLAEQIVPQGGQLDALGSSLWKEDVSCLDWLDGREPGSVVYVNYGSITVMTNEELVEFAWGLANSGHAFLWVIRPDLINGDAAVLPPEFLEAIRGRGHLATWCPQEAVLRHEAVGVFLTHSGWNSTLESLCAGVPMLCWPFFAEQQTNCRYKCAEWGVAMEIGQDVRREAVEGKIREAMGGEKGKEMRRRAAEWREAAVHATRPGGGSYASLEKLVADVLLSGGKRS

SEQ ID NO: 8669 - DNA, 1742 bp, Panicum virgatum
  misc_feature: Ceres CLONE 2013924
  misc_feature: Encodes the peptide sequence at SEQ ID NO. 8670
gagacacagctcgtgcgggcggaatcggaatttcagatacgcgcgcgcgaaaaaggggcggggcggacggagacggtcacggtcaccggggctccttctttctactgcgcgtacaacgcacggcgtccgtcctgtcgcacccccgccccacgcccacggtgcctccttcttttacgcgcggcgcggtaggcggaaagacacagcgcccagcgacggcgcgcgagccctcgcgttgcttgcgtctcccggcccccgcccacctcgccccgctcgctttcctcagctagagcctagcgcgcgccttcgtcttcgtcttcgtcctcgccgctagtcgccgacctgccattggggacgccgtaggccggctgcggtgagcagtccgtaacatggggatcaggaggcggcgggatgctgctgctacgatcctcctgggcctcctgcaggtcttcctcttccgctcggcgacgtcgcagtcgttcatcggcgtcaactacgggacgattgccgacaacctcccgccgccggcgtcgacggccagcctgctcatgtccacgtccatcggcaagctccgcctctacgagccccagccggagctggtcgcggcgctcgcgggctccaacatctccatcctgctgggcatccccaacggcgacgtgccgaacctcgcgtcctcccccgccgccgccgcgtcctgggccgccgccaacatccccaccacggtgaccgtctccgccatctccgtcggcaacgagctgctcaactccggcgaccccaccctcgcgccccagctcctccccgccatgcagaacctcctcgccgcgctccccgccggctcgaccaccaagatctccaccgtgcactccatggccgtgctgtcggcgtcggacccgccgtcgtccggcgcgttccactcggacctcgccggcagcctggacccggtgctggacttcctccaccagaacggcgcgcccttcatgatcaacccgtacccctacttcgcctacgcctccgacacgcggccggagacgctggcgttctgcctcttccagcccaacgccggccgcgtcgacgccgtgtccgggctcacctacaccaacatgttcgacgcgcagctcgacgccatccgcgcggcgctggacgccaagggctacggcgacgtggacatcgttgtcgccgagaccgggtggccgtacaagggagacgccgacgaggctggcgccaccgtggacaacgccaaggcctacatcagcagcctcgtggcgcacctcaagtcccaggccggcacgccgcggacgcccggcaagtcggtggacacctacatcttcgcgctctacgacgaggacctcaagggcgggcccgagtcggagcgctccttcgggctgtacaagacggacctgacggcgaactacgacgccgggctagccaagagcggcggcacggcggctccaaccattttgactccgtctccgccgcagggcacgctgcagccgagcaggggggcaacgccgatggggttttgtcagacgacggccaccgtgccgggcagcacgcaagcccaacaggtgccgctgagcagctcgtgctacatcccggccggagccgtgtcgcgtcaggcagacgccggcccatggcagcttgtttggttcggtgttttgctgtgcctggcaatggtagcaggcatgtagttacagcgtttgtaacgtcacggaacaagtacagtacagtccagtttttttttttgc

SEQ ID NO: 8670 - protein, 432 aa, Panicum virgatum
  misc_feature: Ceres CLONE 2013924
  misc_feature (1)..(323): Pfam Name: Glyco_hydro_17 Pfam Description: Glycosyl hydrolases family 17
MGIRRRRDAAATILLGLLQVFLFRSATSQSFIGVNYGTIADNLPPPASTASLLMSTSIGKLRLYEPQPELVAALAGSNISILLGIPNGDVPNLASSPAAAASWAAANIPTTVTVSAISVGNELLNSGDPTLAPQLLPAMQNLLAALPAGSTTKISTVHSMAVLSASDPPSSGAFHSDLAGSLDPVLDFLHQNGAPFMINPYPYFAYASDTRPETLAFCLFQPNAGRVDAVSGLTYTNMFDAQLDAIRAALDAKGYGDVDIVVAETGWPYKGDADEAGATVDNAKAYISSLVAHLKSQAGTPRTPGKSVDTYIFALYDEDLKGGPESERSFGLYKTDLTANYDAGLAKSGGTAAPTILTPSPPQGTLQPSRGATPMGFCQTTATVPGSTQAQQVPLSSSCYIPAGAVSRQADAGPWQLVWFGVLLCLAMVAGM

SEQ ID NO: 8671 - DNA, 1515 bp, Panicum virgatum
  misc_feature: Ceres CLONE 2013961
  misc_feature: Encodes the peptide sequence at SEQ ID NO. 8672
agagtctagacaaaccgaatcatcacgagatgagcttcgtagtaaccaagtcctccccaccggcgctcgttctaccgtcgaagccaacgccggccggtgacattcctctcacttccaccgacaagtcccggctcttcttctcctttacatcgttccatgtcttcgagcgtcccattcatgagccggctcagacgatacggcgagcactgtcccaggcgctggtctactactaccccgttgctggccgcgtcgcggtcggcaccggaggccaggggggcgtccacctcgcgtgcaccggcgagggcgtggcgtttgtctccgcgacggcaagctgcaccctgcaggacgtcgcgtgcctggacgcgccgccggtgataccgctagcggaactcgcgctccagtatggcgggtgctgccggatatccgaccccctgctgctgatgcaggttaccgagttcgcctgcggcgggtacatcgtcgccgtgtcgtggaaccatggcatcgccgacgccttcgggctggcgcagctgctacaagccgtgggcgagctcgctcgcgggctcccctcgccgaccgtcgttccaatcaggtatgacgagtccctcccggacatcccgcagctgttgtctgctgtgttaaagcaggcgcctgctgggttcgagttcaagcacaacgacttcgcctacagcgacgtcaccgtcccttggagtttcatcaaccgcgtcaagggagagttccgccggagccacgccggcggccaaccctgcaccacattcgaggtggtcaccgccgcgatttggcagtgccggacccgtgcaatcaacactagccccgacgtccccgtgcctctcgtgttcgcggccaacgtgcgcaagcacatcgggagcaaggacggctactacggcaactgcgtgtccacgcagctggtgcaagcgacgagcggcacggtggcgaacggcgccatcgttgacgtggtgaggctgatcaaggacaccaaggagcggataacggagtccctgaggaggaatgcgccagagctggagctgcacgccgagctcatcgacgcgatgttcgggtacaacatgctcaacgtgtcatcctggggcggcatcgggctggacgccgttgatttcggcggcgggcggccagcgcgggtggtgcccaacatggaacggacgctggcgccgtcctgcttcccgtgcctgccgtgctcgaggaacgaccatggtggtgccaacctggtagcgttctgcgtcgcggaggagcacgtccaggagttcaatgcggaattggcgaggctgcggtgatccaattttgtttcatctctgttctactcgtactactgcgcatggtttgagttgtactccatttcgtaagccgttcctacatatagtttgcatatcaagagtcaatctccagccaaataaacaggaaaactataggtttttgatatgattttttttaagtcagtatttgtgaaataatcatttcaaacaaaaaaaaaaaaaaaaaaaa

SEQ ID NO: 8672 - protein, 425 aa, Panicum virgatum
  misc_feature: Ceres CLONE 2013961
  misc_feature (1)..(423): Pfam Name: Transferase Pfam Description: Transferase family
MSFVVTKSSPPALVLPSKPTPAGDIPLTSTDKSRLFFSFTSFHVFERPIHEPAQTIRRALSQALVYYYPVAGRVAVGTGGQGGVHLACTGEGVAFVSATASCTLQDVACLDAPPVIPLAELALQYGGCCRISDPLLLMQVTEFACGGYIVAVSWNHGIADAFGLAQLLQAVGELARGLPSPTVVPIRYDESLPDIPQLLSAVLKQAPAGFEFKHNDFAYSDVTVPWSFINRVKGEFRRSHAGGQPCTTFEVVTAAIWQCRTRAINTSPDVPVPLVFAANVRKHIGSKDGYYGNCVSTQLVQATSGTVANGAIVDVVRLIKDTKERITESLRRNAPELELHAELIDAMFGYNMLNVSSWGGIGLDAVDFGGGRPARVVPNMERTLAPSCFPCLPCSRNDHGGANLVAFCVAEEHVQEFNAELARLR

SEQ ID NO: 8673 - DNA, 1885 bp, Panicum virgatum
  misc_feature: Ceres CLONE 2013996
  misc_feature: Encodes the peptide sequence at SEQ ID NO. 8674
gcacccgctttccttccttggactcatcgtaagtcttagctcggtcaggactaccgccaacgcgccgatggtgacgatgccggcgccgccgccgcgcgcgcggaggtctgtggtggcggagctggagggcgcgctgctccggggcgcggacacgttcccctacttcatgctcgtggcgttcgaggcgtcgggcctgccgcgcttcgcggcgctgctggcgctgtggcccctgctgcggctgctggagctggccggccggggcggcctggcgctgcgcgtcgccgcgctcgtggccaccgcgggggtgtcccgggccgaggtggaggccgtgtcccgcgccgtgctgcccaagttcatggccgacgacgtcgacccgcgcgcctgggcggccttcggggcctgcgaggggaggcgcgtcgtcgtcgccacgcggctgccgcgcgtcatggtggagcgcttcgccagggagcacctcggcgcgcacgaggtggtcgggtgcgacctcgagtacagccggctcaggcggtgcacggggctcctcaggggcggcggaggcgaggccgtcgcgggccgcgtccgcgcgctcttcgccggcggcgaccgcccggacctcggcatcggccggtcagagatggcgcgctccttcttgccactctgcaaggagcagctcgagccgccgttcaccgcgggcgccgcgacgccgagcgccgccgcgccgccgttccggccggtcatcttccacgacgggcgcctcgtgtgccgtcccacggcgctcatgtccctcgtcatcctcctctggctgcccctcggcgcgctggtcgccttcgtccgcatcgccgtcggcctcatggtgcccatctggaccatcccctacatcgcgcccatcttcggcggcgcggtgatcacgcacggccgcgcgcctccccccgtccgccgcggcagcgacgccgccgtggaggacagcggcggctcgccctcgggcgtgctcttcgtctgcacgcaccgcacgctcatggaccccgtggtcctggccaccgtgctcgggcgccgcgtggccgccgtgacctactccatctcccgcctgtcggaggtcctgtccccgatcccgacggtgcggctgacgcgcgaccggggcgtggacgcggcgcggattcgcgcggagctggcccggggcgacgtggccgtgtgccccgagggcaccacctgccgggagcccttcctgctccgcttctcggcgctgttcgcggagctcagcgaccggatcgtgccggtggcgatgaactaccgggtggggctcttccacccgacgacggcgcgcgggtggaaggccatggaccccatcttcttcttcatgaacccgcggcccgtgtacgaggtgacgttcctgaaccagctccccgcggaggcgacgtgcgcggcggggaagagccccgtggacgtggccaactacgtgcagcggatactcgccgccacgctcgggttcgagtgcaccagcctcacgcgcaaggacaagtacagggtgctcgccgggaacgacggcatcgtcaccgccgccaagccggcggcgctcgggaaggcggcgtggcagagccgcgtcaaggaggtcctcggcttcctgctccactaaccactatagttgcagagagagacgccacgtagctctggtcaaatactcgatccgctcaccaatttcaatgagttattatacactttatacatgtacgtatagtcacgtaaagaatgcactcctagcaaaaaatatagtttttagctttttcttacacacgaaatttgcaccgtattgcatgctcttttcattttactttaatctgtaaatgtttttggcaaattctactggttgtaagtaaagatcagattgctccct

SEQ ID NO: 8674 - protein, 519 aa, Panicum virgatum
  misc_feature: Ceres CLONE 2013996
  misc_feature (1)..(119): Pfam Name: Acyltransferase Pfam Description: Acyltransferase
  misc_feature (14)..(494): SWISSPROT Homolog: EC 2.3.1.15 Glycerol-3-phosphate acyltransferase 5
MVTMPAPPPRARRSVVAELEGALLRGADTFPYFMLVAFEASGLPRFAALLALWPLLRLLELAGRGGLALRVAALVATAGVSRAEVEAVSRAVLPKFMADDVDPRAWAAFGACEGRRVVVATRLPRVMVERFAREHLGAHEVVGCDLEYSRLRRCTGLLRGGGGEAVAGRVRALFAGGDRPDLGIGRSEMARSFLPLCKEQLEPPFTAGAATPSAAAPPFRPVIFHDGRLVCRPTALMSLVILLWLPLGALVAFVRIAVGLMVPIWTIPYIAPIFGGAVITHGRAPPPVRRGSDAAVEDSGGSPSGVLFVCTHRTLMDPVVLATVLGRRVAAVTYSISRLSEVLSPIPTVRLTRDRGVDAARIRAELARGDVAVCPEGTTCREPFLLRFSALFAELSDRIVPVAMNYRVGLFHPTTARGWKAMDPIFFFMNPRPVYEVTFLNQLPAEATCAAGKSPVDVANYVQRILAATLGFECTSLTRKDKYRVLAGNDGIVTAAKPAALGKAAWQSRVKEVLGFLLH

SEQ ID NO: 8675 - DNA, 1075 bp, Panicum virgatum
  misc_feature: Ceres CLONE 2014087
  misc_feature: Encodes the peptide sequence at SEQ ID NO. 8676
aacgccagaagctctatatataccactgttagtttcttccatcttccttgtccagcaatcacacagcaagggggaaaattgaaatcttagcacgcgactagcgagctctgcaggaaacaatggcaggtgaaggcgacgagctgaagcttctgagcacctggttcagcccgttcgggtcccgggtgaagctcgcgctccacctcaagggcctgcgctacgagtacgtggaggaggacctcacgaacaagagccggctcctcctcgagagcaaccccgtgcacaagaaggttcccgtgctcttccacggcggcagggcgctctgcgagtccatggtcatcgtggactacatcgaggaggcctttgccggcgccgggccgccgctcctccccgccgacccctacgaccgcgccgtcgctcgcttctgggccgccttcatcgagaccaagctggtggagccgtggttccggatgctcgacggcaccaggacgcgcgcggagatggcggagggggtgaagcagatgctggcggcggtggcgaccctggagggcgcgctggggcagtgcgcagcggggaggcccttcttcggcggcgacggcgtcgggtacgtggacgtcgcgctgggcggcctgctcgtgtgggtgcgcgcgtccgaggtgctgctcggcgtgaggttcctggacgccgccaggaccccgctcctcgcggcctgggccgagcgcttcgcctcgctcggcgcggccagggcggccctgccggacttcggcagggtggtcgagcacgccaagatgcggcggggcgccgccgcaggcgctctggcggcggacaactgaacgcacgcacgtacggtgcgccgttgtcgatcgaccgagaactcgttctatatggtgcgtgcggtgtgtgttgttacgtgtacgtacgggttcggtcgatgtatacgtcttccggctttctacgctttccatgtcacgtgttttagtatcaagtggagatgtactgtcacgagaatgtatttaattttccttccatcaagcaataacaccatttatttttcttgcaaaaaaaaaaaaaaaaaaaa

SEQ ID NO: 8676 - protein, 236 aa, Panicum virgatum
  misc_feature: Ceres CLONE 2014087
  misc_feature (1)..(74): Pfam Name: GST_N Pfam Description: Glutathione S-transferase, N-terminal domain
  misc_feature (1)..(103): Pfam Name: GST_C Pfam Description: Glutathione S-transferase, C-terminal domain
MAGEGDELKLLSTWFSPFGSRVKLALHLKGLRYEYVEEDLTNKSRLLLESNPVHKKVPVLFHGGRALCESMVIVDYIEEAFAGAGPPLLPADPYDRAVARFWAAFIETKLVEPWFRMLDGTRTRAEMAEGVKQMLAAVATLEGALGQCAAGRPFFGGDGVGYVDVALGGLLVWVRASEVLLGVRFLDAARTPLLAAWAERFASLGAARAALPDFGRVVEHAKMRRGAAAGALAADN

SEQ ID NO: 8677 - DNA, 705 bp, Panicum virgatum
  misc_feature: Ceres CLONE 2014223
  misc_feature: Encodes the peptide sequence at SEQ ID NO. 8678
aacgccgaagaagcggcatcgaggaaaccggtacgaacgctcgagaaaatcaagatgtgggggaaggggaagaagcgcttcggcggcgggggcgggggcgagccggcggccaagcgccaggccgccggggacgaggggccttctgaatcagccgaagacggaaccgtcgtggccgagatatcgaagaacaagaaggtgtcggtgaggagctggaagggcaaggtctacgtcgacatgcgcgagttctacgtcaaggacggcaagaccctccctacccgcaaaggtatatcactgcagttggatcagtggaagatactgagggacaatatcaaagccatagatgaggccatcaaggagaacgcgtgataggaagccttggagctggatcacgttggggcaaacttttgcgtgctctcttcagacgcctgatgtccgctagtaggtcccatgctggttttccgttgctccccgatgctgcagtgttgcaccttgatcacctcttgttgttttaggttgctggacggcaactatgtagtctgcactttaggcatccagatgacatgttcccatgcagtctcacttctgtttggggatctgatggtgtgtgggcaagcatggatcagcggcgcacaccagtggattcgcatttatttcttccggtttgaatggatcggcggcgcgcaccaaaaaaaaaaaaaaaaaaaa

SEQ ID NO: 8678 - protein, 103 aa, Panicum virgatum
  misc_feature: Ceres CLONE 2014223
  misc_feature: Great-hit functional homolog of the protein sequence given in SEQ ID NO 9180
  misc_feature: Great-hit functional homolog of the protein sequence given in SEQ ID NO 9686
  misc_feature: Useful for making plants with altered Lignin content
  misc_feature: Useful for making plants with modulated nitrogen use efficiency
MWGKGKKRFGGGGGGEPAAKRQAAGDEGPSESAEDGTVVAEISKNKKVSVRSWKGKVYVDMREFYVKDGKTLPTRKGISLQLDQWKILRDNIKAIDEAIKENA

SEQ ID NO: 8679 - DNA, 574 bp, Panicum virgatum
  misc_feature: Ceres CLONE 2014298
  misc_feature: Encodes the peptide sequence at SEQ ID NO. 8680
atcacaagcgaagcagagcacacaggaagcactccaccttcttcagccgcgctacctgctttccttcctgcttgctcgtgatcaccgagatcaggatgtctggttgcagcggcggcaactgcgggtgcggctccgcctgcaactgcggcggcggatgcaacggctgcaagatgttccctgacgtggaggccgccagcaacaaggcgagctccagcgggttcgaggcggccaccgagagcggcggctgcgactgcaacacctgcaagtgcggcaccagctgcggctgctcctgctgcagctgcaactgaggcggccatgcgccgccgccatggaagcacgaggagaaagccccccggcgtagtatataggagcagcgtctaaataagatcttgccaactgcgccatccatcatctaccatgtcgtgtcgtgacatccatggtcgcctgccgtgtctcagctggggttgttgtctgaacgtctctggtgatcgacgacgcatgccggtcgtcgatctttagcttgtgtgtccgtcctcctcgtgcacgccacctttaatatatgtatttcagaacc

SEQ ID NO: 8680 - protein, 70 aa, Panicum virgatum
  misc_feature: Ceres CLONE 2014298
  misc_feature (3)..(83): Pfam Name: Metallothio_2 Pfam Description: Metallothionein
MSGCSGGNCGCGSACNCGGGCNGCKMFPDVEAASNKASSSGFEAATESGGCDCNTCKCGTSCGCSCCSCN

SEQ ID NO: 8681 - DNA, 912 bp, Panicum virgatum
  misc_feature: Ceres CLONE 2014473
  misc_feature: Encodes the peptide sequence at SEQ ID NO. 8682
aaaactcccagccaaaccaaactcacggctgccggctggcgtgccctccgacaacccccatgattgcggcggctcctagaggcgggctcagcggcccccgaatcctgctatccctcgccattgccttcgtctcccgctcccgcgcccccacggttccagacatggccgacgacctgcccgcctccatctacgacatcgccgtcaaggatattaggggcaatgacgtaaaactgagtgagtatgctggaaaggttcttcttattgttaatgttgcatcgcaatgtggattgactaattcaaattacaaagagctgaatgtcttgtatgacaagtaccgaacaaaagaccttgagatacttgcatttccatgcaaccaatttgctggtcaagagcctggcagtaatgaagatattcaggagacagtttgtactaggttcaaagcagagtttcctatttttgataagattaatgtgaatggtaaggataccgcgccattgttcaagtatttgaaatcacagaaaggaggcttccttggagatggaattaaatggaacttcaccaaatttcttgtcgataaagatggcaaggttgttgggcgatatgctcctacaacttctcctttgaagatagagaatgacatcgagaagcttcttggcaccgtatcatgatttatttgcatgaatcacgtgctcagatttagtatgtcaatctcctgagctgtataattcattgaaaataaggagctcggacatctcagtctgtgttccctacagttgaaattgtaatggtctagtctcaagtaactttgcttgatgcataaaatgctatttgtacaatattgtaccttgttctggattatatatgaaggttacaaaagacatgaactcttcataaaaaaaaaaaaaaaaaaaa

SEQ ID NO: 8682 - protein, 202 aa, Panicum virgatum
  misc_feature: Ceres CLONE 2014473
  misc_feature (1)..(109): Pfam Name: GSHPx Pfam Description: Glutathione peroxidase
  misc_feature (23)..(198): SWISSPROT Homolog: EC 1.11.1.12 Phospholipid hydroperoxide glutathione peroxidase 1, chloroplast precursor
  misc_feature (42)..(198): SWISSPROT Homolog: EC 1.11.1.12 Phospholipid hydroperoxide glutathione peroxidase, chloroplast precursor
MIAAAPRGGLSGPRILLSLAIAFVSRSRAPTVPDMADDLPASIYDIAVKDIRGNDVKLSEYAGKVLLIVNVASQCGLTNSNYKELNVLYDKYRTKDLEILAFPCNQFAGQEPGSNEDIQETVCTRFKAEFPIFDKINVNGKDTAPLFKYLKSQKGGFLGDGIKWNFTKFLVDKDGKVVGRYAPTTSPLKIENDIEKLLGTVS

SEQ ID NO: 8683 - DNA, 912 bp, Panicum virgatum
  misc_feature: Ceres CLONE 2014575
  misc_feature: Encodes the peptide sequence at SEQ ID NO. 8684
atctagcttctggaacagataccctcgcccgcccaacatggctgcccctacccctgagcggcggtttaagaaccccgcggtctttgtctgtgacatacaagaaaagttccgccccagtatttttgagtttgacaaagtcgttctcactacacgcaaactcctccgcgccgccaccactcttcaaatacccatcttcgtgaccacgcaaaaccgtgcccgcctcggtgacaccgtctcagagctccaaccgcacctaaccgccgccggccccctcctcctcgccgacgtcgacaagacccgtttcagcatgtggctcccgcccatctccacgcacccccacttcacctcccccaccagcagcagcaccagcagcaccccgcacgaaatcgcgctcgtcggcatcgagtcccacatctgcatcacccaaaccgccctcgacctgctcgcggccggccacaaggtatacgtgctggcggacggggtgagtagctcgaaccgggccgaggttggggtggcgctggcgcgggtgggggcggcgggggcggtggtgacgacgagcgaggggtgggtgtacgagtgcatgggggacgcagggatcgccgagttcaagggggtggtcggggtggtgaaggatagcgtgggggatacgagggcggcgttggaggggttggtgggaagtaagatctaggtatgtacatacatatctgctctacctaggtaggtatgtatgtatgtacttacttaccttagctagggttgtgttttggaggtgcgtctgggagttgggagggcaggggaagaagggggactgactgactgaccacagatgcggttgatagtcgatatttatattagacacaaaagaggcacacggcacgggcacgtctttggcaaaaaaaaaaaaaaaaaaaa

SEQ ID NO: 8684 - protein, 216 aa, Panicum virgatum
  misc_feature: Ceres CLONE 2014575
  misc_feature (1)..(168): Pfam Name: Isochorismatase Pfam Description: Isochorismatase family
MAAPTPERRFKNPAVFVCDIQEKFRPSIFEFDKVVLTTRKLLRAATTLQIPIFVTTQNRARLGDTVSELQPHLTAAGPLLLADVDKTRFSMWLPPISTHPHFTSPTSSSTSSTPHEIALVGIESHICITQTALDLLAAGHKVYVLADGVSSSNRAEVGVALARVGAAGAVVTTSEGWVYECMGDAGIAEFKGVVGVVKDSVGDTRAALEGLVGSKI

SEQ ID NO: 8685 - DNA, 773 bp, Panicum virgatum
  misc_feature: Ceres CLONE 2014583
  misc_feature: Encodes the peptide sequence at SEQ ID NO. 8686
ctcagaccaccgagctgaaactagagaggcagccaggcagagatagcgtgttcatcaggcggcagcaaggcaagaacctccaagaagggaaccaggaaaccaaggaggaagagggagagatcagagatggcggcaagggctgtgtccacctccacccttgcggcagcagccacgatggtgctggccgcggcggtcctcctggccggcggcgcgtcggcgcagtcgccgccgtcgtctccggcgagccagtgcacatcggtgctggtgagcctgtcgccgtgcctgaactacatctccgggaacgagtcgacggcgccggcgtcgtgctgcgcgcagctgggcaaggtggtgcggtcggacccgcagtgcctgtgcgtggcgctgagcgcggacccggcgtcgctggggctcagcgtcaaccgcacccgcgcgctgggcctccccaccgcgtgcgacgtcgcgacgcccgacgtcagcagctgcaagggcgccgccgccgggcagccggcaaccgcgcccggggccggcacgccggcctggtcgcgggcttcgtcgccgcggccgtcctcgccgccgccgccgcgtgatcgtgcgtaggaaccgagacggattcggctggagtagccttttgtcgattttgtgatttgttgatccgtgagcgttattcctgcgcttgattcatcaccgcattccttctctgaatactaataaagataggcttgcgcctgccctgcctggattgttcttcatttcaaaaaaaaaaaaaaaaaaaa

SEQ ID NO: 8686 - protein, 156 aa, Panicum virgatum
  misc_feature: Ceres CLONE 2014583
  misc_feature (1)..(78): Pfam Name: Tryp_alpha_amyl Pfam Description: Protease inhibitor/seed storage/LTP family
MAARAVSTSTLAAAATMVLAAAVLLAGGASAQSPPSSPASQCTSVLVSLSPCLNYISGNESTAPASCCAQLGKVVRSDPQCLCVALSADPASLGLSVNRTRALGLPTACDVATPDVSSCKGAAAGQPATAPGAGTPAWSRASSPRPSSPPPPRDRA

SEQ ID NO: 8687 - DNA, 1256 bp, Panicum virgatum
  misc_feature: Ceres CLONE 2014639
  misc_feature: Encodes the peptide sequence at SEQ ID NO. 8688
accccaccccacagcaccgcgcggcgcccgagacccagtcccctagcctcaccttccacctcccaattcgacaccacgagaacagggcagccaggcggccggcaaggtccgagagactgccggggaagcggggggttgccgtgaccggggctgcggcacttggatgagaagggcggcaccggcggcggcggcggcggaggatgcggaaggcgtacagggactccatcaaggtgctcgaagctgacatccagcacgccaacaccctggcctctgaatttcccagggactatgatggcgcgtgcctgcagatgcggctgtcctacagccctgcagcgcatatattcctcttcttggtccagtggactgactgcagccttgctggggcgcttggcctgctgagaattctcatatacaaggtttatgttgatggcacgacaaccatgtcgactcacgagaggaaagccagcatcaaagaattctatgctgtgatatttccttctttgctgcaactgcaaagggggatcactgacgtggaggacaagaagcagaaggctgtgtgcatggagaggtacagaaagaaagatgaggatgaacggagaagcttatctgatattgacattgagagggaagaagagtgtgggatttgcatggagatgaatagcaaagttgtgttgcccaactgcacacatgctatgtgtctcagatgttaccaggactggaattcaagatcgcagtcgtgcccattctgccgtgacaacctgaaaaagacttgtcctggtgacctgtggatctatgtcgaggaccaagatgtggttgacatggagacggtgtcaagtgagaacctcagacggctgttcatgtacataagcaagctgcctctgattgtcccagacgtcatcttcagtgtttatgattcccacataaaatgaccgtgatgccgcctcctcgaagtccatcagtcagtgctcaattctggttaatcttatgtcccatgttctccatttccatgctttgctcgagcttttggaagtgcctgaattgctgtggagtcgcaagccgtccagtcgtgctttagaacttattagtccctgcatgcatcctaaatcatatccagccactctgtacagatctgacttggctctgttaatagagaactttgtgcttgccccaaatggaggcaggctttgcctgttaccatctcatgtttccgctagtgaagtaacataaaggtctgagcactggaatgtttctgckgc

SEQ ID NO: 8688 - protein, 242 aa, Panicum virgatum
  misc_feature: Ceres CLONE 2014639
  misc_feature (1)..(38): Pfam Name: zf-C3HC4 Pfam Description: Zinc finger, C3HC4 type (RING finger)
MRKAYRDSIKVLEADIQHANTLASEFPRDYDGACLQMRLSYSPAAHIFLFLVQWTDCSLAGALGLLRILIYKVYVDGTTTMSTHERKASIKEFYAVIFPSLLQLQRGITDVEDKKQKAVCMERYRKKDEDERRSLSDIDIEREEECGICMEMNSKVVLPNCTHAMCLRCYQDWNSRSQSCPFCRDNLKKTCPGDLWIYVEDQDVVDMETVSSENLRRLFMYISKLPLIVPDVIFSVYDSHIK

SEQ ID NO: 8689 - DNA, 1450 bp, Panicum virgatum
  misc_feature: Ceres CLONE 2014664
  misc_feature: Encodes the peptide sequence at SEQ ID NO. 8690
aaattccgattcagaacacgcctgtcgaatctagcggaggggaaggcgaaacaaggcagaaatttctggaggagctagagacacaacgttcatttgatcgggcgagcagaccgagtcgttcgcttcaccttcagtccattccccctcttctctctgctgccgcaaactgccccgaaacatccccaagggggggaggaggagccccggcgggatcgagatcgaaagcgccacccgcttcttcgcctccggagcggggggaaaagggcggcggcgatgtgggtggagatcctgtgcggcctggtggcctacaaggtcatccgccacttcttcttcgacgacggcgacgacgcttcctacctcgctgacctcgactcctcccactccgacctctgcttcgccgtcgctgccaggctcgagaagctctacgccggccgatgcttcgtcggcctccgcatccccgatcccgacgccggcgagcgccagcacatcgatgtcgtcctcgtcaccaagagggaggtgatggtggtggcaattaagaatttctctggcttcgttgaggctgacaaggatggaaattggtcttgtccaactgacaagaagcgtaagcaagagataatccccaacccggtactagaagtcaacagactagctgctaatcttcaatcatacttggagcaaaggggagcaaagctacccgatgggcatataattggaagagttgttctgccaaatcccaactgcaggccttcatataatataactattcaaccagaggttatgttgtatgatcaatggaaagatcttaaggcagactcaaagagtggactctcaacgtggtttaaaggtgcatttactggaagcaaaagtgacatgcaagattcagtactccagaacctacattttattcttagcacatcacctatgtgggacaggttggaactcaaaggagaaaaaaatgttcttggtgagttcatcgagttcaaagggaggcatgaggacattcaacttctcaaaaatcttaagaggtcaaaagtcagtcgattcatcatccagaagtcaactcttttcggtggttttggtaggtcacgggttcaaatattgtattctcctcgcgattatcgagctgagggggcttcatcttcagaatggaaagagatatctgtgaagcaatacacagagattgttttccagcccttgcactccaaaaaagttcggaaattcaagctgtcaagtgttgtttctgttacactgagtgcctagcaagcagaaatcttaaacttccgcttttctggtatactttatactagttccttttcagtgtaactcgctgaaattatgcttctcttttttacacctgtaattatgtgtgataatgtggagtatagtgacttggagcgacgccttactgaataagtttcgcatttttgcctaaaaaaaaaaaaaaaaaaaa

SEQ ID NO: 8690 - protein, 328 aa, Panicum virgatum
  misc_feature: Ceres CLONE 2014664
  misc_feature (1)..(69): Pfam Name: NERD Pfam Description: Nuclease-related domain
MWVEILCGLVAYKVIRHFFFDDGDDASYLADLDSSHSDLCFAVAARLEKLYAGRCFVGLRIPDPDAGERQHIDVVLVTKREVMVVAIKNFSGFVEADKDGNWSCPTDKKRKQEIIPNPVLEVNRLAANLQSYLEQRGAKLPDGHIIGRVVLPNPNCRPSYNITIQPEVMLYDQWKDLKADSKSGLSTWFKGAFTGSKSDMQDSVLQNLHFILSTSPMWDRLELKGEKNVLGEFIEFKGRHEDIQLLKNLKRSKVSRFIIQKSTLFGGFGRSRVQILYSPRDYRAEGASSSEWKEISVKQYTEIVFQPLHSKKVRKFKLSSVVSVTLSA

SEQ ID NO: 8691 - DNA, 1157 bp, Panicum virgatum
  misc_feature: Ceres CLONE 2014688
  misc_feature: Encodes the peptide sequence at SEQ ID NO. 8692
aatggaggcgaccagacgacgatgctgttagcacagccagccttacggcgaggacgagaagacgaaccgatacagcagcttcctccctggcgccatctcctcctcctcccgccgtcgtctcccagttcagatggaggaggagcgcacgcccgcggccggggccgggagcgtgagggcgcggcgctgcggcttcgtggtgtggctgcacggcctgggcgactgcggcagcgccaacgagttcatcgccgagcacttctccgccgccgccttccgcgacacccgctgggccttccccaacgcgcccaccgcccccgtcacatgcaaccgcggcgcgctcatgccctcgtggttcgacatccacgacgcgcccatcacttcgaaatccgtcagagatgaggaagatgtgctgcgagctgtccagatcgtgcacaccatgatcgacagggaaatagctgctggaacaaacccggaagacgtattcgtttttggcctgagccaaggaggtgccttgagcatagcaagcgtgctgacgtaccccaggactatgggcggttgcgcagtcttcagtggcttcctccccttcgactcttcttccttcgcagcacgagtaacagactacgcgaagaagacacccgttttgtggatccatggggaagatgattcgctgatcccgatccaggaagggcgagacggagtgaaattcctgcgggggctcggcatggcctgcgaattcaaggagtacgacaggctcgggcacacgctggcgccgcacgagctggactactgcgagagatgggcgtcggagaacatcctcagcgagcatggagaagaaggcctgaatgtcaggaaccaagtctcctgaacattcagattcttcagacttcacggcgagttgcaagtcggctctcttcgtaccgtttcaccgactcctccagcatcgttgatctactatcctacggcttatggccagttatcgtttctctttccaatgtaacagtgtaataagaccccgtgctggccacgtgaatggacatcgaagaacagaactcaaaccctaagtttaggttcggtagctgtagccgccgccactctgacggtgcttgtatcaggtcctccatcgattctggttctgatccattaatacagttactgttcct

SEQ ID NO: 8692 - protein, 243 aa, Panicum virgatum
  misc_feature: Ceres CLONE 2014688
  misc_feature (7)..(219): Pfam Name: Abhydrolase_2 Pfam Description: Phospholipase/Carboxylesterase
MEEERTPAAGAGSVRARRCGFVVWLHGLGDCGSANEFIAEHFSAAAFRDTRWAFPNAPTAPVTCNRGALMPSWFDIHDAPITSKSVRDEEDVLRAVQIVHTMIDREIAAGTNPEDVFVFGLSQGGALSIASVLTYPRTMGGCAVFSGFLPFDSSSFAARVTDYAKKTPVLWIHGEDDSLIPIQEGRDGVKFLRGLGMACEFKEYDRLGHTLAPHELDYCERWASENILSEHGEEGLNVRNQVS

SEQ ID NO: 8693 - DNA, 1631 bp, Panicum virgatum
  misc_feature: Ceres CLONE 2014764
  misc_feature: Encodes the peptide sequence at SEQ ID NO. 8694
ggactagacttccaagctgatcccgggaccttcactgccggtggagaaaaggtcttgctccactcgcgtccagagagaacagacgtacacgcgacgaccgcatcgcattcccccccggtgctaccagcgacggttgacccgtctcgcccccggccacccatcccaccaggccaccaccaccaccagccacagccccgccgtcgagccggcgccgcctgtactcgttcaacccccgcgcccggccgccgtggacctgtcgctcgcacgcgcgttgaaccattttcccgagggagcaggagctcgcatccccgcctccttttacttctgggtatcacgagttcccgcacgatcctcccctcccagctccagctccgccaccagatcaatccacccgccttcctctccatggacctccccaagccgccgtccacgtccgcctcgtcgtcgggggcggagacgccgaacccgcacgccttcacctgcgagctcccgcactcgatctacgcgctcgccttctcccccaccgcgcccgtcctcgcctccggcagcttccttgaagacctccgcaaccgcgtctccctcctctccttcgaccccgtccgcccctccgccgcatccttccgcgccctcccggccctctccttcgaccacccctacccgcccaccaagctccagttcaacccccgcgccgccgcgccctccctcctcgcctcctccgccgacacgctccgcatctggcacgccccgctcgacgacctctccgcctccgcaccgccgcccgagctccgctccgtcctcgacaaccgcaaggcctcctccgagttctccgcgcccctcacctccttcgactggaacgaggtcgagccccgccgcatcgggaccgcctccatcgacaccacctgcaccgtctgggacatcgaccgcggcgtcgtcgagacgcagctcatcgcgcacgacaaggccgtgcatgacatcgcctggggcgaggcaggggtcttcgcctctgtttcggctgacggctccgtccgcgtcttcgacctccgggacaaggagcactccaccatcgtctacgagagcccgcgccccgacacgccgctgctcaggctcgcgtggaaccgatctgacctccgctacatggccgcgctgcttatggacagcagcgccgtcgtcgtgctcgacatacgcgcgccaggggtgcctgttgccgagctgcaccggcaccgggcttgcgtaaacgctgtcgcgtgggcgccgcaggccagtaggcatctctgttcggctggggacgacgggcaggcactgatctgggagctgcccgagacggcgccagcgccggcaccggccgcggctgtgcctgccgaggggattgatcctgtgctagtgtacgatgcaggcgccgagataaaccagcttcagtgggcggccgcccacccagactggatggccatcgcatttgagaacaaggtccagcttctcagggtctgacaaggtcggtaccatggcgatatgaggtttgacatttctatttctacaagttttttatgtgaatgattggctactgattgctagtatttagaacatgtatggtgataaaatatcgaaatttggagcaaaaaaaaaaaaaaaaaaaa

SEQ ID NO: 8694 - protein, 359 aa, Panicum virgatum
  misc_feature: Ceres CLONE 2014764
  misc_feature: Great-hit functional homolog of the protein sequence given in SEQ ID NO 9584
  misc_feature: Useful for making plants with altered Lignin content
  misc_feature: Useful for making plants with altered terpenoid content
MDLPKPPSTSASSSGAETPNPHAFTCELPHSIYALAFSPTAPVLASGSFLEDLRNRVSLLSFDPVRPSAASFRALPALSFDHPYPPTKLQFNPRAAAPSLLASSADTLRIWHAPLDDLSASAPPPELRSVLDNRKASSEFSAPLTSFDWNEVEPRRIGTASIDTTCTVWDIDRGVVETQLIAHDKAVHDIAWGEAGVFASVSADGSVRVFDLRDKEHSTIVYESPRPDTPLLRLAWNRSDLRYMAALLMDSSAVVVLDIRAPGVPVAELHRHRACVNAVAWAPQASRHLCSAGDDGQALIWELPETAPAPAPAAAVPAEGIDPVLVYDAGAEINQLQWAAAHPDWMAIAFENKVQLLRV

SEQ ID NO: 8695 - DNA, 966 bp, Panicum virgatum
  misc_feature: Ceres CLONE 2014782
  misc_feature: Encodes the peptide sequence at SEQ ID NO. 8696
gagcgtcagtggtcaaacaaaacctgcctgctggctggagttggaagatgccttagcacccaagcagagcagagacggcctcgctcctcatccatccatcagacattcagaccatcaccgggcaccggcctctcaagccggtgatggggctggccatggggcggctgctgggcctcagctatcgcctgacgaagcagctcgaggcgcgcatcctcatgctggggctggacgccgccggcaagaccacaatcctctacaagctcaagaccggcgaggtcgcctccaccatcacaaccgtcgcattcaacattgagagaatcgagtacaggaacatgagcttcactttctgggatgtcggcggccatgcccctaaccggcccttgtggaagtactacttccatgacacccagggcctcgtcttcatcgtcgacagtagcgacagggaccgcgttcgtctggccagggatgagctcaacaccttgctcaacgcggaggagcttagagacgctgcgctgctcgtccttgcaaacaagcaggactttcccaacgccatgagtgccgcagagatgacagaggagcttgggcttcatgagtcccttggcaaccgtagatgtcacattcagagtgcttgtgccacctcaggagaaggcctctacgaggggctggactggctctgcaccaacgtcgatataagggttggatgactttgtttggactgtggatcggactgtaccactgtggtgtgctctgggatcatcagatgctgcacaacacaaacaccccaaggcactgtgctgagtgatttgcacagttgtggttcagaattgagaaataatgtaataaatagaatctggcgccggctgatccttcgctacatcatatatatatacattatggttcgtgtattttgtatatggattattattatatataagattcttgtgtcaaaaaaaaaaaaaaaaaaaa

SEQ ID NO: 8696 - protein, 186 aa, Panicum virgatum
  misc_feature: Ceres CLONE 2014782
  misc_feature (4)..(174): Pfam Name: Arf Pfam Description: ADP-ribosylation factor family
MGLAMGRLLGLSYRLTKQLEARILMLGLDAAGKTTILYKLKTGEVASTITTVAFNIERIEYRNMSFTFWDVGGHAPNRPLWKYYFHDTQGLVFIVDSSDRDRVRLARDELNTLLNAEELRDAALLVLANKQDFPNAMSAAEMTEELGLHESLGNRRCHIQSACATSGEGLYEGLDWLCTNVDIRVG

SEQ ID NO: 8697 - DNA, 1174 bp, Panicum virgatum
  misc_feature: Ceres CLONE 2014801
  misc_feature: Encodes the peptide sequence at SEQ ID NO. 8698
ttcagaattaaaatgaaaaaggttttactcatccttgccgttttgttcgtttctggatttgccagcaaatccttgatcgacgaagttagcccactctggcaaatctggaaggacagataccagaagacttatgctgaagaagaagaaatcgaaagattcgccatcttcgccaagaactacgagaagatcatgaagtacaacgctgaaagcgactctgccagacttgccctcaacaagtttgctgatttgaccaacgctgaattcgctgccaagaactccagatgcgcctatgctgaaactgatgaagaactcatcagagaaaacaccctcgccccacaagacattggtgccctccccactaacgtcgactggagaaaccacggtgctgttacccccatcaagaatcaaggccaatgcggttcatgctggactttctccactactggtgtcctcgaaggctggcacttcctccatgcaggcaagctcctctccttctctgaacaacaaatcgttgactgtgacactggcacaaaccaaggttgtgatggtggttatccttatcttgctgttcaatatgccgccaagaacggtcttgaactcgaatctgactacccctacactgcccaagacggtacctgcaagtacgaaaagtccaagactactgccgtcgccagtggctacaagttcgttactgctgacagcactaacgacctcaaggctgctcttgttaactcacccgtatccgtcctcgtcgaggctgaccaagatgccttccaattctacagctctggtgtcctcaagaccggatgcggtgcttcccttgatcatgccgtcctcgctgtcggttacaccaaggttggcgtcctcgaagccttcatcgtcaagaactcctggggtactgactggggagagcaaggttacatctacatttgggatgaacaaaacgtcaacggtggaaagggtgtctgcggtatcctttctcaacctatgatccccaccaactaaatgtgcgggctaattagggtttagtccttactatttaagtgtgaaaatgcatacttaaaagcatttcatatgattaatcctgaatattatctatattcgatacaatgcactgcccatatctatcctgaattaatttaaggactaacaccaaaaaaaaaaaaaaaaaaaa

SEQ ID NO: 8698 - protein, 330 aa, Panicum virgatum
  misc_feature: Ceres CLONE 2014801
  misc_feature (4)..(208): Pfam Name: Peptidase_C1 Pfam Description: Papain family cysteine protease
MKKVLLILAVLFVSGFASKSLIDEVSPLWQIWKDRYQKTYAEEEEIERFAIFAKNYEKIMKYNAESDSARLALNKFADLTNAEFAAKNSRCAYAETDEELIRENTLAPQDIGALPTNVDWRNHGAVTPIKNQGQCGSCWTFSTTGVLEGWHFLHAGKLLSFSEQQIVDCDTGTNQGCDGGYPYLAVQYAAKNGLELESDYPYTAQDGTCKYEKSKTTAVASGYKFVTADSTNDLKAALVNSPVSVLVEADQDAFQFYSSGVLKTGCGASLDHAVLAVGYTKVGVLEAFIVKNSWGTDWGEQGYIYIWDEQNVNGGKGVCGILSQPMIPTN

SEQ ID NO: 8699 - DNA, 1188 bp, Panicum virgatum
  misc_feature: Ceres CLONE 2014855
  misc_feature: Encodes the peptide sequence at SEQ ID NO. 8700
ggtgtgcattagcttggtgagctgtcctccgcgctgtccgaattccaagctgcttgacaagttcaagatgaacacactaatgacattccaatcccaattcccaaattcccaatccaaggctatatataagaagctaaccatgccagggtgggtagtatcagcagcaacaagcaagaattgaagaagcagaccatccatcatcaatggcggttgcgagccgccggaggctaggcaccctcctggccctcgcggccctcatcgtcatcctcgccggcccggccgcggcgacggggaagacggggcaggtgaccgtgttctggggccggaacaaggcggagggctccctccgggaggcctgcgacgccggcacctacaccttcgtcatcatctcctccctcaacgtcttcggccacggcaggaccaggctggacctctccggccaccccatcggccccgtcggcggcgacatcaagcactgccagtccaagagcatcctcgtcttcctctcgatcggcggctccggcagccagtactcgctccccagcgcccaggccgcgacggacctcgccgaccacctctggttcgcgtacctcgccggccgccgcgacggcgtgcgccgcccgttcggcgacgcggagctcgacggcatcgacctcttcatcgaccagggcccgccggaccactacgacgtgctggccgcgcggctctggagctacaacaaggagttccgcggccggacgccggcgcagctgtcggcgacgccgcggtgccggtacccggacccccgcctggagcgggcgctcgccacgggggtcgtcacccgcatcaacgtcaggttctacggcgacgggtactgcgccgcctactggcaggcggagtgggacaagtggacggcggcgtaccccaactccgggatctacgtcggcctgccggcgtcggagcaggtcgtcggctacgtgcaccccaagaacctctactacggcgtcgtcccggtggtgcagaaggcggccaactacggcggcatcatgatctgggagcgctacgccgacaagcagaccaactacagcagctacgccattcaatgggcttagatcgatcgagctccatcatcactgtcgttcttgtttcttcactagcgtgcttgtgcaagaataaagagaggcctgtggaagaataaacggttattac

SEQ ID NO: 8700 - protein, 295 aa, Panicum virgatum
  misc_feature: Ceres CLONE 2014855
  misc_feature (1)..(258): Pfam Name: Glyco_hydro_18 Pfam Description: Glycosyl hydrolases family 18
MAVASRRRLGTLLALAALIVILAGPAAATGKTGQVTVFWGRNKAEGSLREACDAGTYTFVIISSLNVFGHGRTRLDLSGHPIGPVGGDIKHCQSKSILVFLSIGGSGSQYSLPSAQAATDLADHLWFAYLAGRRDGVRRPFGDAELDGIDLFIDQGPPDHYDVLAARLWSYNKEFRGRTPAQLSATPRCRYPDPRLERALATGVVTRINVRFYGDGYCAAYWQAEWDKWTAAYPNSGIYVGLPASEQVVGYVHPKNLYYGVVPVVQKAANYGGIMIWERYADKQTNYSSYAIQWA

SEQ ID NO: 8701 - DNA, 1227 bp, Panicum virgatum
  misc_feature: Ceres CLONE 2015051
  misc_feature: Encodes the peptide sequence at SEQ ID NO. 8702
acagcgcagcaagcactcctcatagcttgtcaaacagctagctcttgcaaaactagcttccagcagcagcttgccctgccactgccagcctgctccgatgggcaaggaggtggacgtgtccactctggaggccggcggcgcccgcgactacgcggacccgccgccggcgccgctggtggacgtcgacgagctcggcaagtggtccctgtaccgcgccgtgatcgccgagttcgtggccacgctgctgttcctgtacatcacggtggcgacggtgatcgggtacaagcaccagacggacgcggcgtgcggcggcgtgggcatcttcggcatcgcgtgggcgttcggcggcatgatcttcatcctcgtctactgcaccgcgggcatctccggcggccacatcaacccggcggtcaccttcggcctcttcctggcgcgcaaggtgtccctggtgcgcgccatcctgtacatggcggcgcagagcctgggcgccatctgcggcgtcgcgctcgtcaagggcttccagagcggcttctacaagcgctacggcggcggcgccaacgaggtcggcgccgggtactccaccggcacggggctcgccgccgagatcatcggcaccttcgtgctcgtctacaccgtcttctccgccaccgaccccaagcgcaacgcccgcgactcccacgtcccggtgctggcgcccctgccaatcgggttcgccgtgttcatggtgcaccttgccacgatcccgatcaccggcacggggatcaacccggcgaggagcctcggcgccgccgtcgtgtacaacaacagcaaggcctggagcgaccagtggatcttctgggtgggtcccttcatcggcgcggcgatcgcggcgctgtaccaccagatcgtcctccgcgccagcggcaggggctacggctccttccggagcaacgcctaggccggcgaccaagtcgtcgtcaacatccacggccggtcaagccgtgacgtgacggagctcttcctcctccggagtttaagttgaacggagacggagagcaccggcgtggttaatgcagtagcagtagctccaagtcaagtgaagtgtgaagcgtgcagtgctggtagcacaagcgtttgtgtgtgtattgtgtggtgggcatgctgtggaaagcgagcgtaattttgcacgcttgtgtatccatatgccttaaaactttagtcaataaataagggagttgatgtcgctcg

SEQ ID NO: 8702 - protein, 279 aa, Panicum virgatum
  misc_feature: Ceres CLONE 2015051
  misc_feature: Great-hit functional homolog of the protein sequence given in SEQ ID NO 9486
  misc_feature: Useful for making plants with modulated cold sensitivity
MGKEVDVSTLEAGGARDYADPPPAPLVDVDELGKWSLYRAVIAEFVATLLFLYITVATVIGYKHQTDAACGGVGIFGIAWAFGGMIFILVYCTAGISGGHINPAVTFGLFLARKVSLVRAILYMAAQSLGAICGVALVKGFQSGFYKRYGGGANEVGAGYSTGTGLAAEIIGTFVLVYTVFSATDPKRNARDSHVPVLAPLPIGFAVFMVHLATIPITGTGINPARSLGAAVVYNNSKAWSDQWIFWVGPFIGAAIAALYHQIVLRASGRGYGSFRSNA

SEQ ID NO: 8703 - DNA, 1280 bp, Panicum virgatum
  misc_feature: Ceres CLONE 2015054
  misc_feature: Encodes the peptide sequence at SEQ ID NO. 8704
aatatctcatttgcgattctttcttctcacagcttcccgtagatctctccctccttttatttactttgccatctcaatttgcaatcttggtcaacttcttgttggtacgggcggcgtattgatttcttaaagagtcttaaattctgtggtttatgcacgccattgggagctgctctctgctgcttgtgttgtcccaaaccattccgtcggcgcaatagccatgtcgtccacgctcggaagaagcggctctagcccggcggcggtggtggcggcggcggcggttgacaccaagggccactgggtgccgcacggccccgtgctgacggccggcgttgtgggcgtcaacgtgctcatgatcgccctcatcttctttttgttctggaggttcttctccgggaaagaggggccatccacctcagccgacgccgacgtcgacgaggacgattcgcggcccgtggcctccccgtgggcgtcccgttggcggcacgaggacgacgacctcggcccgccgccgctggaagacgtggcgctagccgtgcccgtgtacacctactccagcgccggcgccggcgacgacggagggaagctgctggcggacgagtgcgccgtgtgcatcgtggagctccgcgacggcgactcggcgcgcctgctcccgcggtgcggccaccggttccacgccgactgcatgggcgcctggctgcggctccacgccacgtgcccgctgtgccgcgccatcgtcgtcgcccccgcccccgccacaggcgccgtcgccggcgagtccaggaacgccaaggacgacgacgtcgccgcggattgttccgtgtgaggcggcccgccccggccgaccgacgccgaggccggccagctcgcgagcaagcaagtggatcgcgtaaatggcggaaggtgacaggcacaggcacctttcagcgtccggcatgctcctgaggaccagctggaaaaacatgttggtgaggcgatcgattccttcgtcctgttctgctgcgttgttaattgccatgtatatttctggatgatttgggattagatatatcgagtcatatatatatcttgattggagtcttcttctatgtgtatgtgagatccggggggatttcacttctgtgagatagtatgggcaaattaatagcctgtttgatttgagaagaaaaaggggaacgatggatcatcctatccgatcccctttgtataattctgacgaatattgattcttcactgaaagcttgttggatgttcatcatcaaaaaaaaaaaaaaaaaaaa

SEQ ID NO: 8704 - protein, 201 aa, Panicum virgatum
  misc_feature: Ceres CLONE 2015054
  misc_feature (1)..(42): Pfam Name: zf-C3HC4 Pfam Description: Zinc finger, C3HC4 type (RING finger)
MSSTLGRSGSSPAAVVAAAAVDTKGHWVPHGPVLTAGVVGVNVLMIALIFFLFWRFFSGKEGPSTSADADVDEDDSRPVASPWASRWRHEDDDLGPPPLEDVALAVPVYTYSSAGAGDDGGKLLADECAVCIVELRDGDSARLLPRCGHRFHADCMGAWLRLHATCPLCRAIVVAPAPATGAVAGESRNAKDDDVAADCSV

SEQ ID NO: 8705 - DNA, 1167 bp, Panicum virgatum
  misc_feature: Ceres CLONE 2015104
  misc_feature: Encodes the peptide sequence at SEQ ID NO. 8706
ctctcgcattaaaggccgcctccccttcctatccccttcgtcgtctcgccccaggactccctccccctcctgctgctcccgctgcttgacccacaaggtttctccacccttcccttaacccccgagctgctgctgctgcggctgctatatatatgcgcgcgcgatcccggccccgttcgtagcatgcgcgtctcgcttccggattgatcgagcttggccgtggcaatggattcggtgccttcttcctcctctccctgggccgccgccgccggcgctccctgctgccccttcgacgcgctgcggagggcgtgcgccaggcacgccgccgccgccgccagggccgcgggctgggcgctcggcgcgctgctcacctgcgtcttcgtcgtcgtgggctcactcgttgggatcttccttggtgccttcatggggatgtccacggaaagcggtatgctccgcggggctggcgttggagcagtctccggtgcagtattctccattgaggctgttgaatcctgcattgagatttggaggtccagccattcaggaaaatacagcattctctttgtgctggacatcatctctagcctcttcagcggaagaattgtgtgggagaaagtcagtccagcactgcagcgtgccgtgcaaagccagatgagtctactgagcacaccattcatcgacaacaatgacctttttgaaactggcagcacagggggcatgtcaagggatttgattgacaggatcccaaagatgaggttcagtgctgcaagcaattgtgaccaggaaactgatagcagctgctgctcagtctgccttcaggattttggagtacaacaatttgtgagggccctgcctcagtgccaacacgtattccatgtgcggtgcatcgacaattggctccttaggcatgcatcttgcccactatgtcgggccagtgttcatatagaccatatacatatgtaaatacacttgcagggtggcacctggtgtattttcatagtgaatgcccgtgcacctgtttgataaatatagttgtatacataggttttcactttttgttactcctccagtcttatgtggggctacgctttcagctgcacgtttttgtcaaagtaataacatgatatgtacatcccgaaaatggaccaaaaaaaaaaaaaaaaaaaa

SEQ ID NO: 8706 - protein, 245 aa, Panicum virgatum
  misc_feature: Ceres CLONE 2015104
  misc_feature (1)..(42): Pfam Name: zf-C3HC4 Pfam Description: Zinc finger, C3HC4 type (RING finger)
  misc_feature: The sequence is a functional homolog of  SEQ ID NO 216 in the  10/225,068 US patent application
  misc_feature: The sequence is a functional homolog of  SEQ ID NO 2322 in the  10/374,780 US patent application
  misc_feature: The sequence is a functional homolog of  SEQ ID NO 242 in the  10/412,699 US patent application
  misc_feature: The sequence is a functional homolog of  SEQ ID NO 515 in the  11/479,226 US patent application
  misc_feature: Useful for making plants with modulated growth and phenotype characteristics
MDSVPSSSSPWAAAAGAPCCPFDALRRACARHAAAAARAAGWALGALLTCVFVVVGSLVGIFLGAFMGMSTESGMLRGAGVGAVSGAVFSIEAVESCIEIWRSSHSGKYSILFVLDIISSLFSGRIVWEKVSPALQRAVQSQMSLLSTPFIDNNDLFETGSTGGMSRDLIDRIPKMRFSAASNCDQETDSSCCSVCLQDFGVQQFVRALPQCQHVFHVRCIDNWLLRHASCPLCRASVHIDHIHM

SEQ ID NO: 8707 - DNA, 1127 bp, Panicum virgatum
  misc_feature: Ceres CLONE 2015105
  misc_feature: Encodes the peptide sequence at SEQ ID NO. 8708
ggtctcctcctcccacctcgccttcacacctccttcctcccctcgtctccgccgccgcatcatcctcgccggaaccctaaatggaccccggcgccggcgcgcactactccgcccgcaccgcggaggaggtcttccgcgacttccgcggtcgccgcgcgggcatgatcaaggctctcaccaccgatgtggagaagttctaccagctctgcgaccccgaaaaggaaaatttgtgcctttatggctaccctaatgaaacatgggaagtaactttgccagcggaggaagttcctccggagatccctgaaccagctttgggaataaactttgctagggatggcatgaatgagaaggattggttggcactagttgctgtccacagcgattcctggttactagctgttgcattctactttgcggcccggtttggatttgacaaagaggccaggaggcgactcttcagcatgataaataacttgccaacgatatttgaagtagtgactggggctgctaagaaacaaaccaaggagaagggccccaatagtaccagcaaaagcaacaaaccaagctcgaaaatgccatcaagaccagaatctcattcgaagtcgacaaaagtggtggcgccccccaaggatgatgatgatgatgagagtggtgaagaatacgaggaagaggaagaacgtgataacaccctatgtggatcctgtggaacaaatgacggtaaggacgagttctggatctgctgcgacagttgcgaacggtggtaccatggcaagtgcgtcaagatcacacctgctcgagcagaacatatcaagcactacaagtgccccgattgcaccaacaagagggcaagagcctagcagcaagcaggtggcagaattatcgatgtctgcagatatggcctagctgtctagcatgtagacttgcttttcatttcgaagaacgctgttaattcacttggttgtcccagcagctcgtgttgctcgggcttaattgtgttcaatgtttgaaacggttgttgtagtaataccagattccctggtgaggctgtcctgcagatgtgtcatagacgttattgaactgaaagacgtgaaaactgaccgtttctccaaaaaaaaaaaaaaaaaaaa

SEQ ID NO: 8708 - protein, 258 aa, Panicum virgatum
  misc_feature: Ceres CLONE 2015105
  misc_feature: The sequence is a functional homolog of  SEQ ID NO 1052 in the  10/225,066 US patent application
  misc_feature: The sequence is a functional homolog of  SEQ ID NO 2552 in the  10/374,780 US patent application
  misc_feature: Useful for making plants with modulated growth and phenotype characteristics
MDPGAGAHYSARTAEEVFRDFRGRRAGMIKALTTDVEKFYQLCDPEKENLCLYGYPNETWEVTLPAEEVPPEIPEPALGINFARDGMNEKDWLALVAVHSDSWLLAVAFYFAARFGFDKEARRRLFSMINNLPTIFEVVTGAAKKQTKEKGPNSTSKSNKPSSKMPSRPESHSKSTKVVAPPKDDDDDESGEEYEEEEERDNTLCGSCGTNDGKDEFWICCDSCERWYHGKCVKITPARAEHIKHYKCPDCTNKRARA

SEQ ID NO: 8709 - DNA, 1080 bp, Panicum virgatum
  misc_feature: Ceres CLONE 2015117
  misc_feature: Encodes the peptide sequence at SEQ ID NO. 8710
agccactcagctgtcagctctcatcgcccgctatataaacatagatctcttgctccctttgctttctcccttccctggccttccttgttgacgagtagttgtgagattcacttcgcccccggccggcttctctccgtttctgcaccgccagagaccagcaggtgctgtgcgattagcagccacccagtgtatgcgcaccagcagccggcgcgcggcatggcggagtgcgagcgcggcggcggcggcggcaggtccccgtcttcgtccatggacagcagcacccacccggtgctctccacgacgtcgtcgggctgccggccggcgggccgccgggacctcagcaccgacctccagctagggctcagcctgtcgccggcgtcctcctccctcctggccgcggaggccacgaccatcccttctacgccaaggaaccaagtacaccctgattggcccccaatcaagccgttcctcagaagcgccttgatggcgtcagcacgccggcggcggacattgttcgtgaaggtgtatatggaaggcgttccaatcggccggaagctggacttgctcttgctggaagggtacgacagcctcctcgccaaactccgccacatgttcaagactcccatcacctatgctaatgttatggagtaccatcaacgaattcctcgcgagaaggctgcacatatcctcacctatgaagaccaggatggagactggatgatggttggggatgtaccttgggagctcttccttgcaagtgtgaagaaactgaggattgcaagaacagataaatgctagtagcaagttatccaagcggcggactttatatttggactttatatttcttttttctttttatatatgtttattgagaaaggtttgctgagcagagcgggaatgtgaagctgaggctatactaactgtgtacagtatacttgagaaaatcaaacctcgctacctccctagaaaatatcaaagttgtcttttgtacgttatttttcggtttctttgacttgtaaataccatggttatttgtcgaagagcagagaatttgtatgccaaaaaaaaaaaaaaaaaaaa

SEQ ID NO: 8710 - protein, 193 aa, Panicum virgatum
  misc_feature: Ceres CLONE 2015117
  misc_feature (1)..(162): Pfam Name: AUX_IAA Pfam Description: AUX/IAA family
  misc_feature: The sequence is a functional homolog of  SEQ ID NO 118 in the  10/286,264 US patent application
  misc_feature: The sequence is a functional homolog of  SEQ ID NO 126 in the  10/225,066 US patent application
  misc_feature: The sequence is a functional homolog of  SEQ ID NO 1812 in the  11/479,226 US patent application
  misc_feature: The sequence is a functional homolog of  SEQ ID NO 276 in the  10/374,780 US patent application
  misc_feature: The sequence is a functional homolog of  SEQ ID NO 892 in the  10/412,699 US patent application
  misc_feature: Useful for making plants with modulated growth and phenotype characteristics
MAECERGGGGGRSPSSSMDSSTHPVLSTTSSGCRPAGRRDLSTDLQLGLSLSPASSSLLAAEATTIPSTPRNQVHPDWPPIKPFLRSALMASARRRRTLFVKVYMEGVPIGRKLDLLLLEGYDSLLAKLRHMFKTPITYANVMEYHQRIPREKAAHILTYEDQDGDWMMVGDVPWELFLASVKKLRIARTDKC

SEQ ID NO: 8711 - DNA, 1042 bp, Panicum virgatum
  misc_feature: Ceres CLONE 2015157
  misc_feature: Encodes the peptide sequence at SEQ ID NO. 8712
aattagctagcgttgttcagcccacactggcatggagggaactagcagatcattgccttgcattctcctcacgttgctcgcgaccacaagcctcctttggaaggaagccgcgtgcttctcggcgtccggcttgaacaaggcgttcgccactttttatggcggtagcgacgcttcaggaacgatgggaggcgcttgtgggtacggcaacctgtactccacgggctacggcacgaacacggcggcgctgagcacagcgctgttcaacgatggcgcctcgtgtgggcagtgctaccggatcacctgcgactaccaggcggacccgcggttctgcataagtggcacatcggtgaccatcaccgccaccaacctgtgccctcccaactacgccctgccgaatgataacggcggctggtgtaacccgccccgccagcacttcgacatggccgaacccgcctggctcaagattggcatctaccgcggtggcatcgtgcccgtgatctaccaaagggttccttgtgtgaagcaaggcggggtcaggttcaccatcaacggtcgagactacttcgagctggtgctgatctctaacgttggcggctgcgggtccatccagtcggtgtcgatcaagggctcgcgaacggggtggatagccatgtccaggaactggggtgtcaactggcagtccaacgcgtacctcaacgggcagagcctgtcgttccaggtcactagcagcgatggccagaccaagaccttcctcaacatcgtcccggccaattgggggttcgggcagacctttgcgtcctcgcaacagttctcttaagaggagagcttttgtttttgtttttttggtcctttgggtgtctccgccaataccttgtaaaggtttccctccatatatatgctgcctcacttgtccatcgagggacatccatatgctttgcccaacgtcaccttgtaccctctgtttacacattaaaggaaaaaatctattgtttttttctagaagaaaaaaatcttgagttgccaaaaaaaaaaaaaaaaaaaa

SEQ ID NO: 8712 - protein, 261 aa, Panicum virgatum
  misc_feature: Ceres CLONE 2015157
  misc_feature: Great-hit functional homolog of the protein sequence given in SEQ ID NO 9203
  misc_feature: Useful for making plants with altered Lignin content
  misc_feature: Useful for making plants with altered cell wall content and/or composition
MEGTSRSLPCILLTLLATTSLLWKEAACFSASGLNKAFATFYGGSDASGTMGGACGYGNLYSTGYGTNTAALSTALFNDGASCGQCYRITCDYQADPRFCISGTSVTITATNLCPPNYALPNDNGGWCNPPRQHFDMAEPAWLKIGIYRGGIVPVIYQRVPCVKQGGVRFTINGRDYFELVLISNVGGCGSIQSVSIKGSRTGWIAMSRNWGVNWQSNAYLNGQSLSFQVTSSDGQTKTFLNIVPANWGFGQTFASSQQFS

SEQ ID NO: 8713 - DNA, 1478 bp, Panicum virgatum
  misc_feature: Ceres CLONE 2015185
  misc_feature: Encodes the peptide sequence at SEQ ID NO. 8714
aataatatattttttatttcgaaacaaaaggaaccaaatcatctttaaacatggaacaccaaaaccaccacatcgctcctgaaggaagcttgtcaaacgaagctcaagaactcatcaagaagtacgaaaactcccacctcgttaagaagcatagaggtttcggaaccaacgccatccacgctggtcaagaacccgatccagtttccggaggtgtcagcgtccccgtcaacctctcctccacttatgcccaaaagtaccctggtgaacctttcggcaaatacgactattctcgttgtggacaccccaccagagaagccttcgaaatcgccttggctgctgccgaacacggaaagtacggcatggccttctccagtggttgcgctgccaccacctgcatcgtccaaaccgtcctcggtgttggtgaccacgtcatctgctgcgatgatgtctacggaggcacccaaagatatatgagacaaatcagtcaacaaagaaacggtattgaatactcctttgttgatatgaccaacgtcgaaaacgtcgaaaaggccatcaagcccaacaccaagcttatctggatcgaaactcccaccaaccccaccctcaaggtttgcgacgtcgaagccatctgcaaggttgccaagagcaagggaattatcactgccaccgataacaccttcccctctccttatctccaaagccccctccttttgggctctgacatcagtgtcaactccgtcactaaatacatcggaggtcactctgacgtcgttatgggcgccctcgccaccaacgaccaagccctcagagacaagctcttcttcacttccaagactatcggaggaactccaggagctttcgactgctaccttgccctcagaggtctcaagaccttgaaggtcagaatggacgctgcttgcagaagtgcccaaatcattgctgaattcctcgaaagccaccccaaggttgagaaggtcatttaccccggtcttactagccaccctcaacacgaaactgccaaaaagcaaatgagaggtttcggtggtatgatcaccttcttcatcaagggacaaatcgaagaatccagaaacttcttggccgccatgaagaccatgactttggctgaatccctcggaggtgttgaatctcttattgaatgccccgctgtcatgacccacttctccgtccccgttgaagtcagaaaggaactcggtatttccgacaacttgatcagactctccgttggtcttgaagatatcgaagatttggtccacgatttgcaacaagcctttgaaaagatctaaattagaggataactactatgtttaaaacttgaaggttccttctggttttttttagtaatattttatataaagtcatccatcaatactcaaataaatatgttccttgtctgtcgctttatatatatttaactctggcgaaaataatccacccctcaaaaaaaaaaaaaaaaaaaa

SEQ ID NO: 8714 - protein, 417 aa, Panicum virgatum
  misc_feature: Ceres CLONE 2015185
  misc_feature (2)..(375): Pfam Name: Cys_Met_Meta_PP Pfam Description: Cys/Met metabolism PLP-dependent enzyme
  misc_feature (37)..(415): SWISSPROT Homolog: EC 4.4.1.1 Cystathionine gamma-lyase
MEHQNHHIAPEGSLSNEAQELIKKYENSHLVKKHRGFGTNAIHAGQEPDPVSGGVSVPVNLSSTYAQKYPGEPFGKYDYSRCGHPTREAFEIALAAAEHGKYGMAFSSGCAATTCIVQTVLGVGDHVICCDDVYGGTQRYMRQISQQRNGIEYSFVDMTNVENVEKAIKPNTKLIWIETPTNPTLKVCDVEAICKVAKSKGIITATDNTFPSPYLQSPLLLGSDISVNSVTKYIGGHSDVVMGALATNDQALRDKLFFTSKTIGGTPGAFDCYLALRGLKTLKVRMDAACRSAQIIAEFLESHPKVEKVIYPGLTSHPQHETAKKQMRGFGGMITFFIKGQIEESRNFLAAMKTMTLAESLGGVESLIECPAVMTHFSVPVEVRKELGISDNLIRLSVGLEDIEDLVHDLQQAFEKI

SEQ ID NO: 8715 - DNA, 952 bp, Panicum virgatum
  misc_feature: Ceres CLONE 2015257
  misc_feature: Encodes the peptide sequence at SEQ ID NO. 8716
acacatacgaattttcactattcacttcactcgctctctactctcaaacaatcgttcgtcattcaatcgcttccttccaatctctcaatggcttcttctgttgcagtcaagcgaattttctcctccggcctcctctccaggtctctccgtcctgttgcctcctccgcttcccgttcattcaacaccaacgccatgcgccagtacgacgaacgctccgatgagtccaacgttgccgatcgtcgcggcgccgatcgctctttccctcgcactcgccgcgacgatttcctctcaggtaatgtgtttgatccgttttctccaactaggagtctgagtcaggtgcttaacatggtggatcagttaatggacaatccattcctttctgcttcacgtggaattggagctggtggagctcgacgcggctgggatgcgaaagagacagaggattctctgcttcttcgtttggatatgcctgggcttggtaaggaagatgtgaagatctctgttgaacagaatacccttaccattaaaggtgaaggtggtaaagaaagtgaggaagatgaagaaaatgcgcgtcgattctctagtagaattgatttgcctgagaagctttacaagattgatcagattaaagctgagatgaaaaacggtgtgcttaaggttgttgtgcctaaaatgaaggaagaggagaggaatgatgtgattaatgtcaatgttgagtaggttaaggttttcttttattggttattttcactaagacattttgttagttgtgaactagttgatggatctaggttttgttggtgagttatgttgctgtgttaaagcttttgagaccttagcttttcattgtaataatcgtttggaaagtaacgagtttgagtttttcttttgtaaatctgattttatatttgcattacaaccttatttctcagaaaaaaaaaaaaaaaaaaaa

SEQ ID NO: 8716 - protein, 210 aa, Panicum virgatum
  misc_feature: Ceres CLONE 2015257
  misc_feature (1)..(99): Pfam Name: HSP20 Pfam Description: Hsp20/alpha crystallin family
MASSVAVKRIFSSGLLSRSLRPVASSASRSFNTNAMRQYDERSDESNVADRRGADRSFPRTRRDDFLSGNVFDPFSPTRSLSQVLNMVDQLMDNPFLSASRGIGAGGARRGWDAKETEDSLLLRLDMPGLGKEDVKISVEQNTLTIKGEGGKESEEDEENARRFSSRIDLPEKLYKIDQIKAEMKNGVLKVVVPKMKEEERNDVINVNVE

SEQ ID NO: 8717 - DNA, 1139 bp, Panicum virgatum
  misc_feature: Ceres CLONE 2015323
  misc_feature: Encodes the peptide sequence at SEQ ID NO. 8718
atccctctttatcttgatctctctctcttcagccttcatcatcaggcacggcagggcgctgcagtacaccctcgctcgactctcccggggagcctctcgcttctcccagccctgagctcccctgcattccaagccacaccgacgcaggcgccaaaaataaacgccacgccactacgtggcgagggggctccgcgggtcgcccccatctccagctagctagcctcctccgcgacgacgatggaggttgccgccgaggctgccgcgccggcgcccgacgagggcgcgctggacgagcgcggcgcggcgctgcacctccccaggctggtggccggcgtcgtctccggcgccctcaccggcatcttcgctctcgctggagccttgaccggagccgtcaccggcgccgtcgcggggagagcttcggacagcggcgtcctccggggagctggactgggggcgttcgccggagctgtgctctccatcgaggttcttgaggcttcgcgagcttactggtgctccgaccggctgggctcgcacggtgcatcctccatggctgatttcattgagcagctcattcaggcccggtttgtgcaacagcaattaacatcttcaggatatacatcatctcgctggcaggtcagcatatcagattttggtcatgatgacatgtacgacatttttgtagacatttcatctaaagggctctcactagagtcattgaagaaactaccacattatgtggtcactgatcaaatgcgggactcctttggggaaatcttgtcttgccctatctgcctacaggaccttgtagccggtgagacagcgaggaggttgcccaattgctctcacactttccaccagccttgcgtggacaaatggctcgtcgatcatggctcatgccccgtgtgcaggcaagagatgtaagataggtaacctgcttagatgaaggaattagctgggtgaagtgaaatgttacttcatatagagataatcctacacacggtgatgtaaattaatagtagaattctgcttgttttactaccagtgaaagtgtacctgtatatctgacagtctgactctgtttcagtgtttcttacaccctattaagatgtcaaatgaaataaaaaaaaaaaaaaaaaaaa

SEQ ID NO: 8718 - protein, 227 aa, Panicum virgatum
  misc_feature: Ceres CLONE 2015323
  misc_feature: Great-hit functional homolog of the protein sequence given in SEQ ID NO 9503
  misc_feature (1)..(42): Pfam Name: zf-C3HC4 Pfam Description: Zinc finger, C3HC4 type (RING finger)
  misc_feature: Useful for making plants with altered alkaloid content
MEVAAEAAAPAPDEGALDERGAALHLPRLVAGVVSGALTGIFALAGALTGAVTGAVAGRASDSGVLRGAGLGAFAGAVLSIEVLEASRAYWCSDRLGSHGASSMADFIEQLIQARFVQQQLTSSGYTSSRWQVSISDFGHDDMYDIFVDISSKGLSLESLKKLPHYVVTDQMRDSFGEILSCPICLQDLVAGETARRLPNCSHTFHQPCVDKWLVDHGSCPVCRQEM

SEQ ID NO: 8719 - DNA, 1159 bp, Panicum virgatum
  misc_feature: Ceres CLONE 2015355
  misc_feature: Encodes the peptide sequence at SEQ ID NO. 8720
ataaaatttagaaacttcctcacaactccgattcaaaaattttttgagcctcaagatgaatacacaaacctattacgaagttttaggccttgccaacacgtgtactgctcaagaaattaaaaggagttatcatcaactcgcactgatttggcatccagacaaacatactgataaggaaggagcaaatcttcaattcatgtttattagtgaagcttataatgttctcaatgatgtgaataaaagaatgatttatgatgtctctggaaaagaaggactacttaaagatgaagaatcaaaaacagatattcaaaaaaatatcttttctaaaaaaggatttcaagatactgagaaatctgcagttgatattctcaaagatatcatcgaagaaaaagtgaacgaagaattcttgaaaagttgtgaagcatcaggatattctagatcgatgcattcaagcctgaaatcttttgttcatgagactgttatttcaagtgatgaagatactgctaattttttggctgattatcaacctactttccttaatgcaaaatttgcagaacaatcagaataccttgaccaattcatcctgaataataaagaaaattcttctgtaagagtcaccacaaatcctttcaatatcaagagacaaattcccagaagccgtaaaaatagcttcctagctcctgctcaaggacctgaagagaataagagaaatccatttaaagttctcaaagttgtgaaaacaaaaagtgatgctcttcttattcagactttgaaaaatagcaaaagagttttccttatcaatgacgaagatgaacaaactgaagaagatgatgaatttttaatgagttttgttcaacccaaatttacaaagagaagaaattactgtagtgaagctgtcgaagacagtgataatttgcttgaaaaaatctccaaaaaattgaaaacagaaactgttgtctaagtgaacaaatcagtgtcttgttgtgttttttttttgctgccatttttttttcaactttttatattgattgatttctatatttcatttaatttaaccatattttgtttcatgatttcttgataatttttcaatatcttgtaaatctgtctttttataccaacaaaaagagaacaattggaaaaaaaaaaaaaaaaaaaa

SEQ ID NO: 8720 - protein, 301 aa, Panicum virgatum
  misc_feature: Ceres CLONE 2015355
  misc_feature (2)..(64): Pfam Name: DnaJ Pfam Description: DnaJ domain
MNTQTYYEVLGLANTCTAQEIKRSYHQLALIWHPDKHTDKEGANLQFMFISEAYNVLNDVNKRMIYDVSGKEGLLKDEESKTDIQKNIFSKKGFQDTEKSAVDILKDIIEEKVNEEFLKSCEASGYSRSMHSSLKSFVHETVISSDEDTANFLADYQPTFLNAKFAEQSEYLDQFILNNKENSSVRVTTNPFNIKRQIPRSRKNSFLAPAQGPEENKRNPFKVLKVVKTKSDALLIQTLKNSKRVFLINDEDEQTEEDDEFLMSFVQPKFTKRRNYCSEAVEDSDNLLEKISKKLKTETVV

SEQ ID NO: 8721 - DNA, 808 bp, Panicum virgatum
  misc_feature: Ceres CLONE 2015399
  misc_feature: Encodes the peptide sequence at SEQ ID NO. 8722
gagacgtgccatcccgacaccgcccgccgagctgctgccccccggctccccccctcaaagccccgcggcgcgagtcgagccaggcacgcacgcgacgcgagcgagcatggcggatcggcagcagcacgtccacgcgcacggcgagcggccggactcgccgtcggcggcgctgctgcggcaggtgcagacccacgcgcccaactcgacgcaggtggtgggcttcctggcgctgctcgtgtccggcgccgtgctcctcctcctgacggggctcacgccgacgggcgccgtcgtggcgctcgtcttcctgggcccgatcgcgctgctcaccagccccatctgggtgcccgtcgccatcgcggtcaccgtcctcgccgccgccgcgctctccgcctgcggcttcgctgtcgcggcgctcgcgacgggcacctggatgtaccgctacttcacggggcgccaccccgtgggcgccgaccgggtggactacgcgcgcagccggatcgccgacacggccagccacgtcaaggactacgcgcgcgagtacggcggctacctgcacagccgctccaaggacgccgcgccaggcgcctaggcggcgcggcggcgcgcgcgcagccggtagctaggtcgtcgcggtctcttcgtgttcatctttgcgtgtgtgctccamtccagtctctctccgtgttgtcaatttccactcctttttgctaggacacgtaagatgtttatcttggtacaattttatcttgctttctcctcgtgtaattaggaaattagttgaatcataagaggactcgtcatggcagcc

SEQ ID NO: 8722 - protein, 160 aa, Panicum virgatum
  misc_feature: Ceres CLONE 2015399
  misc_feature (1)..(118): Pfam Name: Oleosin Pfam Description: Oleosin
MADRQQHVHAHGERPDSPSAALLRQVQTHAPNSTQVVGFLALLVSGAVLLLLTGLTPTGAVVALVFLGPIALLTSPIWVPVAIAVTVLAAAALSACGFAVAALATGTWMYRYFTGRHPVGADRVDYARSRIADTASHVKDYAREYGGYLHSRSKDAAPGA

SEQ ID NO: 8723 - DNA, 913 bp, Panicum virgatum
  misc_feature: Ceres CLONE 2015518
  misc_feature: Encodes the peptide sequence at SEQ ID NO. 8724
gagagaagaccaccaccggaatctggtctcttcttccccaatcgcctcctccctcccgatccagccccgcagcgacgccgaggagagagagctagaagagagatcgcgcacggagatgtcgtcggactcgtcgtgggcgcgggccctggtgcagatctcgccctacaccttcgccgccatcggcatcgccgtctccatcggcgtctccgtcctcggcgcggcatggggcatcttcatcaccgggagcagtctcatcggagcctccatcaaggcgcccaggatcacatctaagaacctcatcagtgtcatcttctgtgaggctgttgcaatttacggtgtaattgtggcaatcatcctccagacaaagcttgaaagtgtgccatcatctcaaatgtatgctccggagtctctacgagctggctatgcaatctttgcatctggccttattgttggctttgctaatcttgtgtgcggggtatgcgtggggataattggaagcagctgcgcactgtcggatgctcagaattcgtcactgtttgtaaagatcttggtaattgagatcttcggcagcgctctgggactgtttggagtcattgtgggcattatcatgtcagctcaagccacatggccggccagagcttgattgtcctcattcatcgcactgtaaattaatccgaatgaaatgtatcaagatgtggtccaactgcctttacctgcctcttttttcttttgcacttttttttggcaaaacaagtaattgggtgcccttagcgcatccgattgtagagttgatattcctactgccgagactccatatgtgttgaatatcttgcaggtgctattgctgttgcaagacacactcagcttattgaataaatgcactggaactgaataaaaaaaaaaaaaaaaaaaa

SEQ ID NO: 8724 - protein, 175 aa, Panicum virgatum
  misc_feature: Ceres CLONE 2015518
  misc_feature (1)..(66): Pfam Name: ATP-synt_C Pfam Description: ATP synthase subunit C
  misc_feature (3)..(170): SWISSPROT Homolog: EC 3.6.3.14 Vacuolar ATP synthase subunit c''
  misc_feature (4)..(168): SWISSPROT Homolog: EC 3.6.3.14 Vacuolar ATP synthase 21 kDa proteolipid subunit
MSSDSSWARALVQISPYTFAAIGIAVSIGVSVLGAAWGIFITGSSLIGASIKAPRITSKNLISVIFCEAVAIYGVIVAIILQTKLESVPSSQMYAPESLRAGYAIFASGLIVGFANLVCGVCVGIIGSSCALSDAQNSSLFVKILVIEIFGSALGLFGVIVGIIMSAQATWPARA

SEQ ID NO: 8725 - DNA, 1093 bp, Panicum virgatum
  misc_feature: Ceres CLONE 2015580
  misc_feature: Encodes the peptide sequence at SEQ ID NO. 8726
ctatatttcattccgcctccccagatcgatcgatcaccacccggagaagagagcgagtgggatcacacgcccacagggctacctctccgctcgcgctggttggccggctggttttaaggcgacggccgccctcggcatgcgctgtcctgctcgcccgggaaatggcgcccgcagctgcagcttccaccctctcggccaccgccgccgccgccgatgcttccaagcgtccggccgcttccgacgctgagccgatcggctcccccgtgctccaccaccaggacggcgacgaggccgcgcgcaagcaccacccgaggcggcagcagcagcagcagctcgagtgcccgcgatgccagtccaccaacaccaagttctgctactacaacaactacagcacggcgcagccgcgccacttctgccgcgcctgccgccgctactggacgcacggcggcacgctgcgggacgtgcccgtcggcggcgcctcccgccgcgccgccaagcgccgcagggtcgacgccgacgccgagccctcgccgccgcagaccacggcgcgcgcggaggaagggtaccgcctgatgccggacctctcggccttcccgttcctcagcgacggcatcttcctgccgcagctcgacctcggcgctgcgccggcggccacgttctcgtcgtggcaccactcgggcgtcccggacttttacgacgggctcgcgccgtgggacgacgggacggctggcgtcacgggcgcgtggggtgacatcgccggcctcgagctcagctggccgccgccggggaactgatcacggcagccgggcgccgttgtgaggctccgcttttagcagtgcttccgagttccaagctagtatgcagtgccggcagtatgttttgatgagctaatatccagctaggaatgcgagcagctcaattctcccatggtttcaccgtttcttctcgtcattacaacgaaaaaatgaaatcgtggccagtggttagatcagcggatcatgatctgtagctgcctaggggaggatgtaaggtctctgctgtgattattgtgacaataaaattaagtttatgtcaaaaaaaaaaaaaaaaaaaa

SEQ ID NO: 8726 - protein, 210 aa, Panicum virgatum
  misc_feature: Ceres CLONE 2015580
  misc_feature: Great-hit functional homolog of the protein sequence given in SEQ ID NO 9746
  misc_feature (1)..(63): Pfam Name: zf-Dof Pfam Description: Dof domain, zinc finger
  misc_feature: Useful for biocontainment applications
  misc_feature: Useful for making plants with modulated biomass
  misc_feature: The plant is abnormally small.
  misc_feature: The plant produces a reduced number of seeds.
MAPAAAASTLSATAAAADASKRPAASDAEPIGSPVLHHQDGDEAARKHHPRRQQQQQLECPRCQSTNTKFCYYNNYSTAQPRHFCRACRRYWTHGGTLRDVPVGGASRRAAKRRRVDADAEPSPPQTTARAEEGYRLMPDLSAFPFLSDGIFLPQLDLGAAPAATFSSWHHSGVPDFYDGLAPWDDGTAGVTGAWGDIAGLELSWPPPGN

SEQ ID NO: 8727 - DNA, 1461 bp, Panicum virgatum
  misc_feature: Ceres CLONE 2015722
  misc_feature: Encodes the peptide sequence at SEQ ID NO. 8728
gacgactccgacgagcccttcatatcctttcttcactatactctctcctccgaagtccgaactgccaaacccgtccctctcgtcgccgtcgctcgcctcgcctcccgcggatcaaaaccctagcaacctgctcccccctcgcggcccggtcggccggcgatggcgtccgccgcgctcggaactcaggttgctgcagcagccttggcgcccgtcggctcggacggtttcctcaagggttcttcgcgcaaggggaacaatagtctaaacttctggagcaaaccatgggttgggaagagcttagcatgggaaaagacccagcaatcaaggcatttgaacaaggtcttctgtatgtccgttcaacaagcaagcaaaagcaaagttgctgttaaacctgttgaattggagaatgcaaaggagccaccactcaacttatacaaaccaaaggaaccttacacagccacgattgtctcagttgagaggattgtaggccttaaagcccctggtgaaacatgtcacattgttattgaccatggtggcaatgttccatactgggaaggacagagttatggtgtcattcctccgggagagaatccgaagaaacctgggtctccaatactgttaggctctattctattgcttctactaggtatggtgattcttttgatggaaagacagcaagcttgtgttcgccgtgctgtttactatgatcctgaaactggaaaggaagacccctcaaagaaaggtatctgcagtaacttcctgtgtgactcaaaaccaggggacaaagttcagatcacaggcccctcgggcaaaattatgcttcttccggaggatgatccaaatgcaactcatatcatgattgccactggcactggtgttgctccttaccgtggctacctacgtcgtatgttcatggaagatgtctcaacttacaaatttggtggtctggcatggctcttccttggtgttgctaactctgacagccttctctatgatgaagagttcactaactaccttcagcagtatccagacaatttcaggtatgacaaagcactaagcagggagcagaagaacaagaacggtggcaagatgtacgtgcaggacaagattgaggagtacagcgatgaaatcttcaagctcctggacggcggagcgcacatctacttctgtggtttgaaggggatgatgccggggatccaggacacgctcaagagggtggccgagcagagaggagagagctgggaccagaagctgtcgcagctgaaaaagaacaagcagtggcacgtagaggtttactaggttgtgaaaatgccacagattatgattgtttcacgacaatgtgagaaactggacatataattgaacgattcttgttgcaatgtaaaattgtgggttttgttcataagcttctgctccaaatgtcgaatcaattgaagcacatgcttttgagttggtgttact

SEQ ID NO: 8728 - protein, 379 aa, Panicum virgatum
  misc_feature: Ceres CLONE 2015722
  misc_feature (1)..(117): Pfam Name: NAD_binding_1 Pfam Description: Oxidoreductase NAD-binding domain
  misc_feature (1)..(379): SWISSPROT Homolog: EC 1.18.1.2 Ferredoxin--NADP reductase, embryo isozyme, chloroplast precursor
  misc_feature (3)..(379): SWISSPROT Homolog: EC 1.18.1.2 Ferredoxin--NADP reductase, root isozyme, chloroplast precursor
MASAALGTQVAAAALAPVGSDGFLKGSSRKGNNSLNFWSKPWVGKSLAWEKTQQSRHLNKVFCMSVQQASKSKVAVKPVELENAKEPPLNLYKPKEPYTATIVSVERIVGLKAPGETCHIVIDHGGNVPYWEGQSYGVIPPGENPKKPGSPILLGSILLLLLGMVILLMERQQACVRRAVYYDPETGKEDPSKKGICSNFLCDSKPGDKVQITGPSGKIMLLPEDDPNATHIMIATGTGVAPYRGYLRRMFMEDVSTYKFGGLAWLFLGVANSDSLLYDEEFTNYLQQYPDNFRYDKALSREQKNKNGGKMYVQDKIEEYSDEIFKLLDGGAHIYFCGLKGMMPGIQDTLKRVAEQRGESWDQKLSQLKKNKQWHVEVY

SEQ ID NO: 8729 - DNA, 1538 bp, Panicum virgatum
  misc_feature: Ceres CLONE 2015790
  misc_feature: Encodes the peptide sequence at SEQ ID NO. 8730
aagcgctctgctttgcagctctacacggcgctgtgctgagctgccgagctgcgatctttgcacaggcaaacgcagcaccgtttcctattgccagttgcgagctttgcctgccactccgcgtgccgcgccggtggtcgaattggtcgccatcaagtgtcgtctgtcgatcatggggagccaccgaaggagtaccggtgccctgccggcgtcggcgctgatgctgatgctgaccctgctctgcgcgtcgtgggtgctcgccgcggcgcagaactacagtgccgtcttcaacttcggcgactccatcacggataccggcaacctgtgcaccaacggcaggccgtcgcagatcaccttcacccagccgccctacggcgagacctacttcggcaccccgacatgccgctgctccgacggccgcgtcatcgtcgacttcctgagcgaccagttcggactgccgttcctggcaccgtccaagtccagcaacgcggacttcaagcacggcgcgaacatggcgatcacgggcgcgacggccatggacgcgcccttcttccggtcgctcgggctctccgacaagatctggaacaacgggcccatcagctttcagctccagtggttccagcagatcgccacttccgtctgcgggcaaaattgcacaagctacctggccaactccctattcgtgttcggcgagttcggcggcaacgactacaacgccatgattttcggcggctacaccactgagcaggccaggaaatacaccccgaagatcgtcaacaccatctccaggggcatcgataaactcatcgccatgggcgcgacgaacatcgtggtgccgggggtgctgcctatcgggtgcttccccatctacctgaccatctaccagagctccaacagcagcgactacgacgacctcggctgcctccacaacttcaatgacctctccacgtaccacaacaccctgctccagagaagggtcgacatcatccagagcaggcacaggaagacggcacggatcatgtacgccgacttctactccggcgtctacgacatggtccggaacccgcagaattacgggttcagctcggtgttcgagacgtgctgcgggtcgggcggcggcaagtacaactaccagaacagcgcccggtgcgggatgcagggcgcgtccgcgtgcgccagccccgccgcgcacctcagctgggacggcatccacctcaccgaggccgcgtacaagcagatcaccgacggctggctcagagggcgctactgccgcccgcccatccttcacagctaaataagccacaggatttgcaatatttattggtataatttacattggattaattgaggagggggattaattgttggcttatctccaacttgttatttctttaattttggaggtgtttgttaattaataagttgcccaagaaagaaatgacggcaactgtggaaatgtaatagttatacgatgtccgtcgtcgttgctgtaacttgcttttggtgcagtagatttatcacaaaaaaaaaaaaaaaaaaaa

SEQ ID NO: 8730 - protein, 373 aa, Panicum virgatum
  misc_feature: Ceres CLONE 2015790
  misc_feature (4)..(295): Pfam Name: Lipase_GDSL Pfam Description: GDSL-like Lipase/Acylhydrolase
MGSHRRSTGALPASALMLMLTLLCASWVLAAAQNYSAVFNFGDSITDTGNLCTNGRPSQITFTQPPYGETYFGTPTCRCSDGRVIVDFLSDQFGLPFLAPSKSSNADFKHGANMAITGATAMDAPFFRSLGLSDKIWNNGPISFQLQWFQQIATSVCGQNCTSYLANSLFVFGEFGGNDYNAMIFGGYTTEQARKYTPKIVNTISRGIDKLIAMGATNIVVPGVLPIGCFPIYLTIYQSSNSSDYDDLGCLHNFNDLSTYHNTLLQRRVDIIQSRHRKTARIMYADFYSGVYDMVRNPQNYGFSSVFETCCGSGGGKYNYQNSARCGMQGASACASPAAHLSWDGIHLTEAAYKQITDGWLRGRYCRPPILHS

SEQ ID NO: 8731 - DNA, 1175 bp, Panicum virgatum
  misc_feature: Ceres CLONE 2015843
  misc_feature: Encodes the peptide sequence at SEQ ID NO. 8732
agctagcgaagccggatcaacaccacaccgacctatcctactgaggagttctgccattacaagtcaccaccggcacacctcgagtcactgggacgctcccgcccttaccacgtacaggttccaatatcaagccacttccgaagacggccagccctcacgcaaaccatgtcgcccccccgagcttttgactttggcggtgaagtggccattgtgaccggagcaggttgccgcatggaaaacgagcttggcaatggcagcgcgacggccgttctgctcgcacgccacggggcccgcgtagtggtgatcgaccgtgacccggctgccgccgcagagaccaagcgcatgatcgatgaggagggtggcgtcgcggagactatcctgtgcgacgtgacggtggatgccgagtgtaaggctgctgtgacgaaggctgttgagcttttcggcaaggtggatatcctcgttaacattgtgggcacagggggcgcccaaggcaccgttgacaaggtcaatctcgatgagttcaaccacgacatccattacaatgtaaccagcatggtgcagatggcgcggtatgcagtgcctgagatgcgtaagaacggcaaaggcgccattgtgaacatgagctccgtgtgtgggatggtgggcggaagccctggcgtcttctacgccacttccaaaggggccatcatccagatgacccgcgccatggccggccatcacggccccgacggtatccgtgtcaactgcgtttgcccgggcatggcctacacgcccatggcacgttgccgtggcatctccgaggacatgcgggaggagcgcaagagccttggcttcctcaagtacgaaggaaccgcgcaggacatcggatacgcaattctattcttgtgcagcaaggaagctagatggatcacgggggccatcctgcccattgatggagggtataccgctggaagagtggatcatcccaagatgggcaacatggcgatggctaagaaaccgggcgagtgatgcgagactgggcaagagcatgaccggggagttgacccggcggggtgggtgtggtggatgtgtctggcgaacccttctcaacgtcgaacggtagcgcgacgtatcaagaaaggtaaatgattggaaaggatgtacgaaataggctttaatgatactcgttctcccgg

SEQ ID NO: 8732 - protein, 280 aa, Panicum virgatum
  misc_feature: Ceres CLONE 2015843
  misc_feature (1)..(175): Pfam Name: adh_short Pfam Description: short chain dehydrogenase
MSPPRAFDFGGEVAIVTGAGCRMENELGNGSATAVLLARHGARVVVIDRDPAAAAETKRMIDEEGGVAETILCDVTVDAECKAAVTKAVELFGKVDILVNIVGTGGAQGTVDKVNLDEFNHDIHYNVTSMVQMARYAVPEMRKNGKGAIVNMSSVCGMVGGSPGVFYATSKGAIIQMTRAMAGHHGPDGIRVNCVCPGMAYTPMARCRGISEDMREERKSLGFLKYEGTAQDIGYAILFLCSKEARWITGAILPIDGGYTAGRVDHPKMGNMAMAKKPGE

SEQ ID NO: 8733 - DNA, 1014 bp, Panicum virgatum
  misc_feature: Ceres CLONE 2015848
  misc_feature: Encodes the peptide sequence at SEQ ID NO. 8734
aaaaacagaaacctccaggccaattcctcgaccgcatcgccgacagcccgcccgcccccatggccacctccgccgccctcgccgcgctctccgccacggccgccgccgccggcaagcgcctcctcctcccgcgcccctcctcctcctccctcaccttcgcctcccgccgcccgggcgccgcgggccccatccgggcccgcgggtccccagtccgggccgcggcgtcgtccgcgtcggcgccccccgccgccgccgccaagactatcgcgggcggggaccggctccccgacgcgacgctctcctacttcgactcccccgacggcgagctcaagacggtgacggtgcgcgacctgacggcggggaagaaggtggtgctcttcgcggtgcccggcgcgttcacgcccacctgctcccagaagcacctcccggggttcgtcgccagggccggggagctccgcgccaagggggtcgacgccgtggcctgcgtctccgtcaacgacgccttcgtgatgcgcgcctggaaggagagcctcggggtcggggacgaggtgctgctcctctccgacggcaacggggacctcgcccgcgccatgggcgtccagctcgacctctccgacaagcccgtcgggctcggcgtgcggtcccggcggtacgcgctgctggccgaggacggcgtcgtcaaggtgctcaacctcgaggagggcggcgccttcaccaacagcagcgccgaggacatgctcaaggcgctctgagttgctgcgacccctcctcgctcgccatggtttgtgtgtcccccttacctgaaaaaaagttagctttcgtttctgaatgaataatcgttgcgtcaacggtggcttgtgatggttgctaccgccaccgagagtttggtgactggtgaattctgcgcacttcacctcagtgtataactgtgtaagaggtgtcatcttgatgccaagtttctagttctagcgaacatgatagctcctttgtgattgtgagcgtgctctgtttggc

SEQ ID NO: 8734 - protein, 230 aa, Panicum virgatum
  misc_feature: Ceres CLONE 2015848
  misc_feature (1)..(161): Pfam Name: Redoxin Pfam Description: Redoxin
  misc_feature (2)..(230): SWISSPROT Homolog: EC 1.11.1.15 Peroxiredoxin-2E-1, chloroplast precursor
  misc_feature (3)..(230): SWISSPROT Homolog: EC 1.11.1.15 Peroxiredoxin-2E-2, chloroplast precursor
MATSAALAALSATAAAAGKRLLLPRPSSSSLTFASRRPGAAGPIRARGSPVRAAASSASAPPAAAAKTIAGGDRLPDATLSYFDSPDGELKTVTVRDLTAGKKVVLFAVPGAFTPTCSQKHLPGFVARAGELRAKGVDAVACVSVNDAFVMRAWKESLGVGDEVLLLSDGNGDLARAMGVQLDLSDKPVGLGVRSRRYALLAEDGVVKVLNLEEGGAFTNSSAEDMLKAL

SEQ ID NO: 8735 - DNA, 1555 bp, Panicum virgatum
  misc_feature: Ceres CLONE 2015865
  misc_feature: Encodes the peptide sequence at SEQ ID NO. 8736
atctaaacagaccctatacaaggaatgcatatttggctgcggggaaaggggcctcgtcatgcttccgcagtagcgccatttaatcttcccaggaggggaggagaaagaaagaaagaaggggagtcgattgacgcgaggacggagagctggatctttggcaattatctgtgaattatttgttggggagcacgttctcttggtccactctttctttcttggttcggcaacgaaccagtaacacgagtcctccagggtgttaaagcatgaagagcaaaatgtttcttgagcttgaatgatgccatctggtaacaaaatgcttctgcaagaaatggatggtgatccattccataccatgcaaaactatgatttcctgtctgggaatggttattcaatgaagcagttaattcatagcaattctgataaagactcctcatcaacaaaatctgagcagtctcgccaagacttatccacagtgagtgacagcagcctcaacagacaacacacaccaacgcaatctgacaacaatgatagttgcggaaagcgggaccagggcatggtgaaaactatattgtcctttgggaacccagaagttgctttctccactcaaaagtttgaccacagccagccttttgcttgtgcttcttataccgctgatccgtattattgcggggccttgacaggatacacttcaaatgcaattgttcatccccaaattaatgttgcagcaaactcgagggtaccattgcctattaaacctgcagcagaagagcccatatttgtcaatgcaaagcaataccatgctatactcaggaggcgtcaaatgcgtgcaaaattggaggctcagaataaactggtgaaaggtcggaagccgtatcttcatgaatctcgacatcgtcatgcaatgaagcgagtccgtggaccaggaggtcgtttccttaacaaaaaggagctccaggagcagcagcagcagcagaaggctctgccttcacttcagactccaactggtggggcgggcaagatggccctctgcaggaacaatctatgctctgaaaacagcgcatctcactcgtcttcaacaagctctggtatctcaagtgtttcaaacgggggtggcatggtggctcatcacgagcacatcagcttctcatctactagtttcctccccggcatgaacttccgcgcagagaacggcggtgaaaaaatggctgtccatggtgtccaccgccgcaccccgtcgtgaggtgaacccgcctcacactgttgcggtggtggtgccatcactggcgcactccccgtgtgcccgtggcaattcatccttggcttatgaagtatctaataattaatagtccgctttcagtttgacatggagtggagtagagcttgtctcagatcaactcgtttgtatcctgttgcaactaaatcactgaggttccacttgttgataatgttgtgtggatgcagatgttaatcttgtgtttcttgatgtaccaagtaatgtaaccatggtttgtttggaagaatctgctcttatatccaaaaaaaaaaaaaaaaaaaa

SEQ ID NO: 8736 - protein, 314 aa, Panicum virgatum
  misc_feature: Ceres CLONE 2015865
  misc_feature (1)..(57): Pfam Name: CBFB_NFYA Pfam Description: CCAAT-binding transcription factor (CBF-B/ NF-YA) subunit B
  misc_feature: The sequence is a functional homolog of  SEQ ID NO 1338 in the  11/479,226 US patent application
  misc_feature: The sequence is a functional homolog of  SEQ ID NO 622 in the  10/412,699 US patent application
  misc_feature: Useful for making plants with modulated growth and phenotype characteristics
MPSGNKMLLQEMDGDPFHTMQNYDFLSGNGYSMKQLIHSNSDKDSSSTKSEQSRQDLSTVSDSSLNRQHTPTQSDNNDSCGKRDQGMVKTILSFGNPEVAFSTQKFDHSQPFACASYTADPYYCGALTGYTSNAIVHPQINVAANSRVPLPIKPAAEEPIFVNAKQYHAILRRRQMRAKLEAQNKLVKGRKPYLHESRHRHAMKRVRGPGGRFLNKKELQEQQQQQKALPSLQTPTGGAGKMALCRNNLCSENSASHSSSTSSGISSVSNGGGMVAHHEHISFSSTSFLPGMNFRAENGGEKMAVHGVHRRTPS

SEQ ID NO: 8737 - DNA, 886 bp, Panicum virgatum
  misc_feature: Ceres CLONE 2015915
  misc_feature: Encodes the peptide sequence at SEQ ID NO. 8738
actctctctctcttcccagcactctctctctactcctcacgagcacgcacaccaccacaagaccccaaggctagacagctcacagctcaggcttctctccactccccccccccctcgttccccaacgcgctttcttcccccgtcccctcctctcgccgccgccgcctgcattccgtcgagcaactccgcgcggcggccatggcgaagctcgcgctggcgctgctgctgctcctggccgtggcggcctcggcgtccgtcgacctggacctgggcttcctcgcctcgggcggcggcgcccggagggagtgccgcggcacggtggccgagtgcctggccgaggacgaggaggccgagctcggctccgcctccgccgagtcgcaccgccgcgcgctcgccggccgcggctacatcagctacggcgcgctccgccgcgacaacgtgccctgctcccgccgcggcgccagctactacaactgccgccccggcgcgcaggccaacccctaccaccgcggctgctcccgcatcacccgctgccgcggctgagctcccgccgccggccgccgccccctccctcctcaggtgccctccgccgccggatccgccgccgggagcggggaaaggccggatctttcgccgctcctcctcctcctcccccggcgccgccgccgccgccgagttctaaaaaaataagttcttttttgtttctgctgctgctactgttgccttacaagtactagagctatggttttgttggttgccggtgtatggatttgtgttgggttcgtcgtgctgtttgtaaagtaagacgtcgattgattcgtgcccctatggctacttaaatatgaacatatactcctattcttttgaaaaaaaaaaaaaaaaaaaa

SEQ ID NO: 8738 - protein, 114 aa, Panicum virgatum
  misc_feature: Ceres CLONE 2015915
  misc_feature: Great-hit functional homolog of the protein sequence given in SEQ ID NO 9695
  misc_feature: Useful for making plants with modulated biomass
  misc_feature: The plant is abnormally small.
MAKLALALLLLLAVAASASVDLDLGFLASGGGARRECRGTVAECLAEDEEAELGSASAESHRRALAGRGYISYGALRRDNVPCSRRGASYYNCRPGAQANPYHRGCSRITRCRG

SEQ ID NO: 8739 - DNA, 1171 bp, Panicum virgatum
  misc_feature: Ceres CLONE 2015957
  misc_feature: Encodes the peptide sequence at SEQ ID NO. 8740
gccgtgcctcggcgcggctataaatcccgtcgcgcgacgggccggggatcacacgcagccggcagcgggagatcacaaaccggccctatctagctaggcacgagatcgatcgaggagagatcaccatggccacggcgggcgaggacgaggccagcagggcgagctccgccgccgccgccggcggcgggagtagggggcggtggtccctccgcggcatgacggccctcgtcaccggcggcatcgggcgcgccgtggtggaggagctggcggcgctgggcgcggccgtgcacacctgctcccgcaacgaggccgacctccgcgcccgcctcgccgagtgggacgccgccgccgccgccggcgccacccgcggcgccgtcacgggctccgtctgcgacgtgtccgcccgggaccagcgcgagcagctgctccgcgacgtcgcggcgcggttcgccaacaaactcgacatcctggtgaacaacgtcggcaccaacttcggcaagcccaccaccgactacacggcggaggactacgcgttcctgatggccaccaacctggagtcggcctaccacctctgccagctcgcgcacccgctcctccggcgggcgcccggctccggcgggtccggctccggcggcagcgtcgtgctcgtctcctccgtctgcggcgccgtcgccgtcggcacgggctccgtctacgccatggccaagggcgccatgaaccagctcgccaggaacatggcctgcgagtgggcccgggacggcgtccgggccaacgccgtggcgccgtggtacatccggacgccgctcgtcgagggggacctgtcgcgggaggcgtacgtggagagcatcgtggcgcggacgccggcgcggcgcgtcggcgagccggaggagatctcgtcgctggtggcgttcctctgcatgccctgcgcgtcctacatcaccggccagaccatcgccgtcgacggcggcatgaccgtctacggcctctacccagctgacaattgagcagtgatcgtcgtcttcctctacccggtgttctcaacagtcaacaccgcgttttattttgagtgaatcttatacttttttgagcgaaaaataagtgaagcgttacctgcagcctgcagatgatcgtccggactgctaaataagtgaagcttttattactttgagcg

SEQ ID NO: 8740 - protein, 292 aa, Panicum virgatum
  misc_feature: Ceres CLONE 2015957
  misc_feature (3)..(169): Pfam Name: adh_short Pfam Description: short chain dehydrogenase
MATAGEDEASRASSAAAAGGGSRGRWSLRGMTALVTGGIGRAVVEELAALGAAVHTCSRNEADLRARLAEWDAAAAAGATRGAVTGSVCDVSARDQREQLLRDVAARFANKLDILVNNVGTNFGKPTTDYTAEDYAFLMATNLESAYHLCQLAHPLLRRAPGSGGSGSGGSVVLVSSVCGAVAVGTGSVYAMAKGAMNQLARNMACEWARDGVRANAVAPWYIRTPLVEGDLSREAYVESIVARTPARRVGEPEEISSLVAFLCMPCASYITGQTIAVDGGMTVYGLYPADN

SEQ ID NO: 8741 - DNA, 1293 bp, Panicum virgatum
  misc_feature: Ceres CLONE 2016037
  misc_feature: Encodes the peptide sequence at SEQ ID NO. 8742
gacgaccacaactacaacagacaagaacaggaaagagcaagcttgacttgagcgagtaagagagagatggaagtggccgaaggacatcactttgccgaacagctgcatgcgtaccgcccggacttcgcccaagacgcggacatcgaggccgcggacgcgtcgacctcggacaccgcgcccctgctcgccctccccgccttcatgcccggcgcctcctcgtcctcatcctcgtccattctgggctcgagccagtcctccagcagcgaagccatcagcacacctccaggcgccggaggcgggctggcgccggaggcgtggcccggcggccgtaaggtgtgctacgcgtggcgttgcctgaacctgggctacggcgcctacctcgcggccgtggcggtggcattgggcgttgggctgggaatgaatggcggcgccagctgcgaacggcacctgggcgtgtgggcctcgatcgagatggccttttgcgtggtgggcgtgctgaatgcgctgtggaagcacaagcgggtaccgcagctggtcgtggatcgcaacgcacagactgacgacatgttcatcgctgcgtccaggctcaccttaagcgacatgtgcgcggtgtacggcggcgtgctgctcaacattgcatggatcgtgtggcttgtgctcggttgcatctggacttttaacgactctaattgctcgagcgaggcgcccatcctcttcgatacaacttctcttgttctgatggcacacctgtgcgtggtgggagcgccggtgagcgtgatcgtgtgcgcggcctcggcgatgccgctcgtgtactttgtgcgtccggacctcttcgaggagccctctcgcggagccaccaagtccctcatcgacagcacgaccaagtgctcgacctaccaacgcccgccctccaagtctcactctgacgccgacaaggcgggcaaggagaaagagaaggagatggctggcgatgaggaagagaagcagagggaagaggaggtgcagggcgaggaggaaggcgagtcgtgcgccatctgcctgagcgagtacgagacgggcgagcaggtgcgcgagctcggatgcggacacgtcttccacgccagctgcgccgaggcgtggctccaaaccaacaagacctgtgcggcctgccgacggcccatcgacgtcgcagtggagccctgaagtcctgccgcacgcacccaatcgtcaccatcacgggcatccatccgttcgtgtaaacttgtacataacgcaaacgcgaatccgacctcccaaaaaaaaaaaaaaaaaaaa

SEQ ID NO: 8742 - protein, 371 aa, Panicum virgatum
  misc_feature: Ceres CLONE 2016037
  misc_feature (1)..(41): Pfam Name: zf-C3HC4 Pfam Description: Zinc finger, C3HC4 type (RING finger)
MEVAEGHHFAEQLHAYRPDFAQDADIEAADASTSDTAPLLALPAFMPGASSSSSSSILGSSQSSSSEAISTPPGAGGGLAPEAWPGGRKVCYAWRCLNLGYGAYLAAVAVALGVGLGMNGGASCERHLGVWASIEMAFCVVGVLNALWKHKRVPQLVVDRNAQTDDMFIAASRLTLSDMCAVYGGVLLNIAWIVWLVLGCIWTFNDSNCSSEAPILFDTTSLVLMAHLCVVGAPVSVIVCAASAMPLVYFVRPDLFEEPSRGATKSLIDSTTKCSTYQRPPSKSHSDADKAGKEKEKEMAGDEEEKQREEEVQGEEEGESCAICLSEYETGEQVRELGCGHVFHASCAEAWLQTNKTCAACRRPIDVAVEP

SEQ ID NO: 8743 - DNA, 1481 bp, Panicum virgatum
  misc_feature: Ceres CLONE 2016100
  misc_feature: Encodes the peptide sequence at SEQ ID NO. 8744
agcagcacgcaggggcaggggccgggcatcagcagctccactctgccaatggaagacacggagcttccgatccaacatggcggcaccacgctatctgctgaggaccaaaagaagccactgtcggtgacgagctgcttgctgccagcacgtagcctgagatctacagcagccgttgcccctgctgctcatgctcaaagccaagccgatggtgatctctgcatccgatcgctgtccttctccaagctcttcagcttcagaatggccagggcgccgtcatcactgtccaccccggagcacattgatcaaattgatcctgatgccgccgcaagcaactgctctgctctaactccaggtaacagcagcaccaaggaggaggacaagctgaagcagatacgccgctcccagtccatgcctacgagcggcaggcagttcaagatggcaaaagggttgaggagagtagcggactccagctctctcggccctgccccagctggagtgttccgcctcagagtggtgccacttgttcctcaaacggagggaagcgtcactgctgcaggcggggaggaggaggcggcggccgtcgcagaagacattgcggccgaggaagcggtgtgccgcatctgcatggtggcgctgtcggaagaggcggtgctcaagctggagtgctgctgcaagggtgaactggccctggcgcacaggggatgcgccatcaagtggttcagcatcaagggcaacggcacctgcgacgtctgcagccaggaggtgctcaacctccccgtcaccctgcgccacctccatcaccatccatccattcaggctcagggtgttcagcagcaagcagatcccaccaccacggccaccagcagccgcagccgtcgctacagaatgtggcacggcacaccgatcctcgtgattatcagcatgctcgcctacttctgcttcctggaacagctgctggtcggcgaccatgggaccgcggctctggccatctccttgcccttcgcctgcgtcctcggcctcttctcctctctcaccacaacaaagatggtgtccaggagatatgtgtggatctactctgcagtgcagttcctcttcattgtgctcttcacccacctcttctacagatacgtgcggatgcaagctgtgatcgccatcatcctgtccaccttcgccggcttcagcatggccatctgcaccaactctgtcctcctccagattctcagatggagggtcaggcatgtggcatcgccaaccacaaccacaacgcgcgcaggtcactggctcccgggagcccccggcagcacccctcccccccgcttgcctcctttgtagctcacttcactaccatccaatcctctccagtccagcaccagctccccctccagctagctgtgtttgtatatagcttcatcctttgtttgctgagaccttgttgtatgcatgaaccgtcctttctggctttctatcattctatggtactg

SEQ ID NO: 8744 - protein, 427 aa, Panicum virgatum
  misc_feature: Ceres CLONE 2016100
  misc_feature (1)..(48): Pfam Name: zf-C3HC4 Pfam Description: Zinc finger, C3HC4 type (RING finger)
  misc_feature (1)..(54): Pfam Name: zf-C3HC4 Pfam Description: Zinc finger, C3HC4 type (RING finger)
MEDTELPIQHGGTTLSAEDQKKPLSVTSCLLPARSLRSTAAVAPAAHAQSQADGDLCIRSLSFSKLFSFRMARAPSSLSTPEHIDQIDPDAAASNCSALTPGNSSTKEEDKLKQIRRSQSMPTSGRQFKMAKGLRRVADSSSLGPAPAGVFRLRVVPLVPQTEGSVTAAGGEEEAAAVAEDIAAEEAVCRICMVALSEEAVLKLECCCKGELALAHRGCAIKWFSIKGNGTCDVCSQEVLNLPVTLRHLHHHPSIQAQGVQQQADPTTTATSSRSRRYRMWHGTPILVIISMLAYFCFLEQLLVGDHGTAALAISLPFACVLGLFSSLTTTKMVSRRYVWIYSAVQFLFIVLFTHLFYRYVRMQAVIAIILSTFAGFSMAICTNSVLLQILRWRVRHVASPTTTTTRAGHWLPGAPGSTPPPRLPPL

SEQ ID NO: 8745 - DNA, 996 bp, Panicum virgatum
  misc_feature: Ceres CLONE 2016127
  misc_feature: Encodes the peptide sequence at SEQ ID NO. 8746
acgcatcaccattcgcaaggccatccaaagctacctctttgcatcacgatcgatcgagctgtgaggtcagggcggcgagaggaggcggccagctaccagctactagctcatcggaggatcgatggggctgaagctgaacctgatcgtgaggctgctcgcggtggtggctgcgctggcggcgccggcgtcggggcaggccggggcggcgtcgtgcacggcgtcgctgatcaccagcttcaccccctgcctcaacttcctcaccaacagcaccagcggcggcggctcgtcgccgacgcaggactgctgccggtccctggcggcgctggtgaacgcgagcaccggctgcgcgtgcctcatcctcaccggcaacgtgccgctcggcgtgcccgtcaaccggacgctcgccgtcgcgctgcccaaggcctgccactccgccgccgtcccgctgcagtgccgagacacgtcggcgcagatcccagctcctggccccatcgccggcggcgcgccctccgccgccttgccgccgctgccgccagcgtcgccggcaacgccggagcctgaagcgccggcgccgccggtggcggatccgaccgggacggtgccggtgagccaggggcagacgaggccggcgatgctgcccagctccgcccggagagcgagcacccacgcccccgcagcggctgcgctcgcgctgctgctcgccgttggagctgcgctggtgtgatcggcagcagatggcatcgattgccttggtggggtgtgttcatacttgttcagttgcagacttgcagagtggtagagactttgacagattcgtgtgagtattggttttgtgagtgatttgtagggagcattgcgtttgccgtacatgtaattagtggtgcattctttcaggcttctttaatttctgagcatgagttggataatgtcgacgtggcagttacagtaatacagtgatgaattgtttttctctttcaaaaaaaaaaaaaaaaaaaa

SEQ ID NO: 8746 - protein, 200 aa, Panicum virgatum
  misc_feature: Ceres CLONE 2016127
  misc_feature (1)..(89): Pfam Name: Tryp_alpha_amyl Pfam Description: Protease inhibitor/seed storage/LTP family
MGLKLNLIVRLLAVVAALAAPASGQAGAASCTASLITSFTPCLNFLTNSTSGGGSSPTQDCCRSLAALVNASTGCACLILTGNVPLGVPVNRTLAVALPKACHSAAVPLQCRDTSAQIPAPGPIAGGAPSAALPPLPPASPATPEPEAPAPPVADPTGTVPVSQGQTRPAMLPSSARRASTHAPAAAALALLLAVGAALV

SEQ ID NO: 8747 - DNA, 921 bp, Panicum virgatum
  misc_feature: Ceres CLONE 2016161
  misc_feature: Encodes the peptide sequence at SEQ ID NO. 8748
atccacttctctccatccagctctcggacgacagatccatcgccggctgcaaactgcgacgaacgcgagcaagatcgagcggaacttccaaagccacctgctttaatttttcaccaccagcggctgcaagtgctagccatggttgccggcctggaagctctcctcgacccgacggcgctctccctcgcgctcccggcgccgccggcgctcaagaaggaggactacctcgccatctgcctcgccgcgctcgccgggacccgcaagttcgccgggctcgggagccagccccacgcgccgcctgcgccgcagcagcaggagctgccgttccggtgcgcggtctgcgggaaggccttcgcgtcgtaccaggcgctcggggggcacaagtccagccaccgcaagccgcccacggaggagcagtacgccgccgccgcggcgcaggcggaggcttccgcgggtggcctcgacgagacggcgtcgtcggggtcgggagggactagcggcggcgggccgcaccggtgcaccatctgccgccggggcttcgccacgggccaggcgctcggcgggcacaagcgctgccactactgggacggcatgtcggtgtccggcatcgtctccgccgcgtccgtgtccgcgtccgggacggggtcgtcgggcgtcaccgtcaggaactttgacctcaacctggcgcctctgccggagaacgccgggatgaagaggtggggtgaggaggatgaggtgcagagtccattgcccatcaagaagcgcaggattttgatcgactgatcaatctcgtgtccatctctctgttcatgtaaaaattaaagggatctaggcaaccattgtttcattaacttgttcaaattctgttttcaacagagattttttaattcattgattcattaaaaaaaaaaaaaaaaaaaa

SEQ ID NO: 8748 - protein, 214 aa, Panicum virgatum
  misc_feature: Ceres CLONE 2016161
  misc_feature (1)..(23): Pfam Name: zf-C2H2 Pfam Description: Zinc finger, C2H2 type
  misc_feature: The sequence is a functional homolog of  SEQ ID NO 1212 in the  10/412,699 US patent application
  misc_feature: The sequence is a functional homolog of  SEQ ID NO 1213 in the  10/412,699 US patent application
  misc_feature: The sequence is a functional homolog of  SEQ ID NO 1214 in the  10/412,699 US patent application
  misc_feature: The sequence is a functional homolog of  SEQ ID NO 1215 in the  10/412,699 US patent application
  misc_feature: The sequence is a functional homolog of  SEQ ID NO 1762 in the  10/412,699 US patent application
  misc_feature: The sequence is a functional homolog of  SEQ ID NO 1988 in the  10/374,780 US patent application
  misc_feature: The sequence is a functional homolog of  SEQ ID NO 32 in the  10/286,264 US patent application
  misc_feature: The sequence is a functional homolog of  SEQ ID NO 592 in the  11/435,388 US patent application
  misc_feature: The sequence is a functional homolog of  SEQ ID NO 903 in the  10/374,780 US patent application
  misc_feature: The sequence is a functional homolog of  SEQ ID NO 904 in the  10/374,780 US patent application
  misc_feature: The sequence is a functional homolog of  SEQ ID NO 905 in the  10/374,780 US patent application
  misc_feature: The sequence is a functional homolog of  SEQ ID NO 906 in the  10/374,780 US patent application
  misc_feature: Useful for making plants with modulated growth and phenotype characteristics
MVAGLEALLDPTALSLALPAPPALKKEDYLAICLAALAGTRKFAGLGSQPHAPPAPQQQELPFRCAVCGKAFASYQALGGHKSSHRKPPTEEQYAAAAAQAEASAGGLDETASSGSGGTSGGGPHRCTICRRGFATGQALGGHKRCHYWDGMSVSGIVSAASVSASGTGSSGVTVRNFDLNLAPLPENAGMKRWGEEDEVQSPLPIKKRRILID

SEQ ID NO: 8749 - DNA, 1198 bp, Panicum virgatum
  misc_feature: Ceres CLONE 2016194
  misc_feature: Encodes the peptide sequence at SEQ ID NO. 8750
tctagcaagggttggttttggttggtgccttgtgcctgtgtgttccagtctgtcgcacactagctagtagcagctgcatcggaccggatcgcggagtggccacgacgcgtatgcgcgcggcgagcgtggaggcgacggggaggtgatccgatggagctggagctcgggctcgcgccgccgaacccgcacgcgctgggcggcggcggcggcggcggcggggagtccgtcggactccacgacggcgccccggcgggtgccgcctgcgggaagagggcgttcggcgaggcgttctgccgggccgagaaggccacgctcccgctcttcgtgcgcgacggcgacggcggcggcggtggcggcgcccgcgacggcgtcgaccgtgaaatgagcaacaagaggaagaggctggtggggtggccgccggtgaagtgcgcgcacaggcggcggagctgcggcggcgggtacgtgaaggtgaggatggaaggggtggccatcgggcggaaggtggacgtctccctccacggctcctacgaggagctgctccgcacgctcgcccgcatgttcccgtccacgaacgaaggcgcgggtgcagatgtggagggggaggcggcggcccaggacggcgagcgccgccgtggccgtggccaccacccgtccgtggtgacctacgaggacggcgagggggactggctgctcgtcggagacgtgccgtgggaggactttgccaagtcggtgaagcggctcaagatcctcgcgtagctgacgacatacgtacgtcagcagcactgcagcaacgtgttgcgtttgcgagctcgccactcaataatcgtcctcggagcgtagatcagtgcattgtattcaggtcgtcggtggtttcagtctttcagagcatgacgagagcgctagcactcagccactcactatagctagtagtagtagctacgagctgttcatcgtcacgctgtacctagttcgttgttcacttgttcgtgtcaaagggtttcgtctaccgtaccctaagccgccgctcggtccccattgcgaccggacgcgtgtatggccgtcgtctgtggcctgctttaggtcgtctactagtagtgtgttgaagccttgaaggtctctgcttaaacctgtgaccggaagccttgctggttttccattttccaatgcatgtgttaaataaaaaaaaaaaaaaaaaaaa

SEQ ID NO: 8750 - protein, 201 aa, Panicum virgatum
  misc_feature: Ceres CLONE 2016194
  misc_feature (1)..(182): Pfam Name: AUX_IAA Pfam Description: AUX/IAA family
MELELGLAPPNPHALGGGGGGGGESVGLHDGAPAGAACGKRAFGEAFCRAEKATLPLFVRDGDGGGGGGARDGVDREMSNKRKRLVGWPPVKCAHRRRSCGGGYVKVRMEGVAIGRKVDVSLHGSYEELLRTLARMFPSTNEGAGADVEGEAAAQDGERRRGRGHHPSVVTYEDGEGDWLLVGDVPWEDFAKSVKRLKILA

SEQ ID NO: 8751 - DNA, 1283 bp, Panicum virgatum
  misc_feature: Ceres CLONE 2016261
  misc_feature: Encodes the peptide sequence at SEQ ID NO. 8752
ccccgcgcccacggcggcacggcccacccccgcatcgtcaaaacagtcaccttcttcccctccacgcaagcccagctcccccctcccagcgactcgatcatcatcccaacggcgatgatggcgtccgcctccctcccggcgcccgctcccggccgcgccgagctgctcaaggccttcgaggactcccgcacgggcgtgcgcggcctcgtggagtccggcgtctcctccgtcccggagatcttccgccacccggacccctacgcctccatcccgctcgccccgcccggcgtctccatccccgtcgtcgacctctccctccccttccccgccgccgccgcggccgccgccgaggccgcccggacctggggcttcttccacctcgtcaactaccaccacgccctcccccacccgcccgcggacggcggcggtggcggcgactaccccgcgcgcgccctcgccgcggtgcgcgccttcaacgagctcccgcccgccgagcgcacgccgcactacggccgcgccgtcgacggcggggtcaactactccaccaacgtcgacctgtacaactccccggcggcgagctggcgcgacaccatccagatcatgctcgggcccagccgccggcccgacctcaccacccggatcccgggcgtctgcagcgccgaggtgctcgagtgggaggcgcgagccaccgccgcggcgcgcgccgtgatggggctcctctccgaggggctcgggctcgggcccgccgcgctggaggaggcgtcctgcctcgagggcaaggtcatggcgtgccactactacccgcactgccccgagccggagcgcaccatgggcatcgtcccgcacacggaccccggcgtgctcaccgtgctcgcgcaggatgagattggtggcctgcaggtgaagcaccaggatgaggcagggagaagctgctgggtggatgtgaagcccgtgcccggagcgctagtgatcaacgtcggggatctcttgcagataatgtccaatgacaagtacccgagcgtcgagcaccgggtgaccatgaacacaaacacgcgtgaggaacccagagtttcgatcgccatcttcttcagtcccgggaagagaggcgactcggtcttctacgggccattgccggggctggtttcttcggagaacccacccaggtacaggaatttcaccatgggcgagttcttcgggaccttcttctcgcgagacctttcgagcaaagctctaatcgaccacttcaagctgtaacgcaagtggggactgtctagtgtcgaccc

SEQ ID NO: 8752 - protein, 379 aa, Panicum virgatum
  misc_feature: Ceres CLONE 2016261
  misc_feature (1)..(106): Pfam Name: 2OG-FeII_Oxy Pfam Description: 2OG-Fe(II) oxygenase superfamily
MMASASLPAPAPGRAELLKAFEDSRTGVRGLVESGVSSVPEIFRHPDPYASIPLAPPGVSIPVVDLSLPFPAAAAAAAEAARTWGFFHLVNYHHALPHPPADGGGGGDYPARALAAVRAFNELPPAERTPHYGRAVDGGVNYSTNVDLYNSPAASWRDTIQIMLGPSRRPDLTTRIPGVCSAEVLEWEARATAAARAVMGLLSEGLGLGPAALEEASCLEGKVMACHYYPHCPEPERTMGIVPHTDPGVLTVLAQDEIGGLQVKHQDEAGRSCWVDVKPVPGALVINVGDLLQIMSNDKYPSVEHRVTMNTNTREEPRVSIAIFFSPGKRGDSVFYGPLPGLVSSENPPRYRNFTMGEFFGTFFSRDLSSKALIDHFKL

SEQ ID NO: 8753 - DNA, 1022 bp, Panicum virgatum
  misc_feature: Ceres CLONE 2016334
  misc_feature: Encodes the peptide sequence at SEQ ID NO. 8754
accatcccattcccaggcaactagcaagcgtcccaggttccagctagctacgagcaaagaaccgagagccacgagctagccatggcgacgaggctggcgctcgcggccatggcggcgctgctggtcggcgtggcggcggcggacgtgggctccattatcacgcaggacgtgtacaacagcatgctgcccaaccgcgacaactccatctgccccgccaacgggttctacacctacgacgccttcatccaggccgccggcgccttctcagggttcggcaccagcggcaacagcgacgaggacaacaggcgcgagctcgccgccttcttcggccagacctcccacgagaccaacggcggagctgctggccagtacacttgggggtactgcttcaaggaagagatcaacaaggcgacgtcgcctccctactacggacgaggacccatccaattgacagggcagaccaactaccagcaggccggggatgcgatcggcgcggacctggtgggcaacccagacctggtgtcgacggaccccgtgatctcgttcaagacggccatctggttctggatgacggcgcagtcgcccaagccgtcgtgccacgacgtgatcctgggcaactggacgccgtcgagcaccgacgccgcggcggggcgggtgcccggctacggcgtgatcaccaacatcatcaacggcaggttcgagtgcggcgtggggaccaacgacgccaacgtcaaccgcatcggctactaccagcactactgcgacatgctaggcgtcggctacggcgacaacctcgactgctactcccagcagcatttctgatcattcaacatgatcagctagctgctcgacagttattactatacatcatctgtgtgcgatctgtgaataagtggcacatgcatgcgccatcttttagttgaataataataatttcgtcgttgatatatatcacagatatatatgatttacttcaaaaaaaaaaaaaaaaaaaaaaaaaataaaaaaaaaaaaaaaaaaaa

SEQ ID NO: 8754 - protein, 246 aa, Panicum virgatum
  misc_feature: Ceres CLONE 2016334
  misc_feature (1)..(219): Pfam Name: Glyco_hydro_19 Pfam Description: Chitinase class I
  misc_feature (14)..(246): SWISSPROT Homolog: EC 3.2.1.14 Acidic endochitinase Q precursor
  misc_feature (5)..(246): SWISSPROT Homolog: EC 3.2.1.14 Acidic 26 kDa endochitinase precursor
MATRLALAAMAALLVGVAAADVGSIITQDVYNSMLPNRDNSICPANGFYTYDAFIQAAGAFSGFGTSGNSDEDNRRELAAFFGQTSHETNGGAAGQYTWGYCFKEEINKATSPPYYGRGPIQLTGQTNYQQAGDAIGADLVGNPDLVSTDPVISFKTAIWFWMTAQSPKPSCHDVILGNWTPSSTDAAAGRVPGYGVITNIINGRFECGVGTNDANVNRIGYYQHYCDMLGVGYGDNLDCYSQQHF

SEQ ID NO: 8755 - DNA, 1137 bp, Panicum virgatum
  misc_feature: Ceres CLONE 2016390
  misc_feature: Encodes the peptide sequence at SEQ ID NO. 8756
acgggccatcgagcggcccagatcgcgccacggatcggatgctcctccgcctcggctcccaccgcctgctcctgggccccctcgccgccgcgcccctcccccgccgccgccccctcggcgtcgtccaggccatgtcctccgcctcccccgcgcccgcccagatctccaggcggcctctgcgcggggtggtcttcgacatggacggcaccctcacggtgcccgtcatcgacttccaggccatgtaccgcgaggtgctcggcggggatgccgcctacgccgcggcgcgcgccgccgggggaggctccgtcgacatcctccactgcatcgaggactgggcgcccgacaagcagcgccacgcctacgaggtcatcgcgcgcttcgagaaagaggggctcgaccgcctccagatcatgcccggggcgtcagagctatgcgggttcctggacacgaagcagatcagaagaggtttgatcacccgaaatgtgaaggatgcagttgatttgtttcaccaaagatttggtatgacatttaatcctgcactgagcagagcatttcgtccctataagccaaatccagctccattgcttcacatttgctccacttgggaaattccaccacatgaagtgatcatggttggtgacagtctcaaggatgatgttgtttgtggaaagaaggcaggagcttttacttgcttgctcgatgaaacggggcgatatgggccacacgattctttgcctgaggaagttaaacctgacttcaaggtctcttcacttaccgaagtattcaccgtgctggaagagaattttgatctggcacccgtgcctgctgagagtagaatatgacaggaaaagttctaaactaccccttgtctaacgtgaaaacagcacacatcaccttgaataatttggatggatggataatgttgaaggcttttcaagtgtctgaagccctgctgcagccagaaagacgattgccgccaccaaagtggattctcttggaaacaattgtgctgtaaatccaaacaatggttgtggagcactaaatcagctcctgcgattcagtaagtggaatggccatgattatatggggcattcaaaatataacaattcaaacttccaaaaaaaaaaaaaaaaaaaa

SEQ ID NO: 8756 - protein, 267 aa, Panicum virgatum
  misc_feature: Ceres CLONE 2016390
  misc_feature (1)..(177): Pfam Name: Hydrolase Pfam Description: haloacid dehalogenase-like hydrolase
MLLRLGSHRLLLGPLAAAPLPRRRPLGVVQAMSSASPAPAQISRRPLRGVVFDMDGTLTVPVIDFQAMYREVLGGDAAYAAARAAGGGSVDILHCIEDWAPDKQRHAYEVIARFEKEGLDRLQIMPGASELCGFLDTKQIRRGLITRNVKDAVDLFHQRFGMTFNPALSRAFRPYKPNPAPLLHICSTWEIPPHEVIMVGDSLKDDVVCGKKAGAFTCLLDETGRYGPHDSLPEEVKPDFKVSSLTEVFTVLEENFDLAPVPAESRI

SEQ ID NO: 8757 - DNA, 1265 bp, Panicum virgatum
  misc_feature: Ceres CLONE 2016447
  misc_feature: Encodes the peptide sequence at SEQ ID NO. 8758
attcctctgctttgcttgcttcaagaagccgaggtagctcaggtagaagaagacagcgagcaccatgaaaaccatcacggcgagaaacccccatgactcgctctccttctcccggcggcacttcaagtggccggttcttggcaagagcaagagccatggcgccacgttcggggacgaggagtacatgaagagctcggaggcggaggaggaggatgaggcgaccgtggccttctcctccgcctgtccgtccttccactccgaggatttcgtgtcccctccgctgaaggcggcggcgggcaccgcgccggcgcagcagcagcagccgccgaggcggaggaaggtccggacggccgtctcgcgcctgcggtcggcgctggccaatgccgtggccggccggcaccggcaggtcggcctcggcgcgcggctcaccggcactctgtacggccaccggcgcgggcacgtgcacctcgcgttccaggtcgacccgcgcgcgtgcccggcgctgctgctggagctcgccgcacccacggcggcgctggtgcgcgagatggcctcgggcctggtgcgcatcgcgctggagtgcgagcgcgccaagggctccgcgctcccgaccccgaccgccggccccaacagcggcaacgggaagaagctgctggaggagacggtgtggcgcgcgtactgtaacggcaagagctgcgggtacgcggtgcggcgcgagtgcggcgcggcggactggcgcgtgctccgcgcgctggagcccgtgtccatgggcgccggcgtcatccccgcggccagctgcggcggcggcgagggcgacgtcatgtacatgcgcgcgcggttcgagcgcgtggtgggctcccgcgactcggaggcgttctacatgatgaacccggacaacagcggcggccatggcggacccgagctcagcgtctacctcctcagagtctgatcgatcatggcacttcagctgtgcgtcgatcacgtccccttttttgtgcatggtatgctgtgaaattggattaggcgcctaggtgggtagctggaaacgtagctgatggggttggaaatagaaatgtttttgtggtttcttgtggtgatcaaatgtggtgcggagtaggatgaatccatgctgtgctgttcaggttgtgatggctctgaagctgaatagtagttaatcaggtagagttgtagcagtacttgttctgcatatggtgtaatgataaataaaatagccgtattagtttcaaaaaaaaaaaaaaaaaaaa

SEQ ID NO: 8758 - protein, 294 aa, Panicum virgatum
  misc_feature: Ceres CLONE 2016447
  misc_feature: Great-hit functional homolog of the protein sequence given in SEQ ID NO 9646
  misc_feature: Useful for biocontainment applications
  misc_feature: The plant produces a reduced number of seeds.
MKTITARNPHDSLSFSRRHFKWPVLGKSKSHGATFGDEEYMKSSEAEEEDEATVAFSSACPSFHSEDFVSPPLKAAAGTAPAQQQQPPRRRKVRTAVSRLRSALANAVAGRHRQVGLGARLTGTLYGHRRGHVHLAFQVDPRACPALLLELAAPTAALVREMASGLVRIALECERAKGSALPTPTAGPNSGNGKKLLEETVWRAYCNGKSCGYAVRRECGAADWRVLRALEPVSMGAGVIPAASCGGGEGDVMYMRARFERVVGSRDSEAFYMMNPDNSGGHGGPELSVYLLRV

SEQ ID NO: 8759 - DNA, 1427 bp, Panicum virgatum
  misc_feature: Ceres CLONE 2016463
  misc_feature: Encodes the peptide sequence at SEQ ID NO. 8760
gttcgcccctccttttactttcgcccattcgcaccgctctctcccgtggccttccttttcctggcggcgacagagcagcgccgtccttcaccgggtcttcgtcggtcccttcgccggcgacgagcacccaccagataaggtggagctcagagcattggtgcctcttttatctttcaccaaggactcgggtgcctcattttgcgagtgggacaataagcttggtctagcaaatatattatgagctttgtgctgatgtaatagcatatctacaagaattcttttactggaaggtttattagttgtttgcaacaatgaaggatcatctattgctcaacgttgatgacctaagcatccctgagcccaatgaggtcactagggcattaaagaacacatcatctaggggaaccattgaacacccaccctccatggctcatgccattttagcaatgggacaaagcatggtttcagaagaagaacctcttctacagatggtggagtgtcgcatttgtcaggaggaggatagtattaaaaatctagagagtccatgcgcttgcactggcagtctaaagtatgctcatcgggcttgtgtacagcgatggtgcaatgagaaaggagatgtatcatgtgaaatatgtcatgagccttacgaacatgggtacactgcacctcccagagctcatcctgatgaaactaccattgatataagtggcggctggaccattactggtactgcatttgacttgcgtgatcctagaatccttgcagtggcacaaaaccatatcctggaagctgaatatgatgattattctgccacgaatgctagcactgctgccttttgccgctctgctgctcttgttttaatggctctcttattgttgaggcatgcactgactctaactgacgaagatgatgatgatacttctgcggtattttcactttttctattgcgcgctgctggtttcctgctaccattctacattatggcatgggcaattagtatcttgcagcgccgcagacagagacaggaggcagctgctctagctgcaacggaggtggcattcatcctgcagtcggggcaagggaggggagtgcatttcaccatcgcaccagactccccggccacacctcagcatgaaccaccacacccttaatgatatctatccaggagtgcctggctgtggcaatggtcgctgcaactgcagattatttgcaccagatcccccaaggattcaattatcgtggctgcaatctagtgcagaaccagataatttccacctgaagtttcattgcatatcagtgtaccgagtgcaaagatgcatgttcgtgctttggatttcactagtgcgttttgcatgtcggctgggaagtaacggggtgtatatatataacttaacagagatatctggggcctgattgccctaaatgtc

SEQ ID NO: 8760 - protein, 279 aa, Panicum virgatum
  misc_feature: Ceres CLONE 2016463
  misc_feature (1)..(46): Pfam Name: zf-C3HC4 Pfam Description: Zinc finger, C3HC4 type (RING finger)
MKDHLLLNVDDLSIPEPNEVTRALKNTSSRGTIEHPPSMAHAILAMGQSMVSEEEPLLQMVECRICQEEDSIKNLESPCACTGSLKYAHRACVQRWCNEKGDVSCEICHEPYEHGYTAPPRAHPDETTIDISGGWTITGTAFDLRDPRILAVAQNHILEAEYDDYSATNASTAAFCRSAALVLMALLLLRHALTLTDEDDDDTSAVFSLFLLRAAGFLLPFYIMAWAISILQRRRQRQEAAALAATEVAFILQSGQGRGVHFTIAPDSPATPQHEPPHP

SEQ ID NO: 8761 - DNA, 1373 bp, Panicum virgatum
  misc_feature: Ceres CLONE 2016499
  misc_feature: Encodes the peptide sequence at SEQ ID NO. 8762
aacctcaagttctgaacctgcacctgcagcagtgctcggtccggcggctccccatccgaccatctccggcagccgcgccccgcccgcccgtcccttcagcgacatgggcaccgccacggccgacgatccgcacccctccttcctcgccgacaaggacgccaaggtcttcgtcgccgggcaccggggcctcgtcgggtccgcggtcctgcgccgcctcctctcgctcggcttcacctccgtcgtcgtccggacccacgccgagctcgacctcacccgccaggccgacgtcgaggccttcttcgccgccgagcgcccgcgctacgtcgtcctcgccgccgccaaggtcggcggcatccacgccaactccaccttcccggccgacttcatcgccgccaacctccagatccagaccaacgtcgtcgacgccgcgctgcgctgcggctccgtccgcaagctcctcttcctgggctcctcctgcatctaccccaagttcgcgccgcagcccatcaccgagggcgcgctcctctccggcccgctcgagcccaccaacgagtggtacgccgtcgccaagatcgccggcatcaagatgtgccaggcataccgcatccagcacggcctcgacgccgtctccgccatgcccaccaacctctacggcccgcacgacaacttccacccggagaactcgcacgtcctgcccgcgctcatccgcaggttccacgaggccaaggcctgcgacgcccccgaggtcgtcgtctggggctcgggctcgccgctgcgggagttcctgcacgtcgatgacctcgccgacgcggtcatcttcttgatggaccagtactccgggctggagcacgtcaatgtggggagtggcagcgagatcaccatcaaggagctcgctgagttggtgaaggaggtggtggggttccaggggaagctggtgtgggactccagcaagccggacggcacacccaggaagctcatggatagctccaagatacaaggcatggggtggaagcccaagatcgccctcaaggagggcctcgtcgaaacctacaaatggtatgttgagaatgtcgtctccgacaagaagtagagccttgcttgccagtggtggtggtgtcttgctctccattgctactcttgcaagttggtgtcatgatttctagtgttcctatggttgttgattatcagatcatacgattctgttttactgtaacttaaacccacatagaagaggtttgttataatgttatgtgttggctgaataatccgtgggtcaaattagtatactgctaggatcataattgatcttgaacactttttgttgattagaaagtttaacgaccatctgtgaatgggagatgttcttggcctag

SEQ ID NO: 8762 - protein, 328 aa, Panicum virgatum
  misc_feature: Ceres CLONE 2016499
  misc_feature: Great-hit functional homolog of the protein sequence encoded by LOCUS At1g17890
  misc_feature: Great-hit functional homolog of the protein sequence encoded by LOCUS At1g73250
  misc_feature (1)..(233): Pfam Name: Epimerase Pfam Description: NAD dependent epimerase/dehydratase family
  misc_feature (14)..(323): SWISSPROT Homolog: EC 1.1.1.271 GDP-L-fucose synthase 1
  misc_feature (20)..(322): SWISSPROT Homolog: EC 1.1.1.271 GDP-L-fucose synthetase
  misc_feature: Useful for making plants with altered cell wall content and/or composition
MGTATADDPHPSFLADKDAKVFVAGHRGLVGSAVLRRLLSLGFTSVVVRTHAELDLTRQADVEAFFAAERPRYVVLAAAKVGGIHANSTFPADFIAANLQIQTNVVDAALRCGSVRKLLFLGSSCIYPKFAPQPITEGALLSGPLEPTNEWYAVAKIAGIKMCQAYRIQHGLDAVSAMPTNLYGPHDNFHPENSHVLPALIRRFHEAKACDAPEVVVWGSGSPLREFLHVDDLADAVIFLMDQYSGLEHVNVGSGSEITIKELAELVKEVVGFQGKLVWDSSKPDGTPRKLMDSSKIQGMGWKPKIALKEGLVETYKWYVENVVSDKK

SEQ ID NO: 8763 - DNA, 1412 bp, Panicum virgatum
  misc_feature: Ceres CLONE 2016540
  misc_feature: Encodes the peptide sequence at SEQ ID NO. 8764
agtcttcagtcttgccggaactgaaaggaaaccgaaaaggaaacagagaagaaggcctcactccacactccagtactccactcccctcccctcccatcccctcccctcccggtcccggcgctttcttggatcgcgagaaaaccactcgagaaacccgcagttctagggaactgtatcggcaggagcacgaggaagtagagggtgccgggcatggatcacgccaggggacggagacgagcagggaggcagcaacgaccgtcccggtctctggtcttgttctcgctgtaaagagagtaggtgccctctgaattccacttgagcgatccaactccagtcgcctcgccatgaagcggccacgcgccggcagcccctccctccttccgacggccagcccggatgatgatggttacggcgcggcagctgggatggaggcggaggaggagatggtggcgtgcggcggcggcggcggggagaagaagcggcggctgagcgcggagcaggtgcgcgccctggagcggagcttcgaggtggagagcaagctggagccggagcgcaaggcgcggctggcgcgcgacctcggcctgcagccgcgccaggtcgccgtctggttccagaaccgccgcgcgcgctggaagaccaagcagctcgagcgcgactacgccgcgctgcgccactcctacgacgcgctgaggcgcgaccacgacgcgctccgccgcgacaaggacgccctcctcgccgagatcaaggagctgaaggcgaagctcggggacgaggcagcggcgagcttcacgtcggtcaaggcggagccggcggcctccgacgggccgccggccgcgggcgtggggtcgtccgagagcgactccagcgcggtgctgaacgacgcggacccggccgtgggcgcggcggaggcgccggtgccggaggtgcagggcgccctccttcccgcgcccaccggggccgccgcgacgagccgcggcggggcgttcttccacgggggcttcctgaaggtggaggaggacgagacggggttcctggacgacgacgagccgtgcggcgggtttttcgccgtggagcagccccccccgatggcgtggtggaccgagcccacggctggaactgagctggggtggatgagagcgcggacttgggatttgtgagccagccgagccaagcggtgggggaataaaggattcggagcgagagacgggggctattctgcgaattttgttgtcgtggtgtggcaaaccacagccgggtggcgtgtggtgtggcaaaccacagccgggtggcggaaggcacccgccctagtccagagggtgtgtactcgggggttagctagtcccaattagatctcactcaagaacccgatgaacacagctggtttagagtggttcgggccaccggagcgtaaa

SEQ ID NO: 8764 - protein, 270 aa, Panicum virgatum
  misc_feature: Ceres CLONE 2016540
  misc_feature (1)..(55): Pfam Name: Homeobox Pfam Description: Homeobox domain
  misc_feature: The sequence is a functional homolog of  SEQ ID NO 1075 in the  11/479,226 US patent application
  misc_feature: The sequence is a functional homolog of  SEQ ID NO 470 in the  10/412,699 US patent application
  misc_feature: Useful for making plants with modulated growth and phenotype characteristics
MKRPRAGSPSLLPTASPDDDGYGAAAGMEAEEEMVACGGGGGEKKRRLSAEQVRALERSFEVESKLEPERKARLARDLGLQPRQVAVWFQNRRARWKTKQLERDYAALRHSYDALRRDHDALRRDKDALLAEIKELKAKLGDEAAASFTSVKAEPAASDGPPAAGVGSSESDSSAVLNDADPAVGAAEAPVPEVQGALLPAPTGAAATSRGGAFFHGGFLKVEEDETGFLDDDEPCGGFFAVEQPPPMAWWTEPTAGTELGWMRARTWDL

SEQ ID NO: 8765 - DNA, 977 bp, Panicum virgatum
  misc_feature: Ceres CLONE 2016574
  misc_feature: Encodes the peptide sequence at SEQ ID NO. 8766
caacacaataattcactggcatgcagatcgatcaaaacatgtaaacatcacacaccagggcctagctagctagctgcgtatcgatctgcactgcacgaggaccgtcgtctccctccctgcagctggccgatcatatataggatcgatcgacacgccggcgtcgacgatgagggagctgatgcggcgcctgagcttctcggaccgcgtgagcgacggcagcggcggcgtgccccgcgggtgcgtgccggtgctggtgtgcgacggcggcggcgagggcgagcggttcgtggtgcgcgtggaggcgctgcggcacccgtcgttcgcggcgctgctggagatggcggcgcaggagttcgggtacaagcaggagggcgtcctccgggtcccctgcgacgtccgccacttcaaggacgtcctcgccgccgtctccgccgtctcctcgccgcgctctaggaactgatccgcgaatttattatctaggagccaatcggatcgcctcctttaatcaaggacctgataactaattccttcttcttcttcttcttcttcttcttcttcttcttcttcttcttctttgtgttaattatttggtttcttggtttgggcaagatcgacgacggagaggatttgctagctagctgctagcatggatcagtctgcactgcacatatgtttctcttacagtattgacttcactcctgcaacttggagtgaaacaagaaggaatcaagttttcaagtcaggttttcagagtttggatgataagttaaagagctagcataggtgttcaagttatcaatacagggttcttgggtcaacttttcagtaatattgtagagcagcgtataatctactagtcgtgttgtgtttggtgtccagattctcctcggcagtgctagtacattagagttagtgttgtacctcctgtttcataattagtgagactagtcaccggtcaaaaaaaaaaaaaaaaaaaa

SEQ ID NO: 8766 - protein, 97 aa, Panicum virgatum
  misc_feature: Ceres CLONE 2016574
  misc_feature (27)..(91): Pfam Name: Auxin_inducible Pfam Description: Auxin responsive protein
MRELMRRLSFSDRVSDGSGGVPRGCVPVLVCDGGGEGERFVVRVEALRHPSFAALLEMAAQEFGYKQEGVLRVPCDVRHFKDVLAAVSAVSSPRSRN

SEQ ID NO: 8767 - DNA, 1154 bp, Panicum virgatum
  misc_feature: Ceres CLONE 2016598
  misc_feature: Encodes the peptide sequence at SEQ ID NO. 8768
acactcgcagacacaaccgaaaaaccaaggggggaaaatagtaaagaaacggaggcgaggcggccctcctcctccacctcctccccgtttcttatctatcctgatccaaatccgcctcgcttcttatatcctcctccgaggaaaacaattccatcccccaccaccgcatctcgtcctgctcgcctccgtcgccgccgccgccgccgtcgccatggccaccgcggaagccgccaagccgtccccgctcccgccctacccggagatgatcctggcggcgatcgatgggctgggcgacaagaacgggtcgaacaagtcagccatctcgaggtacatcgagggcaagtacggcgagctgcctccggcgcacccgtcgctgctgacggcgcacctgtcgcgcatgaaggagtccggcgagctcatcttcctcaagaacaactacttccgcgccgacgcccccgacgcgccgccgaagcgcggccgcgggcgcccgcccaaggtgcgggacccgaacgcgccgccgccaccgcccaaggcgccgtccaccggctcgccgcgcccccgcgggcgcccgcccaagcccaaggacccgctggacgccgccgtcgcgcaggccaccgcggggatgcccaaggcccgcggccgcccgcccaagaaggccaagaccgaggcggccgcccccgcccccgcccccgcccccgcccccgccgcgcccgccggcgacggctccacccccgtcaagcgcggccgcggcaggccccccaaggtacgccccgccgcgcccagcgagacggccgccgcctgacgccgccgccgtgatagaggtggatggattagggcgtagcgatccgtccgcgctccacctgccgccgccgccgtgttgttaatcttagggttgggttcggttcccttgctcggtctaattgtcgtcgtggcttaattaattattaatggagtaattaggaaggatttgatgtgccgtggtttcacctgttgagttggtgctggtgtgttgtaatctaagcttaagctagagatctgctgctgctgagacctgagagtgttctgtgctggttcgattagtcaggctgctaatgtggatgtttgcaacttaattagcggatgatggtgactgatggtgatgttgatgttgattt

SEQ ID NO: 8768 - protein, 196 aa, Panicum virgatum
  misc_feature: Ceres CLONE 2016598
  misc_feature: Great-hit functional homolog of the protein sequence given in SEQ ID NO 9193
  misc_feature: The sequence is a functional homolog of  SEQ ID NO 138 in the  11/375,241 US patent application
  misc_feature: The sequence is a functional homolog of  SEQ ID NO 204 in the  10/412,699 US patent application
  misc_feature: The sequence is a functional homolog of  SEQ ID NO 2286 in the  10/374,780 US patent application
  misc_feature: The sequence is a functional homolog of  SEQ ID NO 56 in the  10/669,824 US patent application
  misc_feature: The sequence is a functional homolog of  SEQ ID NO 56 in the  10/870,198 US patent application
  misc_feature: The sequence is a functional homolog of  SEQ ID NO 706 in the  10/225,066 US patent application
  misc_feature: Useful for making plants with modulated nitrogen use efficiency
  misc_feature: Useful for making plants with modulated growth and phenotype characteristics
MATAEAAKPSPLPPYPEMILAAIDGLGDKNGSNKSAISRYIEGKYGELPPAHPSLLTAHLSRMKESGELIFLKNNYFRADAPDAPPKRGRGRPPKVRDPNAPPPPPKAPSTGSPRPRGRPPKPKDPLDAAVAQATAGMPKARGRPPKKAKTEAAAPAPAPAPAPAAPAGDGSTPVKRGRGRPPKVRPAAPSETAAA

SEQ ID NO: 8769 - DNA, 1170 bp, Panicum virgatum
  misc_feature: Ceres CLONE 2016637
  misc_feature: Encodes the peptide sequence at SEQ ID NO. 8770
agactcttcatctcaggcaggtcgacagtccttcgtttctacttcggaattccagctctcaaactagcagctttccgccctttaccttcgttttctcagtatgaagttctccgctctcgctgtcggcgccatcgccgcccagggtgtctcggcgcactactggtttgacaccaacatcatgaacggcgccgcacagaccccgtacaagtacgtccgcgagtccagccggcaaatcaagtacaaccccatcaagttctcgtccaaccctcccgccgatctccgtgatggctcgactatcgacggacccgatgccatgtgcaaccagggcgctttcgctagcgctggccgtacccaggtcctgactgtcaacgccggtgacgagatccgtctccgcctagctgccggtgccgccttccagcacccgggtcccggtcttgtctatctttctcgggcccccaatgataatgtgaaggcctatgacggatctggaaactggttcaagatctacgaggagggcgtgtgcaacagaaacgccgacttcaccaacaccgcctggtgtgactacaacaggaactaccttgccgccaggattcccaaggatacccccaacggcgaatacctcgcccgtttcgagcatatcggtgtccaccggtcccatgtcaaccagcccgagcactacgtctcgtgcatgcagatcaaggttcagaacggcggcaacggcaaccctggccctaccgtcaagttccccggcgcctacaagagcagcgacccctacgccaacttcagcatctacaacggctacaaggactttcccatgcccggccctgccgtctggaccggcggcggcggcggcagcaacaacggcggtggcaacaccggcggcggcaacaccaaccccggaactgcctgcgcccccatgtgggctcaatgcggcggcagcggatactcgggccccacgtgctgctcggccggaacgtgcaaggtcagcaacgagtggtactcgcagtgcgtgtaaactgtgacgggatttctcttcgtaccggtctctgtaagggggctggcgatggcactgcccagctggaacaggggccaatatttttgcatagcgacattgatagtggcatattttttttgaagtcttcctgttctcaaaaaaaaaaaaaaaaaaaa

SEQ ID NO: 8770 - protein, 304 aa, Panicum virgatum
  misc_feature: Ceres CLONE 2016637
  misc_feature (1)..(237): Pfam Name: Glyco_hydro_61 Pfam Description: Glycosyl hydrolase family 61
MKFSALAVGAIAAQGVSAHYWFDTNIMNGAAQTPYKYVRESSRQIKYNPIKFSSNPPADLRDGSTIDGPDAMCNQGAFASAGRTQVLTVNAGDEIRLRLAAGAAFQHPGPGLVYLSRAPNDNVKAYDGSGNWFKIYEEGVCNRNADFTNTAWCDYNRNYLAARIPKDTPNGEYLARFEHIGVHRSHVNQPEHYVSCMQIKVQNGGNGNPGPTVKFPGAYKSSDPYANFSIYNGYKDFPMPGPAVWTGGGGGSNNGGGNTGGGNTNPGTACAPMWAQCGGSGYSGPTCCSAGTCKVSNEWYSQCV

SEQ ID NO: 8771 - DNA, 1304 bp, Panicum virgatum
  misc_feature: Ceres CLONE 2016641
  misc_feature: Encodes the peptide sequence at SEQ ID NO. 8772
acgactcggattggacgcacgcggagcaagcaggcggcgccggccatggcatcaccacaagcagggagggtaggcaccgactgtcctgagatccgtgagttcctggctggcgccgccgctggccggccggtgccggtgccggcggtggggcttggcacggcatcgttcccgttcgtggaggaagacgtcagggccgccgtcctcgccgcgctggagctcggctaccgtcacctcgacaccgcctcgctctaccgctccgagcgggccgtcggcgaggccgtggccgaagcggcgcggcgcggggtcgtggcgtccagggaggaggtgttcgtcacgaccaaggtgtggtgctcgcagtgccacccggacctcgtgctcccctccctcagggagagcttgcagaaccttcaaatggactatgttgatctgtacctggttcattggccagtggctgcaaagccaggaaagccccaaattccaatcaaaagggaggacataacgcccatggacctgagcggcgtttggcgggcgatggaggaatgccatcggcttgggcttgctagaatgattggtgtcagcaatttcacgacaacaaagctgcaagagctacttgcaattgctgatatccccccagcagtcaatcaggttgaaatgaatccgatttggcagcagaaaaaattaattgagttctgcaaagacaaaggtattcatgtgactgcatattctccccttggaggccaaagcatgtcaaatgcagtactacagtctcaagttctagaagagatttccaaggctagagggaaatcggtggctcagatttctctgaggtggatctacgagcaaggtgccagcatggttgtcaagagcctgaaacgggagaggctcagggagaacatggagatcttcgactgggaactgagtgatgaagaccgtttcaagattagtcagataccgcagcacaagagggtcagagtgacggtgatgcttagccccgaaggcgcctccagcgtggatcttgccgagcttgacatcgttgaaacgtagctgaattctccatctagttgcggccgtgttctgaaaaattggtcgtgctggttgtttgatacatcctgaaattcctgcaaagccatactgtcgctttgaattgtcagtacacttcgcaaaacaaaacgaaactatatatggcagcacatatgttgtcggcatggccggcgaatcacttcgcattgcacatatgttgtcaacagcacatatgtggctataaacgatgctgttgtttcaccgaaaaaaaaaaaaaaaaaaaa

SEQ ID NO: 8772 - protein, 332 aa, Panicum virgatum
  misc_feature: Ceres CLONE 2016641
  misc_feature (8)..(285): Pfam Name: Aldo_ket_red Pfam Description: Aldo/keto reductase family
  misc_feature (31)..(308): SWISSPROT Homolog: EC 1.6.5.2 NAD(P)H:quinone oxidoreductase
MASPQAGRVGTDCPEIREFLAGAAAGRPVPVPAVGLGTASFPFVEEDVRAAVLAALELGYRHLDTASLYRSERAVGEAVAEAARRGVVASREEVFVTTKVWCSQCHPDLVLPSLRESLQNLQMDYVDLYLVHWPVAAKPGKPQIPIKREDITPMDLSGVWRAMEECHRLGLARMIGVSNFTTTKLQELLAIADIPPAVNQVEMNPIWQQKKLIEFCKDKGIHVTAYSPLGGQSMSNAVLQSQVLEEISKARGKSVAQISLRWIYEQGASMVVKSLKRERLRENMEIFDWELSDEDRFKISQIPQHKRVRVTVMLSPEGASSVDLAELDIVET

SEQ ID NO: 8773 - DNA, 1521 bp, Panicum virgatum
  misc_feature: Ceres CLONE 2016667
  misc_feature: Encodes the peptide sequence at SEQ ID NO. 8774
aactaacgctaaaaaagtaacagtttctgtactttattgagagcgcgaaaggttctacacacgccccggcgagattcatcacaaagacaccaccaatttccacttatcaccatgaccgttctggccgtcgagtatctctggtgcagcggcgccaacacccaccacgatctccgctcaaaggtgaagtccgtgaccgtcactgacaaagagctcaagctcatcatggacgagccgaaccaactcctcgacaagctgcccgtgtggaacttcgacggctcgtcgacgggccaagcactcggccgcgacacggagatcctcatcaagcccgtggcctgctggaagcacccgttcctgacgggtgtccccgctattgtcgcactctgtgagtgctacctgcccaacggccagcccacgccggacaacacccgctacatcgcccgccaggtgttccaccgcgacgacacgaccaagaagctctcgccgtggttcggactcgagcaggagtacgtgctgtaccagcacggccgcccgtacggctggccggcgcaggggcagcccgccgcccagggcccgtattactgctccaacggcgtcgtcgcctacggacgcaagtacgccgacgcgcactacgccgcctgcatcaacatgggcctcaagctctccggcacgaacgccgaggtgatgcccggccagtgggagtaccaggtcggcccgtgcgagggtatcgagtcgggcgaccaggcggtgatggcgcgctgggtgatgctccgcgtcctcgagcaggacggtatcgatgtgaattttgactccaagccgatgaagggtgactggaacggctcgggtatgcacaccaacttctccaccgccccgatgcgcgatgagaacggcatcaagaagatccacgaggcgctggagaatctcagccgcgacccgttccgcgaggtggccgtgtacggcagcgacaacaaccagcgcctgtccggcaagcacgagacgtcgcgcctggaccactacgactacggcgtggggtcgcgctgcacgtccatccgtatcccgaacgagacccagagcaacggacgtggctatttcgaagaccggcggccgtcgggcagcgccgacccgtggctcgtcacgagccgcctattcgcttcgtcatgcctgatcccctccgagctgctggacacctacggccgcgagcacgagccggagttcgtgaaggacctccgcgccggcaacgccattgtgcactagactggccgcgcgcagtggcacatgtatgagacaatccgatgacagggttcttgcttgcgccccctcccaacagggggcgcattccttggaggtaaatatacaagcgcgcggcagttgtgtgtgagtataaaagccagtgcgtcggtggctttttcgcgcgctggtggctgcccgtgcacccctcgccccactactttattcgatgcgtgggtgcaatctaatacccatgctcggaaaatccaaccgtgtcaaaaaaaaaaaaaaaaaaaa

SEQ ID NO: 8774 - protein, 379 aa, Panicum virgatum
  misc_feature: Ceres CLONE 2016667
  misc_feature (2)..(247): Pfam Name: Gln-synt_C Pfam Description: Glutamine synthetase, catalytic domain
MTVLAVEYLWCSGANTHHDLRSKVKSVTVTDKELKLIMDEPNQLLDKLPVWNFDGSSTGQALGRDTEILIKPVACWKHPFLTGVPAIVALCECYLPNGQPTPDNTRYIARQVFHRDDTTKKLSPWFGLEQEYVLYQHGRPYGWPAQGQPAAQGPYYCSNGVVAYGRKYADAHYAACINMGLKLSGTNAEVMPGQWEYQVGPCEGIESGDQAVMARWVMLRVLEQDGIDVNFDSKPMKGDWNGSGMHTNFSTAPMRDENGIKKIHEALENLSRDPFREVAVYGSDNNQRLSGKHETSRLDHYDYGVGSRCTSIRIPNETQSNGRGYFEDRRPSGSADPWLVTSRLFASSCLIPSELLDTYGREHEPEFVKDLRAGNAIVH

SEQ ID NO: 8775 - DNA, 965 bp, Panicum virgatum
  misc_feature: Ceres CLONE 2016684
  misc_feature: Encodes the peptide sequence at SEQ ID NO. 8776
actttcgcttcactgcacaacacacagcgagaatgagcctcagcaacgcgctgcgccgcggctatgcgacgacggtggcccaggtcatccgccaccacgagcacgagagtgccacccatgcccagtccatgggcacctggcagaaggtctccatgttcgtgtgcgtccccttcatggctttcgccgctgtgaaggccttctctgcggcccaccctgagagcccggagttccgcgagtacagctggctccgcatccgccgcaaggccttcccctgggacgacggcaagcagcactcgctcttccacaacccgcacgtcaacgccctgcccgagggctatgagggccaccactaagcggcgagactggagagcgcgcgtacacaaattgcaatgttgccttattctggattgattgactgacagcagccaatctggagtccgcatcgcatcagtatgacggcactggcaacgttggtttattttgtgtgaatgtgacatttgtttctgcgtttttgttgttttgcttgtgagaggttgtggcatggcgcacttacccttcgggtgcccttgtccttgagatctgcaaaagagagaagaagaagaagaagaagttgactatttcaatttcctctcttgttttctcttctttctcatcctctcacacgaacacatccacgttcagtttcagttcacatttcactcacgcgcgctcaaaagagtttcatttcatctcaatccctttttcaattttcaattagacatcaccccctcgttctcatctctatggtttcttatgctggcaaaaacactttctctccgagcttcgtctatctccactcggtttggagggatttttttttggccagcgcgtgtgtttcttgtgtattcctttttccattctttccgactagattttgttttttcgaatttgaactttcccaattacaaaaaaaaaaaaaaaaaaaa

SEQ ID NO: 8776 - protein, 106 aa, Panicum virgatum
  misc_feature: Ceres CLONE 2016684
  misc_feature (1)..(85): Pfam Name: COX6A Pfam Description: Cytochrome c oxidase subunit VIa
MSLSNALRRGYATTVAQVIRHHEHESATHAQSMGTWQKVSMFVCVPFMAFAAVKAFSAAHPESPEFREYSWLRIRRKAFPWDDGKQHSLFHNPHVNALPEGYEGHH

SEQ ID NO: 8777 - DNA, 978 bp, Panicum virgatum
  misc_feature: Ceres CLONE 2016700
  misc_feature: Encodes the peptide sequence at SEQ ID NO. 8778
agcaacaccaaaacaacatgaaaccatacagcgccgacgttattgctccaagtactggtgaatttaagagacaagtctcttcatttcgtaattggatcaaaaaggacagtcaacatccaccagaagcagatcgataccatctttatgtctcctatgcttgcccttgggctcatcggaccctgattggtttggctttaaaaggactccaacatatcatttccgtttcagttgtccatcatttcttaggaccagacggttggtcttttgctactcctgaggaatgtcctggtgctattcctgatccgctttacaatagcaaatttcttagagagctctatttgaaagctgacccagaatacaaagcaagagtcactgttccattactctgggataaaaaactccatactgcagtcaacaatgaatcttctgaaatcttgagaatgcttaacagtgaatttaacgaatttgctaaaaatccaactttggacttatatccagaagcattgagagctcaaattgatgaacttaacacctgggtttatgatggattcaataacggagtctacaaatctggattcgcaacaaaacaagaagcttatgaaaataatgtaaaagttgtctttgagaccatggataaaatggaggcaatcctcgcaaagcacccctatttcgttggagatgtttttactgaggctgatgtaagagctttcactacagctgtcagatttgatcctgtttatgttgttcacttcaaatgtaacttgaaacaaattggttcaagctatcctcatctcctgaaatggatgcgcaagatttatcaaattcctggagtagctgaaactgtcaatatggagcacatcaagaaacactattttattagtcacatttcaatcaatccaaaccaaattgttggttggtcaaatggacctgacctaaccttgaaagactaagcttcgccaataaacagatttttcattg

SEQ ID NO: 8778 - protein, 310 aa, Panicum virgatum
  misc_feature: Ceres CLONE 2016700
  misc_feature (2)..(111): Pfam Name: GST_C Pfam Description: Glutathione S-transferase, C-terminal domain
MKPYSADVIAPSTGEFKRQVSSFRNWIKKDSQHPPEADRYHLYVSYACPWAHRTLIGLALKGLQHIISVSVVHHFLGPDGWSFATPEECPGAIPDPLYNSKFLRELYLKADPEYKARVTVPLLWDKKLHTAVNNESSEILRMLNSEFNEFAKNPTLDLYPEALRAQIDELNTWVYDGFNNGVYKSGFATKQEAYENNVKVVFETMDKMEAILAKHPYFVGDVFTEADVRAFTTAVRFDPVYVVHFKCNLKQIGSSYPHLLKWMRKIYQIPGVAETVNMEHIKKHYFISHISINPNQIVGWSNGPDLTLKD

SEQ ID NO: 8779 - DNA, 1324 bp, Panicum virgatum
  misc_feature: Ceres CLONE 2016717
  misc_feature: Encodes the peptide sequence at SEQ ID NO. 8780
gtcgattgtttgaaagttctgcaaactagcagctcgtgcacgagcatcgagcggcggagccagtgattcgcccgccggcatcacggtctcggtcagtgtggacgcttggccgcgacaaaatatttagctctcgcctctcggctgctcccttcctcgcacacgggaccttttcgccgttgagaggtcaatcggaggttgaggacccgccgagcgcgaaccggcccaactcgaggaggagcaagagcaacgcggggcggcgaatggggacggaggcggaggactccgccgcggacctgctccggtcgcagatcccgttccagaccgacggggagctcgtcctcccgccgcgcggggtggggctcgtcctcgtcgacctctgcaacggcttctgcaccgtcggcgccgggaacctcgctcctgttgcacccaacaagcagatcgaaaagatggtgggagaggcggctaggctctctaagctgttctgtgatagaaactggccaatctttgcatttcttgatacccactatccagataagcctgaaccaccatatccccctcactgtatcattggtactggggaggagaactttgttccagatctggagtggttggaaaaggagccgaatgtgactataaagaggaaaagttgtatcgatgggtacatcagctgtatagagaaggatgggtccagtgtttttgctgattgggttggaaaataccaaatcaaaactgtcttggtgctcggaatatgcacagacatctgtgttttggattttgcaagctcaactctggctgctcgaaatattgaccgagtgcctccattacaagatgttgtgatttattcagagggttgtgctacatacgaccttcctgctgaggttgcgacaaatgttaaaggagctcttgcccatccacaggatcttatgcatcatatcggactctacatggccaaaggaaggggtgcaaaggtagttgacagggttgctgtcgaaccttgaatcaaaaacatggccatactgatgttgctagtgtttgatctgtcctctcatccttcctatggaaaaatcagatatgcatcttagcatgaatttgtcgagaaacaatttgatacactgatgctggcgataatcaccttcaaatctgtaaagatgggttcatcttgtggttaacttgtacatatcctcttagtagtatcccaaattgtcctgctaaatatgcgtcagtttaacttgcactatattttctcattggttgctaatgtccagttctgggattgtataacggtatttaatgaagtataaaactctccccagtcctacgattc

SEQ ID NO: 8780 - protein, 245 aa, Panicum virgatum
  misc_feature: Ceres CLONE 2016717
  misc_feature (1)..(186): Pfam Name: Isochorismatase Pfam Description: Isochorismatase family
MGTEAEDSAADLLRSQIPFQTDGELVLPPRGVGLVLVDLCNGFCTVGAGNLAPVAPNKQIEKMVGEAARLSKLFCDRNWPIFAFLDTHYPDKPEPPYPPHCIIGTGEENFVPDLEWLEKEPNVTIKRKSCIDGYISCIEKDGSSVFADWVGKYQIKTVLVLGICTDICVLDFASSTLAARNIDRVPPLQDVVIYSEGCATYDLPAEVATNVKGALAHPQDLMHHIGLYMAKGRGAKVVDRVAVEP

SEQ ID NO: 8781 - DNA, 1175 bp, Panicum virgatum
  misc_feature: Ceres CLONE 2016728
  misc_feature: Encodes the peptide sequence at SEQ ID NO. 8782
gcagagtccgacatgaagggtctttacacatgtgagcacaggtgacagaggtaacatgaaaagcaagcgaagatggaccccgcaagaagacgaactacttcgacaggaatcacaaaagcagctcaccaagttaaaccaccagccatggcaagatcatgagaatggaaagttgctgcgagcactagcaacgcatggcagcagctggaaggaaatacaagagaagcatttcccgacccggtctgcaaacaacgtaaagaatcagtataccatcttgatgcgtcgcggaaccacgctgtcagaagatgttcctccgtgttgtccaggtcgcagcaaaaagacaggtgcttcttcttctcgagccttgtctccagacaccataccgccgccagatgcgccgtcatcgaaaccaccaagtccccggttgattcagccacaatcggacaaggcatcagcatgggacagcatgagcgacaacagctatcatgcgtcgagaaacagcgtcatggaggtagacgccatttgtccgactttctcggaggagcgcgaccacatctacccctttttatcaccaatgccctctgtcaatgaagggtttaacaccgacttcaacaacctctttagcttccagaattttagcgaccaaagcactgtccagagcagcgactgcccggacatgtgcacaccggtctcggccgcgtgctccggctcaggggttggcgtgatgggtgacaacgactcggtcgggagatgctgtgcgagcaatgacgtttctgccggcagcactttatcgtggccactggatcatctcccgttgtccgaaatggatatggatatgggtgggacaggaatggggaaagctggaaacggcgctgtgctgtcggcggcgacacggccattgactgctgtggatagctcatgctcaaaagccagcatgcaagctgcaacacgactgtcggcgtctggaagtggcgatgcgagtccgaggtcacgcatgaccattgtggtggacgaggccaagcccgagacgctggtagaggtgatgaaggtgctcatggagtctcaggcgcgggtggagttctggcgtcagtgacgacgagggaggaaaactgttaaataccacccacatgtactcagcactgagctgggagaaaagtcaaaaaaaaaaaaaaaaaaaa

SEQ ID NO: 8782 - protein, 344 aa, Panicum virgatum
  misc_feature: Ceres CLONE 2016728
  misc_feature (1)..(47): Pfam Name: Myb_DNA-binding Pfam Description: Myb-like DNA-binding domain
MKSKRRWTPQEDELLRQESQKQLTKLNHQPWQDHENGKLLRALATHGSSWKEIQEKHFPTRSANNVKNQYTILMRRGTTLSEDVPPCCPGRSKKTGASSSRALSPDTIPPPDAPSSKPPSPRLIQPQSDKASAWDSMSDNSYHASRNSVMEVDAICPTFSEERDHIYPFLSPMPSVNEGFNTDFNNLFSFQNFSDQSTVQSSDCPDMCTPVSAACSGSGVGVMGDNDSVGRCCASNDVSAGSTLSWPLDHLPLSEMDMDMGGTGMGKAGNGAVLSAATRPLTAVDSSCSKASMQAATRLSASGSGDASPRSRMTIVVDEAKPETLVEVMKVLMESQARVEFWRQ

SEQ ID NO: 8783 - DNA, 1342 bp, Panicum virgatum
  misc_feature: Ceres CLONE 2016750
  misc_feature: Encodes the peptide sequence at SEQ ID NO. 8784
gattgcatacaagctaggcagccgtgtgtgtgtgcgcgcgctagcgatagctgtagggacagatcgatctatcgaccatgggcatggggtacgagcttgccgtgaagcaggttcttgttgttagcatcgtgctcggcgtcgccgtcgccggcgtagagccgagcaagaagatgatgcggctccggcaggtgccggcgatgtacgtgttcggggactcgacgctggacgtcggcaacaacaactacctgcctggggaaggcgtccccagggccaacaagccctactacggcatcgatttgcctggctccggcaagcccaccggaaggttcagcaacggctacaacaccgctgacttcgtcgcaaagactctaggatttaacaagagtccgctggcttactttgtgctcaaagcacacgataagctgattccgagcgcaatcacaagaggagtaagctatgcatcggcaggatctgggatcctggactccactaacgctggaggcaacatcccgctgtcgcagcaggtgcggcttttccagtcgaccaaggccgagatggatgccacggtgggcccacgagcagtgaccagcctgctcaccaggtccttcttcctcctcggcgtcggcagcaacgacttgttcgtcttcacgacggagctggccaagcagaacagatcggcgacgcagagcgacatcgccgccctctacggcagcctcatctccaactactcggccgccatcacagagctgtacgagcttggcgccaggaagttgggcatcatcaacgtgggccctgtcggctgcgtgccgcgcgtgcgcgtgctcaacgcgacgggcgggtgcgcggacggcatgaaccagctcgccgccggcttcgacgccgcgctcgagtccctcctcgccgggctcgccgccaagctgccgggcatggcctactccctcgccgactccttcggcctcgccgcccgcaccgaccagctcgcggcggggtttgtcaacgccgacagcgcctgctgcggcggcgggcggctcggcgcggaggcggactgcctgcccggcgccactctgtgcgccgaccgcgaccgcttcctcttctgggaccgggtgcacccttcccagcgggccgccatgctcagcgcgcaggcctactacgacggcccggcccagttcaccaagcccatcaacttcaagcagctggcacaggcacaagagtagttgattttccaaagacggcccgttgaggatttgtttgttttactactacattataattaatctcaaaaaaaaatactactacattataattcgtacgaggaagtattattcgttgtttcattctcccc

SEQ ID NO: 8784 - protein, 378 aa, Panicum virgatum
  misc_feature: Ceres CLONE 2016750
  misc_feature (1)..(318): Pfam Name: Lipase_GDSL Pfam Description: GDSL-like Lipase/Acylhydrolase
MGMGYELAVKQVLVVSIVLGVAVAGVEPSKKMMRLRQVPAMYVFGDSTLDVGNNNYLPGEGVPRANKPYYGIDLPGSGKPTGRFSNGYNTADFVAKTLGFNKSPLAYFVLKAHDKLIPSAITRGVSYASAGSGILDSTNAGGNIPLSQQVRLFQSTKAEMDATVGPRAVTSLLTRSFFLLGVGSNDLFVFTTELAKQNRSATQSDIAALYGSLISNYSAAITELYELGARKLGIINVGPVGCVPRVRVLNATGGCADGMNQLAAGFDAALESLLAGLAAKLPGMAYSLADSFGLAARTDQLAAGFVNADSACCGGGRLGAEADCLPGATLCADRDRFLFWDRVHPSQRAAMLSAQAYYDGPAQFTKPINFKQLAQAQE

SEQ ID NO: 8785 - DNA, 1355 bp, Panicum virgatum
  misc_feature: Ceres CLONE 2016791
  misc_feature: Encodes the peptide sequence at SEQ ID NO. 8786
accctaccgacggaaccatgatcatggccttcaagttggccatggagggctttattgtgctgtgccttgtgatatcgtccatggatgtcctcggcgccatcgcctccggcgtcctgcagccaccaccgatatatgtgttgggtgactcgacattagacgttggaaacaacaacttcctaccaggactatccgttcccagagccaacatgtactacggcgtcgactccccaggcgttcctgccggaaggtacagcaacggcttcaacgtcgctgacttcatcgcaaagagcatgggattcgtgagtagccctccgccttatctgatgctggcgccaagcacaggccttctggtctccgccgctctcgaaactggtgtgaactatgcttccggaggatctggcatccttgacgtcactaacgcctggcaacacatcatcccgctgtcgaagcaggtgcagtatttcaatgacaccagggctaagatggtcgccgccgtgggctccgctgcggcggtggacgccctgctcgccaggtccgtgttcctcatcagcgtcgctaacaacgacctctccgggttcaccatttgggagctgatgcataataggtcggctgcgcaacagcccagtgacgcggctgcgttcttggcatacctcatttcaaactactcggccaccatcacggagctgtacgccatgggcgcaaggaagtttgccatcgtcaacgcggcgctcatcgggtgcacgccggcggcgcgggtggtatcccaaccgttgggagcgtgcgccgagggcgtgaacctgctcgccgccggcttcaacgtcgccctccggtcgctgctcgccaccgacctcgccccaaggctgccgggcctcgtatactccctcgccgactccttcgtcctcatgaaggacttcttcgccgacccactggcgtgggggttcaccgacatcaccagcgcgtgctgcggcgatggcttcctgctcgcgcagtcagcctgccggcccacctccaaggtctgccccaccagatacgagcgtgaccagcacatcttctgggatcccttccacttttcccagcgggcctgtttcctcacggcccaagcattctacgatgggccgtccaaatacaccacgcccatcaacttcatgcagctggcacagtccatttaacgataagaaggaaataatgctatctccgttcaagaaagaattccaagaagaagatagtatagtatatatatatatatatatatatatatatatacacacgaggagattgttgtgctcgatcacgtatagtacatgtaatgttatcgagaaaaaaacatatatatgcaatcatgaataaatttaatt

SEQ ID NO: 8786 - protein, 383 aa, Panicum virgatum
  misc_feature: Ceres CLONE 2016791
  misc_feature (1)..(318): Pfam Name: Lipase_GDSL Pfam Description: GDSL-like Lipase/Acylhydrolase
MIMAFKLAMEGFIVLCLVISSMDVLGAIASGVLQPPPIYVLGDSTLDVGNNNFLPGLSVPRANMYYGVDSPGVPAGRYSNGFNVADFIAKSMGFVSSPPPYLMLAPSTGLLVSAALETGVNYASGGSGILDVTNAWQHIIPLSKQVQYFNDTRAKMVAAVGSAAAVDALLARSVFLISVANNDLSGFTIWELMHNRSAAQQPSDAAAFLAYLISNYSATITELYAMGARKFAIVNAALIGCTPAARVVSQPLGACAEGVNLLAAGFNVALRSLLATDLAPRLPGLVYSLADSFVLMKDFFADPLAWGFTDITSACCGDGFLLAQSACRPTSKVCPTRYERDQHIFWDPFHFSQRACFLTAQAFYDGPSKYTTPINFMQLAQSI

SEQ ID NO: 8787 - DNA, 1204 bp, Panicum virgatum
  misc_feature: Ceres CLONE 2016836
  misc_feature: Encodes the peptide sequence at SEQ ID NO. 8788
acttacaccccgcctcacaaccacatcaacatcagcatcaacatcaacaacagcaacaaccaccactgcaacaacaaccccccaaaaagcacctacacatcaaaccaccccccaccatcaacatgcccaacgtcctcatcctcggcggcgccggctacctcggccttgccgtcggccaagcgctcctccgcacgggcaactacgccgtctgggcgaccacccgcagcgcggacaaagccaagaccctcatcaccaacgaaatcacgcccctcgtcggcgaagccaccgacgcgacctggctcgcctccatcatttccacccaccacatcgacacggtcatcgacaccacccaagcctacgagcaagcgggcgccatcctgtcgggcatcaccagcgcggccaaaacccgcgccgctgccctcgccgccgacaaatccatcggccccaagcttggcttcatctacacgtccggctcctgggtgcacggctcgcccgcccgtcgcgtcagcgaccgcaccgtgccgggggtgtcctcctcgcccgacaagccggctaccgcggtgggctggcgccccgcgcatgagcaggccatcctggcggcgcgcgacgtgctggacgtggcgatcctgcggccgtgcgcgatctatgggcgtggctcgtgggtttggggcgtgtggtggggcccgttgctggccgcggctaaggcgggcggcgaggagcccgtgcagttgccggtgggggaagaggcgcgcacggggacggtgcatgtggatgatttggcggaggcgtttgtgggcgcggcggatcggttggagggtgggctgggctcgtggccggtgtttgacgtgggggcggagacgctgccggtgggggatatcatgcaggcggcggccagggtgttgggggtgaaggcgccgttggtgtacgggggcacgcatgggaatgcgttcttggaggcgttggggctggttagtaactcggatacggcgcgggcgaggtcggtgctggggtgggcaccgaagcatcgcgactttattcagaacttgccggttattgtcgcggcgtggcgcgcggcgcagcctgagtaaatggggaagatggagaggaccgacacgggatggaagtaggtccatcattgtctgatagtttgggaaatataactagcaaatggcactgagtaaggcaaaaaaaaaaaaaaaaaaaa

SEQ ID NO: 8788 - protein, 321 aa, Panicum virgatum
  misc_feature: Ceres CLONE 2016836
  misc_feature (1)..(240): Pfam Name: Epimerase Pfam Description: NAD dependent epimerase/dehydratase family
MPNVLILGGAGYLGLAVGQALLRTGNYAVWATTRSADKAKTLITNEITPLVGEATDATWLASIISTHHIDTVIDTTQAYEQAGAILSGITSAAKTRAAALAADKSIGPKLGFIYTSGSWVHGSPARRVSDRTVPGVSSSPDKPATAVGWRPAHEQAILAARDVLDVAILRPCAIYGRGSWVWGVWWGPLLAAAKAGGEEPVQLPVGEEARTGTVHVDDLAEAFVGAADRLEGGLGSWPVFDVGAETLPVGDIMQAAARVLGVKAPLVYGGTHGNAFLEALGLVSNSDTARARSVLGWAPKHRDFIQNLPVIVAAWRAAQPE

SEQ ID NO: 8789 - DNA, 1073 bp, Panicum virgatum
  misc_feature: Ceres CLONE 2016863
  misc_feature: Encodes the peptide sequence at SEQ ID NO. 8790
actagacacttgaccttgcctggcaggagcaagaagggaaaagttcgtcgcggtaacaatggcgttcacacgccggagaccgtcgtcagtagtagcagccgcggcgcttctctccgtcctggagctcagcctcctcgccggcccggcctcggcgcaggggaagaccgggcaggtgacggtgttctggggccggcacaaggacgagggctccctccgcgaggcctgcgactccggcctctacagcatggtcatcatgtccttcctcgacgtctacggcagcggcagctacgacctcgacctctccggccactcgctcgccggcatgggcgacgccatcaagcggtgccagttcctgggcgtccccgtctccatctccatcggcggcttcggcgccggctactcgctgcccaccaaccagtcggcgctcgccctcttcgaccacctctggaatacctacttcggcggcagcctcaacgacacccgccgcaccttcggcgacgcctggctcgacggcgtcgacatgttcctggagcacgccacccccgccgagcattacagcaccctcgccctcgagctcgccaagcacaacatccgcgccggcgacggcaagctgctgcacctgacggcgacgccgcactgccggttccccgacgaccgcgtcaaggaggcgctcgacacgggcatcttcgagcgcatccacgtaaggttctacgacgacccggcctgcgccggagggttcagcgccgccgagtggggcaggtggacggccgcgtacccgttcaccaagatctatgtcggcgtgccggcgtcgccgcaggcggccgcgagcgggtacacggacccggcgacgctgcgcagggctgtgctcccggtggcgcagaaggcgaccaactacggcggcgtcatgctctgggacaggtacttcgacaagcgaagcaactacagcggcagcatcaagagttgggtttgagatcgacatggtacggtgtcgctgtgaaactaggtgtatgttctttttttttgaaataaagaaactaggcgtatgttctctgcaaaaaaaaaaaaaaaaaaaa

SEQ ID NO: 8790 - protein, 303 aa, Panicum virgatum
  misc_feature: Ceres CLONE 2016863
  misc_feature (1)..(250): Pfam Name: Glyco_hydro_18 Pfam Description: Glycosyl hydrolases family 18
MAFTRRRPSSVVAAAALLSVLELSLLAGPASAQGKTGQVTVFWGRHKDEGSLREACDSGLYSMVIMSFLDVYGSGSYDLDLSGHSLAGMGDAIKRCQFLGVPVSISIGGFGAGYSLPTNQSALALFDHLWNTYFGGSLNDTRRTFGDAWLDGVDMFLEHATPAEHYSTLALELAKHNIRAGDGKLLHLTATPHCRFPDDRVKEALDTGIFERIHVRFYDDPACAGGFSAAEWGRWTAAYPFTKIYVGVPASPQAAASGYTDPATLRRAVLPVAQKATNYGGVMLWDRYFDKRSNYSGSIKSWV

SEQ ID NO: 8791 - DNA, 892 bp, Panicum virgatum
  misc_feature: Ceres CLONE 2016890
  misc_feature: Encodes the peptide sequence at SEQ ID NO. 8792
accgcaaagctaactaaatttccgagcacggcaagaatggcgccgatgaagctgtacggctgggtggtgtctccatggatgggccgggtgcgggtgtgcctggaggaggccggcgccgagtacgagatcgtccccatgagcaggtgcggcggcgaccaccgccgccccgagcacctcgccagaaacccattcggtgaaatcccagttctggaggttggtgatctgacgctctaccaatcacgcgccatcgcgaggtacgttctgcggaagtacaagcccgagcttctcaaggaaggggacctggagggatcggcaatggtggacgtgtggatggaggtggaagcccaccacgtggagccgacgctgtggcccatcatccggcactgcatcatcggcccgtatgtcgggcgcccgcgcgaccaggccctggtcgacgagtgcctcgggaagttgagagcgctgctcccggtgtacgaggcgcggctgtcggtgtccaagtacctcgccggcgacgaagtcaccgccgcggacctctgccacttcggcttcatgcgctacttcatggccaccgagtacgccggcgtcgtggacgagtacccgcacgtcaaggcgtggtgggatgcgctcctggcgaggccgtcggtgaagaaggtgatcgccggcatgccgccggattttgggtacgccagcgggaacataccgtagtgctctggctctgtctggtgactccaattgcattttgttccaaataaacttgcttgtcttacggttcacaattcacaaataaagcatggactatttgtgttggtaaatggataatggagtaatggactcccattgcaatgcaaatagaagcatcaatcaaaacttgcaaaaaaaaaaaaaaaaaaaa

SEQ ID NO: 8792 - protein, 222 aa, Panicum virgatum
  misc_feature: Ceres CLONE 2016890
  misc_feature (1)..(93): Pfam Name: GST_C Pfam Description: Glutathione S-transferase, C-terminal domain
  misc_feature (2)..(76): Pfam Name: GST_N Pfam Description: Glutathione S-transferase, N-terminal domain
  misc_feature (1)..(212): SWISSPROT Homolog: EC 2.5.1.18 Glutathione S-transferase I
  misc_feature (4)..(215): SWISSPROT Homolog: EC 2.5.1.18 Glutathione S-transferase IV
MAPMKLYGWVVSPWMGRVRVCLEEAGAEYEIVPMSRCGGDHRRPEHLARNPFGEIPVLEVGDLTLYQSRAIARYVLRKYKPELLKEGDLEGSAMVDVWMEVEAHHVEPTLWPIIRHCIIGPYVGRPRDQALVDECLGKLRALLPVYEARLSVSKYLAGDEVTAADLCHFGFMRYFMATEYAGVVDEYPHVKAWWDALLARPSVKKVIAGMPPDFGYASGNIP

SEQ ID NO: 8793 - DNA, 1553 bp, Panicum virgatum
  misc_feature: Ceres CLONE 2016894
  misc_feature: Encodes the peptide sequence at SEQ ID NO. 8794
actcaattgactccagcatcacgagtcgacacccaacacaattaacattgtaacaatgagtgttgcggtgaggaagtcctcgccggcggtcatcagaccaccggagccggtgacgacgacgaggagtggtgctggtgccataaagctcacacctttcgactggccttttgtcggggttccattcacagtgttgctcgtgtttgagcatctgagccatgaggccgttgagggcgtaaggagggcgctgtcccaggcacttgtccactattacccatttgctggtcgcatttgttcatcaggagccggatacgatggattcggcatccggtgcaccggcgagggtgtggaattcgtcaccggatcagtcgtctgcggcttgacggaagcgaatatcttcggcgaactgtccggcgcgaaggccctcttcgacgagctcgccgtctactacccggttgggagctatggctccgacgaccctctgctgtccgtgcaggtgaccgagttctcttgcggtggggtcgtcctcggggcgacatggaaccacgccgtcgccgacggcgctgggatcgcccagttcctagccgccgtcggcgagctcacccgcgggcagccgtcaccgttgatccttccggccaggtgcgacaacgcggtctcccgcctccctatgctgtcgaatccgatagtggaggccgtgctggcgtgccctgagtcaccagacatggagcttatcgtcccccttgagctcacggtcccctcggccctgatcgaccgcgtcaaggcagaataccgtagctgctccgacgatgacggacagccgtgcacgacgttcgaggccgtcctcgccgtcctgtggcagtgccgcgtccgcgccaccatgccgccgggctcggggacgaccccggttctcctctcgttctccgccgacatccgcgggtacgcgggcgccagggccggctactacggcaactgcgtcgccaaccagccgctcgccgcggcgacaagcggtgcggtggcaagcgcgagcctcgtggacctcgtcgggatggtcaggcgcgccaaggcccggctgccggacaagctcaaagaggagctcgggagcggcaggttatttgctgggggacggtacgacatgctgcacgtgtcgtcatggaggaacatcggcttcgaaggagtcgacttcgggggcgggccgccggcgagggtgatgtaccattcccggtgggtcgggccaccgacggtgccgacttgcatggtgtacccgccgtgcagggggaaggatggggtcaacatgctatcgatcgcagtgaaggaggagcacgccgaggcgttccttggcgagctggcatggcacacatgacgagggtagtctttgccgagaggagcaggaaatctgcaacggagttttaccgaccaacaatcatcagtgaccactagaggaataaaatactgtggcacactcagccattggctagaaattctcggctaaaactacaaatctgtttggtagtactaatcacctcaatcttaaaaacagaaaaaaaaaaaaaaaaaaa

SEQ ID NO: 8794 - protein, 433 aa, Panicum virgatum
  misc_feature: Ceres CLONE 2016894
  misc_feature (3)..(190): Pfam Name: Transferase Pfam Description: Transferase family
MSVAVRKSSPAVIRPPEPVTTTRSGAGAIKLTPFDWPFVGVPFTVLLVFEHLSHEAVEGVRRALSQALVHYYPFAGRICSSGAGYDGFGIRCTGEGVEFVTGSVVCGLTEANIFGELSGAKALFDELAVYYPVGSYGSDDPLLSVQVTEFSCGGVVLGATWNHAVADGAGIAQFLAAVGELTRGQPSPLILPARCDNAVSRLPMLSNPIVEAVLACPESPDMELIVPLELTVPSALIDRVKAEYRSCSDDDGQPCTTFEAVLAVLWQCRVRATMPPGSGTTPVLLSFSADIRGYAGARAGYYGNCVANQPLAAATSGAVASASLVDLVGMVRRAKARLPDKLKEELGSGRLFAGGRYDMLHVSSWRNIGFEGVDFGGGPPARVMYHSRWVGPPTVPTCMVYPPCRGKDGVNMLSIAVKEEHAEAFLGELAWHT

SEQ ID NO: 8795 - DNA, 1199 bp, Panicum virgatum
  misc_feature: Ceres CLONE 2016924
  misc_feature: Encodes the peptide sequence at SEQ ID NO. 8796
aacaacggcgaacaatccgtcagatttcacaacatcatcaccgtttcaagaaccgccaccgtagccgccaccacgccaatacctcatcccgagtaacacaccacgccgcattcgtccaacctcaccctcgccctcaccgcacccccctccccaacccacccctccacagcacgccgacaaggcaaaccagccaacatggcctcccaaccccaaccggcgcccctccccgcctacgcccactaccagcactacctcatcaccgcgcccctcccgctcgtcgcccacgtcgagatcaaccgcccggccaagctcaacgccttccacgaggccatgtgggtggagctgcgcgccgtgttccggcagctgtcgtccgacgccgacgtgcgcgccgtggtgctgtcgggcgccggcgaccgcgccttcacggccgggctggatgttaccgcggcgagcgagggtgtgttgtcgggaggggagggctcgccgccgctggatggggcgcgggtggcggctgggttgaggaggcatatcgctgagtttcaggagtgtattggcgcggtggagaggtgtgagaagcctgtgatctgcgtcatgcacggtatcgccatcgggctggccatcgatatctcgtgctgcgccgatatccgggtatgcgccaaggatgcgcggtttgccgtcaaggaggtcgacatcgggctggcggctgatattggcaccctcgcgcgcttgcccaaggccgtgggcagccagtcgtgggtcaaggacgtctgtctgacggcgcgcggctttgacgcggccgaggcgctcgccgtcgggttcgtgagccaggtgcacgagtccaaggccgccgcgctggccgcggccgtcaagacggccgggtttatcgcctccaagagccctgtggctgtgcaggggaccaaggagttgctcaaccacagccgggaccacacggttgaggacaatctcaggtacacgggcgtctggaatgccgcggccctccaaaccaacgatgtggcggctgcgctcatgtcggggctgaacaagaaaaagcccacgtttgagaagctttgagaaccagaggtggtttggggatgtgtaattatatgcgggggtggcacttccccctgggttgtagagtgcatgtctattgatacacaaatcatgaacatcgttattcgtaaaaaaaaaaaaaaaaaaaa

SEQ ID NO: 8796 - protein, 291 aa, Panicum virgatum
  misc_feature: Ceres CLONE 2016924
  misc_feature (1)..(184): Pfam Name: ECH Pfam Description: Enoyl-CoA hydratase/isomerase family
MASQPQPAPLPAYAHYQHYLITAPLPLVAHVEINRPAKLNAFHEAMWVELRAVFRQLSSDADVRAVVLSGAGDRAFTAGLDVTAASEGVLSGGEGSPPLDGARVAAGLRRHIAEFQECIGAVERCEKPVICVMHGIAIGLAIDISCCADIRVCAKDARFAVKEVDIGLAADIGTLARLPKAVGSQSWVKDVCLTARGFDAAEALAVGFVSQVHESKAAALAAAVKTAGFIASKSPVAVQGTKELLNHSRDHTVEDNLRYTGVWNAAALQTNDVAAALMSGLNKKKPTFEKL

SEQ ID NO: 8797 - DNA, 961 bp, Panicum virgatum
  misc_feature: Ceres CLONE 2016939
  misc_feature: Encodes the peptide sequence at SEQ ID NO. 8798
atacacattgccacctaagccaacccgaatcttcgccctgacatccagaaccggcacagcaaaatgacaattccccgtcgtgtactcgctatcctcggctgcggtggcatggggctggccaccgcccggcggctcgggggcggtcgaaagattctgctcgcagactactcccaaaccaaccttgactccgccgccaaaaccctccgggacgaagggcaggacgtcgaaacccacctcgtcgacgtggccgactttgactcggtccaggccttcgccgccaccgccgccagcgcgggccacatcgaagccgtcgtgcacacggccggcctctcgccggtcatggcaccgcccagacgcatctacgaggtcgacctgctcggcaccgcccacgtgatcgacgccttccagccgctcatccccgcgggcgcctcgctcacctgcatcgccagcattgcgcgcttcgacaaggccccctcgcccgagctcgccgcccacctggcctcggccccgcgcgaccagctgctcaccaccaagcacctgctcgacgtcgacgccccggaccccgcccccgccgcctcctacagcctgtccaagtgcgccaacttcctgcgcgtccaggccgccgcccgcccctgggcggctcgcggcgcccgcatcaactgtgttagtccgggcgtcatcaccacccccatgatccgccaggagctggcgtcgcctctgggaccggctatcaagggcatgattgattcgttgccgatgcagcgcgggggctcgccggatgagatcgcgggcgtggttgcgtttttggcggggccggatgcctcgtacattacgggcgcggatattgtggtcgatggcgggttcatcgcgggtaaccgggggatgggggctaggcaggctgattaggctttgtttggatgtcttgttatgctcggtcctgctgaatgattattcgagtctg

SEQ ID NO: 8798 - protein, 280 aa, Panicum virgatum
  misc_feature: Ceres CLONE 2016939
  misc_feature (2)..(84): Pfam Name: adh_short Pfam Description: short chain dehydrogenase
MTIPRRVLAILGCGGMGLATARRLGGGRKILLADYSQTNLDSAAKTLRDEGQDVETHLVDVADFDSVQAFAATAASAGHIEAVVHTAGLSPVMAPPRRIYEVDLLGTAHVIDAFQPLIPAGASLTCIASIARFDKAPSPELAAHLASAPRDQLLTTKHLLDVDAPDPAPAASYSLSKCANFLRVQAAARPWAARGARINCVSPGVITTPMIRQELASPLGPAIKGMIDSLPMQRGGSPDEIAGVVAFLAGPDASYITGADIVVDGGFIAGNRGMGARQAD

SEQ ID NO: 8799 - DNA, 1466 bp, Panicum virgatum
  misc_feature: Ceres CLONE 2017002
  misc_feature: Encodes the peptide sequence at SEQ ID NO. 8800
atagtcgcaagtcgcaacgaaggccccgaacgcgcgagccaccgagccggcctcgccggcagcacccgccgcccctatataggcaccattccctcctcccccgccaccaccgctgcttcctaccgtccggtgctacgcccctctgcgttccccaatccccgtgtgaccaagcgcccagtagcagagagactgagagaggcggcgatggcgaggcacttcgtgctcaacaccggcgccaagatcccctcggtcgggctcggcacctggcagtccgaccccggcgtcgtcggcgacgccgtctacgccgccgtcaaggcggggtaccgacacatcgattgtgccagagtttacggcaatgagaaggagattggtttggcactgaagaagctatttgcagagggtgtagtgaagcgcgaagatctatttatcacctctaagctatggaatgatcaccatgctcctgaagatgtgcccgaggcactaaatgaaagcctgaatgatttgcagcttgattacttggatctttaccttattcattggccatttagcgtgaagaagggaacaaacaccagccctgaaaacttcgttacacctgacatccctgctacctggggggcaatggaaaagttatatgatgctggcaaagcccgtgcaattggtgtgagtaacttctcatcaaagaaattgggggacttgcttgctgtagctcgtgtacctccagctgttgatcaggtggagtgtcatcctggctggcaacaaactaagctccatagcttctgtcagtcaactggtgttcatcttactgcttactcgccactaggttcacctggtactagttggatgaacggtaatgtccttaaagaaccagtaatcatctcaatagctgagaaacttgggaaaacacctgcacaagtggctttgcgctggaacattcagatgggtcacagtgtactaccaaagagcacaaaagaagaaaggataaagcaaaaccttgatgtttatgattggtctattccagatgatttgcttgcaaagttctctgacattaagcaggctagactgctcagaggcaacttcattgttaatcctcagagtgtttacaagacccacgaggagctctgggacggtgaactgtaggaaggataccattgttgatcctgagcagggagctgcgtacgttagggcctgtcagtcagttcatttttatctctgaatttgctcgtcacgaatgaaggttcagttgcacgaaagctccaattaatgtcctgtaccgcgagctacggtttagcctaggatctttggtttctggtgcctgtgagctgtggcctatgcagttaatctgctggcattatttatccaattatcctgtgctgcgtgctagtttgtatcaatcactggaaattgcttcatttatcctgaagacttgagctattttcttatgccctgaaaaaaaaaaaaaaaaaaaa

SEQ ID NO: 8800 - protein, 310 aa, Panicum virgatum
  misc_feature: Ceres CLONE 2017002
  misc_feature (1)..(278): Pfam Name: Aldo_ket_red Pfam Description: Aldo/keto reductase family
MARHFVLNTGAKIPSVGLGTWQSDPGVVGDAVYAAVKAGYRHIDCARVYGNEKEIGLALKKLFAEGVVKREDLFITSKLWNDHHAPEDVPEALNESLNDLQLDYLDLYLIHWPFSVKKGTNTSPENFVTPDIPATWGAMEKLYDAGKARAIGVSNFSSKKLGDLLAVARVPPAVDQVECHPGWQQTKLHSFCQSTGVHLTAYSPLGSPGTSWMNGNVLKEPVIISIAEKLGKTPAQVALRWNIQMGHSVLPKSTKEERIKQNLDVYDWSIPDDLLAKFSDIKQARLLRGNFIVNPQSVYKTHEELWDGEL

SEQ ID NO: 8801 - DNA, 1482 bp, Panicum virgatum
  misc_feature: Ceres CLONE 2017192
  misc_feature: Encodes the peptide sequence at SEQ ID NO. 8802
cccgtctgcataccaacctcgctcaggagaggagccgctcccccgccgaggatctgccggaatggccgctgacgctgcattttcgtcgcctccggccgccatcacctgccgagcggcggtggcgtgggggccggggcagccgctggtgatggaggaggtggaggtggcgccgccggggcgcctggagatccgcggccaggtcgtcgccacctccgtctgccgcagcgacgtcggcgcgtggcagtccaaggcgcaacctgatctgttccccagaatctttggccacgaggcatccggagtggtagagggtgtgggtgaagaggtgaccgagttccaagtgggagatcatgtgctgaccgtcttcatcggggaatgcaagagctgcaaacactgcatctcggggaagagtaacatgtgccagaagctcggtctggagaggaagggcgtcatgcacagcgatcagaagacccgcttctctatcaaggccaaacccgtgtaccactactgtgcagtgtcaagcttcagcgagtacaccgttgttcattcaggatgtgctgtgaaggtcggcctgacagtgccaatggacagggtgtgcctgcttagctgcggtgtgtctgcaggactcggcgcagcttggaatgttgcagatgtatccgagggctcaagcgtagttattttcggtcttggaactgtaggactttctgttgctcaagctgctaagcttcggggggcatccaagatcataggagttgatactaatcctgagaagcaggaaaaggggaaagcttttggtgtcacagattttattaacccgaatgaactgagcgagcctgttcagcaggtaatcaaaagaatgactgatggaggggcagattactcctttgaatgtgtgggtgataccggcgtagtttccactgcgcttcaatcatgttctgatggttggggagtaaccgtaactcttggtgtaccaaaagcaaagccagaggtgtctgctcattatgcatttcttctctctggaaggacactgaagggatctttgtttggaggatggagacctaaatctgacctaccttcattggtagataagtatgcagacaaggaaatccaagttgatggcctagtcacgcatgatataccattcggtgacatcaaccatgcactcgaactgatgctagaaaacaagtgcctgcggtgtgtgattcacatgtcacagtgacagcctgataaggttgaacaactgctgcatatctgctattttccccttgatcacctttgtggctcaattatccatagcacatcacagctccctctttttggccttttttgcttatcgtaaattgtggtgttgtaaatccaagtacagcactctcaagagaaccacaatgatcttcattctcagaaattgtcctgtaacctgtcttactgagatggaacctgtaatagctgtaatgttttcatgtaacatgtataagccatcaagcc

SEQ ID NO: 8802 - protein, 384 aa, Panicum virgatum
  misc_feature: Ceres CLONE 2017192
  misc_feature (2)..(129): Pfam Name: ADH_N Pfam Description: Alcohol dehydrogenase GroES-like domain
  misc_feature (14)..(382): SWISSPROT Homolog: EC 1.1.1.1 Alcohol dehydrogenase 1
  misc_feature (14)..(382): SWISSPROT Homolog: EC 1.1.1.1 Alcohol dehydrogenase 2
MAADAAFSSPPAAITCRAAVAWGPGQPLVMEEVEVAPPGRLEIRGQVVATSVCRSDVGAWQSKAQPDLFPRIFGHEASGVVEGVGEEVTEFQVGDHVLTVFIGECKSCKHCISGKSNMCQKLGLERKGVMHSDQKTRFSIKAKPVYHYCAVSSFSEYTVVHSGCAVKVGLTVPMDRVCLLSCGVSAGLGAAWNVADVSEGSSVVIFGLGTVGLSVAQAAKLRGASKIIGVDTNPEKQEKGKAFGVTDFINPNELSEPVQQVIKRMTDGGADYSFECVGDTGVVSTALQSCSDGWGVTVTLGVPKAKPEVSAHYAFLLSGRTLKGSLFGGWRPKSDLPSLVDKYADKEIQVDGLVTHDIPFGDINHALELMLENKCLRCVIHMSQ

SEQ ID NO: 8803 - DNA, 1226 bp, Panicum virgatum
  misc_feature: Ceres CLONE 2017442
  misc_feature: Encodes the peptide sequence at SEQ ID NO. 8804
aacactcacccacacagggagcaaaaccttgttgcgggcttgcggcgctttcccgaaaaaaaaaaacccttgttgcggctgcggcgtaacggaaggggaaggccgccgggacctagggtttagtttagccatggcggcggaggaccaggctcctcgtactgagccccgccctgacaaggctaagaagaggaagaagcccaagaaggacaaatggggtcagcctctctccgccgccgcggccgaggtagagccgtcggtggagccggcgcaagatccaccggcagagggcgtcgcgcctgcggcagttgcggtggcggcggcagcggtggagggctatgagcccagcaaggtggtggcgagcggcttgccctacacgaccaccgaggcggacatccggaagctgttcgagttctacggccccctcgggtcggtgcagctctctcgcttcccggactccggcaacttccgcggcctcgccttcgtctgcttcgagtcagatgaagatgcagtgaagtctcttgagcttgatggattcaaaattggcaacagatatatgagggttgaaagatgcagagttactgctagctcaaataagaaaaggaagacagaattccaaacagaccctgaaaagtctctgggttgcctatccgcatatgtaggcaatctctcatggaatgttacagaaaaggacttgcgagacttcttcaaatcatcgaagatctcctcgataagatttgccatcgataaaagaactggaggttctcgtggcttctgtcatgttgattttcaagatgacgattcgcttgagaaagctgtagcgatgaatcagtctgaactgcaaggcagacccgtcaaagttgcgtattcagtcagtaacaggggctgaaagtgaagagaatccatcgtcaatattttttatttttttacttgtgagcttgtagtgttatggttctgatccatggttgcagttaagcttttgattcgatggaatgaatgttttggagtaaaatccacagtgccaattcttgcaccaaacatgtggcaaatgtaatccttatgtaagaaatacttggcggttgtaccacctcaacgtctgtctgctggctggcctagtggccttcctctctgctggaagtactgaagaaatattgtactgcataaggatgattgacagtgggaaactattggtaagacagttctgagttcaaaaaaaaaaaaaaaaaaaa

SEQ ID NO: 8804 - protein, 251 aa, Panicum virgatum
  misc_feature: Ceres CLONE 2017442
  misc_feature: Great-hit functional homolog of the protein sequence given in SEQ ID NO 9616
  misc_feature: Useful for making plants with altered Lignin content
MAAEDQAPRTEPRPDKAKKRKKPKKDKWGQPLSAAAAEVEPSVEPAQDPPAEGVAPAAVAVAAAAVEGYEPSKVVASGLPYTTTEADIRKLFEFYGPLGSVQLSRFPDSGNFRGLAFVCFESDEDAVKSLELDGFKIGNRYMRVERCRVTASSNKKRKTEFQTDPEKSLGCLSAYVGNLSWNVTEKDLRDFFKSSKISSIRFAIDKRTGGSRGFCHVDFQDDDSLEKAVAMNQSELQGRPVKVAYSVSNRG

SEQ ID NO: 8805 - DNA, 1331 bp, Panicum virgatum
  misc_feature: Ceres CLONE 2017464
  misc_feature: Encodes the peptide sequence at SEQ ID NO. 8806
gcagtttcgcgagtccagccgccgtcgctcacctcagtcagcagtcacctcctcttcccactccggcgccggccgcccttctcctggctccaccatccatccccccaccctccttgtgaatctaggatccaatgagcaacctcgagtgacgcccgctccagcggagtaagatggcttcgccggcgggcctccgccccgacacgccgccggcgatacccggcgccgctgcggtggcggcgtgcgccgccatggccgtgtcctacgtcgctgtcctctacgccccgacggtcatcctccgcttcccgcccccgacctcgcttcgttccttcctccaccgccgcttcgcctgcgccgccgtcgcctcgaccgcctccgcgctcgccaccacggcgctcctacgcgtctggagcctaagcgacttcgctgatatgctcgcggtgttcggcattcggaaggatcacttgcttcaggcagtggtgattccacttctccttacatccctagtgtatgctgggtcgttcatcaacagactgtggcttcttgcgagcttgcggggcggaaatggtgatgaggtggggattggctgcacccagaggcttgtgctccggatcccagctgccattgatgatgtaatggtttggcggaattatgtagtggcaccatttaccgaggagctggtttttagggcgtgcatgataccacttcttctgtgtggtggattcaaaatgtcgacaattatttttctgagtccagtcttcttcagtctagcacacttaaaccatttgtttgaactgcaacagcagggatgcaattttatgagatcgctactgattgtaggtgtccagttaggctacactgtaatctttgggtggtatgcagcatttttgttcattcggacagggaatctgttatctcccattgttgctcacgtcttttgcaatatgatgggtttgcctgctttctcatcgccacaaacaaaaggagtggcatcggtagcatttttggctggttcaatatgttttttttgtctccttttccctgcaacaagtcctgaactgtacaacactagattagatcgctgcagatgctggcatggattttgcaattggaaatagtgcagaactcgatggagagcagtggatcctgaacctaacttgaagctactagccagtgaaaccctcggctggcttcagccacttcgtttatttttcatttcagaattccatattggtgttcaacgtttttgtagatatattgttccctttttggtggctaagagcttagacttgtgaaaaattgcatctcattagtgttaagtatgtattgaccag

SEQ ID NO: 8806 - protein, 314 aa, Panicum virgatum
  misc_feature: Ceres CLONE 2017464
  misc_feature (1)..(110): Pfam Name: Abi Pfam Description: CAAX amino terminal protease family
MASPAGLRPDTPPAIPGAAAVAACAAMAVSYVAVLYAPTVILRFPPPTSLRSFLHRRFACAAVASTASALATTALLRVWSLSDFADMLAVFGIRKDHLLQAVVIPLLLTSLVYAGSFINRLWLLASLRGGNGDEVGIGCTQRLVLRIPAAIDDVMVWRNYVVAPFTEELVFRACMIPLLLCGGFKMSTIIFLSPVFFSLAHLNHLFELQQQGCNFMRSLLIVGVQLGYTVIFGWYAAFLFIRTGNLLSPIVAHVFCNMMGLPAFSSPQTKGVASVAFLAGSICFFCLLFPATSPELYNTRLDRCRCWHGFCNWK

SEQ ID NO: 8807 - DNA, 1088 bp, Panicum virgatum
  misc_feature: Ceres CLONE 2017488
  misc_feature: Encodes the peptide sequence at SEQ ID NO. 8808
aaaatcagctcaacgaccgaagagagactagccgcccgccgcccgcgctcgcaaaggagaccgacaccgcgcggcgcaccaaccatgcgtccagtagcagctcgccacctcggcctcgcggcggccgcgctcctcgccgccgccgccctcctgcttgtcgccgccgcgccggcagccagggcacaggaggagacggagcacgaggaggagttcagctacgccggcggcgacgcgcacgggccggagcactggggcgagatcaagcccgagtgggcggcgtgcggcgcggggcggatgcagtcgcccatcgacctcgcccaccaccgcgtctcgctggtgcgcgccctcggcttcctcgaccacgcctaccgccccgccgaggcctccatcgtgaaccgcggccacgacatcatggtgaggttcgagggcgacgccggcgacctggtgatcaacggcacggcgtaccacctgaagcagctgcactggcactcgcccaccgagcacaccgtcgacggccgccgctacgacctggagctgcacatggtgcacgagagcgccgagggcaaggccgccgtggtcggcttcctctacgaggtcggcggccgccgcgacccgctcctccgccagatggagccgttcatcaggcggatcgccgacaagcgggaccgggaggagcgcgtcggggtggtggacccccgcgccgtgcgcggcagggccagcgtgtactaccggtacatgggctccctcaccgtgccgccctgcaccgagggggtcatctggaccatccttaagagggttcagaccgtgtccaagtaccaactggagcttctcagggaagccgtgcacgatgacatggagaagaacgcgaggccgcttcaggaggtcaacagcagagacgtcagcatcttccggccaagcgcccataaacactattagtcgttcagagtagtgtggctgatgaagattttttttttgtaattccttctatatttttttttgtaattccttctatttctgtgcatttatttattatatgggtaaataatgaagatattactctatttgattaaaaaaaaaaaaaaaaaaaa

SEQ ID NO: 8808 - protein, 283 aa, Panicum virgatum
  misc_feature: Ceres CLONE 2017488
  misc_feature (2)..(228): Pfam Name: Carb_anhydrase Pfam Description: Eukaryotic-type carbonic anhydrase
MRPVAARHLGLAAAALLAAAALLLVAAAPAARAQEETEHEEEFSYAGGDAHGPEHWGEIKPEWAACGAGRMQSPIDLAHHRVSLVRALGFLDHAYRPAEASIVNRGHDIMVRFEGDAGDLVINGTAYHLKQLHWHSPTEHTVDGRRYDLELHMVHESAEGKAAVVGFLYEVGGRRDPLLRQMEPFIRRIADKRDREERVGVVDPRAVRGRASVYYRYMGSLTVPPCTEGVIWTILKRVQTVSKYQLELLREAVHDDMEKNARPLQEVNSRDVSIFRPSAHKHY

SEQ ID NO: 8809 - DNA, 877 bp, Panicum virgatum
  misc_feature: Ceres CLONE 2017585
  misc_feature: Encodes the peptide sequence at SEQ ID NO. 8810
accgaggggagatacgggcatagtacggctgcgccggcaatggctactgcggcttcccccttgcttgccttgctcctcatccagctgaacgtcctcttccacctctccgactcctccatcgccctcgcacaaccacaacacagcagcagcagcaaggaacgtcaccaacccgcgctgttgcagtcgacgtgcaactccaccagcttctacgacgtctgcatcgccgccctcgccgccgacccctccagctccaccgccgacgtccccgccctctgtgccatcgccgtctccgccgccgccgccaatgcctccggcaccgcctccttcctcgccaacgccagcgacgccgccgccacccccgaggcggaccgcgcgctcctccgcacctgcgccgccaagtacgcggccgcctgcgacgcgctcctggcggcgcgggtctccctcgcggagcaggactacgactacgccttcgtgcacgcgagcgccgcggccgagtaccccgcggtgtgccggacgctgttccggaggcggcagcagcagcaggcgcgcccgagcaggacgacgacgtacccgccggagctgtcgaaaagggaggaggcgctgcggcgcctctgcaccatcaccctcgacatcatctcgctattgcagacgcacgaaccctccacctgaatgaatgcgtttgacacctgttgggatagacatcactccatcctctgtcgaaactcatgaggtttgagaatctgatcagagatgagagtgcttgtaaatcgagcatgcaatgtatggttgatcattcatgtgatgcatggcatgaataatccatggaatggaaaggttggtcacggactgttgtttgcaaaaaaaaaaaaaaaaaaaa

SEQ ID NO: 8810 - protein, 209 aa, Panicum virgatum
  misc_feature: Ceres CLONE 2017585
  misc_feature (5)..(161): Pfam Name: PMEI Pfam Description: Plant invertase/pectin methylesterase inhibitor
MATAASPLLALLLIQLNVLFHLSDSSIALAQPQHSSSSKERHQPALLQSTCNSTSFYDVCIAALAADPSSSTADVPALCAIAVSAAAANASGTASFLANASDAAATPEADRALLRTCAAKYAAACDALLAARVSLAEQDYDYAFVHASAAAEYPAVCRTLFRRRQQQQARPSRTTTYPPELSKREEALRRLCTITLDIISLLQTHEPST

SEQ ID NO: 8811 - DNA, 940 bp, Panicum virgatum
  misc_feature: Ceres CLONE 2017613
  misc_feature: Encodes the peptide sequence at SEQ ID NO. 8812
acaaatcagtcgcagcactctcgccggaggccatccacacccccaagaactcagctcagctcaggtcgccgtgctctagccaatggaggccacagccggcacctatgacgacgactatgtcctcaacctgtcgctgacgctggggcccacctcgccgcctcctgaccatgctgccgcaatcccggcttctggtggtggcgatggagccgccgccgccggcggcggcggccgaggtggtatgaggctcttcccttgcctcttctgcaacaagaagttcctcaagtcgcaggcgctaggggggcaccagaatgcgcacaagaaggagaggagcgttgggtggaacgctcacctctacctccccgcggagacatccgccgccgccgtccccggcatggttgttgcgccgccgatcagccaagcagctcctatggcggcggcggtgccgatccgggtctcgcactcgtgccgctcctctcaacgtgcgcacctcgacgacacggcggcgatgctcggagggtctcgctacgccgctgatggcggtgatggatcgcggtggtggtacgacgcggagggcgagaggcagaagcagaggcatgttgatctcaacctcaagctctagctacgtacgagttattagtttcatgctggatgcgtgatgaggtatttattattttgtactttggatttctctttctttttttttctttctttctttttgttgctttattttaactagctagtgtgtaaagtacgtccttctgccgattgtacaacggcttattgtaatgttctcaagctgttgtacagtggcatatgatcgatgcgctgctgcctctgtagtctctactgtccgggctgctggggttgcagtttgttggcccagagaagtgtggaaataacactttggaacacgtttatctaaaaaaaaaaaaaaaaaaaa

SEQ ID NO: 8812 - protein, 178 aa, Panicum virgatum
  misc_feature: Ceres CLONE 2017613
  misc_feature: The sequence is a functional homolog of  SEQ ID NO 1091 in the  10/412,699 US patent application
  misc_feature: The sequence is a functional homolog of  SEQ ID NO 1279 in the  10/666,642 US patent application
  misc_feature: The sequence is a functional homolog of  SEQ ID NO 636 in the  10/374,780 US patent application
  misc_feature: Useful for making plants with modulated growth and phenotype characteristics
MEATAGTYDDDYVLNLSLTLGPTSPPPDHAAAIPASGGGDGAAAAGGGGRGGMRLFPCLFCNKKFLKSQALGGHQNAHKKERSVGWNAHLYLPAETSAAAVPGMVVAPPISQAAPMAAAVPIRVSHSCRSSQRAHLDDTAAMLGGSRYAADGGDGSRWWYDAEGERQKQRHVDLNLKL

SEQ ID NO: 8813 - DNA, 1449 bp, Panicum virgatum
  misc_feature: Ceres CLONE 2017785
  misc_feature: Encodes the peptide sequence at SEQ ID NO. 8814
atactccctgcaggagcgagagcgagccgattcgcccacgacggctgcctcctgctctgctcttctctgcttcctccctccccacgcgagcgctctctcctctgcttcccctcctccccgcgactccgcccggctctagggttttgccccctatcgatcgaaatggtggaggtggaggaggtcgggaacaagatgcagtcgcagatgcgcctccatccagagccggaggacgacgccgacctcccgctccccgccctcttcgacagggcgtcccggctccacggcctcgcctccagctccgccctcgaccaggaagggatccggaagggggtcgagctgctgcggcgctgcgacgagatggtcagcaagctcggcctcttctccaccaacgagacaaaggaagacgtctccaccgccaacctcaaataccttctcgtcccatactacctaggggaaatgactgagaagatcgcacaggaggacaggatcccgattcttaaggcatcacagaaccatttgaaggagtttattgctctatgtgaagcactagagcttattccagaggatgagcttgaattatctagacagaagcagcctgatactacggcaaacagaagagcacagaagattgcccgtttcagacgtcaaaaagctgcagaaacgaagctccaagagattaaagagagaaaagaaaggcgtgggcgctcattgagggcagctgctttatctgctcctgctgaagctggggaggaagatgccttggaggatgatggggaggaagaaagagaggcttggttagctactatctcattggctctctgcaaggcctttgatcttctggacatgctaaagaaggaagaagaaatgcttctagcagtaaaggaaagacaggaaaaggatgggaatgcatttgctcgtgaaatgcttgacgagcgtacacaaaaagctgaagcatggcacaataatgctgcaaaccgtgcaccatattccaaaccagctgatccaatcacttgcgcaacatttgctcaagacgtccttgaaggtagagcaagtgtttcacaagctcatgagcacaaacaccaacccctgatatttggacctgcaagtcttgttggtggaggactaaccagtgaaagggaaagaatggcagcacaagttttccagcctggttacaggctgccaacaatgagcatagaagaagctggtttacgtgaaatgaaaatgatggagaaatggcaagaaagaaccgcaaatatgatcaaagaagcaaactcggcatggcacaaggacggyactagctcagcccaagaggatgaggatgcagaggaggcaaaagcaagagcttgggacgactggaaggatgacaaccctcgtggtgctggcaacaagaagctcacgccctgcggctaaattgcttgcaatgtgttgaaatacccccttgtgatggat

SEQ ID NO: 8814 - protein, 415 aa, Panicum virgatum
  misc_feature: Ceres CLONE 2017785
  misc_feature: Great-hit functional homolog of the protein sequence given in SEQ ID NO 9337
  misc_feature: Useful for making plants with modulated biomass
  misc_feature: The plant is abnormally small.
MVEVEEVGNKMQSQMRLHPEPEDDADLPLPALFDRASRLHGLASSSALDQEGIRKGVELLRRCDEMVSKLGLFSTNETKEDVSTANLKYLLVPYYLGEMTEKIAQEDRIPILKASQNHLKEFIALCEALELIPEDELELSRQKQPDTTANRRAQKIARFRRQKAAETKLQEIKERKERRGRSLRAAALSAPAEAGEEDALEDDGEEEREAWLATISLALCKAFDLLDMLKKEEEMLLAVKERQEKDGNAFAREMLDERTQKAEAWHNNAANRAPYSKPADPITCATFAQDVLEGRASVSQAHEHKHQPLIFGPASLVGGGLTSERERMAAQVFQPGYRLPTMSIEEAGLREMKMMEKWQERTANMIKEANSAWHKDGTSSAQEDEDAEEAKARAWDDWKDDNPRGAGNKKLTPCG

SEQ ID NO: 8815 - DNA, 1487 bp, Panicum virgatum
  misc_feature: Ceres CLONE 2017859
  misc_feature: Encodes the peptide sequence at SEQ ID NO. 8816
gctttcgcgtcgacgccgcgaccgcgaccgaggaattctctattcgatccggtctggtttggttagagttcgcgagcctctgattgggggttggtcgcctcgctcggttcttctccgggagactcatttgctctgaactctgaagtcgccatttccgggaggtcctggtggtcaggtgtgtctgctgcaaatggagaggtacgaggcgctgaaggagctgggcgccggtaacttcggggtagcgaggctggtcaaggacaagcggaccaaggagctcgtcgccgtcaagtacatcgagaggggcaagaagattgatgagaatgtgcagagggagatcatcaatcaccagtcgctccggcaccctaacatcgtacggttcaaggaggtttgtttaacgcccacacatcttgccattgtaatggaatatgctgctggtggagagctctttgagaaaatctgcagcgcggggagattcagtgaagatgagtccaggtatttctttcagcagctaatatcaggagtcagctactgccattccatggaaatttgtcaccgtgatcttaaacttgagaacactctccttgatgggagtccaacacctcgcgtgaaaatttgcgactttggttactcaaagtctgccttgctgcattccaaaccaaaatcgacagttggcactccagcttacatagcgcctgaggttctttccagaaaagagtatgatggcaaggtagcagatgtttggtcctgcggcgtgacactgtatgtaatgctcgtgggatcgtatccatttgaagatcccgaggatccaaggaacttccgcaagacgatcagcagaattcttggcgtgcaatactccatcccggattatgtgagagtgtcttcagactgcagacgccttctgtctcaaattttcgtctccgatccttcaaagaggatcacgatcccggagataaagaagcacccgtggttcctgaagaacctgccgcgggagatctcggagagggagaaggccaactacaagtacacggagcccgccgagccggcgcaggccgtggacgagatcatgcggatcgtccaggaggccaagacccccggcgacatgtccaaggccgtggacccggcgctgctcgccgagatggccgcgctggagagcgacgaggaagaagccgacgccgaggacacctactgatcagtgatcagcttgagcttgctcttccatgcagctcaccagggaccttcgtgccgcggagacaccatatggccgggcatgatcgaggaacggggatacgctgccgctgaacctaaccaacaataaggaatgttgagtgcgcgtgtgataaggaatgttgcattcttactctgtatgtatagcagctgtataattgtacattgcatcatcgcatggcacgggattaactagggtgcagtgatgatgataaataaaaataaaaaagtttggtccgctgcaaaaaaaaaaaaaaaaaaaa

SEQ ID NO: 8816 - protein, 332 aa, Panicum virgatum
  misc_feature: Ceres CLONE 2017859
  misc_feature (1)..(331): SWISSPROT Homolog: EC 2.7.11.1 Serine/threonine-protein kinase SAPK2
  misc_feature (2)..(332): SWISSPROT Homolog: EC 2.7.11.1 Serine/threonine-protein kinase SAPK3
MERYEALKELGAGNFGVARLVKDKRTKELVAVKYIERGKKIDENVQREIINHQSLRHPNIVRFKEVCLTPTHLAIVMEYAAGGELFEKICSAGRFSEDESRYFFQQLISGVSYCHSMEICHRDLKLENTLLDGSPTPRVKICDFGYSKSALLHSKPKSTVGTPAYIAPEVLSRKEYDGKVADVWSCGVTLYVMLVGSYPFEDPEDPRNFRKTISRILGVQYSIPDYVRVSSDCRRLLSQIFVSDPSKRITIPEIKKHPWFLKNLPREISEREKANYKYTEPAEPAQAVDEIMRIVQEAKTPGDMSKAVDPALLAEMAALESDEEEADAEDTY

SEQ ID NO: 8817 - DNA, 1197 bp, Panicum virgatum
  misc_feature: Ceres CLONE 2017877
  misc_feature: Encodes the peptide sequence at SEQ ID NO. 8818
agatcgaaacgacatcacatcatcgatcatcccccatcgatttccaacctccagcagtctgtgccccatctaccgatcgatccatccatccctcaaggatctgacatggaagacagccggctgatgagccccgagcggcaggcggcggcggagcctgtgcggtcgcggtggacgcccaagccggagcagatactcatcctcgagtccatcttcaacagcgggatggtgaacccgcccaaggacgagaccgtccgcatccgcaagctgctcgagcgcttcggcgccgtcggcgacgccaacgtcttctactggttccagaaccgccgctcccgctcccgccggcgccagcgccagctgcagctgcaggcgcaggcgcaggcggcagcggcggcaggctcctcgtcctcgtcgggatcgccgccccccacgagcgccgccggcctcgcgccggcctcgtcgttcgcgcacggcgcgacgtacggctcgtcgtccgcctccgcgtcgtggcaggggatgatgggggacctggactgcgggggcggtgacgacctgttcgccatatcgcggcagatgggctatgcggacggcggtggctccggttcggcggccatgtcgtcacagcagcagcagcagctttactactcgtgccagtctgcagggagcttgacgacgatgtcggtgttcatcaatggcgtggcgacggaggttccccggggcccgatcgacctgcggtccatgttcgggcaggacgtgatgctggtccactccaccagcggcgccatcctccccgtcaacgagtatggaatcctcatgcagagtctgcagatgggcgagagctacttcttggtcacgaggggctagcgctagcgctactactactgacgcatgcacattcttggatgctatatatccggagatactagatgcatgcatgcaagcatactgcgcaagttaagtgctgccgccagtgatgatccgctagacgatcaggatcaggagggtgcaagctacctaagtatacctaggatgatatgagctaccatccagctgttgacatggaaccgataatccagacatatgtacgagctagctagtgtgatggaaggcgatcgaggaattaatattaattcaggcatgcatgaatataatgatacgggcagtactactctattactataaaaaaaaaaaaaaaaaaaa

SEQ ID NO: 8818 - protein, 251 aa, Panicum virgatum
  misc_feature: Ceres CLONE 2017877
  misc_feature: Great-hit functional homolog of the protein sequence given in SEQ ID NO 9278
  misc_feature (1)..(62): Pfam Name: Homeobox Pfam Description: Homeobox domain
  misc_feature: Useful for biocontainment applications
  misc_feature: Useful for making plants with modulated biomass
  misc_feature: The plant is abnormally small.
  misc_feature: The plant produces a reduced number of seeds.
MEDSRLMSPERQAAAEPVRSRWTPKPEQILILESIFNSGMVNPPKDETVRIRKLLERFGAVGDANVFYWFQNRRSRSRRRQRQLQLQAQAQAAAAAGSSSSSGSPPPTSAAGLAPASSFAHGATYGSSSASASWQGMMGDLDCGGGDDLFAISRQMGYADGGGSGSAAMSSQQQQQLYYSCQSAGSLTTMSVFINGVATEVPRGPIDLRSMFGQDVMLVHSTSGAILPVNEYGILMQSLQMGESYFLVTRG

SEQ ID NO: 8819 - DNA, 789 bp, Panicum virgatum
  misc_feature: Ceres CLONE 2017982
  misc_feature: Encodes the peptide sequence at SEQ ID NO. 8820
acgtcaaaacagcgagccgaaaatggagcacgcgacccctccggccgccgccgtcggcgtcacggccaccgtcgacctctcccctgcggccactgaccttggcggggcgcacctccttccctgcggcatcaggcagaacggcggcgcccccgtctccgactacttcaagcctaggagcacaggtgtggaggtggagggggtgagggtggaggaggcattcttccgcgggaggaagctgcagggcgctaccctcgcactcccggatggctaccgaggttatgtattggagaagaagagtggaggaaaggatacacagaattcagaaggtgaagtgagtaattttgtatcacgtgcggaattccagaacataacctactggaatcatgataccacaccatcagcagaggattccctcccaaggtgctttcattggctaactgttgcaaatgcgatgcacaagccagtgacagctgaagagctggctaacatgtcagcaatgcagaatcaggacggctagcttcattgtatgctgattatgattttcctatatgatgtaactgtggcaccggtgggaaaagtctctactcaatgtaatctcagcttggcgaaccatcctgacaagctatctacctgtctaacaagtagcatacttttcagcgcatccaccttcagtagatccgccttcagtagcacgataatgcttgatgtaatgcagactgggagctggattgctggaagcctggaactatcgtgttcatttctgcaatacaaaaaaaaaaaaaaaaaaaa

SEQ ID NO: 8820 - protein, 164 aa, Panicum virgatum
  misc_feature: Ceres CLONE 2017982
  misc_feature (1)..(116): Pfam Name: RNase_H1_sml Pfam Description: Ribonuclease H1 small subunit
MEHATPPAAAVGVTATVDLSPAATDLGGAHLLPCGIRQNGGAPVSDYFKPRSTGVEVEGVRVEEAFFRGRKLQGATLALPDGYRGYVLEKKSGGKDTQNSEGEVSNFVSRAEFQNITYWNHDTTPSAEDSLPRCFHWLTVANAMHKPVTAEELANMSAMQNQDG

SEQ ID NO: 8821 - DNA, 1299 bp, Panicum virgatum
  misc_feature: Ceres CLONE 2018169
  misc_feature: Encodes the peptide sequence at SEQ ID NO. 8822
tcgtggcaactctactgtgtcgcgtcactactcactaggcgtgcggcgtgccacatgggcgccgacggcgagctggatgtcttcgacgccggccgctgcaccgacgggtacgcgctgggcctcgccgtgggccggcggttcgcccatgtcatcaggagcaggatgcggcaggacctcgtgctccgggaccagctgctgccgttcgcgtccacggcgaaggcgccgccgctcctcgccgccctccaggccgccaacagggagaggtacccgcggtactgggacgagctggtcggcaccgccgacggcagcggggtcccgctcctccacgtcatcctgctcaacttcaggaaggagatcctaccgttcatccccaaggagggcgacggtcacggccgggaggaggagcccgacggcgactgctccgacgtcctcatcgtcagcgactccacggcgatcgccgcgcacaacgaggacgggaacgtcgcgctgctcggccacacgtacctggtgcgggccacgctgccggacggcctgtcgtccttcaccgcttacacctacgccggcgagctcccgagctgcgccttcgggttcaacagcaacggcgtggccttcacgctcgactcggttcctccggtgaacgacgagatcgtcgccggcgccattgcccggaacttcgtgtcacgggacctgctagaggcgaagaacctcgacgacgcaatgcgcaggatctgctcaccgggcgtttcagtcggccacggctacaacctgatggatgtcagaggccggaggatcgtcaacgtcgagaccgcctccgggaaccggttcgcggtccacgaggccggcgccacaccattcttccacgcgaacatgtaccggcatctccaagtgaagcaggtgcaggacgagaactccatcagcagggagaagagagcagcgcagtgttcagtggactccaaggaaacggcactttcactgctgggagatacagctgatgacaagtacccaatctacatgacaggcccaacattgcacactctttgcaccgtcttggttgacctcgacaaggagaccgtgaccatatacaaaggcaatccgaagaacggagaaatggctcttgttcttcctatgttatgaaactaaggagattagcccaattcttgtgcgagaacttgagcagcacccccaattcctatttgtatctgtaactgaaagatacacagattttggacactgcaggtgtcattcattgaatcaatgagcataatttcttttcctgaacaaaaaaaaaaaaaaaaaaaa

SEQ ID NO: 8822 - protein, 359 aa, Panicum virgatum
  misc_feature: Ceres CLONE 2018169
  misc_feature (1)..(229): Pfam Name: AAT Pfam Description: Acyl- coenzyme A:6-aminopenicillanic acid acyl-transferase
MGADGELDVFDAGRCTDGYALGLAVGRRFAHVIRSRMRQDLVLRDQLLPFASTAKAPPLLAALQAANRERYPRYWDELVGTADGSGVPLLHVILLNFRKEILPFIPKEGDGHGREEEPDGDCSDVLIVSDSTAIAAHNEDGNVALLGHTYLVRATLPDGLSSFTAYTYAGELPSCAFGFNSNGVAFTLDSVPPVNDEIVAGAIARNFVSRDLLEAKNLDDAMRRICSPGVSVGHGYNLMDVRGRRIVNVETASGNRFAVHEAGATPFFHANMYRHLQVKQVQDENSISREKRAAQCSVDSKETALSLLGDTADDKYPIYMTGPTLHTLCTVLVDLDKETVTIYKGNPKNGEMALVLPML

SEQ ID NO: 8823 - DNA, 985 bp, Panicum virgatum
  misc_feature: Ceres CLONE 2018171
  misc_feature: Encodes the peptide sequence at SEQ ID NO. 8824
aacgcaagttgcaacccccacgccacgcaccgcccaggtcacgccacgccacgcaccgctcaagtcacgccacaccaacgccccgcgtttccttctcctcccgccgccgcgcccctcccttccccggcattttcttcgcctccgcgctgccgccgccgccgcaggtccctcccccgaagatggccaacgcggcgtccgggatggccgtggacgacgactgcaagcgcaagttcctggagctcaaggccaagcggacctaccgcttcgtcgtcttcaggatcgacgagaagcagaagcaggtcgtcgtcgagaggctgggcgagcccaacctcacctacgacgacttcgccgccaccctccccgccgacgagtgcaggtactgcatctacgacttcgacttcgtcaccgaggagggatgccagaagagcaagatcttcttcatcgcgtggtccccggacacggcaaagattaggagcaagatgctgtatgcaagctccaaggacaggttcaagagggagctcgatggtatccaggtggagctgcaggcaactgatcccaccgaaatgggccttgatgtgatcaggggccgtgccaattgagtgtctgcttcctggttcctgctgtggaagtactccacatctttaggaaattctatagctcctgaatatcagtgagttgggaagttgtagtctaggatttcttactgtccactgactctggttagcttgatacctgccacctgagttttagtttgtctatctccgtcctgttgctcagtagtaagtgcattgtggaacatgtgacattgcctgctcctagtttgatgtctccaagctaatgatatgctaagtctacaggtgttggatttgtcaacagcctgcttatgttaatgcaacggaagcttgaccaatgacatcaggccctatcctattctttttcatattgtcgaatgcacgtgttaacggaaaaaaaaaaaaaaaaaaaa

SEQ ID NO: 8824 - protein, 139 aa, Panicum virgatum
  misc_feature: Ceres CLONE 2018171
  misc_feature: Great-hit functional homolog of the protein sequence given in SEQ ID NO 9722
  misc_feature: Useful for making plants with modulated time to senescence
  misc_feature: The plant senesces significantly late compared to wild-type.
MANAASGMAVDDDCKRKFLELKAKRTYRFVVFRIDEKQKQVVVERLGEPNLTYDDFAATLPADECRYCIYDFDFVTEEGCQKSKIFFIAWSPDTAKIRSKMLYASSKDRFKRELDGIQVELQATDPTEMGLDVIRGRAN

SEQ ID NO: 8825 - DNA, 786 bp, Panicum virgatum
  misc_feature: Ceres CLONE 2018191
  misc_feature: Encodes the peptide sequence at SEQ ID NO. 8826
atggaagagcctatataagtatcctaaattcccctctgacctgcgtctccgtatataataacccagatttcgaattcctcctcccctctcccaaggttccgcgctcctcgtcgacgccgctgttccagcagatcccaagggagtcttcctcttcctccgatccgtccccgtcccgatcctctctggggatggccaccttcgagctgtaccggaggtccaccatcggcacctgcctcaccgagacgcttgacgaactcgtgtccagcggggccgtcagccccgagctcgccattcaagtccttgtgcagtttgacaagtccatgactgacacgctggagagtcaggtcaagagcaaggttaacatcaagggccatctgcacacctacaggttctgcgacaatgtctggaccttcattctaacagatgcaaccttcaagagcgaggagatttcagaaacattgggcaaggtgaagatcgtggcctgcgattctaagttgctgcagcctcatcaaccataaattgacagccacctgctccatgtcgattgatcaccatccagtttagctcagttgatgctattcctggcgccacccaaactttcctagtttatgtgaatttgccctctctgaatgttgtttctgtgaatctaaactatcgccgtggcactagagtaccatggctgacaacttgttatccgtactggctatgaatatggtttcactcgtttctgttgataatttggcatggatgtcaggtccaatataataaaaaaaaaaaaaaaaaaaa

SEQ ID NO: 8826 - protein, 109 aa, Panicum virgatum
  misc_feature: Ceres CLONE 2018191
  misc_feature: Great-hit functional homolog of the protein sequence given in SEQ ID NO 9382
  misc_feature: Useful for making plants with altered Lignin content
  misc_feature: Useful for making plants with altered terpenoid content
MATFELYRRSTIGTCLTETLDELVSSGAVSPELAIQVLVQFDKSMTDTLESQVKSKVNIKGHLHTYRFCDNVWTFILTDATFKSEEISETLGKVKIVACDSKLLQPHQP

SEQ ID NO: 8827 - DNA, 752 bp, Panicum virgatum
  misc_feature: Ceres CLONE 2018208
  misc_feature: Encodes the peptide sequence at SEQ ID NO. 8828
ccgtgatactcccacagattcttatcggaagaaaggaacccaccccaccgcggaagagccaaaaccaccgcaccatcaccatggagtcgctgatgacgcttcgcgctcgcgcctcgccgtcgccgctgcagcagcagcgccggctgccggggcggcagcgcgcgacgcccgtccgcgccacggccgccggcgagcccgacctctcggtgcgcgtgaacgggctgcagatgcccaacccgttcgtgatcgggtcggggccgccgggcaccaactacaccgtcatgaagcgcgccttcgacgagggctggggcgccgtcatcgccaagatccgggtgtacggcaagctgcagctgcgcaaggggatgaaggccgtgaaccaggtgtggcaggtcgggtcctccgccaccggcggcgcccccgacaagcacgccttcggggccgacgccgacgcggccggtgccgggaagacctccggcgccgccgccgccggcgccgccgcggtggaggggtctgccggttccacggaaggcggcgctgcgcagtgagatagatgcgcgtggttcccccggaggcccggacgaacgatgatgctcgattcggaactgcagcgcgtgtggccgtcgtgctaccaacgatgcctattgtgttgtggtgtaatttcgtattgtacccaatgggctccggtgcggattgactgaataaattaaatgtaataaatactctttaaaaaacaaaaaaaaaaaaaaaaaaaa

SEQ ID NO: 8828 - protein, 154 aa, Panicum virgatum
  misc_feature: Ceres CLONE 2018208
  misc_feature (1)..(43): Pfam Name: DHO_dh Pfam Description: Dihydroorotate dehydrogenase
MESLMTLRARASPSPLQQQRRLPGRQRATPVRATAAGEPDLSVRVNGLQMPNPFVIGSGPPGTNYTVMKRAFDEGWGAVIAKIRVYGKLQLRKGMKAVNQVWQVGSSATGGAPDKHAFGADADAAGAGKTSGAAAAGAAAVEGSAGSTEGGAAQ

SEQ ID NO: 8829 - DNA, 1032 bp, Panicum virgatum
  misc_feature: Ceres CLONE 2018248
  misc_feature: Encodes the peptide sequence at SEQ ID NO. 8830
cccaggtgcgagtgcgagccatccatcctgacttgtgacttccttcccccggccgccccatacttgcctcctctccttcgattcatccactgctccggcctcctcctcattcattcattcattctcgtaccatcgagcgctcgcacgctctataaatctagctagaagagagggagctaggctgtaccactggccacatctctagctcaagtcacccgatagcaccgcacaccacagcagattgagcagagcagagagccagagagcagaggaggaggatggatccgcccggcggggacgacaagtactggaagctgtccaagaaggggcggagcagatccggcaggccgcacgccatggatgccgccggcaccagcaccatgctcagccggagctactcggccagcgtgagcagcaccaggactgccaccaccagcagcagctcgtcctcttcctcttcttcttcttgtccacaagcacaagcacaacaacagcagcaaggagctgggcagcagtcgtcgcggctgtccaagaagaagtgcgtggaggcggtcaaggagcaccgggcgcgcttctacatcgtccgccgatgcgtctccatgctcgtctgctggcgcgaccactagccggccgtacgtagacaatgcaatcagatagacctagctagctagctgtactacaagtaatagtgactagtagaatataatcctccatggaggttccattttttcttcttcaattcctacctgaatcggatcggactagtgttttttccttgtttctttggccggttaattaattaatttgtgtatgtacatatagtaagtatatatatactagtattatagaggaatcatatatccatacatccatccaaggggagctaagctagctagctgatggaatacattacaatagctggcagcaaagatatatatgatccatctatcttagtagttttgatccccttggactggactggatatatctatatatccttttctttcttttcaaaaaaaaaaaaaaaaaaaa

SEQ ID NO: 8830 - protein, 115 aa, Panicum virgatum
  misc_feature: Ceres CLONE 2018248
  misc_feature: Great-hit functional homolog of the protein sequence given in SEQ ID NO 9735
  misc_feature: Useful for making plants with modulated biomass
  misc_feature: The rosette leaves do not appear in the normal fashion, i.e., their phyllotaxy may be abnormal or too many leaves may be emerging in comparison to the control.
MDPPGGDDKYWKLSKKGRSRSGRPHAMDAAGTSTMLSRSYSASVSSTRTATTSSSSSSSSSSSCPQAQAQQQQQGAGQQSSRLSKKKCVEAVKEHRARFYIVRRCVSMLVCWRDH

SEQ ID NO: 8831 - DNA, 915 bp, Panicum virgatum
  misc_feature: Ceres CLONE 2018614
  misc_feature: Encodes the peptide sequence at SEQ ID NO. 8832
aaacccattagaaatccagcccagaatacccacttcgggtcgtctgctcggccgatctcgcgcagcgccggcgccgccgcatccctgaatctgagcccctttcgtcttgcccagcctcgagcacgtcccccttcccctcctctaccctccctccattcgattcgagcttatcgctagggttcctgaccccgctccaccttctcccatggcggacgaagccaaccgaacggcgttcatggagctgcaggcccggatgttcgataccaccggaaagatcaagcagttacaaacccaaatgcgttctaaagagggggaaaagaagcgtgcttacctcactctggaggaactccgccaattgccagatgacactaacacctacaagactgttggtaaggaagaatttttgtgtagataatcctgtttcgcttttgaagccaagattacccattattacgtattttccttgtccatgaaatgtgtagaagaccaattgagttctctctaacatgctgccaattattattgtcgaatgatcacagagtgatcaggtgtcaatagtgagtattattattatatatatggtcatcgaaaaaacttgtaacctgtgactatcttcactctgaacctatgtgggttatgttatttgtagctgataaccatcttgaacctatgtgggttatattatttgtagctgataaccatcttgaatgttgtgcttccattcataaatgttataggtgatatccactcataaatgttttgcttccattaactactttacctatccttatactttatttaagaaaattatgtaatgtacttatgtgcaccttgtgtttatttcacctatagcatttagaagttcatgctgcaaatgtgaccaatcgagctaaccaaaaaaaaaaaaaaaaaaaa

SEQ ID NO: 8832 - protein, 69 aa, Panicum virgatum
  misc_feature: Ceres CLONE 2018614
  misc_feature: Great-hit functional homolog of the protein sequence given in SEQ ID NO 9498
  misc_feature: Useful for making plants with altered terpenoid content
MADEANRTAFMELQARMFDTTGKIKQLQTQMRSKEGEKKRAYLTLEELRQLPDDTNTYKTVGKEEFLCR

SEQ ID NO: 8833 - DNA, 999 bp, Panicum virgatum
  misc_feature: Ceres CLONE 2018917
  misc_feature: Encodes the peptide sequence at SEQ ID NO. 8834
atcactagcagagagaaaaaaaaaacctgccgtgaaatcgaaaaaggaaatccgaagcagctcgccgccgtcgccatggccgtggaggtgtgcgtgaaggccgctgtcgggcaccccgacacgctcggcgactgtcccttctcccagagggtgctgctcacgctggaggagaagaaggtcacctaccagatgaagctcatcgacgtcagcaacaagcccgactggtttctgaagattaacccagagggaaaggtacctgtgtttaacggtggtgatggcaaatggattgccgattctgatgtgattgttcaagttattgaggagaagtacccaaatccatctcttgtaactcctcctgaatatgcatcagtgggatcaaagattttctcatcctttgtcacgttcttgaagagcaaggacccaaacgatggttcagagaaggcacttctcaatgaactgcaggctctagaggagcatctcaaggctcatggcccctatgtgaacggacagaatgtatcagctgttgatcttagcctggcgccaaagctcttccacctccaggtcgcactagagcatttcaagggctggaagatcccggagaacctcaccagcgtccagacatacacccaggctcttttcagccgtgaatcctttgtgaagactaagccagctaaggagcacctgatcgctggatgggcacccaaggtgtaaacgcctttggcactacccagacaccatcagtttatctgatctatccgtttcgatgatggttacgcttctgtagcttgagcctgtgattgggctggaatagtgatattaatgcagcaccctcctgttctgagcaccttgtttgttttggttgtgacatgtctgcacctaccatcctgtgccggttccatggatgttttggtcttatgttatgaagggacgggcatctgctgtaatgtaaaccttgatatcaaataatggagctgcttctaaaaaaaaaaaaaaaaaaaa

SEQ ID NO: 8834 - protein, 211 aa, Panicum virgatum
  misc_feature: Ceres CLONE 2018917
  misc_feature (1)..(72): Pfam Name: GST_C Pfam Description: Glutathione S-transferase, C-terminal domain
  misc_feature (1)..(74): Pfam Name: GST_N Pfam Description: Glutathione S-transferase, N-terminal domain
MAVEVCVKAAVGHPDTLGDCPFSQRVLLTLEEKKVTYQMKLIDVSNKPDWFLKINPEGKVPVFNGGDGKWIADSDVIVQVIEEKYPNPSLVTPPEYASVGSKIFSSFVTFLKSKDPNDGSEKALLNELQALEEHLKAHGPYVNGQNVSAVDLSLAPKLFHLQVALEHFKGWKIPENLTSVQTYTQALFSRESFVKTKPAKEHLIAGWAPKV

SEQ ID NO: 8835 - DNA, 920 bp, Panicum virgatum
  misc_feature: Ceres CLONE 2019147
  misc_feature: Encodes the peptide sequence at SEQ ID NO. 8836
atcacttggctgaggcctgagggcgctttctgtccatgcccatgccgtcccgtcctccgatgctgtggccgctccactccccttgcccgcttctcttttgcagcttctcaccgccgccgccgccgccggccggtctcaccagtgaccgcctccggccttgatttctttcgtcccatccatgggcacgccgctacggatgccccacatgtccacctgtagcaacgtcgcgcccgctcccgcgcccgaggcgccgcgcgcgccgccgtcgtcgccgctggactacgacgtggtggtgatcctggcggcgatgctgtgcgcgctggtgtgcgcgctggggctcaactcgatgctccagtgcgtggtgcggtgcacccgccgcgccgtggccgaccccgtcggctgggtcgcgcaccgccgcgccagcgccgggctcaagcgcgaggacgtcgtcgcgctgcccgtggtcacctactccgcctcgccgccggcggccgcggcggcggggtgcgccatctgcctgtcggacttcgccgacggggagaggatgcgggtgctccccgtgtgcgggcaccggttccacgtcgtgtgcatcgacaggtggctcgcctcgcacggmtcctgcccgacgtgccggcgccgcctctcctccgagtccggcggtggccaccgccacctgcaagttttgacggctgtttaaccgatcaatcggatagctatactgttttcctcttttttttttgttctcgagatcattgcttccggcatagtatgcgtgtatgtaacgtaaagatggcatgctcatcgcctcatccggtatagcttgtttgatgtggttcactttgccatcctgcatgagagttttttttcttcttctgtacgtgtacaccttaccaccatgagttatgagatgtttattgctc

SEQ ID NO: 8836 - protein, 172 aa, Panicum virgatum
  misc_feature: Ceres CLONE 2019147
  misc_feature (1)..(42): Pfam Name: zf-C3HC4 Pfam Description: Zinc finger, C3HC4 type (RING finger)
MGTPLRMPHMSTCSNVAPAPAPEAPRAPPSSPLDYDVVVILAAMLCALVCALGLNSMLQCVVRCTRRAVADPVGWVAHRRASAGLKREDVVALPVVTYSASPPAAAAAGCAICLSDFADGERMRVLPVCGHRFHVVCIDRWLASHGSCPTCRRRLSSESGGGHRHLQVLTAV

SEQ ID NO: 8837 - DNA, 944 bp, Panicum virgatum
  misc_feature: Ceres CLONE 2019615
  misc_feature: Encodes the peptide sequence at SEQ ID NO. 8838
agaagtcaccgccgccacttgacaccgcagcttcttcctttctccaatccgaggcaagcaagcattcttcgtccattactggcctcactccgcatccagctggtgcttctgtagtgtctgagcaagagccgagaggcggctggcggccatggcggcggcgaagcccatcctgtacagcgcgtggatcagctcctgctccttccgggtccggatcgccctcaacctcaaaggtgtggattatgagtacagggctgtgacacggactgatccagattatgaaaatatcaatccaatcaagtatgtcccagcatttgtagatggggattttgttgtttctgactccctcgcaatcatattgtatcttgaagacaagtatcctcaacaccctcttctgcctcaagatctcaaaaagaaagctcttaatctgcagattgcaaatatagtgtgttcaagcattcaacctcttcaatgttatgctgtagttggcctggttgacggcaagttaagctccaacgagagcgttcagatagttcggcattacattgacaagggattcagagcaatcgagaaacttctggaaggttgtgacagtaaatatgctactggagatgaaatccaattggcggatgtgtttcttgtgccacagatccatgcaggcgtgacgcgtttccaaattgatatgtcgaactatcctcttctggagagattgtacaaagcctacatggaaattcctgcagttcaagttgctgttcctgaaaagcagccagatgcaccatcatcctagatatgaaaacttccgccaagacgagtactgtaatgtgggaaataacagagttgctggttctcccggtaaccatggattatacaagagcggcctcctgctcttgtgcagcgcgaataaaagaataagtgttcacaatacataaaaaaaaaaaaaaaaaaaa

SEQ ID NO: 8838 - protein, 211 aa, Panicum virgatum
  misc_feature: Ceres CLONE 2019615
  misc_feature (1)..(93): Pfam Name: GST_C Pfam Description: Glutathione S-transferase, C-terminal domain
  misc_feature (1)..(72): Pfam Name: GST_N Pfam Description: Glutathione S-transferase, N-terminal domain
  misc_feature (1)..(211): SWISSPROT Homolog: EC 2.5.1.18 Glutathione S-transferase
  misc_feature (8)..(210): SWISSPROT Homolog: EC 2.5.1.18 Glutathione S-transferase zeta class
MAAAKPILYSAWISSCSFRVRIALNLKGVDYEYRAVTRTDPDYENINPIKYVPAFVDGDFVVSDSLAIILYLEDKYPQHPLLPQDLKKKALNLQIANIVCSSIQPLQCYAVVGLVDGKLSSNESVQIVRHYIDKGFRAIEKLLEGCDSKYATGDEIQLADVFLVPQIHAGVTRFQIDMSNYPLLERLYKAYMEIPAVQVAVPEKQPDAPSS

SEQ ID NO: 8839 - DNA, 1142 bp, Panicum virgatum
  misc_feature: Ceres CLONE 2019640
  misc_feature: Encodes the peptide sequence at SEQ ID NO. 8840
attatcaaataatcatctctaaaaaaatgaacaaggctatccttgcttttaccctcatcgctctcttctccgttgcttctgccaccagagctgaaaccatctcttctctctggagcgcttggaaatccgtccacaacaagcactaccgtgcttctgaagaacccaccagacttgctgttttccttgacaacattagaaagatcgctaaactcaatgcccaaaactctcatgctaaattcggcctcaaccaatttgccgatttaactgatgctgaatttgctgaaacctatgcttctggcactttcattgaagctgtcaatgaagacgaaatcattgaattcgctgctaatggagctctccctgaatccgtcgattggagacccaagggtgctgttactcccgtcaagaaccaaggtgcctgcggctcttgctggactttctctgccactggtgtcattgaaggtttctatttcattaagaacggaaagctcctttctttctccgaacaacagatcgttgattgcgctaagctcgctggacaaggttgcaatggcggctggcccaagaaggctgttgcctatgcttccaacaatggcctcgaactccaagatgattatccctacactgctaagaacggaaagtgcacttatgactcttccaaggctattaagactaactctggcgtcaaggtcgtcactcccaagaactctgaacaactcaagactgctttggtctccagccctgtttctgttgccgtcagagctgatgaaagcgctttcagattctacaagtccggtgttgtcacttctgaatgtggctccgctgttaatcacgctgttttggctactggttatgaaaaggtcgatggtgttgaagctttcactgtcaagaactcttggggtaccagctggggtaaccaaggttatattgccatctccactgatcaatctattaacaagggattgggtgcttgcggtatcttgttccaacctgttattgctgtctaaaataaagaaattattgtttaatttaattaaaagaatatattttattgtggtcatcatgcataaaaatctaaatctattggttattgatgattcaaagctaatttgaacattcctcaaaaaaaaaaaaaaaaaaaa

SEQ ID NO: 8840 - protein, 326 aa, Panicum virgatum
  misc_feature: Ceres CLONE 2019640
  misc_feature (4)..(209): Pfam Name: Peptidase_C1 Pfam Description: Papain family cysteine protease
MNKAILAFTLIALFSVASATRAETISSLWSAWKSVHNKHYRASEEPTRLAVFLDNIRKIAKLNAQNSHAKFGLNQFADLTDAEFAETYASGTFIEAVNEDEIIEFAANGALPESVDWRPKGAVTPVKNQGACGSCWTFSATGVIEGFYFIKNGKLLSFSEQQIVDCAKLAGQGCNGGWPKKAVAYASNNGLELQDDYPYTAKNGKCTYDSSKAIKTNSGVKVVTPKNSEQLKTALVSSPVSVAVRADESAFRFYKSGVVTSECGSAVNHAVLATGYEKVDGVEAFTVKNSWGTSWGNQGYIAISTDQSINKGLGACGILFQPVIAV

SEQ ID NO: 8841 - DNA, 1357 bp, Panicum virgatum
  misc_feature: Ceres CLONE 2019658
  misc_feature: Encodes the peptide sequence at SEQ ID NO. 8842
atcagccggcgacgagctaagatagatcatatacacacactgcagtcgtctgtgtgtacaacaaatatatagcacgcaggtagtagctaggcgtgcctgcctgtattaatcatggggtacgagctggccatgaaggcacttgtcctcagccttgtggtgggcgccgtcgccggaattcggccgagcaagctcgtgcggctggtgccggcgatgtacgtgttcggggactcgacgctggacgtcggcaacaactactacctgccggggatgaacgtccccagggccaacaggccctactacggcatcgacctgccgggctccggcaagcccaccggaaggttcagcaacggctacaacaccgccgacttcgtcgcaaagactttggggttcgacaagagtcctctggcttattttgtgctcaaagcacacaataagctgattccgagcgcaatcacaagaggagtaagctatgcatcggcaggatctgggattctcgactccacaaacgccggaaagaacataccgctgtcgcagcaggtgcggttgttcgagtcgaccaaggcagagatggaggccaaggtgggcccccgcgcggtgggtgacctgctcggcaggtccttcttcctcctcggcgacgggagcaacgacttgttcgccttcgcgacggcgcaggcggagcagaacaagacggccacgcagagcgacgtcgccgccttctacggcagcctgctctccaactactccgcggccatcacggagctgtacaagctgggcgcgaggaagtttggcatcatcaacgtggggccggtggggtgcgtgccccgggtgcgcgtgctcaacgtcaccggcgcgtgcgccgacgccatgaaccagctcgccggcggcttcgacgccgcgctcaggtccctcctcgccgggctggcccccaagctgccgggcatggcctactccctcgccgactccctcggcctcacccaggacaccttggccgacccgctggcggtagggttcgtgagctcggacagcgcctgctgcgggagcgggcggctgggggcgcagggcgagtgcacccccgccgccgcgctctgccccgaccgcgaccgctacgtcttctgggactcggtgcacccgtcgcagcgctccgccatgctgggcgccaaggcctactacgacggcccagcgcgatacaccacgcccatcaccttcaagcagctggccgccaccagatcatagtatcatcagctgagcggcttgcatgccatcagagatcaagacgaccaccaccaccacgagtccacgacgacctgcgttcaaataaaactactcctatatatactaaaaaaaaaaaaaaaaaaaa

SEQ ID NO: 8842 - protein, 373 aa, Panicum virgatum
  misc_feature: Ceres CLONE 2019658
  misc_feature (1)..(318): Pfam Name: Lipase_GDSL Pfam Description: GDSL-like Lipase/Acylhydrolase
MGYELAMKALVLSLVVGAVAGIRPSKLVRLVPAMYVFGDSTLDVGNNYYLPGMNVPRANRPYYGIDLPGSGKPTGRFSNGYNTADFVAKTLGFDKSPLAYFVLKAHNKLIPSAITRGVSYASAGSGILDSTNAGKNIPLSQQVRLFESTKAEMEAKVGPRAVGDLLGRSFFLLGDGSNDLFAFATAQAEQNKTATQSDVAAFYGSLLSNYSAAITELYKLGARKFGIINVGPVGCVPRVRVLNVTGACADAMNQLAGGFDAALRSLLAGLAPKLPGMAYSLADSLGLTQDTLADPLAVGFVSSDSACCGSGRLGAQGECTPAAALCPDRDRYVFWDSVHPSQRSAMLGAKAYYDGPARYTTPITFKQLAATRS

SEQ ID NO: 8843 - DNA, 868 bp, Panicum virgatum
  misc_feature: Ceres CLONE 2019692
  misc_feature: Encodes the peptide sequence at SEQ ID NO. 8844
ccccgcaccaagaagcacacgaacaccagcaatccacagatcaaccaaaccaaacaacaaaatcgatcgaagagaggccaagatccgcggcggcgagatggacgcgaggatgttcgggctggagacacccctgatggcggcgctgcagcaccttcttgacgtcccggacggcgaggccggcgacaaggcgagcgcggcggggagcggccccacgcgcacctacgtccgcgacgcgcgcgccatggcggcgacccccgccgacgtcaaggagctcccgggggcctactcgttcgtggtggacatgccggggctgggcaccggcgacatcaaggtgcaggtggaggacgagcgggtgctggtgatcagcggcgagcggcgccgggaggagcgcgaggaagccaagtacctgcgcatggagcgccggatgggcaagttcatgcgcaagttcgtgctgccggacaacgccgacatggacaagatctctgccatgtgcaaggatggcgtcctcacggtgaccgtggagaagctgccgccgccggagcccaagaagcccaagaccattgaggtcaaggtcgcctctgaggatcatcgaatcctcatcgattgaagcagaggatgaagtcagagcagtgccagtgagttgtggcgagtgctgaggagaagcatgcagttgtgcttgtttccttatgtccctctgtgtgtgtgtctaccgcctacctatcacctatcagttgtgctttgtttgatgcatgctgggtttgaaacttgtattgcaaaagagaatgcatgatgctttctgaataaactagaaatggtcgcggcgacgtcgccgcgtgtggccagtggcgaaaaaaaaaaaaaaaaaaaa

SEQ ID NO: 8844 - protein, 169 aa, Panicum virgatum
  misc_feature: Ceres CLONE 2019692
  misc_feature: Great-hit functional homolog of the protein sequence given in SEQ ID NO 9388
  misc_feature: Great-hit functional homolog of the protein sequence given in SEQ ID NO 9432
  misc_feature (1)..(104): Pfam Name: HSP20 Pfam Description: Hsp20/alpha crystallin family
  misc_feature: Useful for making plants with modulated drought sensitivity
  misc_feature: Useful for making plants with modulated heat sensitivity
MDARMFGLETPLMAALQHLLDVPDGEAGDKASAAGSGPTRTYVRDARAMAATPADVKELPGAYSFVVDMPGLGTGDIKVQVEDERVLVISGERRREEREEAKYLRMERRMGKFMRKFVLPDNADMDKISAMCKDGVLTVTVEKLPPPEPKKPKTIEVKVASEDHRILID

SEQ ID NO: 8845 - DNA, 1620 bp, Panicum virgatum
  misc_feature: Ceres CLONE 2019705
  misc_feature: Encodes the peptide sequence at SEQ ID NO. 8846
accaagcttctcctcatcatcagtcatcaccacctcctccatctcggcctccgctcccctctctctcctcccctcctcctctccctctccaaaccccatctacgtcggcgtagggtgcgggggctggagttggaggaagcatttgtgaagattctgtggcgacttctccagatcggcagatccatctttctgggttgtatctttgggcgttttggagcaaagcccccaaatagtttgttgcagaaaggagccgcttttccgctgctccagactctctatgagtctctgctcgtcgttcttggcctcggatcatatatccatctaggaaaaagaggccacctttgcatttattcttttgccccttcggagatcgccctcgtcaagatttggtgggaacccaattcactgcgattcccttgtggaaaagcgccgctttggttcctgtttccccacagctcccaactctatatttctcaatctcttgttcacctacttgcctaactttcttttacttcgatccaccagtttgtggcttccacgcctcggcattcgatagttatatactgatttgacgcaaaccagatcaatctgtggcccttttttccggagggttgttgtgcttattcctgttcttggtcggaggcatggcggcggcgaacggaggtgccggcgcggcgctgttcagcgaggaggagctgcgggaggtgagcggggtgcgccggggggaggacttcgtggagatgacgtgcggatgcaccagccaccgctacggcgacgccgtcggccgcctccgcgtcttcgcctccggcgacctggaggtcagctgcgagtgcacccccggctgccgcgaagataagttgacacctgcagcctttgagaagcactctggaaaagagaccgctggaaagtggaggaacactatctgggtcatggttcagggagaaaaagtgccactgtcaaagacagctctgctcaaatactactacttggcacacaaatccagcaatggttctcacaaaggtcgtaatggacgtccatctcaccgtgatgagttcatccgctgcacaagatgtggaaaggataggagatttcggctccggtcaaaagaagagtgccgtgtttaccatgatgctcttgccaaaattaactggacatgtgcagatttgacaactgatagggtcacctgtgacgatgaggaggagcgagcaagccgcaaggtgctgcgtggctgctcccgcgccacgtcctgcgccggctgcatgaagtgcgtctgcttcgggtgcgagacctgccgcttcaaggactgcgactgccagacctgcgtcgacttctaccgcaactcggagtcggaaggaataacagggaggacctaacaccattcgttccattggccaggacaccaaaaatggcttccgccagggtaaaccggaggcttttagccttcagctgatcgatgccctcatcaaccaacatattgggacagggcaggccgttattctgaacaatcccgttctctcattttccatggctggcgttcgtggagtagcgaagggcgccagccaattttgctacatagtacaatttaccaacacttctcctcaaaaaaaaaaaaaaaaaaaa

SEQ ID NO: 8846 - protein, 242 aa, Panicum virgatum
  misc_feature: Ceres CLONE 2019705
  misc_feature: Great-hit functional homolog of the protein sequence given in SEQ ID NO 9711
  misc_feature: Useful for making plants with modulated nitrogen use efficiency
MAAANGGAGAALFSEEELREVSGVRRGEDFVEMTCGCTSHRYGDAVGRLRVFASGDLEVSCECTPGCREDKLTPAAFEKHSGKETAGKWRNTIWVMVQGEKVPLSKTALLKYYYLAHKSSNGSHKGRNGRPSHRDEFIRCTRCGKDRRFRLRSKEECRVYHDALAKINWTCADLTTDRVTCDDEEERASRKVLRGCSRATSCAGCMKCVCFGCETCRFKDCDCQTCVDFYRNSESEGITGRT

SEQ ID NO: 8847 - DNA, 1048 bp, Panicum virgatum
  misc_feature: Ceres CLONE 2019768
  misc_feature: Encodes the peptide sequence at SEQ ID NO. 8848
gtacttgggacgttgaaaacatggctgacaagaaaatcgttgccgtcacaggagctagtggatatgttgcaggggaactgattaaacaactccaagataaaggatacactgtacgtggaactgttcgttctctcaaggaccaagttaaaaccaaacaccttcttgattccttcccaaaccttcaattatttgaagcagatctcctgatccctggctccttcgacgagtgcttcaaaggagttcacgcagttatgcacactgcttctccatttcaacttgtaaatattactgatccccaaaaggaattaattgaccctgctgttaatggtaccaagaacgttcttgcttcagttgagaagtacttggacacaattaaatttgttgttgttacatcatctgttgctgctgttgttcaacagaacactgctgattatcctgctgataaggtttggactgaagcagactttaatacaacatctacacttacagcgggaccatacagattgtcaaaatatctcgcagaacaggctgcttgggattgggccaagggtaaaactggggttaaattaactacagttaatccttcattcgttatgggaccaccacattctgcaagaacggatgcaaccagcattggaacaatccttctcatgatgaacggaggaatgtcagcttccggagcaccaccatccgcattcggagtcgttgacgtaagaaatgttgcccaagcacatatcgcttgtatcgagaacccaaatgcaagtggaagatatattacatcatcaacagatgcttatcctcaattggctttggctcaatttttaaaagctgaatttccagattatcctcttcccgaaaaacaaaatggagaggttgcttattctccaaagatgtctaatgaaaaggcaagaaaggaattaggaattgaatttattcctgttaaacaaacaatgattgatatgggtcatgctctaatcaaatttggtttggttaacaaacctaatcctcaataaacgataatttggtttaaaaaaaaaaaaaaaaaaaa

SEQ ID NO: 8848 - protein, 330 aa, Panicum virgatum
  misc_feature: Ceres CLONE 2019768
  misc_feature (1)..(125): Pfam Name: Epimerase Pfam Description: NAD dependent epimerase/dehydratase family
MADKKIVAVTGASGYVAGELIKQLQDKGYTVRGTVRSLKDQVKTKHLLDSFPNLQLFEADLLIPGSFDECFKGVHAVMHTASPFQLVNITDPQKELIDPAVNGTKNVLASVEKYLDTIKFVVVTSSVAAVVQQNTADYPADKVWTEADFNTTSTLTAGPYRLSKYLAEQAAWDWAKGKTGVKLTTVNPSFVMGPPHSARTDATSIGTILLMMNGGMSASGAPPSAFGVVDVRNVAQAHIACIENPNASGRYITSSTDAYPQLALAQFLKAEFPDYPLPEKQNGEVAYSPKMSNEKARKELGIEFIPVKQTMIDMGHALIKFGLVNKPNPQ

SEQ ID NO: 8849 - DNA, 1014 bp, Panicum virgatum
  misc_feature: Ceres CLONE 2019774
  misc_feature: Encodes the peptide sequence at SEQ ID NO. 8850
atctcgggccgcttcattcggattctgtgcccttccacaggcgacctgctgacactctttaaatacagcagtgcccgtgccttctccatcaagacgcccttcgacgtcaaccacaacatcacacatcatcaaacatggcgctgaagcgtattaacaaggaactcgccgacctcggccgtgacccgccctcttcgtgctccgcaggaccgactggcgatgatctcttccaatggcaggcgacgatcatgggtccgggtgactccccatatgctggcggcgttttcttccttcagatcacgttccctaccgactatcccttcaagcccccaaaggttcatttcacgacccgcatctatcaccccaacatcaacgcaaatggcagcatctgcctcgacatcctacgcgaccagtggagccctgccttgaccatctcgaaggttcttctctccatctgctcgatgttgaccgacccgaaccccgatgacccgcttgtccccgagattgctcacgtatacaagaccgagattgcgaagtatgagcagacagcgcgcgaatggacccggaagtatgctgtctaacggttgcaaaccgggggttttgcgtcggtctgactgcggttgatcgtactggtttctggggcgcttagcgtggttcaacggccggctcgggttctacatcccgggataatctggcattttggacttcgcggctggggggtagtttctgggagttctgagaaggcgcgagggatatccacggtaccatttatcatgcgggattgattggagtgatatgggattggcagaagcaccacggtttggcagcatcctcccgaatcattcatactgcatcacctagcctgggaaccggaagggttcggtcactacacgcaaccctctttgactatccgtcgccgcttggaacctaacgtgtgatcctacctacttacctggattgctgggagaaaatccaatcattaatacatcatgtccataaaaaaaaaaaaaaaaaaaa

SEQ ID NO: 8850 - protein, 147 aa, Panicum virgatum
  misc_feature: Ceres CLONE 2019774
  misc_feature (1)..(147): SWISSPROT Homolog: EC 6.3.2.19 Ubiquitin-conjugating enzyme E2 4
  misc_feature (1)..(147): SWISSPROT Homolog: EC 6.3.2.19 Ubiquitin-conjugating enzyme E2-16 kDa
MALKRINKELADLGRDPPSSCSAGPTGDDLFQWQATIMGPGDSPYAGGVFFLQITFPTDYPFKPPKVHFTTRIYHPNINANGSICLDILRDQWSPALTISKVLLSICSMLTDPNPDDPLVPEIAHVYKTEIAKYEQTAREWTRKYAV

SEQ ID NO: 8851 - DNA, 1112 bp, Panicum virgatum
  misc_feature: Ceres CLONE 2019792
  misc_feature: Encodes the peptide sequence at SEQ ID NO. 8852
gcagcaacacacattagctagtgtggaaacagcacgcaagcaattcagtcttctctcactccctgcttgcttgcatcacattcacattcacattcaattcatatagagcagcaggtaggacatggatgcaggcggcctgagccccgcgcggcacgcggcggcggagccggtgcggtcgcggtggacgcccaagccggagcagatactcatcctcgagtccatcttcaacagcgggatggtcaacccgcccaagaacgagaccgtccgcatccgcaagctgctcgagcgcttcggcgccgtcggcgacgccaacgtcttctactggttccagaaccgccgctcccgctcccgccggcgccagcgccagctgcaggcggccgcggcagcaggctcctcgtcctcgtcgggcggcgccggcctcgcgccggcctcagcggcctcgtcatcgacggggatgttcgcccacggcgcggcgtacggctcgtcgtccgagtccgtgtcgtggccgccgccgtccgcggggatgatgggggacctggacagcgggggcggtgacgacctcttcgccatatcgcggcagatgggctatgcgaacggcggtggctccggctcggcggccatgacgtcgcagcagcagcggcagcggcagctttactactcgtgccagccagcagggagcatgacgacggtgttcatcaatggcgtggcgacggaggtggcccggggcccgatcgacctgcggtccatgttcgggcaggatgtgatgctggtccactccaccggcggcatcctccccgtcaacgagtatggaatcctcatgcagagcctgcaaatgggcgagagctacttcctggtgacgaggggctagctagcgctaccactgcatgcatgcacattcttagtatgatcgagaggctatatgtatagagaggaattcaggcatgaatataatgatagatacgggcagttattagtactactctatacaaggatgggtactgtagcagcagcagggatgacgacatgcatgatacagagttaagcatgcaagagtagcgtagtataaatatatatacgcacattatttattggaaaaaaaaaaaaaaaaaaaa

SEQ ID NO: 8852 - protein, 248 aa, Panicum virgatum
  misc_feature: Ceres CLONE 2019792
  misc_feature: Great-hit functional homolog of the protein sequence given in SEQ ID NO 9278
  misc_feature (1)..(62): Pfam Name: Homeobox Pfam Description: Homeobox domain
  misc_feature: Useful for biocontainment applications
  misc_feature: Useful for making plants with modulated biomass
  misc_feature: The plant is abnormally small.
  misc_feature: The plant produces a reduced number of seeds.
MDAGGLSPARHAAAEPVRSRWTPKPEQILILESIFNSGMVNPPKNETVRIRKLLERFGAVGDANVFYWFQNRRSRSRRRQRQLQAAAAAGSSSSSGGAGLAPASAASSSTGMFAHGAAYGSSSESVSWPPPSAGMMGDLDSGGGDDLFAISRQMGYANGGGSGSAAMTSQQQRQRQLYYSCQPAGSMTTVFINGVATEVARGPIDLRSMFGQDVMLVHSTGGILPVNEYGILMQSLQMGESYFLVTRG

SEQ ID NO: 8853 - DNA, 587 bp, Panicum virgatum
  misc_feature: Ceres CLONE 2020010
  misc_feature: Encodes the peptide sequence at SEQ ID NO. 8854
atgtctctctctcggcattctcccttcctagcttagtttcgcttctcgcgatcgccatgggcacctcttcccgccgcaatgccaccacagcggaggcgctgcttcttgcactgatgctgtcgtcgtcggcagcgcgggcggcggccgccgacccggggttctcgtgcggcccgtcgtcgccgtcgcggtcgctcccgttctgcgaccggtcgctcccggcggcgcggcgcgcggcggacctggtgtcccggatgacggtggcggagaaggtgtctcagatgggggacgaggcggcgggcatgccccggctgggcgttccgccgtacaagtactggtcggaggggctccacgggctggccttctggggccacggccttcggttcgaaggcgccgtccggggggtcaccagcttcccgcaggtgctcctcaccgccgcctccttcgacgagggcctctggttccgcatcggccaggtgagcacgccgcctacttggaatgtgtttgtgtggactcacctttagttagaccaattaatgtgatatgtcatctagttctagcacttcatttcaaacgccttctatatacag

SEQ ID NO: 8854 - protein, 154 aa, Panicum virgatum
  misc_feature: Ceres CLONE 2020010
  misc_feature (1)..(61): Pfam Name: Glyco_hydro_3 Pfam Description: Glycosyl hydrolase family 3 N terminal domain
MGTSSRRNATTAEALLLALMLSSSAARAAAADPGFSCGPSSPSRSLPFCDRSLPAARRAADLVSRMTVAEKVSQMGDEAAGMPRLGVPPYKYWSEGLHGLAFWGHGLRFEGAVRGVTSFPQVLLTAASFDEGLWFRIGQVSTPPTWNVFVWTHL

SEQ ID NO: 8855 - DNA, 1370 bp, Panicum virgatum
  misc_feature: Ceres CLONE 2020246
  misc_feature: Encodes the peptide sequence at SEQ ID NO. 8856
tctttcgcttcagcagctgaggcaaccagtctctttgcgggggagcgagagcagaaaggaacccaagaactgtggagagagtgtgagcatggcgggggatggcgacggccgcgcgggccttcctcggatcgcggtgctcggcgccggcatcttcgcgcgcacgcagtacatccccaggctccgcgagatcgcgcacctcgtcgtcctcaaggccatctggagccgcacccaggaatctgcaaaggcggccgcggagctcgctcgcgactttgcccctgagatcgagtgcaaatggggtgatgcggggctaaaggagatcatgagagacagttcaatcatgggcgtcgccgttgttcttgctgggcaagtccaggttgagctttccctaaagatgctgaaggcaggaaagcatgtgattcaagaaaaacctgcttctgcatcaacaacagaagcagaaaccgcactttcaatttacaattcatttccaaatcagtttccatataaaccaatttgggctcttggagaaaactacagatttgaacctgcctttgtggagtctagcaagttgatcaaagatatcggtgatatgatgcacatccaagttatcattgaaggatcaatgaacagttcaaacccatatttcaatagctcctggagacgaaattttgtgggtggtttcattctggacatgggtgtccacttcattgcaggactacgaatgcttgtaggttcagaaatcacaagtgtatcatctgtctcccgtcatatggatatggctttgccgccaccagataacatatgttcccttttccaactggaaaatggatgtgctggtgtttttgtatttgcagtcaattcaaggtcaccaaagatactatggcgggtcgatggaacgaaaggaacaattcaagtagaacgtggagttgatagtgggaaacatggttaccaggtgttattctctggtgaaaacgggcagtgccagaagacattttacccgttctgtggagtgaatgaagaactgaagatgtttatccaggacatgttggcagctagcaaagatggagaccataatgctgaaccccgcagttcttatgtcgagggtgcccgtgatgttgccgtgctagaagccatgctagaatctagtgcgaagcaaggagccccagttcaagtgaagagatttccatagatgtgaattatcacacaaaatactttcttctagcgtgattgtccactggaacagcatgaattcatgatagtaaaatgaacactgctccatcttccaacttcataccatttatggtacagaatgctaaaatggtagacctagaatcagcattctttcactcagtcaaaaaaaaaaaaaaaaaaaa

SEQ ID NO: 8856 - protein, 365 aa, Panicum virgatum
  misc_feature: Ceres CLONE 2020246
  misc_feature (1)..(98): Pfam Name: GFO_IDH_MocA_C Pfam Description: Oxidoreductase family, C-terminal alpha/beta domain
  misc_feature (1)..(103): Pfam Name: GFO_IDH_MocA Pfam Description: Oxidoreductase family, NAD-binding Rossmann fold
MAGDGDGRAGLPRIAVLGAGIFARTQYIPRLREIAHLVVLKAIWSRTQESAKAAAELARDFAPEIECKWGDAGLKEIMRDSSIMGVAVVLAGQVQVELSLKMLKAGKHVIQEKPASASTTEAETALSIYNSFPNQFPYKPIWALGENYRFEPAFVESSKLIKDIGDMMHIQVIIEGSMNSSNPYFNSSWRRNFVGGFILDMGVHFIAGLRMLVGSEITSVSSVSRHMDMALPPPDNICSLFQLENGCAGVFVFAVNSRSPKILWRVDGTKGTIQVERGVDSGKHGYQVLFSGENGQCQKTFYPFCGVNEELKMFIQDMLAASKDGDHNAEPRSSYVEGARDVAVLEAMLESSAKQGAPVQVKRFP

SEQ ID NO: 8857 - DNA, 1024 bp, Panicum virgatum
  misc_feature: Ceres CLONE 2020420
  misc_feature: Encodes the peptide sequence at SEQ ID NO. 8858
agccgagctgaggcccctcatccagtagaatggcgagtttaccacggcagacgacgaccctgacgggcttggctctcgggctagtggcgttcctctgcgccgccggcccgtgctcggggagcggcggcgcgtccgtgcccagcgtcgtcaccgaggcgttcttcaacggaatcaagtctcaggccggggacgagtgcgagggcaagaacttctacacgcggggcgcgttcctgagcgccgccggctcgttcccgggcttcgcgcgcggcggctcggagggcgacggcaagcgcgaggtcgccgccttcttcgcgcacgccacgtacgagaccggacacttctgctacatcagcgagatcaaccgggcgaacgtgttctgcgacacgagcagcaggcagtggccgtgcgccccggggaagaagtactacgggcgcggcccgctgcagctgtcgtggaacttcaactacgggccggcgggggagagcatcggcgtcgacctgctgcgggacccggaccgggtggcgaaggaccccgtggtctccttcaaggcggcgctctggtccttgatgagcagcgcgcaccaggccgtgccgcgggggttcggcgccaccgtcggggccatcgacggcggcctcgcgtgcggcgggaggaaccccgcccaggtgaacgcgctggtgggctactacaggcggtactgccagcagctcggcgtcggccccggcaataacctcacctgctaggcgtgccgcgtccatggatggatggattgatggatgcttggctcgtgacctcgtgtgaagaataaatcgcctgacggctgaagtagggaaggtgaagaaaccgggaggttcccgagtgcgtactagtaatactagtagaaatcaaaataatgcacagttgggacgatgttattctacctgaataacgtagcatttgcaatgcgcagcagaggggcatgaacgcttggcatcaggccatcacaataataacgaccaaacgtgtcgaaaaaaaaaaaaaaaaaaaa

SEQ ID NO: 8858 - protein, 236 aa, Panicum virgatum
  misc_feature: Ceres CLONE 2020420
  misc_feature (1)..(198): Pfam Name: Glyco_hydro_19 Pfam Description: Chitinase class I
  misc_feature (23)..(236): SWISSPROT Homolog: EC 3.2.1.14 Basic endochitinase CHB4 precursor
  misc_feature (26)..(236): SWISSPROT Homolog: EC 3.2.1.14 Endochitinase A precursor
MASLPRQTTTLTGLALGLVAFLCAAGPCSGSGGASVPSVVTEAFFNGIKSQAGDECEGKNFYTRGAFLSAAGSFPGFARGGSEGDGKREVAAFFAHATYETGHFCYISEINRANVFCDTSSRQWPCAPGKKYYGRGPLQLSWNFNYGPAGESIGVDLLRDPDRVAKDPVVSFKAALWSLMSSAHQAVPRGFGATVGAIDGGLACGGRNPAQVNALVGYYRRYCQQLGVGPGNNLTC

SEQ ID NO: 8859 - DNA, 919 bp, Panicum virgatum
  misc_feature: Ceres CLONE 2020425
  misc_feature: Encodes the peptide sequence at SEQ ID NO. 8860
acacatcgcatcatcactgcaagtacaaaagcagcagccacacgtatactcacaactcactctgagctcctccaaagctcgtgccatcgagtcattccgagggatcgatcgatcgagatcatggcgggtctgagggtgcagatgaggctgctcgccgcggccgtggccgtggtggcgctggcctcgccggcggcggtggtgtccgggcagcaggtcgcggggccgctggggtgcacgacgtcgctggtcaccagcttcgccccgtgcctcaacttcatcatcaacagcacggcgtccccgacggccgactgctgccgctccctgggggcgctgatgaaggcgagcaacggctgcgcctgcctcatcctcaccggcagcgtgccgctcggcgtgcccgtcaaccggaccatggccgtcacgctgcccagggcctgcaacaacgcctccgtccccctgcagtgccaagacgcgacgacgtcggctcagaccccggctccgggtcccgtggcggacgcgcctgctccctccttcttggccccgctgccacctgtggcggcggcgccggtggcaacgcccgtgcctgaagcgccggcgccggggacggcgacggcgacgcctgtgttggagcccacgaacacgccgccggtcagccagggggagacgaggccgacggttgtgtacagctctgcctggaggagggcgagcgcccacgtgtccgcggggcctgcggccgctgtgttgctatttgcagtagctggagccgccctggtgtgaactgtgtgatcacctagcagtggttaactgaataagcgttggaatttatttggtgatttttttagcagcagattggtacaggggttgtatacatatttgtttgttcatcgcgatttggagttctgaaaaaaaaaaaaaaaaaaaa

SEQ ID NO: 8860 - protein, 217 aa, Panicum virgatum
  misc_feature: Ceres CLONE 2020425
  misc_feature (1)..(89): Pfam Name: Tryp_alpha_amyl Pfam Description: Protease inhibitor/seed storage/LTP family
MAGLRVQMRLLAAAVAVVALASPAAVVSGQQVAGPLGCTTSLVTSFAPCLNFIINSTASPTADCCRSLGALMKASNGCACLILTGSVPLGVPVNRTMAVTLPRACNNASVPLQCQDATTSAQTPAPGPVADAPAPSFLAPLPPVAAAPVATPVPEAPAPGTATATPVLEPTNTPPVSQGETRPTVVYSSAWRRASAHVSAGPAAAVLLFAVAGAALV

SEQ ID NO: 8861 - DNA, 1268 bp, Panicum virgatum
  misc_feature: Ceres CLONE 2020446
  misc_feature: Encodes the peptide sequence at SEQ ID NO. 8862
gcctcgcctaaaaatcccggtcgctctcgcagtctcgctgtcctcaagctccagctcccccaacccccctcgcctcggcggccgcccaaaaccctaaccctagcccgcccccctgcccgagctccggcgccggggacatggacggcggcggcacgccccgcacgccggaggacgtgttccgggacttccgcgcgcgccgggccggcatgatcaaggcgctcaccaccgacgtggagaagttctaccagcagtgcgacccagagaaagagaatctgtgtttgtatggccttcccaatgaaacatgggaagtgaacttgcctgcagaagaggttcctcctgaacttccagagccagctctaggaattaattttgcacgtgatggaatggaggagaaagattggttgtcacttgtcgccgtacatagtgatgcttggctgctggctgtggcattttactttggagcaagatttgggtttgacaaagaatccaggaagcggctctttgtcatgattaataacctccctaccatatatgaggttgtcacaggaactgcgaagaagcaaaccaaagaaaaaactccgaaaaacagcagcaagagcaataaatctggcacaaaaccaccacggcaaccagaacccaactcaatgggttccaagatgccacctccaaaggatgaggatgacagcggaggcgaggaagatgaggaagaggatgatcatgaaaacacattgtgtggttcatgtggcgacaactatggacaggacgagttctggatatgctgtgatgcctgtgagacatggttccatggcaaatgtgtcaagatcactcccgccaaagccgagcacatcaagcactacaagtgtgcgaactgcagcggtagtagcaagagagcccgagcatgatcctggtgggtatatccattgctcatgcctgtagaaccaagaggttgactcgctgtaaaacatccgcatgggaccgactgcccccatggtttcgcattcagtcgttgctttcagtgtaggaccagctgtagggtcttcatcttgatgtgctgtttgttgtatgtcaaagacattctagatcttctgttgttagtaactagcaactaactgtagtagcctgtatttcttcaagcttctcccagcgcgcctgtattggatttgggaatagctttagatctcagttgtgcattatgtatcaccatgtactcatgttagttcgttaaaaggttgtgtgctgctatttcccaaaaaaaaaaaaaaaaaaaa

SEQ ID NO: 8862 - protein, 254 aa, Panicum virgatum
  misc_feature: Ceres CLONE 2020446
  misc_feature: Great-hit functional homolog of the protein sequence given in SEQ ID NO 9570
  misc_feature: The sequence is a functional homolog of  SEQ ID NO 1981 in the  11/479,226 US patent application
  misc_feature: Useful for making plants with altered alkaloid content
  misc_feature: Useful for making plants with modulated growth and phenotype characteristics
MDGGGTPRTPEDVFRDFRARRAGMIKALTTDVEKFYQQCDPEKENLCLYGLPNETWEVNLPAEEVPPELPEPALGINFARDGMEEKDWLSLVAVHSDAWLLAVAFYFGARFGFDKESRKRLFVMINNLPTIYEVVTGTAKKQTKEKTPKNSSKSNKSGTKPPRQPEPNSMGSKMPPPKDEDDSGGEEDEEEDDHENTLCGSCGDNYGQDEFWICCDACETWFHGKCVKITPAKAEHIKHYKCANCSGSSKRARA

SEQ ID NO: 8863 - DNA, 1373 bp, Panicum virgatum
  misc_feature: Ceres CLONE 2020449
  misc_feature: Encodes the peptide sequence at SEQ ID NO. 8864
atggatgatacatcgttcaagccgcgcaacctgggcgcctcgctgcccgtacccaacgtccaggacctcgccgcgcgccccgcctgcctcgaccaccacgtcctccaccgctacctccgcgacgacgacgacgctccggcggctctgtcgccgtcgtctaccaactacgccgcagcacttgctgccgcctcctcctcggttcccgtcgtggacctcgccaggctgctcgacccggcccacaccgacgacgaggccgcgaggctgcgggccgccggcgaggactggggcttcttccacgtggccaaccacggcgtggccgacgaggtcatccacgacgtcaaggaggacatcaaggccttcttccggctcccgctggccgacaggcaggccctggcgcagggccccgccggcatcgagggctacggccaggccttcgtcgtctccgaggaccagaagctggactgggcggacatgctcttcctgtccacgcagccgcccgagtaccgctccctcaacttgtggccgtcccgccccgccacgttcagggactccctccaccgctactccctggcggtgcagcgggtggccacccacatgctcgccgccatggccaggaacctgggcctgctagtggatcatcaggacacagccgccgggaacgggaagaatcagatgacggccatcgccgccgcgcaggccatgcggatcaactactacccgccctgcccgcaggcgcacgacagggtgctgggcctgtcgccgcactcggacgccgtcgggctgacgctgctgctgcaggtgagccccgtgcccggcctgcagatccggcgtgggggcgcctggatccccgtggagccgctgccgggggccctcgtggccaacgtcggcgacgtcatcgaggtgctcaccaacggcaggtacaagagcatcgagcacagggcgttggtcaacgccagccaggagcgggtctccgtcgccgccttccactccgccaggttcgacggcacctacggccccatccaggagatcatgcgccccggcgaggcgccgctctacaggaccatcgccgtcgaggactacgtcaagctcctgctgtccaacaagcttcagggcaagagctccaccatcgacgccatgaagatcaactgaatgaaattaatggcctggtttcatgcatacagcagcaactgaatgtgcgtgtctcatcagaacactttaattatacagatttgcagtggatttagatgagagaggagagagtatccatgtcaaaaattgttacagtatctttctactatatactatcatgtatcaccccccaaataattaaaaaaaaacttgtttcgtttggtcaaaaaaaaaaaaaaaaaaaa

SEQ ID NO: 8864 - protein, 225 aa, Panicum virgatum
  misc_feature: Ceres CLONE 2020449
  misc_feature (1)..(103): Pfam Name: 2OG-FeII_Oxy Pfam Description: 2OG-Fe(II) oxygenase superfamily
MLFLSTQPPEYRSLNLWPSRPATFRDSLHRYSLAVQRVATHMLAAMARNLGLLVDHQDTAAGNGKNQMTAIAAAQAMRINYYPPCPQAHDRVLGLSPHSDAVGLTLLLQVSPVPGLQIRRGGAWIPVEPLPGALVANVGDVIEVLTNGRYKSIEHRALVNASQERVSVAAFHSARFDGTYGPIQEIMRPGEAPLYRTIAVEDYVKLLLSNKLQGKSSTIDAMKIN

SEQ ID NO: 8865 - DNA, 623 bp, Panicum virgatum
  misc_feature: Ceres CLONE 2020702
  misc_feature: Encodes the peptide sequence at SEQ ID NO. 8866
aagtgtgacccacgttcctcatcgctagagacggagatgcggggagtcgggggtccgctcctcaccatcggggatctcctcagcgacctcgccgtcgacggcggcgatgatcccgtcgccgctggcggagatgcgtctgttccctcctctccctcggcggcacaacaggcgtgggaagccgacccgtccgacctcagccggctcttcgaggaacactacaacaatttgatgaaggcgctccaagagaacgatccttcatggccatcgctgatgctgaagctatgcgcggcgttgaaggcggcagataagagggtgagttccgcgaacacagatgttgagcagttgatggagaaggtgaaagtgctggagggtgtcctcgagagaggagatcgcccggtggaacagattgtagaaagtctccagaggtcaggcctcgccaaggatcatcggagttcccaatcaaaatcgactagcaagtagtggcataggttgtgctcttatgtttgtgttgcaaatgtgagctcttgtcactgaccgtgggtactgaaaagagttgtatgtatatcgacctttgttcatgaaccctacagtctgcttgtgctttagatctattggaaccttgg

SEQ ID NO: 8866 - protein, 147 aa, Panicum virgatum
  misc_feature: Ceres CLONE 2020702
  misc_feature: Great-hit functional homolog of the protein sequence given in SEQ ID NO 9314
  misc_feature: Useful for biocontainment applications
MRGVGGPLLTIGDLLSDLAVDGGDDPVAAGGDASVPSSPSAAQQAWEADPSDLSRLFEEHYNNLMKALQENDPSWPSLMLKLCAALKAADKRVSSANTDVEQLMEKVKVLEGVLERGDRPVEQIVESLQRSGLAKDHRSSQSKSTSK

SEQ ID NO: 8867 - DNA, 1410 bp, Panicum virgatum
  misc_feature: Ceres CLONE 2020704
  misc_feature: Encodes the peptide sequence at SEQ ID NO. 8868
atgtatcgaagcaaaccaagcaaaagaaaattccagaattgatccatagagcaatggcggctcaagctcaaactgtagtccccactgacgcggagctcgtgcaggcgcaggctgacctgtggcgccacagcctatactacctgacgtcaatggcactgaagtgtgccgtcgagcttaacatccccacagcgatccaccgcctcggtggggctgcaacacccactgacctgatctctgcactctctctcccagctgctaagctgccgttccttcgtcgtctgctgcggctcttggccgcctcaggcgtgttcagtgtcgacaggagcgcagaggaggggaaatactgcatcaaccccgtgtcctacctcttggtggatggcatccctgacgaggtgcacatcaaccacacgtccttcgtgctcacggccacctcgacacgctacgtcgatgcggccatgggcctggctgactggttcaagaaggatgtggtgacaccaccattcgaggagctgcatggagcaactttgttccacgagagtatggagagcctcgacgccgatttccacaagatggcgaatgaagcattggaagcccacgacaactttgggatcccgattgcgctgcgggagttccgtgatttgttcaacgggattcagtcggtgacttactgctgcagtggctctggtgatgatgcagctgccagggccattgtcaaggccttcccacacataaagtgcacggtgctggtcgatcccaagatgatgattggcaccaagtcatctgatgatggtctcataagctatgttgcaggtgacatgctcaacttcatcccaccggctcaaactgtggtgctaaagtttgtgctgcattttctgaccgacgaggattgtgcgaaaatcctagcccaatgccgaaaggcaattccttcacgaaaggatggtggaaaagttatcattgctgatattgtaattgactataattctcctgggccaatgttggaagctcaactgttagtggacattggctttatgacgatgactaaaggacggcaacgcgacgaaaatgaatggcgtcagattttcaagaatgcagggttcactgactataagcttctaaagaaatttggagctcgaagtgtctttgaggtctatccataaggttgcmccggggcttggcatgctgatgtactagttaaataaagctcccagacaatgcagctgagccgacagtcttgcatgcttccttatgatccgtgtagaacttttatttggaaaagtatcagtgcatctgatgaaaacagcaaactaatatttccaaaacaggtggcgtcattggatagtttgtactatgtacctttttttaatttatgagcaatgttatcataatatatcgtggcagtatgttgcttgc

SEQ ID NO: 8868 - protein, 367 aa, Panicum virgatum
  misc_feature: Ceres CLONE 2020704
  misc_feature (5)..(257): Pfam Name: Methyltransf_2 Pfam Description: O-methyltransferase
MAAQAQTVVPTDAELVQAQADLWRHSLYYLTSMALKCAVELNIPTAIHRLGGAATPTDLISALSLPAAKLPFLRRLLRLLAASGVFSVDRSAEEGKYCINPVSYLLVDGIPDEVHINHTSFVLTATSTRYVDAAMGLADWFKKDVVTPPFEELHGATLFHESMESLDADFHKMANEALEAHDNFGIPIALREFRDLFNGIQSVTYCCSGSGDDAAARAIVKAFPHIKCTVLVDPKMMIGTKSSDDGLISYVAGDMLNFIPPAQTVVLKFVLHFLTDEDCAKILAQCRKAIPSRKDGGKVIIADIVIDYNSPGPMLEAQLLVDIGFMTMTKGRQRDENEWRQIFKNAGFTDYKLLKKFGARSVFEVYP

SEQ ID NO: 8869 - DNA, 1417 bp, Panicum virgatum
  misc_feature: Ceres CLONE 2020736
  misc_feature: Encodes the peptide sequence at SEQ ID NO. 8870
accccgtaggccccgccgaacgcccgaacccctccctcatgcacccgcaccctcgctcttgtggcaatgtcgcccgccgccaccaccttgttcgccgccgcagccaccgtcgcggcgcccaccgccccgttccgcgcctgcgtccgacttccgctccgcgggggccccggtgcccctcgccgcgccgtcacctcgatggccgtttccaccccgaggtccgccgccgccgcctcgttcctcgagcgccgcgggtccgagcgcgccctccacttcgtcaagtaccagggcctagggaacgacttcatcatggtggacaatcgggattcgtctgtgccgaaggtgactcctgaggaagcggcaaagctgtgcgaccggaacttcggcattggcgctgacggcgtcatcttcgtcatgccggggtccaatggcgcggactacactatgaggatcttcaactccgacggcagtgagccggagatgtgtggtaatggagtccgttgctttgctcggtttatagctgagcttgagaacctgcagggaacgcatagcttcacgattcatactggtgctggactgatcattcctgaaatacaaagtgatggccaggtaaaggttgatatgggcgagcccatcctttctggaccagacatccccacaaaactgctagctaccaagaacaaagctgttgtccaagctgaattggatgtcgagggcagaccatggcatgtaacatgtgttagcatgggcaaccctcactgtgtcacatttggtgcaaaggacttagaggtcttgcaggttgataatctaaaacttagtgaaattgggcctaaatttgagcatcatgaaatgtttcctgctcgaaccaacacagaatatgtacaggttttgtctcactcacacctcaaaatgcgagtttgggagcgcggtgctggagcaactctcgcttgtggtactggtgcttgtgcagttgttgttgctgctgttcttgagggccgagctgagcggaaatgcgtagttgatttgcctggcggaccattgaaaatagagtggagggaggatgacaatcatgtttacatgactggtccagcagaggctgtcttttatggatctgttgctccctaggtactggggaccaagacagaagggttagctacccactgagagcttgtgagattggttaaacagaatgttctggtaccagtacacctgtttcagatattcttaattatggtttcttaatttgggcagcattaaaggctttattgtcaagtattctagtgctgttcaccttttgtactcttactctgtcaggtttgaacactacattggtagcatacctgccgaaccattttctgtttcttttctttggcaataagcggatgtcaatgcatagtttcaaaaaaaaaaaaaaaaaaaa

SEQ ID NO: 8870 - protein, 351 aa, Panicum virgatum
  misc_feature: Ceres CLONE 2020736
  misc_feature (1)..(123): Pfam Name: DAP_epimerase Pfam Description: Diaminopimelate epimerase
  misc_feature (66)..(347): SWISSPROT Homolog: EC 5.1.1.7 Diaminopimelate epimerase
  misc_feature (66)..(349): SWISSPROT Homolog: EC 5.1.1.7 Diaminopimelate epimerase 2
MSPAATTLFAAAATVAAPTAPFRACVRLPLRGGPGAPRRAVTSMAVSTPRSAAAASFLERRGSERALHFVKYQGLGNDFIMVDNRDSSVPKVTPEEAAKLCDRNFGIGADGVIFVMPGSNGADYTMRIFNSDGSEPEMCGNGVRCFARFIAELENLQGTHSFTIHTGAGLIIPEIQSDGQVKVDMGEPILSGPDIPTKLLATKNKAVVQAELDVEGRPWHVTCVSMGNPHCVTFGAKDLEVLQVDNLKLSEIGPKFEHHEMFPARTNTEYVQVLSHSHLKMRVWERGAGATLACGTGACAVVVAAVLEGRAERKCVVDLPGGPLKIEWREDDNHVYMTGPAEAVFYGSVAP

SEQ ID NO: 8871 - DNA, 716 bp, Panicum virgatum
  misc_feature: Ceres CLONE 2020770
  misc_feature: Encodes the peptide sequence at SEQ ID NO. 8872
atcacaggcgcttagcaataatcgagttatttctgctctaatttgcgcgtgtgctccagtaatttcagcagagcaaaaaatggcaggaaaggcctcggtcgcgctgttcctggccgtcaacatggtcgtgttcgccgtggccagcgccacctgcggtggcggctgccccacgccgtcgaccccgtcgacgccgaccccaacgccggcgtcgagaggcaggtgcccccgcgacgcgctgaagctgggcgtgtgcgccaacgtgctgggcctcatcaaggccaaggtcggcgtgccgccggcggagccctgctgcccgctgctggaggggctcgtcgacctcgaggccgccctgtgcctctgcaccgccatcaagggcaacatcctcggcatcaacctgaacctgcccgtcgacctcagcctcatcctcaactactgcggcaagaccgtgcccaccggcttcaagtgcctctaagctaccagacgctatgcatccatcgtggtttggtttgctatgtgctatacacgttctaagtatcggaagcttgcatgcactgtggggaggcaaaggatcggacgtgcgcacgcatgtatccgcgttcgatttgcttgtgttgttccgttgtcttatttattctggcatgtccctctctgagttatgtggatttttgttcatttacatttgcaaccgggattgtatgaataaaaatttgtttgct

SEQ ID NO: 8872 - protein, 130 aa, Panicum virgatum
  misc_feature: Ceres CLONE 2020770
  misc_feature (1)..(82): Pfam Name: Tryp_alpha_amyl Pfam Description: Protease inhibitor/seed storage/LTP family
MAGKASVALFLAVNMVVFAVASATCGGGCPTPSTPSTPTPTPASRGRCPRDALKLGVCANVLGLIKAKVGVPPAEPCCPLLEGLVDLEAALCLCTAIKGNILGINLNLPVDLSLILNYCGKTVPTGFKCL

SEQ ID NO: 8873 - DNA, 876 bp, Panicum virgatum
  misc_feature: Ceres CLONE 2020988
  misc_feature: Encodes the peptide sequence at SEQ ID NO. 8874
accgatccaaaccatcccgaagaagaagaaaaaatccccgatccagcacgcacagcgcggaccggcgggaaggagatcgcggcgggaggatgtcgtcggactcgtcgtcgtgggcgcgcgcgctcgtgcacatctcgccctacaccttcgccgccatcggcatcgccgtctccatcggcgtctccgtcctcggcgcggcatgggggatcttcatcacggggagcagcctcatcggggccgccatcaaggcgcccaggatcacctccaagaacctcatcagtgtcatcttctgtgaggctgttgcaatttatggtgtaatcgtggcaatcatcctccaaacaaagcttgaaagtgtgccaacatcccgaatgcatgatccagagtccatgcgagccggttatgcaatctttgcctcaggtctcattgttggctttgctaatcttgtttgcggggtatgcgtgggagtaattggaagcagctgtgcactgtctgatgctcagaattcaacactctttgtaaagatcctggtgattgaaatcttcggcagtgctttgggcctgtttggagtgatcgtgggcataatcatgtcagctcaagcaacatggccaacgaaagcctaagtccatccatctgggaatctgtaaattatattcggtgacacctttggtcaacatgtgttcaactacttatctatattcttttttcttttgcacatttttttggtaaatcacttcggtgctttgatgcacgtagagatactgttcctattgtaaagactccaggcctgccagctatcttgtaggtgctattgcttttgcagaacgtgggctgcgtattgaataagagcattgaactcaaaaaaaaaaaaaaaaaaaa

SEQ ID NO: 8874 - protein, 176 aa, Panicum virgatum
  misc_feature: Ceres CLONE 2020988
  misc_feature (1)..(66): Pfam Name: ATP-synt_C Pfam Description: ATP synthase subunit C
  misc_feature (12)..(169): SWISSPROT Homolog: EC 3.6.3.14 Vacuolar ATP synthase 21 kDa proteolipid subunit
  misc_feature (7)..(171): SWISSPROT Homolog: EC 3.6.3.14 Vacuolar ATP synthase subunit c''
MSSDSSSWARALVHISPYTFAAIGIAVSIGVSVLGAAWGIFITGSSLIGAAIKAPRITSKNLISVIFCEAVAIYGVIVAIILQTKLESVPTSRMHDPESMRAGYAIFASGLIVGFANLVCGVCVGVIGSSCALSDAQNSTLFVKILVIEIFGSALGLFGVIVGIIMSAQATWPTKA

SEQ ID NO: 8875 - DNA, 967 bp, Panicum virgatum
  misc_feature: Ceres CLONE 2021138
  misc_feature: Encodes the peptide sequence at SEQ ID NO. 8876
cccaaaccctaccagccgcggcagacgccagcccgccactccaggagcgacccgcgccctccccccttcctccctacgcaaggccgcaaccacgccggcacgctgcccctctccgatccacctcgcctgcagccgccgcaaaacccctcttagaacccaccgggagaaagcggaaaagcgggggaaacagagggcgatggcgtcgtcggagggggatacgaaccggctgtggcgcatccggcgcacggtgatgcagatgctgcgcgaccgcggctacttgatcaatgaggccgaggacatcggcctcaaacgggcggccttcgtggagaaatacggcgaccccgtcagccgcgaagccctcgccttcaaccgctccaagaaggacgagcccgcagaccagatctacgtgttcttcccgaacgaggccaagcccggcgtgaagacgatcaggaactacgtcgagaagatgaagcaggaaaaagtcttcgccggcatactcgtcgtgcagcaggcgctcagcgcgttcgcacgcagcgccgtacaggaggtctcccagaagtaccatctggaggtcttccaggaagctgagcttcttgttaacattaaggagcatgtcctggtgccggaacacgaggtcctgacaccggagctgaagaagcaagtgctagagcgatacaccgtgaaggaaacccagctcccccggattcagattacagacccaatagcaagatactacggcatgaagcgtgggcaggttgtgaagatcaaccgatccagtgaaactgctggaaaatacatcacctaccgctacgttgtctgagcttcccctacattctcatggcttgagcttctgccgtgaaccatcaccaagtgaaaatttccccctagcttctaatctcgctgtgtatttcgaaacattgttaccgctgagaagctgaagtgcctttaaaaaaaaaaaaaaaaaaaa

SEQ ID NO: 8876 - protein, 207 aa, Panicum virgatum
  misc_feature: Ceres CLONE 2021138
  misc_feature (1)..(74): Pfam Name: RNA_pol_Rpb5_C Pfam Description: RNA polymerase Rpb5, C-terminal domain
  misc_feature (1)..(90): Pfam Name: RNA_pol_Rpb5_N Pfam Description: RNA polymerase Rpb5, N-terminal domain
  misc_feature (1)..(207): SWISSPROT Homolog: EC 2.7.7.6 DNA-directed RNA polymerases II 24 kDa polypeptide
  misc_feature (5)..(206): SWISSPROT Homolog: EC 2.7.7.6 DNA-directed RNA polymerase II 23 kDa polypeptide
MASSEGDTNRLWRIRRTVMQMLRDRGYLINEAEDIGLKRAAFVEKYGDPVSREALAFNRSKKDEPADQIYVFFPNEAKPGVKTIRNYVEKMKQEKVFAGILVVQQALSAFARSAVQEVSQKYHLEVFQEAELLVNIKEHVLVPEHEVLTPELKKQVLERYTVKETQLPRIQITDPIARYYGMKRGQVVKINRSSETAGKYITYRYVV

SEQ ID NO: 8877 - DNA, 1413 bp, Panicum virgatum
  misc_feature: Ceres CLONE 2021155
  misc_feature: Encodes the peptide sequence at SEQ ID NO. 8878
actcttggcatcccggcggcggcgcgcgaaaggagaaggaggaggagcagcagcaggcggtgccgaagagcaagaatgcgccaccgcctgctccgccgcgcgatgccgctcccgccgccgacgcctcctgcgccccggacgccggggatcgccggcgggcgcctcttctcctcgctcccgccgccgccgccgccgccgccgctccagtcccgaagagaggtgcatgtttggtatcttttgcctgatgagttgaatgatgcctcccaactgaagatgtacatggatctcctttcgccttctgaaaggaagaatgctttatctatgaatacggagaagttgcagaaaggtgctgtgctgtcccgtgcactagtgcgcaccacactctccagatatacagattgcaaagttgatccaggatcatttgagtttaagaaaaacaaatttggcaaacctgagatactgtggcaatctgatgacaacaagatggaatggcctttgcatttcaatatttcacacacatcttctttgattgcctgtggcataaccatggataatcttattggcattgacattgaagagaagaaacgaaagacagccaagaatattttatctcttgctcgacgttatttcaccccatctgaagttgattatctagctcagattccggatcccgatgctcagcaaaaggaattcataaaactgtggactcttaaagaagcatacgtaaaagctcttggaaggggattttcaggtgctcctttcaataagttctcaatcgaaatggaagcaaagaacggaatccgaatttctgtggcaccaaaagtattcaaggattctgactctacttgtgactgtttgtccgagaattggcaatttgcacttgcggagctaaatagttctcattacatggcagtttgtgtaggggatgactcaagaagttcagaatctgggaatggtcggctacctctaggattgaaagtatggaagacttttcccttcctagaagatacacttgtttctggaacagaagctttgactcgtatcgtttgagtatgtgagagtctggtattggccttatgatttcaccagatgacaatgcgatacacaatgaattcatattttgaagaagtatgcagggcaactctcaacattcttcaagcattgattagctgattgcagacatcatgcattagcggggacttgggaaatacaattttcatagtccatattcagattatgactgttattagctgtagcctaccacgacaaactgtttcggaaggaataaactgtttgtactgttgcagaattatgtatcatttgaaaagatactagtaacatgtataggcttctataagtaacattggaaatagatcttgtagtatttcattgcaaaaaaaaaaaaaaaaaaaa

SEQ ID NO: 8878 - protein, 324 aa, Panicum virgatum
  misc_feature: Ceres CLONE 2021155
  misc_feature (1)..(68): Pfam Name: ACPS Pfam Description: 4'-phosphopantetheinyl transferase superfamily
MRHRLLRRAMPLPPPTPPAPRTPGIAGGRLFSSLPPPPPPPPLQSRREVHVWYLLPDELNDASQLKMYMDLLSPSERKNALSMNTEKLQKGAVLSRALVRTTLSRYTDCKVDPGSFEFKKNKFGKPEILWQSDDNKMEWPLHFNISHTSSLIACGITMDNLIGIDIEEKKRKTAKNILSLARRYFTPSEVDYLAQIPDPDAQQKEFIKLWTLKEAYVKALGRGFSGAPFNKFSIEMEAKNGIRISVAPKVFKDSDSTCDCLSENWQFALAELNSSHYMAVCVGDDSRSSESGNGRLPLGLKVWKTFPFLEDTLVSGTEALTRIV

SEQ ID NO: 8879 - DNA, 640 bp, Panicum virgatum
  misc_feature: Ceres CLONE 2021210
  misc_feature: Encodes the peptide sequence at SEQ ID NO. 8880
tcattcccccacagcacaacgcagctagacatccactcagctcacacactgcagctagcatttgcttagcttagcaggagcatcatatcgataataataatacaatgacaatggctttgatgatgaagaacaacaggatgcaggcggtggtggcgttggccgttgtcatggcagctgcggcgctggtggcgtcggcgtcggcggccatcacgtgcgggcaggtgggttcggcgctggcgccgtgcatcccgtacgcgacggggaaggcgagcgcgctgccgtcgtcgtgctgcggcggcgtgcgcagcctgaacagcgcggcgcgcacgagcgcggaccggcaggcggcgtgccggtgcctcaagagcctggccagcaccgtcaagtcggtgaacatgggcaccgtcgccaccatccccggcaagtgcggcgtctccgtgccattccccatcagcatgtccacagactgcaacaactgatcgacgatgacaagcttggtgacgtcgtccttcacaagatagctgctacgaggcagctatatatttaattaggaaaataaaataaagttgttatcaaggcatcagcatcatctatactattatgtatgtatgtatgtagtaattaaatgcatgttgtgctc

SEQ ID NO: 8880 - protein, 122 aa, Panicum virgatum
  misc_feature: Ceres CLONE 2021210
  misc_feature (1)..(86): Pfam Name: Tryp_alpha_amyl Pfam Description: Protease inhibitor/seed storage/LTP family
MALMMKNNRMQAVVALAVVMAAAALVASASAAITCGQVGSALAPCIPYATGKASALPSSCCGGVRSLNSAARTSADRQAACRCLKSLASTVKSVNMGTVATIPGKCGVSVPFPISMSTDCNN

SEQ ID NO: 8881 - DNA, 991 bp, Panicum virgatum
  misc_feature: Ceres CLONE 2021272
  misc_feature: Encodes the peptide sequence at SEQ ID NO. 8882
aaggaagataaattaagcagcgcgcagcaagcatgaacaagccgccggcgtacggccatggccagagcgacagcccctactgctgcttccaccccagggagctcgtcgtcggcgtctgcgcccactgcctcaaggaccgcctcctcctcctcctcgccaccaccaccaacaacgccgccgccgacggcaccctccgccgccgcaggactagcatcagcaccagcagcaacagcatctccctccccaaggtcttgtccttcctccagcgcctcgactcccggcaccaccgccgccccgacgctgcagccgacgactccgacggcaccacctccgccgcaagccccgatgattctttcatctccatcaagttcgaggacaccggcaaggcgacgtgggacagccacaagcaggccggcaatcccccggcaccggtgaggtcgtcgtcgtcgaccgcggtggtggtggagcacgtcgtcgtcaataacaagcggggcggcgtcaccatgaccaggtggcgcaagcaggtggtggggcggttgctgcagctggcgcgctggaagaggtcggcggtagggctggacggcaagaagcaggcggcgggggagcggtcgtccaaggtcaggggcggcagaagctggatccggagcctcacgcggaggccacccgccggcgacagggcgcggtcatgatcgctcatcgctagctctgaccgacgagctagatgtcttctcatctgcaagcaagcgcgcggctttacaagtgactgcttaatttgcctgttacatatacgagcgagtgtagaaaggatttttcctatatatatacaccagagagagaaagaggggtgacgacgacacatgtcgatgtggagcagatataatcatacactgcatgcatgcatgcatgtttatacgtggagtggagttgagtagtaaacaatgcaaggaaattaaaaagaagaactacttagcaaaaaaaaaaaaaaaaaaaa

SEQ ID NO: 8882 - protein, 218 aa, Panicum virgatum
  misc_feature: Ceres CLONE 2021272
  misc_feature: Great-hit functional homolog of the protein sequence given in SEQ ID NO 9738
  misc_feature: Useful for making plants with modulated biomass
  misc_feature: The rosette leaves do not appear in the normal fashion, i.e., their phyllotaxy may be abnormal or too many leaves may be emerging in comparison to the control.
MNKPPAYGHGQSDSPYCCFHPRELVVGVCAHCLKDRLLLLLATTTNNAAADGTLRRRRTSISTSSNSISLPKVLSFLQRLDSRHHRRPDAAADDSDGTTSAASPDDSFISIKFEDTGKATWDSHKQAGNPPAPVRSSSSTAVVVEHVVVNNKRGGVTMTRWRKQVVGRLLQLARWKRSAVGLDGKKQAAGERSSKVRGGRSWIRSLTRRPPAGDRARS

SEQ ID NO: 8883 - DNA, 1146 bp, Panicum virgatum
  misc_feature: Ceres CLONE 2021398
  misc_feature: Encodes the peptide sequence at SEQ ID NO. 8884
gtgctaggacttgggcccagtcgttctagcgaaacccgaaccgttcgttcgccgctccggcgaaggctgcccctacaccggcggaccggcctcgttcgccgcctcgtcggtcctccgcaacggctgctgcggcgacaaggagaaggagcctcagggtcatatccgcagcccctcgctccaccggtacggcggtaacagcctgtggttagcacccgacagagcgctcgcctgagggaggagagatccgccgctgggtccagccggctgacgatggaagcagcggcgagcggcaagcgcgcgtacagcatcatcgtgcccacctacaatgagcgcctcaacgttgccctcatcgtctacctcatcttcaagcacctcccggatgtgaactttgagatcattattgtggatgatggtagtccagatggaactcaggacattgtaaaacaactgcagcaagtatatggtgaagatcgtgttttactgcgagctagaccaaggaagctaggacttggtaccgcatatttacatggattaaagcatgcctcagggaaattcgttattatcatggatgcggacctatctcaccatccaaagtatttgccaagctttattaggaagcaaaaggaaactggtgctgatgttgtaactggcacacgttatgttaagaatggtgatgtccatggttggaatctcatgcgcaagcttactagcagaggagcaaatgttcttgcacaaacgttactacagcctggagcttcagatttaactggatcgtttaggctatataagcgagatgtactggaagatttaatctcctcatgcgtcagcaagggctacgtgttccagatggagatgattgttagggctactaggaaaggctatcacattgaagaggtcccaataacgtttgttgacagagtcttcggaatttcaaaacttggtgggtccgagatagttgaatatttgaaaggccttgtgtatctgttgctcacaacataattgatgatgtactgtaggcatctaacttcgtgggtaaaaccgtgtaacagagaatttttatgatgtgtcactgcagcttgagttgcatatcactacttacctcttcaaattgcgaatggattattgtaaaaaaaaaaaaaaaaaaaa

SEQ ID NO: 8884 - protein, 242 aa, Panicum virgatum
  misc_feature: Ceres CLONE 2021398
  misc_feature (1)..(170): Pfam Name: Glycos_transf_2 Pfam Description: Glycosyl transferase family 2
  misc_feature (1)..(242): SWISSPROT Homolog: EC 2.4.1.83 Dolichol-phosphate mannosyltransferase
MEAAASGKRAYSIIVPTYNERLNVALIVYLIFKHLPDVNFEIIIVDDGSPDGTQDIVKQLQQVYGEDRVLLRARPRKLGLGTAYLHGLKHASGKFVIIMDADLSHHPKYLPSFIRKQKETGADVVTGTRYVKNGDVHGWNLMRKLTSRGANVLAQTLLQPGASDLTGSFRLYKRDVLEDLISSCVSKGYVFQMEMIVRATRKGYHIEEVPITFVDRVFGISKLGGSEIVEYLKGLVYLLLTT

SEQ ID NO: 8885 - DNA, 716 bp, Panicum virgatum
  misc_feature: Ceres CLONE 2021423
  misc_feature: Encodes the peptide sequence at SEQ ID NO. 8886
aacacagctcaccagggacaacctctcgctctggtcgcttaggtcgatctctcagctccatccatccatccgatccgattccgatcatggcagccagcagcagcaagcaggcgtctctcgcgctcttcctggcggcgctggcggtgtcgagcgccgtgctggcgagcctggcgccgggcgcgggcgcggcgacgacgacgtgcgctccgacgcagctgaccccgtgcgcgccggccatcatcgggaacgcggcgcccacggcggcgtgctgcgcgaggctcaaggcgcacccggcgagctgcttctgccagtacaagagggaccccaacatgaagcgctacgtcaactcccccaacggcaagaaggtcttcgccgcctgcaaggtgcccctgcccaggtgctgagcgcccgatcggattccgatccagctcgcgttctggatcgacgccgtgcgcgcgcgcgcgctcccgtgcgagcacacccgatctctcgatggcgtggctcgctggtgctatctgctgtgtactaataaaagagcagtgatctgctcagagttcgtacgtaatatatacttgctgagaataaattgagacgtagcagtgtgaaccgaacatggcaccatttatgccatttcgagtgattttggtgatcgaatgacaacacaatacttggactaatatgattgttaagatgaccaaaaaaaaaaaaaaaaaaaa

SEQ ID NO: 8886 - protein, 105 aa, Panicum virgatum
  misc_feature: Ceres CLONE 2021423
  misc_feature (1)..(67): Pfam Name: Tryp_alpha_amyl Pfam Description: Protease inhibitor/seed storage/LTP family
MAASSSKQASLALFLAALAVSSAVLASLAPGAGAATTTCAPTQLTPCAPAIIGNAAPTAACCARLKAHPASCFCQYKRDPNMKRYVNSPNGKKVFAACKVPLPRC

SEQ ID NO: 8887 - DNA, 895 bp, Panicum virgatum
  misc_feature: Ceres CLONE 2021474
  misc_feature: Encodes the peptide sequence at SEQ ID NO. 8888
tgtctccccgcagcgcgccaccaccaccacctctctcccgcccccaagccggccggcgccgccgtcgtctccctccctcctccgctgccgtctccggccctcgtccctcgccatgatcatctccaagaagaaccgccgcgagatctgcaagtacctcttccacgagggggtcttgtatgccaagaaggactacaacctggccaagcaccccaagcttgacgtccccaacttggaggtcattaagctaatgcagagcttcaagtcaaaggagtatgtaagggagaccttctcctggcagtattactactggtacctgaccaatgatggcattgagcacctccgcaccttcctcaacctgccatcggaggttgtgcctaatacccttaagaagtcctccaagcccccgtctcgtcccttcggctctggcccaccgggtgaccgccccaggggtcccccacgttttgagggtgacaggccgaggtttggagacagggaaggttacagaggaggtccgcgtggtgctccaggtgattttggtggtgataagggtggtgctcctgcggagttccagccatcttttaggggtagcagacctggctttggccgtggtggcggtggcggcacatttggtgctggggcatcttccatggagtgatacttcagttagccagcgcattgatttgatgaatggctttacagatgcagcgcgcaaggggaggcttctctgttggtctttgaattatgaggacaatgagattttgttttccaagttgtagaagtggttctgtgtttttcgtttttgttagatgatgatgaaattcttgaggctgtttgtatgccaagaatgttatgagcaagttatcatcattctgtcaaaaaaaaaaaaaaaaaaaaa

SEQ ID NO: 8888 - protein, 180 aa, Panicum virgatum
  misc_feature: Ceres CLONE 2021474
  misc_feature: Great-hit functional homolog of the protein sequence given in SEQ ID NO 9569
  misc_feature: Useful for making plants with modulated nitrogen use efficiency
MIISKKNRREICKYLFHEGVLYAKKDYNLAKHPKLDVPNLEVIKLMQSFKSKEYVRETFSWQYYYWYLTNDGIEHLRTFLNLPSEVVPNTLKKSSKPPSRPFGSGPPGDRPRGPPRFEGDRPRFGDREGYRGGPRGAPGDFGGDKGGAPAEFQPSFRGSRPGFGRGGGGGTFGAGASSME

SEQ ID NO: 8889 - DNA, 640 bp, Panicum virgatum
  misc_feature: Ceres CLONE 2021513
  misc_feature: Encodes the peptide sequence at SEQ ID NO. 8890
atcatctccctcgcacgagtcaccacctgttctgtgcgtgcgtgtgccagtagtctctcatcgtccaagcaaagcgagcgagcgaagcaagctagcttccgcgcgccaccgccatgggcaaggtcaggctgctcttggcgctctcgctggtcgtcgtcctgctcctcgtcgagaccaccgctccccatggacaggctcacgccatcgactgcgtggcgagctgctcgtaccggtgcagcaaggccgggcgccccaagatgtgcctgagggcgtgcaacacctgctgccagcgctgcggatgcgtcccgccgggcacctccggcaacgaggacgtctgcccctgctacaccaacatgaccaccaagcacggcaagcacaagtgcccgtgatccggcggcctccatcgccagcatgcatgcatgcttgcttgttaccaagacatgacgcgaccatcgacgatcactcagcatgatcactcatgatactctacttcctcctacctagctactactactaatgacgtacccgtcgatcagttcatctatgatctatatctagtactccgatcccacccctggatcatatcgattacgcatgaaaattaaagctcctccacatgaataaatgatgaattaaatac

SEQ ID NO: 8890 - protein, 91 aa, Panicum virgatum
  misc_feature: Ceres CLONE 2021513
  misc_feature: Great-hit functional homolog of the protein sequence given in SEQ ID NO 9601
  misc_feature (5)..(89): Pfam Name: GASA Pfam Description: Gibberellin regulated protein
  misc_feature: Useful for making plants with altered terpenoid content
MGKVRLLLALSLVVVLLLVETTAPHGQAHAIDCVASCSYRCSKAGRPKMCLRACNTCCQRCGCVPPGTSGNEDVCPCYTNMTTKHGKHKCP

SEQ ID NO: 8891 - DNA, 637 bp, Panicum virgatum
  misc_feature: Ceres CLONE 2021556
  misc_feature: Encodes the peptide sequence at SEQ ID NO. 8892
gtagttcttcacagacatggccacatctgctattccatcaattggttcacctgctcctgcattcactgttgatgcaattgtaaagggagaaatcaaacaagttagcctttctgattacaaaggaaaatacgttgtcttgttcttctacccactcgacttcacattcgtctgcccaacagagatcattgcattcagcgaccgtgcaaaggagttcagagaacttggagttgaaatccttggagcatcagttgattctgtctattcccatcttgcttggattaatactcctcaaaaggcaggaggattaggaccaattgacttccctctcttggctgacgtcaaccgttccctctctcaatcatatggagctttattgggaaacactggacacactcttcgtgctaccttcatcatttcaccaactggagttgttcgtcaattctcattcaatgaaccacctgttggaagaagcgttgatgaaactctccgtttgattcaaggattcaaacatgttgatgcccatggagaagtttgtccaattaactggaaacctggatctgacaccatgaaagctgacccaactgcatccaaagcctacttcgaaaaacatggaaaataaacaaatccatttttgctc

SEQ ID NO: 8892 - protein, 200 aa, Panicum virgatum
  misc_feature: Ceres CLONE 2021556
  misc_feature (9)..(198): SWISSPROT Homolog: EC 1.11.1.15 Peroxiredoxin-2
MATSAIPSIGSPAPAFTVDAIVKGEIKQVSLSDYKGKYVVLFFYPLDFTFVCPTEIIAFSDRAKEFRELGVEILGASVDSVYSHLAWINTPQKAGGLGPIDFPLLADVNRSLSQSYGALLGNTGHTLRATFIISPTGVVRQFSFNEPPVGRSVDETLRLIQGFKHVDAHGEVCPINWKPGSDTMKADPTASKAYFEKHGK

SEQ ID NO: 8893 - DNA, 577 bp, Panicum virgatum
  misc_feature: Ceres CLONE 2021640
  misc_feature: Encodes the peptide sequence at SEQ ID NO. 8894
ggcgcaccaccggcccacactacctcggtccgcctgcgcttgtaacgagccagagatctaggagccaggagccatggcgaaggcggtggcggtgctggtggcggtgctgctggtggcggcggcgggcgcgggcggggcggcggcccagcagtgcgacgcgtcggggctggcggtgtgcgcgccggcgatcatcggcggggcggcgcccacgggggggtgctgcaccagcctgcgcgcgcagcaggggtgcttctgccagtacgcgcgcaacccggcgtacagccgctacatcaacagccccggcgcccgcggcttgctcaccgcctgcggcatcgccatcccgcgctgctagaggcgccgcgccgtgtcctcgcgcgcgctccgcctcgcgtgcgcgtgcgcgtcgatctgtctgggttttccttgtccgtgtcgtggtgtggcgtgtggattgaaacaataaaaaatgtgtgaaccggttgatcgtggagtgtgtgtgtgctgtagcttagccgatggatgcatgtcgatcggcctattgtatctgtgctcgagatggagagtacttaattaccgc

SEQ ID NO: 8894 - protein, 92 aa, Panicum virgatum
  misc_feature: Ceres CLONE 2021640
  misc_feature (1)..(66): Pfam Name: Tryp_alpha_amyl Pfam Description: Protease inhibitor/seed storage/LTP family
MAKAVAVLVAVLLVAAAGAGGAAAQQCDASGLAVCAPAIIGGAAPTGGCCTSLRAQQGCFCQYARNPAYSRYINSPGARGLLTACGIAIPRC

SEQ ID NO: 8895 - DNA, 715 bp, Panicum virgatum
  misc_feature: Ceres CLONE 2021657
  misc_feature: Encodes the peptide sequence at SEQ ID NO. 8896
agagctactcccgcggcaggtacgcgcgcatcgatcgccagctgaaattcacagcagcatagtaggaggagcgctaggaattaaggggcacgacggggccatggcctccggcgcggtgtgccccgcgttcgcctacaccatcgtgtacgtgacggacgtggagaaggcggccgccttctacgccgccgccttcggctacgacgtccgccgcctcgaccagtcccacaagtgggcggagctggagagcggggcgacgacgatcgcgttcacgccgctgcaccagcgggagactgacgggctctccggggaggtgcagctgccggacgccgcagcggcgcggggccccgtggaggtctgcttcgtctacgcggacgtcgacgcggcgtacaggcgcgccgtggagcacggggcggtgcccgtgagcgcgccggagcagaagccgtgggggcagaagtccggcttcgtgcgggacatggacgggaacgtcgtgcgcatcgggagccacgtccgcgagtgatcgatcccccggctgcttgctgctgcgtgcgacatagtagcagtaggaaaaatacgctcggccggctactagtatatatgtcaaaataaatcgtgtagctggagaggtttaggcgtcgaggtacatacttgtgtgaagaccagtgtagtagtagtttaataataacaaaataaatcgtgatctcgatcaccagtgggt

SEQ ID NO: 8896 - protein, 138 aa, Panicum virgatum
  misc_feature: Ceres CLONE 2021657
  misc_feature (1)..(124): Pfam Name: Glyoxalase Pfam Description: Glyoxalase/Bleomycin resistance protein/ Dioxygenase superfamily
MASGAVCPAFAYTIVYVTDVEKAAAFYAAAFGYDVRRLDQSHKWAELESGATTIAFTPLHQRETDGLSGEVQLPDAAAARGPVEVCFVYADVDAAYRRAVEHGAVPVSAPEQKPWGQKSGFVRDMDGNVVRIGSHVRE

SEQ ID NO: 8897 - DNA, 569 bp, Panicum virgatum
  misc_feature: Ceres CLONE 2021662
  misc_feature: Encodes the peptide sequence at SEQ ID NO. 8898
aatcgcctcctcttcgtcctcgaacccggaatccagagctatggcgctcgccaaggccaaggagatcgtcgcctccgagcccgtcgtcgtcttcagcaagtcttactgccctttctgcgtccgtgtgaagcagctgttcgagaagttgggagcaaccttcaaggccattgagttagatgtggaaagtgatggggctgagctccaggctgctctgaaggaatggactaaacagggcactgtcccaaatgtcttcatcaaggagaagcatattggtggctgcgatgataccatggcactgcacaatagcgggaagctggtgcccctgctgaccgaggctggagctatcaaaggttctacctcaaaggaaaccaccatcactgcttaactcgaccagacagttgtcgtggttgacatgtttatactgttcccgtgctatgaaataaggggcgcgtagtcctgaacttgtgtgctgtcaaagtggcaactagtactatcatgactgtttagtgtccgtattgaactgctcaatcactcgagttgcatgcctgcgctagtagtactgaattccc

SEQ ID NO: 8898 - protein, 114 aa, Panicum virgatum
  misc_feature: Ceres CLONE 2021662
  misc_feature (1)..(63): Pfam Name: Glutaredoxin Pfam Description: Glutaredoxin
MALAKAKEIVASEPVVVFSKSYCPFCVRVKQLFEKLGATFKAIELDVESDGAELQAALKEWTKQGTVPNVFIKEKHIGGCDDTMALHNSGKLVPLLTEAGAIKGSTSKETTITA

SEQ ID NO: 8899 - DNA, 725 bp, Panicum virgatum
  misc_feature: Ceres CLONE 2021674
  misc_feature: Encodes the peptide sequence at SEQ ID NO. 8900
ctcccacttccacattccacagccagcctccgatccaccccctcgcgcggcgttcccctctccaaccgaccaaacacgcatggcgcgcctcggcctcggcatgccgtgcctgctcgccgccgccgccgcggtgaccgtcctcgcgctcgcgcccggcgcggcgtcgcaggcgccggcgccggcaccggctccggcctcgtcggcggactgctcgtcggcgtttaccagcctcatcgggtgcctctcgtacgtgcagcaggggagcgcgcaggccaagccgggcaaggagtgctgcgccggcgtcaagagcgcactcaagagcccggccgccgtcacctgcctctgcgccgccctcggccagaacaacggcgtcccgatcaacttcacccgcgccgccacgctcccggcggcctgcggcgagaacccggccgccctcagcaactgcaacatcaaattgcccggtgctcctactgaaggtccctcttctggatcggcaccggctgctaacagcccaggcacgtcgaagtcagcggcagctcggtcaccggtctcggcgttcgccatagtagccgctgtcgccacgcctctgctctcctactacttcctctgaagatttgttggttgaattgctgtgaatctcgtgatgtgtatcagcattgtgccataattcagtgagacttgatttgggagaggttgttgctgttcaaaaaaaaaaaaaaaaaaaa

SEQ ID NO: 8900 - protein, 176 aa, Panicum virgatum
  misc_feature: Ceres CLONE 2021674
  misc_feature (1)..(79): Pfam Name: Tryp_alpha_amyl Pfam Description: Protease inhibitor/seed storage/LTP family
MARLGLGMPCLLAAAAAVTVLALAPGAASQAPAPAPAPASSADCSSAFTSLIGCLSYVQQGSAQAKPGKECCAGVKSALKSPAAVTCLCAALGQNNGVPINFTRAATLPAACGENPAALSNCNIKLPGAPTEGPSSGSAPAANSPGTSKSAAARSPVSAFAIVAAVATPLLSYYFL

SEQ ID NO: 8901 - DNA, 686 bp, Panicum virgatum
  misc_feature: Ceres CLONE 2021741
  misc_feature: Encodes the peptide sequence at SEQ ID NO. 8902
acttggctgaaaatgtcgcaacaaatttctgatctctgcccgccttctgctcccttctttggcgcgatgggctgcacggctgcgatcgtcttcacttgcatcggcgctagttacggcaccagtaaatctggtgttggcatctcagctatgggtgttctgcgtccagatctcatgatgaaatgcatcattccggtcgttatggcgggtattatcgccatctacgggttggtcgtcagcgtgctcatttctggcgatctcaaatctcccatgcctctctacaccggtttcattcagctgggtgctggcctgtcggtcggactcgccggtctcgccgctggcttcgcgataggaatcgtaggcaatgccggtgtccgaggcacagcccaacaacccaggcttttcgttggaatgatcttgattctcattttcgctgaagtgttgggtctttatggtcttatcattgcccttatcctcaacacccgttctggtgaagcaccaagctgctacatttgaacacgtcaagatcagtgacgaaacgaaaacacatctcgccccgcgcgcaagctgcggtcacacttcaaggcaaaacgtttctctcattgtatggagggtgctgctgcaacgtagtttggccgctcttcttagctgcatacataaatttgccccaaaaaaaaaaaaaaaaaaaa

SEQ ID NO: 8902 - protein, 166 aa, Panicum virgatum
  misc_feature: Ceres CLONE 2021741
  misc_feature (1)..(66): Pfam Name: ATP-synt_C Pfam Description: ATP synthase subunit C
  misc_feature (6)..(164): SWISSPROT Homolog: EC 3.6.3.14 Vacuolar ATP synthase 16 kDa proteolipid subunit
MSQQISDLCPPSAPFFGAMGCTAAIVFTCIGASYGTSKSGVGISAMGVLRPDLMMKCIIPVVMAGIIAIYGLVVSVLISGDLKSPMPLYTGFIQLGAGLSVGLAGLAAGFAIGIVGNAGVRGTAQQPRLFVGMILILIFAEVLGLYGLIIALILNTRSGEAPSCYI

SEQ ID NO: 8903 - DNA, 518 bp, Panicum virgatum
  misc_feature: Ceres CLONE 2021789
  misc_feature: Encodes the peptide sequence at SEQ ID NO. 8904
acttaaaaagcattaatttacgaaagtatacatttagctactttagactcttctttaaagctaattaatcgcatcccattatcgcaatggccagcaacatgattagaacctgtgtcaccagaagcctgctgttgaacaaggctgtcttcaacccggctatgactctcccagtcgccgccaacaaaatgatccacactagctcagtccgcagcgatattgactctgccgccaagtacattggtgctggtgctgccaccgtcggagtcgctggtgccggagccggtattggaacagtctttggtagcttggtcatcggctatgctcgcaacccgggtcttaagcagcagctcttttcctatgccatcttgggctttgccttgtctgaggctatgggtctcttctgtcttatgatggccttcatgttgttgttcgccttctagaagtagaatacggattcatcatttaaccatcatcatcatcacctgcccatatacaacacacatacacacaacacacag

SEQ ID NO: 8904 - protein, 117 aa, Panicum virgatum
  misc_feature: Ceres CLONE 2021789
  misc_feature (1)..(69): Pfam Name: ATP-synt_C Pfam Description: ATP synthase subunit C
  misc_feature (23)..(117): SWISSPROT Homolog: EC 3.6.3.14 ATP synthase lipid-binding protein, mitochondrial precursor
MASNMIRTCVTRSLLLNKAVFNPAMTLPVAANKMIHTSSVRSDIDSAAKYIGAGAATVGVAGAGAGIGTVFGSLVIGYARNPGLKQQLFSYAILGFALSEAMGLFCLMMAFMLLFAF

SEQ ID NO: 8905 - DNA, 997 bp, Panicum virgatum
  misc_feature: Ceres CLONE 2021920
  misc_feature: Encodes the peptide sequence at SEQ ID NO. 8906
aagttcacgtgctttagacagatctgaacatgttctttcgtgccgctcgctcagtgtccagacgaccacttcctttaggaaggagaactttcattgatggtctctttgatcataactcgggaccaaaagccgtcagccacaaaggagtcttgaactttgaaatttatcgttacaatacccaaaaggacccttatgttcaagtttttccagttgacctcggttcttgtggtcctatggtcctcgatgctctgattaaaattaagtcagaacaagattcatcgctgacatttagaagatcctgtcgtgaaggaatttgtggaagttgttcaatgaacattgcaggaacaaacactttagcttgtttgaaaccaattgatgaagcaatcaccaatggatctgtaagaattttcccccttccacacatgccaatcatcaaggatcttgttccagatttaaataatttctatgaacaacataaatcaattaaaccatggcttgaaccaggagagaaagccgaaagtttaaaaactgaaattcttcaatcagaagatgacagaaaacaacttgatggactttatgagtgtgtgctttgtgcttgttgttccgcttcttgtccaagttattggtgggctggagataaagattacttaggacctgctattcttttacaagcctacagatggcttattgattccagggataaagcaacttccgaaagaatcggtattttaactgaaaaagaaggaaaagtctacaaatgtcacactatcctcaactgctccagaacttgccctaaaggactcaatcctggaaaggctattcaaagagtcaagaatactatcgctaagaatactcaattattcccattccttcagaatcttgaaactgcttatcatccaaaagaagtcgaaaatgatcatgggcatcaccactaaactgatcaaaactactttttgttgaataaaatgtgaacaattaaaaaaaaaaaaaaaaaaaa

SEQ ID NO: 8906 - protein, 301 aa, Panicum virgatum
  misc_feature: Ceres CLONE 2021920
  misc_feature (27)..(272): SWISSPROT Homolog: EC 1.3.5.1 Succinate dehydrogenase [ubiquinone] iron-sulfur subunit, mitochondrial precursor
  misc_feature (40)..(271): SWISSPROT Homolog: EC 1.3.5.1 Succinate dehydrogenase [ubiquinone] iron-sulfur subunit
MFFRAARSVSRRPLPLGRRTFIDGLFDHNSGPKAVSHKGVLNFEIYRYNTQKDPYVQVFPVDLGSCGPMVLDALIKIKSEQDSSLTFRRSCREGICGSCSMNIAGTNTLACLKPIDEAITNGSVRIFPLPHMPIIKDLVPDLNNFYEQHKSIKPWLEPGEKAESLKTEILQSEDDRKQLDGLYECVLCACCSASCPSYWWAGDKDYLGPAILLQAYRWLIDSRDKATSERIGILTEKEGKVYKCHTILNCSRTCPKGLNPGKAIQRVKNTIAKNTQLFPFLQNLETAYHPKEVENDHGHHH

SEQ ID NO: 8907 - DNA, 1353 bp, Panicum virgatum
  misc_feature: Ceres CLONE 2021965
  misc_feature: Encodes the peptide sequence at SEQ ID NO. 8908
atctccaactctgccgaacccctctccaaaccattgtgaagtcatactcccaaattcagactcaacatccgtcacaatggcttccaacctctccttcatcctcaacaagcccaacgacgtcaccttcgcggagcggcccatccccaagctccaacacccgcacgacgtgctcgtcggcatcaactacacgggcatctgcggctccgacgtgcactactggcagcacggcgcgatcgggcacttcgtggtcaaggacccgatggtgctgggccacgagtccgccggcaccgtgctcgaggtcggctccgccgtctccaccctccgcaagggcgaccgcgtggccctcgagccgggctacccctgccggcgctgcgggccctgcctctcgggccattacaacctctgcccggacatggtcttcgccgcgaccccgccctacgacggcaccctgacggggttctggaccgccccctcggatttctgctacaagctgcccgagaatgtctccctgcaggagggggcgctgatcgagccgctggcggtggcggtgcacatagtcaagcaggcgcgggtgcagcccggccagagcgtggtggtgatgggggccggacccgtggggttgctgtgcggggcggtggcgcgggcgtttggggcgaccaaggtggtggcggtggacattgtgcagggcaagctggactttgcgcgggggtacgcggcgacgcacacgtatctgtcgcagcgggtgtcggccgaggagaacgcgcgcaacctggtggcggcggcggagctgggggagggcgcggacgtggtgattgatgcgtcgggcgccgagccgtccatccaggcgtcgctgcatgtggtgcgcatgggtggtacgtatgtgcaaggtggtatgggcaaggccgatatcaacttcccgattatggcgctttgcctgaaggaggtgacggcccgtggctcgttccgctatggcagcggtgattacaagctcgcgattgagttggttgctgccggccgggtggatgtcaaggcccttattaatggtgtcgtgccgttcaaggacgctgaggaggccttcaagaaggtcaaggagggcgaggtcatcaagatcctgatcgccggtcccaacgagaaggtcgagggggctttggacaccagcgttgatgagaagaagctcaaagaggcgcaggcggccggtagcacgggctgctgctaaggggaggcgagttgcataagtgtcatggcgtacggtgcatgggtcggttttgttcatgatctatattggcgtctgtgtattgggaaatctaatgaaaatcacttaactcttcttttgaaaaaaaaaaaaaaaaaaaa

SEQ ID NO: 8908 - protein, 379 aa, Panicum virgatum
  misc_feature: Ceres CLONE 2021965
  misc_feature (1)..(112): Pfam Name: ADH_N Pfam Description: Alcohol dehydrogenase GroES-like domain
  misc_feature (3)..(350): SWISSPROT Homolog: EC 1.1.1.14 Sorbitol dehydrogenase 1
  misc_feature (3)..(350): SWISSPROT Homolog: EC 1.1.1.14 Sorbitol dehydrogenase 2
MASNLSFILNKPNDVTFAERPIPKLQHPHDVLVGINYTGICGSDVHYWQHGAIGHFVVKDPMVLGHESAGTVLEVGSAVSTLRKGDRVALEPGYPCRRCGPCLSGHYNLCPDMVFAATPPYDGTLTGFWTAPSDFCYKLPENVSLQEGALIEPLAVAVHIVKQARVQPGQSVVVMGAGPVGLLCGAVARAFGATKVVAVDIVQGKLDFARGYAATHTYLSQRVSAEENARNLVAAAELGEGADVVIDASGAEPSIQASLHVVRMGGTYVQGGMGKADINFPIMALCLKEVTARGSFRYGSGDYKLAIELVAAGRVDVKALINGVVPFKDAEEAFKKVKEGEVIKILIAGPNEKVEGALDTSVDEKKLKEAQAAGSTGCC

SEQ ID NO: 8909 - DNA, 966 bp, Panicum virgatum
  misc_feature: Ceres CLONE 2022099
  misc_feature: Encodes the peptide sequence at SEQ ID NO. 8910
atttctaatacgctcacaagtcacggtatttaaagaaccagatctcaatgcaaagagtggttctgttagcatcccacttgacctcaagtaacgacagcacatccaacaaaatggccgagaccaagtcagacatccacctctacacggcccagacgccgaacggcatcaaggtctcgatgctccttgaagagcttggcctgccgtacaaggtgaccgccattgagctgagcaagaacacccagaaggagccctggttcctcgagatcaaccccaacggacgcatccccgccctgaccgacaccttcaccgacggctcgcccatccgcctgtttgagagcggttctattatgcagtacctggtcgaccgctacgacaccgagcacaaggtgtcgtatccgcggggcacgcgcgagtactacgaggtgaacagctggctgttttggcagatgggcggtcttggaccgatgcaaggtcaagcaaaccatttcgctagatatgctcctgagaagatccagtacggcatcgaccgataccagaacgagacgcggcgcctgtaccgtgtcatggatgatcacctgagcaagtccaagtcaggctatcttgttggtgacaagtgcaccatcgccgaccttgcttgctggggttgggtggctgctggctcctgggcgggtatttcgttggatgatttcccttccttgaatgcctgggtcgacaagattttgtcccggcctgggtctgaaaagggcagacatgtcccgagcccgcacaaggccctggagaaccggcacaagactgaggaggaacttgacaaggccgctgagcagacgagggcctgggtgcagcagggcatgcaagcggatgcaaagaagaagtgaagagtagttgaaaatgtgttcgttatcgcgtaaatcatccgtatggtgaataaaaagagaaatcacaaattaaaaaaaaaaaaaaaaaaaa

SEQ ID NO: 8910 - protein, 275 aa, Panicum virgatum
  misc_feature: Ceres CLONE 2022099
  misc_feature (1)..(80): Pfam Name: GST_N Pfam Description: Glutathione S-transferase, N-terminal domain
  misc_feature (1)..(64): Pfam Name: GST_C Pfam Description: Glutathione S-transferase, C-terminal domain
MQRVVLLASHLTSSNDSTSNKMAETKSDIHLYTAQTPNGIKVSMLLEELGLPYKVTAIELSKNTQKEPWFLEINPNGRIPALTDTFTDGSPIRLFESGSIMQYLVDRYDTEHKVSYPRGTREYYEVNSWLFWQMGGLGPMQGQANHFARYAPEKIQYGIDRYQNETRRLYRVMDDHLSKSKSGYLVGDKCTIADLACWGWVAAGSWAGISLDDFPSLNAWVDKILSRPGSEKGRHVPSPHKALENRHKTEEELDKAAEQTRAWVQQGMQADAKKK

SEQ ID NO: 8911 - DNA, 1415 bp, Panicum virgatum
  misc_feature: Ceres CLONE 2022192
  misc_feature: Encodes the peptide sequence at SEQ ID NO. 8912
ggccaggctgaggccatgcaaacgacagattttaagctctggtggggtggagaggggtgagaagctagttctctctgcttccaactcttcgtctcgttccatttcttctactcgactactctctcgtctcctcccgcacccacacgacgtgaggtgagcaagagctccgcgaactccaagggcacaataatggcgacggcgggggcggtggatggcaaaggcaccggcggcaccgataagatggctgcgttgaaggagatatacaacaagctcaaggcggaggtgctcgaggaccacgccatcgaggtcactcacgagtcagccatccagtggatcgaccgcatgatggattataatgtgctcggaggaaagtgcaaccgactgctctctgtcattgatacctataatatactgaagggtgctgatgttatcagccaagaagagacatttcttgcttgcacccttggttggtgtatggaatggcttcaagctgtttatcttatgctcgatgatattatggacaactcccagacacgacgtggccagccttgctggtttagggtgcctcaggttggcctcattgctataaatgatgcaattatccttcacaaccatgttccgcgtatccttcggcgccacttcaaaacgaagccatattatgttgatatcattgatttgttcaatgaggcagagttcaaggcagtttcaagtcagttgttggatcttatcattactcatgatggtagaaaggatctgaatagatataacgaaacaatttaccgccacatcgctcaatacaagacagcctactactccttttatattcctgttgcatgtgctttgttgttggctggtgagaacctggataactttggtgatgtaaagaacattctcattgaaattggaatatactttcagatccaggatgattatctagactgttttggtgaccctgaactcaccggcaagattggaactgatattgaagagtccaagtgttcctggttagttgtgcaagctcttgaacacgctgatgagaaccagaagagcattctgattgaaaattatggaaagtctgatccagcatgtgttgcaaaagtgaaggacttgtacaaagagcttaatctggagttggtgtttcgtgagtacgagagggagacctacatcaagctgatcggtaccatcgaggcccagctgaacaaggccgttcagactcttttgaagtccttcctgcacaagatctacaagagagagaagtagacctagctcgttaagaagatgcttgatcgatgcttgatgtggtatttgtactatgttgtttgttgttcggtcttaaatttcctatcatattgtacgctgggcttatatgtaataaagtacatgctttcttgtggtaaaaaaaaaaaaaaaaaaaa

SEQ ID NO: 8912 - protein, 356 aa, Panicum virgatum
  misc_feature: Ceres CLONE 2022192
  misc_feature (1)..(272): Pfam Name: polyprenyl_synt Pfam Description: Polyprenyl synthetase
  misc_feature (15)..(356): SWISSPROT Homolog: FPP synthetase 1 Farnesyl pyrophosphate synthetase 1, mitochondrial precursor
  misc_feature (6)..(356): SWISSPROT Homolog: FPP synthetase Farnesyl pyrophosphate synthetase
MATAGAVDGKGTGGTDKMAALKEIYNKLKAEVLEDHAIEVTHESAIQWIDRMMDYNVLGGKCNRLLSVIDTYNILKGADVISQEETFLACTLGWCMEWLQAVYLMLDDIMDNSQTRRGQPCWFRVPQVGLIAINDAIILHNHVPRILRRHFKTKPYYVDIIDLFNEAEFKAVSSQLLDLIITHDGRKDLNRYNETIYRHIAQYKTAYYSFYIPVACALLLAGENLDNFGDVKNILIEIGIYFQIQDDYLDCFGDPELTGKIGTDIEESKCSWLVVQALEHADENQKSILIENYGKSDPACVAKVKDLYKELNLELVFREYERETYIKLIGTIEAQLNKAVQTLLKSFLHKIYKREK

SEQ ID NO: 8913 - DNA, 657 bp, Panicum virgatum
  misc_feature: Ceres CLONE 2022245
  misc_feature: Encodes the peptide sequence at SEQ ID NO. 8914
atcacattacactcactcacacccactcacactcactcgcgctcactgcgcactcactaaggaaaacacacacaaacacacacacaagaagaaaggatggcagactacaaggtaggcgaggtcaagatcaaggagggcggcagcgttcccagcggcgttctgcgcatgcgtaccaacggcgagacccgcacgctcaccaccgaccagatcttcaagggcaagaaggtggtcctcttctcgctgcccggcgccttcacgtccatctgcagctccaagcatctcccgcagttcgtgggccgcatggaagaattcaagaagctgggcatcgactcagtcatctgcatggcggtcaacgacgagttcgtgatggaagcatggggcaagggctaccacgcgcaggacaaaggcctcctcatgctgggcgatggcgacggcagcttcacgcgctcgctcgggctcgaccaggagctcgagggaatgggccgccgagggcgtcgcttctccatgtttgtcgacgacggcgtcatccggatgctcaacatcgaggagcccggacctatgtcctacaaggtctctggacccgagaccctcctccgcttcctccagacgccctccgcgccacagcagtgctgagataaatagttggtcattagctct

SEQ ID NO: 8914 - protein, 178 aa, Panicum virgatum
  misc_feature: Ceres CLONE 2022245
  misc_feature (32)..(172): Pfam Name: Redoxin Pfam Description: Redoxin
MADYKVGEVKIKEGGSVPSGVLRMRTNGETRTLTTDQIFKGKKVVLFSLPGAFTSICSSKHLPQFVGRMEEFKKLGIDSVICMAVNDEFVMEAWGKGYHAQDKGLLMLGDGDGSFTRSLGLDQELEGMGRRGRRFSMFVDDGVIRMLNIEEPGPMSYKVSGPETLLRFLQTPSAPQQC

SEQ ID NO: 8915 - DNA, 1319 bp, Panicum virgatum
  misc_feature: Ceres CLONE 2022247
  misc_feature: Encodes the peptide sequence at SEQ ID NO. 8916
gcatacaaaatatatacttctttgatttttttttttgcgaaagaatatacttttttgatttaactatgaatatatgtattacgtggcatgcatgagctacgcacgtctggtttcgttttatattgagtaaaatgcactgggggtccttaaactagttgacctgttctgtttaaaaaaaaaaaaaaaaaaaaaaaaaaaaaaaaaaaaaaaaaaacccccctacggcaggaacttaataaaagggccagttgaaggccggcaggatatggcaggaaacaaaaagcttacgctgctcgggctgggggcaagcccgttcgtgatcagagcgcgcatcgcgctcaacctgaaaggcctcagctacggctacaccgaggagagcctctacaacaagagcgacctcctcgtcaggtctaacccagtgcacaaaaaagtgcccgtcctcatccacaacggcaagcccgtctgcgagtctcaaaacatcgtgtcgtacgtcgacaaggttttccctggcagcggccagtccatcctcccctccgatccatatgatcgcgccgttgctcgcttctgggcctcctacgtcgatgacaagttgtacagcacgtgggtgcccgtcttcaggggcagcacaagcaaggagagggtggaggcggcgacacgggtcatcgccgtcctggagacgttcgagcagcgagcgttcggagagtgctcgcgctccaatggcggccgggccatggcggcgttcttcggaggggacagcgttgggctcgtggatgtcgtgctcggcagcctccttgggtggttgcaggccaccgaggccatctgcggggtcaaggtcatcgacgccgccaggacgccgctcgtggcagcatgggcggagcggttccgcgccatcgacggcgtcaaggaggtgataccggatgtgccgaggctagtggagtataacaaggtgaggcgggctcgccttgggctgccgttgctgctgccgtctgttgagttgctgcagtaacaagctagctactcctatccttaattgatcagtacgtgatgcgcctggtgatcgagtgcagctcctatctttatttgaagcccggtcaaacaaaatcacgtgcagaaatggacgtcaaaacgaaactactgcagcagcggaggcatacaaaatatatacttytttgatttttttttttgcgaaagaatatacttttttgatttaactatgaatatatgtattacgtggcatgcatgagctacscmcgtctggtttykttttwtattgagtaaaatgccctgggggtccttaaactagttgccctttttttttt

SEQ ID NO: 8916 - protein, 246 aa, Panicum virgatum
  misc_feature: Ceres CLONE 2022247
  misc_feature (1)..(74): Pfam Name: GST_N Pfam Description: Glutathione S-transferase, N-terminal domain
  misc_feature (1)..(104): Pfam Name: GST_C Pfam Description: Glutathione S-transferase, C-terminal domain
  misc_feature (1)..(106): Pfam Name: GST_C Pfam Description: Glutathione S-transferase, C-terminal domain
MAGNKKLTLLGLGASPFVIRARIALNLKGLSYGYTEESLYNKSDLLVRSNPVHKKVPVLIHNGKPVCESQNIVSYVDKVFPGSGQSILPSDPYDRAVARFWASYVDDKLYSTWVPVFRGSTSKERVEAATRVIAVLETFEQRAFGECSRSNGGRAMAAFFGGDSVGLVDVVLGSLLGWLQATEAICGVKVIDAARTPLVAAWAERFRAIDGVKEVIPDVPRLVEYNKVRRARLGLPLLLPSVELLQ

SEQ ID NO: 8917 - DNA, 1263 bp, Panicum virgatum
  misc_feature: Ceres CLONE 2022458
  misc_feature: Encodes the peptide sequence at SEQ ID NO. 8918
gcccacgtctcccgatacccctcacccgcgcggcccgccgacccccgcccccgcgcccctcctccgtcgccccgcgctcggcgccgccgcccccgccgccgccgttggtgaggagtttggtttctgagagggggtgcgattgcgagggttacaggggaggagggatttgggatggccggccaggatcatgtggtggttgatgtggacggcttggcgaaatccaaggctgatggggtcgccgagaagccgtctgagggtgtgaccgcctcggcggctgctgtgtctccgtccacggtcgttgacgtggtcgatgaggaggaggtgggcggtggggaggaggagccgctcatccaggcagccgagtgccgcatatgccaggaggaggacagcgtcaagaacctcgagaagccgtgcgcttgctgcggcagcctcaagtatgctcatagagcttgtgttcaacgctggtgcaatgagaaaggagacactacatgtgaaatttgccatcaggaatacaagtctggttacaccgcaccacctcgtgttgaaccagatgagacaaccatagacattgatggagatttgattatggatttgcgtgacccaagaattctcgctgtagcagctgcccagcgtcgtcttcttgaggcagagtatgatggttatgctactacagatgcaagtggtgctgcattctgccgttctgctgcacttattttaatggcactgttgctgctcaggcatgcattatccatctcagacaatgaaggaagcgatgatgatgcttctaccatgttctcacttttcttgctgcgagctgctgggtttctgttgccgtgctatatcatggcgtggatattcagtattttgcatcgccggcgtcaaagacaggaagaggctgcactggcggcagcagaggtggccttcatcctacagtcagcccggggacgtgccctccagtttgccattgctccagactcccctgccactccgcagcaggagcaggagccatcaccgcagcaacaacaataactaatgacgcagcaacagtagttcatcacgactactgaccatacccgtacatccctggttgtttcgttgtttatgcccactgattgaagaaggttaggccagctcggcttctgcttcctatttgccaagtaggatgccccacacacacttcgattcagcggaaactctctgtaccttgtgttcgagatgagtgtaatcgaagcatcgaacttaatgtaaattcgttttacattc

SEQ ID NO: 8918 - protein, 285 aa, Panicum virgatum
  misc_feature: Ceres CLONE 2022458
  misc_feature (1)..(46): Pfam Name: zf-C3HC4 Pfam Description: Zinc finger, C3HC4 type (RING finger)
MAGQDHVVVDVDGLAKSKADGVAEKPSEGVTASAAAVSPSTVVDVVDEEEVGGGEEEPLIQAAECRICQEEDSVKNLEKPCACCGSLKYAHRACVQRWCNEKGDTTCEICHQEYKSGYTAPPRVEPDETTIDIDGDLIMDLRDPRILAVAAAQRRLLEAEYDGYATTDASGAAFCRSAALILMALLLLRHALSISDNEGSDDDASTMFSLFLLRAAGFLLPCYIMAWIFSILHRRRQRQEEAALAAAEVAFILQSARGRALQFAIAPDSPATPQQEQEPSPQQQQ

SEQ ID NO: 8919 - DNA, 631 bp, Panicum virgatum
  misc_feature: Ceres CLONE 2022459
  misc_feature: Encodes the peptide sequence at SEQ ID NO. 8920
aagcaatctcaaagcagcaacatctcccacatcgagccagtttatataacatttcagcttgttagtttcgtcagagcttgaagaagatgtcttgcagctgtggatcaagctgcagctgcggctctaactgcacctgcgggaagaagtaccctgaccttgaggagaagagcagcggcgctcagagcaccgtggtgctgggcgttgcccccgagaggaaggcccagttcgaggcggcgaccgagtccggcgaaaccgcccacggctgcaagtgcggctccagctgcacctgcgacccctgcaactgctgattgcttcgcttgcctgcctatgacgacgtacgtatagcgtactctgcttgcttgtgtacgtgtgactgcgagtgatatatatgatcgactacgtactgaaatgacaataaggatgagccgttagttgtatcggtttgcctatgtgtggtttgctaccttgatgtacctctgcttcttggcgccttgtgctcattcatgtacccgtgtgtgtgtgctcatctttacaaaccatgcttgcatctctgtgtagtatgtctgcatgtgtctctgtaatggtcggcccagagtgatgatgaatttataaaaaaaaactggtttgcttt

SEQ ID NO: 8920 - protein, 73 aa, Panicum virgatum
  misc_feature: Ceres CLONE 2022459
  misc_feature (1)..(73): Pfam Name: Metallothio_2 Pfam Description: Metallothionein
MSCSCGSSCSCGSNCTCGKKYPDLEEKSSGAQSTVVLGVAPERKAQFEAATESGETAHGCKCGSSCTCDPCNC

SEQ ID NO: 8921 - DNA, 1136 bp, Panicum virgatum
  misc_feature: Ceres CLONE 2022546
  misc_feature: Encodes the peptide sequence at SEQ ID NO. 8922
gcacacaaaacagctaccaccagcacagcagatagacgacatgatgagagcagtggcgttagtggccatgttggccactgccttggcggcttccgcgcgcgccgagcagtgcgggtcgcaggccaacggggctctctgccccaacggcctctgctgcagcaagtggggctggtgcggctccacctccgactactgcaccaacggctgccagagccagtgcggcggcggcagcccaccgagcggcggcggcgtcgagtccatcatctcgcgttcgctgttcgaccagatgctcctccaccgcaacgacaacgcgtgccctgcccggggcttctacacgtacgacgccttcgtcgcggcggcgagcgccttcccggggttcggcacgacgggcagcctggagacccagaagcgggagctcgcggcgttcctggcccagacgtcacacgagacgaccggcgggtgggcgacggcgcccgacggaccctacgcctggggctactgcttcaagcaggagcagagcccgtcgtcgtcctactgccagccgagctcgcagtggccctgcgccgccggcaagcagtactacggccgtggccccatccagatctcgtggaactacaactacggccccgcgggccaggccatcagccaggacctcctgggcaacccggacctggtggccagcgacgccgtggtgtcgttcaagacggcggtgtggttctggatgacggcgcagtctcccaagccgtcgtgccacgccgtagtgaccgggcagtggagcccctccagcgccgaccaggcggccgggagggtgcccgggtatggggtcatcaccaacatcatcaatggtgggatcgagtgtggccacggcgctgatagcagcgtcgcggaccggatcggattctacaagcgctactgcgacttgctcggggtcagctatggggccaacttggactgctacaaccagaggcccttcggcagctagctcagatcagctggcatggcagtcttcacaacttggactgcgataaagctaaggcagagatcgtcacacaataacaagtgtgttatgtatacgatccaataataatgcaattaagcaatatattgaatcagtggaataaaatacatgattatat

SEQ ID NO: 8922 - protein, 313 aa, Panicum virgatum
  misc_feature: Ceres CLONE 2022546
  misc_feature (1)..(234): Pfam Name: Glyco_hydro_19 Pfam Description: Chitinase class I
  misc_feature (2)..(311): SWISSPROT Homolog: EC 3.2.1.14 Basic endochitinase 1 precursor
  misc_feature (2)..(313): SWISSPROT Homolog: EC 3.2.1.14 Basic endochitinase 2 precursor
MMRAVALVAMLATALAASARAEQCGSQANGALCPNGLCCSKWGWCGSTSDYCTNGCQSQCGGGSPPSGGGVESIISRSLFDQMLLHRNDNACPARGFYTYDAFVAAASAFPGFGTTGSLETQKRELAAFLAQTSHETTGGWATAPDGPYAWGYCFKQEQSPSSSYCQPSSQWPCAAGKQYYGRGPIQISWNYNYGPAGQAISQDLLGNPDLVASDAVVSFKTAVWFWMTAQSPKPSCHAVVTGQWSPSSADQAAGRVPGYGVITNIINGGIECGHGADSSVADRIGFYKRYCDLLGVSYGANLDCYNQRPFGS

SEQ ID NO: 8923 - DNA, 1275 bp, Panicum virgatum
  misc_feature: Ceres CLONE 2022701
  misc_feature: Encodes the peptide sequence at SEQ ID NO. 8924
gggaccacgttgacacgcccgtcacatattccggctcttcaagccgtgttctcgccatgacctcggtggggttcgccgctctttctgttgttgcttgcgggttccatcgtttgcaaacgatcttcaagggcctatcttattcttaactataacggacacaacaaatcaagccaacaaagattacggcctctccagattcgaaaagaagccagtacatcagcccttaaacgctggaatatggcgacaccaaacgggaccaacgggacgaacgggacccagcaccaccgcttcctgatctggggtggcgatggctgggttgcgggccatctcaaggccttgttagaaaagcagggcaaggaagcacatgcaacaacggttcggatggaaaaccgcgaggccgtcatccaagagctcgaccggatccggccaacacatgtgcttaatgcagctggctgcaccgggcgccccaacgtcgactggtgtgaggacaacagggaggccactatcagatccaacgtcatcggcaccctgaatctggccgactgttgcttcctccagggcatccactgcaccgtcttcgccaccggatgcatctatcagtatgataagacgcatcctttgggcgggccgggcttcctcgagactgacccggccaactttgccggcagtttctactccatgaccaaggcgcacgttgaagagattatcaagcattacaataactgcctgatcctgcgattgcgcatgcccgtctcagacgacctacacccgcggaatttcgtgaccaagatctccaagtacgatcatgtggtggatatccccaacagtaacacgatcttgacggatttgctcccagcatcagtcctgctggctgaacacggcgaagtgggagtctacaactttacaaacccgggcgcgatatcgcacaacgaggtgctcaccctgttccgcgatattgtgcgcccgtcgtatacgtggaaaaacttcagtctcgaacagcaggccaaagtcatcaaggccggccggagtaactgcaagctggatactaccaagctggtatcgaagctgaaggagtatggctatgagcttcccgaggtacacgaagcttaccgaaggtgctttgagcgaatgaaggctgcgggtgttcggtagatacaaaaaggagaatggggcgctcaataacgatgaggccgttcatacgaagtataccgtgttcgtttattgggttagttagacatcaattgctgttcacgtcaaaaaaaaaaaaaaaaaaaa

SEQ ID NO: 8924 - protein, 304 aa, Panicum virgatum
  misc_feature: Ceres CLONE 2022701
  misc_feature (1)..(143): Pfam Name: Epimerase Pfam Description: NAD dependent epimerase/dehydratase family
MATPNGTNGTNGTQHHRFLIWGGDGWVAGHLKALLEKQGKEAHATTVRMENREAVIQELDRIRPTHVLNAAGCTGRPNVDWCEDNREATIRSNVIGTLNLADCCFLQGIHCTVFATGCIYQYDKTHPLGGPGFLETDPANFAGSFYSMTKAHVEEIIKHYNNCLILRLRMPVSDDLHPRNFVTKISKYDHVVDIPNSNTILTDLLPASVLLAEHGEVGVYNFTNPGAISHNEVLTLFRDIVRPSYTWKNFSLEQQAKVIKAGRSNCKLDTTKLVSKLKEYGYELPEVHEAYRRCFERMKAAGVR

SEQ ID NO: 8925 - DNA, 499 bp, Panicum virgatum
  misc_feature: Ceres CLONE 2022882
  misc_feature: Encodes the peptide sequence at SEQ ID NO. 8926
tagaccacaccagcaccacccaagagaaatcattgccgggcagccgcaccaacaactgagagcagcggcgagcaccttgcagctgcagctcccatggcttccgctcccgtgtccgttccccgcatcaaactcggctcgcaggggctggaggtctccgcgcagggcctcggctgcatgggcatgtccgccttctacggcccgcccaagccggagcctgacatgatcaagctcatccaccacgccgtcgccgccggggtcaccttcctcgacacctccgacatctacggcccgcacaccaacgagatcctcctcggcaaggcgctgcaaggcggggtgtgagaggcggacgtgcacgatgtgtatatctgtacgtacgtaaggtacgcggaaggcagtagaataagtgtggttccgtacgtggccgtgtacaaatactgtatgctactgaggcgcgcggtgatgttcataaataaataataaataaaaagcaggtgttccg

SEQ ID NO: 8926 - protein, 81 aa, Panicum virgatum
  misc_feature: Ceres CLONE 2022882
  misc_feature (1)..(68): Pfam Name: Aldo_ket_red Pfam Description: Aldo/keto reductase family
MASAPVSVPRIKLGSQGLEVSAQGLGCMGMSAFYGPPKPEPDMIKLIHHAVAAGVTFLDTSDIYGPHTNEILLGKALQGGV

SEQ ID NO: 8927 - DNA, 983 bp, Panicum virgatum
  misc_feature: Ceres CLONE 2022956
  misc_feature: Encodes the peptide sequence at SEQ ID NO. 8928
acactgcagcctcagtctcaagcatcgcggtctactgctactatcaagcacagcttcttcatcatggtgtctttcaagtctctccttgtggccgctgccacggtgacttcggtcctcagtgctcccttcgacttcgctgagcgcgacaatggaaactcgactgatgtcctcgaaaagcgccaggtgacgccaaactcacagggttaccacaatggatacttctattcgtggtggtccgacggaggcggccaggttacctacactatgggtgaaggcagccggtaccaggttagctggagaaacactggcaactttgttggtggcaagggctggaaccccggtaacggccggaccatcaactacggcggtgccttcaacccgagcggcaacgggtacctcgccgtctacggctggacccgcaaccctctcgtcgagtactacgtcattgagtctttcggcacctacaaccccagcagcggagcgcagtacaagggtcagcaccagaccgacggcggtacctacaacatctacgtctccactcgctacaaccagccctctatcgacggtacccggaccttccagcagtactggtccgtccgcacctccaagcgcgtcggaggctccgtcaccatgcagaaccacttcaacgcctgggcccgcgttggcctgaaccttggacagcacgattaccagatcgttgccaccgaggggtaccagagcagcggttcttccgacatctacgtgcaaacccactaacgttttcgatcgccgaacggaaaaggccctgtcggtctgctccggtggacagttagtgggtgatcccggagggaacgctacctaaacgtatggacctcgggtgcacataacggattcggatacatcaagcaaggtcaatagtttgaagatgtgaattgtcaccctcgagacagctccattccagacaataaagaagcgttgcctcacaaaaaaaaaaaaaaaaaaaa

SEQ ID NO: 8928 - protein, 230 aa, Panicum virgatum
  misc_feature: Ceres CLONE 2022956
  misc_feature (1)..(181): Pfam Name: Glyco_hydro_11 Pfam Description: Glycosyl hydrolases family 11
  misc_feature (1)..(227): SWISSPROT Homolog: EC 3.2.1.8 Endo-1,4-beta-xylanase A precursor
  misc_feature (1)..(230): SWISSPROT Homolog: EC 3.2.1.8 Endo-1,4-beta-xylanase 1 precursor
MVSFKSLLVAAATVTSVLSAPFDFAERDNGNSTDVLEKRQVTPNSQGYHNGYFYSWWSDGGGQVTYTMGEGSRYQVSWRNTGNFVGGKGWNPGNGRTINYGGAFNPSGNGYLAVYGWTRNPLVEYYVIESFGTYNPSSGAQYKGQHQTDGGTYNIYVSTRYNQPSIDGTRTFQQYWSVRTSKRVGGSVTMQNHFNAWARVGLNLGQHDYQIVATEGYQSSGSSDIYVQTH

SEQ ID NO: 8929 - DNA, 1236 bp, Panicum virgatum
  misc_feature: Ceres CLONE 2023028
  misc_feature: Encodes the peptide sequence at SEQ ID NO. 8930
atgttgttttctattaatgtgaaaacaaggtagtgttcgactgagttcaattggccgtaagcttcatgacgaaatccgagtcgattcaaggaagcgtgatcgagggtcattaatctcaagagagctcaactcccgggaagattataccgaccgaaggaccagccacatcatgatgcagttcaggtgagtagtgaattcccctcaccttttatcagggtcactagtcgggttcaccacgccagattggatctgcggcgcctcgctgtccgaccggcggcgattcttcacacagagaggccccctcgagcgggggcggccaggatcccctgccggatcagcgccgcggacgagcagcggcttccggcggtgcagggcagcagcggcttccggcggcaaggcggtgcgggcggccaggatccaagcgcccccctgccggatcagcgccgcggacgagcagcggcttccggcggcgcagggcagcagcggcttccggcggcaaggcggtgcaccagcggtgggcgacgcaggcatggcagactcgagctcacgaggttccaggataagtgcaagtggtcgtggtggccgtgggcttctgaggtcgcgaccaccggtgccgtacagagaaggtcctctagattatgagcccaccgtggtgtgtatgtgcaacagaaaggcaccacagtggatttcttggagtgatgattatccaggtcggaggtactacagatgcaatcgagcaaggactgatggggattgtggcttctatgtgtggtatgattctgagcacacaacatttatgaagaatttactttttgatcttcgtaatgctgtttgggagttgaggagcaaagtggaggaggttgctgacctgaagcaaatcaatgaactggtgtctagtgagaatgaagagaagggcttagtcctaaaggcacaagagcaggagctggaggagaagaataagcaattggtagtactggctaacaggatcagttcagggagtaggtgtagtttattctgttgtggctttgtaatgttgcttgttggcttgttccttggcatgatgttagttgccatgtgacgtatccatgtaatgtgtctcatcattatatggcacgtgtttgaggagaaggttttggatgtcctgcgagaattaagttaaatatttgatgtatggcatatgttcagtagatcataatatcataatgtccttcgagacaaaaaaaaaaaaaaaaaaaa

SEQ ID NO: 8930 - protein, 182 aa, Panicum virgatum
  misc_feature: Ceres CLONE 2023028
  misc_feature (1)..(42): Pfam Name: zf-GRF Pfam Description: GRF zinc finger
MADSSSRGSRISASGRGGRGLLRSRPPVPYREGPLDYEPTVVCMCNRKAPQWISWSDDYPGRRYYRCNRARTDGDCGFYVWYDSEHTTFMKNLLFDLRNAVWELRSKVEEVADLKQINELVSSENEEKGLVLKAQEQELEEKNKQLVVLANRISSGSRCSLFCCGFVMLLVGLFLGMMLVAM

SEQ ID NO: 8931 - DNA, 495 bp, Panicum virgatum
  misc_feature: Ceres CLONE 2023040
  misc_feature: Encodes the peptide sequence at SEQ ID NO. 8932
atcgacctttgccatggccaccgcgtccctgtccgccgtcgcggcgccgctgtccgtcgccgggctgaggaagcctctcggcgccaccgcgacgttccagccgctgcagccgaggaggccggccgccaggatggccgtgcgggcgtcggcggcgtccatgaaggagaaagcagcggcggggctgaccgcggcggccgtggcggcggcgctggtgatgcctgacgtggcggaggccgcgcagctgacgccgtcgctcaagaacttcctgttcagcatcgtctccggcggggtcgtgctcgtggccatcgtcggcgccgtcgtcgccgtctccaacttcgaccccgtcaagcgggcctgatcgttcgttcgttccttaggaggcacgtctccccttgtatcattcatgtatcgagtgtggtatatctttccgtgttgttttgcagaatgttcaaacatatttatatgatacggagttcaagtttttttttttgaacg

SEQ ID NO: 8932 - protein, 114 aa, Panicum virgatum
  misc_feature: Ceres CLONE 2023040
  misc_feature: Great-hit functional homolog of the protein sequence given in SEQ ID NO 9275
  misc_feature: Useful for making plants with modulated nitrogen use efficiency
MATASLSAVAAPLSVAGLRKPLGATATFQPLQPRRPAARMAVRASAASMKEKAAAGLTAAAVAAALVMPDVAEAAQLTPSLKNFLFSIVSGGVVLVAIVGAVVAVSNFDPVKRA

SEQ ID NO: 8933 - DNA, 479 bp, Panicum virgatum
  misc_feature: Ceres CLONE 2023068
  misc_feature: Encodes the peptide sequence at SEQ ID NO. 8934
aatcagatccggaccgcgaattcgagcgagctcgtcgtcggctcctgcgactcctattcgagatggggaacacagcatctgtgaaaactgaggcttcagtttccgcggagccacctgccacaacagctcctgcacctgaaaccaagccgaaaaagaagatctgctgtgcttgcccagatacaaagaagctgagagacaactgcatcgtgcagaatggcgaggatgcctgcggaaagttcatagaagcccacctgcagtgcctgagagctgaagggttcaatgtctgacacctagctctgtcatgggaactccgcatctgtttctgcggtagtcagattttggtcataaggagcatgatgaataagaacttctggtagagggatagtgagaaactaagaacttactgtttcatttagaggctgcaaaaaacgccactgaacatggctgtttggaagagggtatgtgtctttttccagtgc

SEQ ID NO: 8934 - protein, 74 aa, Panicum virgatum
  misc_feature: Ceres CLONE 2023068
  misc_feature (1)..(63): Pfam Name: COX17 Pfam Description: Cytochrome C oxidase copper chaperone (COX17)
MGNTASVKTEASVSAEPPATTAPAPETKPKKKICCACPDTKKLRDNCIVQNGEDACGKFIEAHLQCLRAEGFNV

SEQ ID NO: 8935 - DNA, 1563 bp, Panicum virgatum
  misc_feature: Ceres CLONE 2023103
  misc_feature: Encodes the peptide sequence at SEQ ID NO. 8936
gcatacatatcccagcactgtaatcgcctttctcttctagagcatacctggagaacagtttttcaccaagagtacctgtctcaggctaactggtaggcaccatttcacatcacacaaacacacaccttccttttgacttggaggccgggatactacaccatgccgattgagacgcccatgccggccctctccggccacggcctgacggtctgcgtgaccggcgccggaggattcatcgcctcctggctcgtcaagcgcctcctggagaagggctacactgtccgcggcacggtccggaaccctgttgatcccaagaacgaccacctgagggcgcttgaaggtgccgccgaccgccttactctcgtccgcgccgacttgctggatcccgacagccttctcgcggccttctccggctgcgagggtgtcttccatactgcctccccggtcaccgatgatcccgagaagatgatcgagccggcgatccgcggcacaaggcacgtgatgacggtggccgcggacaccggcgtgaagcgcgtcgtgttcacgtcctccatcggcacggtgtacatgaacccataccgcgaccccaacgagcccgtcgacgacacctgctggagcgacctcgagtactgcaagaagaccgagaactggtactgctacgcgaagacggtggcggagcagggcgcgtgggaggtggcgcggaagcgcgggctggacctggtagttgtgaacccggtgctggtgctgggtccgctgctgcagccgacggtgaacgcgagcacggaccacgtgatgaagtacctgacggggtcggccaagacgtacgtgaacgcggcgcaggcctacgtgcacgtcaaggacgtcgccgaggcgcacgtccgggtgtacgaggccgcccacgcgcacggccgctacatctgcgccgagagcaccctccaccgcggcgagctctgccgtatcctcgccaagctcttcccggagtaccccatacccaccaagtgtaaggacgaggtgaatcctccggtggccggatacaagttcagcaaccagcggctcaaggatctagggatcgagttcgtgccggtgctgcagtgcctgtacgagacggtgaagagcctccaggagaaagggatgctgcccgtcctcccgccaaacgacgaccaccacctcgaccaactgatgacatcatgatcatcccaaggttcactactgatggtctacggcatgctgccacgcatatcatgagctagctgattaatatattataagcaaacctttttatcaacataatatatggcaactttcatggttgcatgcatgtacgcgtggcagccactgcaccgaccgacccaaatgttagtgctgtatgacgtacacatgcaacacatctttgtggaatatatatgattgtaatttatataactgctgtgagcaataactgggctcctttttagctgccctatgccacacacttggcccttggccctttgcttgtcctcgagtagagattgaaggaccaaataaagtggatgcaactcctttgaaaaaaaaaaaaaaaaaaaa

SEQ ID NO: 8936 - protein, 343 aa, Panicum virgatum
  misc_feature: Ceres CLONE 2023103
  misc_feature (1)..(239): Pfam Name: Epimerase Pfam Description: NAD dependent epimerase/dehydratase family
MPIETPMPALSGHGLTVCVTGAGGFIASWLVKRLLEKGYTVRGTVRNPVDPKNDHLRALEGAADRLTLVRADLLDPDSLLAAFSGCEGVFHTASPVTDDPEKMIEPAIRGTRHVMTVAADTGVKRVVFTSSIGTVYMNPYRDPNEPVDDTCWSDLEYCKKTENWYCYAKTVAEQGAWEVARKRGLDLVVVNPVLVLGPLLQPTVNASTDHVMKYLTGSAKTYVNAAQAYVHVKDVAEAHVRVYEAAHAHGRYICAESTLHRGELCRILAKLFPEYPIPTKCKDEVNPPVAGYKFSNQRLKDLGIEFVPVLQCLYETVKSLQEKGMLPVLPPNDDHHLDQLMTS

SEQ ID NO: 8937 - DNA, 1216 bp, Panicum virgatum
  misc_feature: Ceres CLONE 2023115
  misc_feature: Encodes the peptide sequence at SEQ ID NO. 8938
cactttcactgcacttgtccagctactttcttcttcctcccttgaatcagattcaggtagcattggcatagcctagccgcggagagaaagcagggcagatcgagaggaggagcggaggtggaggaagaccaaggaatcaaaccggccgaaccaaggcgtctcggatcggaggatgctcggaggccggccggtgttcgtgctgttcggctcctccatcgtgcagtacagcttcagcaacggcggatggggcgccgcgctcgccgacatctacgcccgcaaggctgatatcttgcttagaggatatatcggctggaatacaaggcgggctcttcaagtcatggacaaagtgttccctaaggattcaccagtgcagccatctttggtaatagtttactttggtggaaatgactccattgctgcccactcgtctggtctggggcctcacgtgccgatagatgagtacatagacaacatgagaaagattgcggagcacctgaagagcttatccgagaagacccgtgttatcttcctgagctgtccacctctgaacgaggagatgcttcgcacatcaaccagcagcactatactgagcgagatcgtgcggaccaacgagacctgccacctctactcggacgcctgcgtagctctgtgcaaagagatgaacctgaaggtggttgatctgtggcatgccatgcagaagagggaggactggatgacggcatgctttacagatggcctgcatctgtctgaagaggggagcaacatcgtggtggaagagatcctcaaggtgctcaaggaggcagacgactgggacccgtgcctgcactggaaggctttgccgacggagttcgccgaggactcgccctacgacctcgtctcctccagcggcgacgccaccgtgaacccctcggagtggaccatccacaggaagataccatgggactgagtgactggcagactgtgtgccttagccgcttcgaagcgggtcaattgagacgaataacgactagtttgacggcttttgtcacatggacgtagtatgcagctcgatcgatcgatcgatcatcttaatcagacctcaaataaagattattcttgattatttaatttcctgttcatggctatcatatttatactactatttcttcaagagatgagagcagaattattattatacatataactcatgtttgcggaaaaaaaaaaaaaaaaaaaa

SEQ ID NO: 8938 - protein, 257 aa, Panicum virgatum
  misc_feature: Ceres CLONE 2023115
  misc_feature (1)..(195): Pfam Name: Lipase_GDSL Pfam Description: GDSL-like Lipase/Acylhydrolase
MLGGRPVFVLFGSSIVQYSFSNGGWGAALADIYARKADILLRGYIGWNTRRALQVMDKVFPKDSPVQPSLVIVYFGGNDSIAAHSSGLGPHVPIDEYIDNMRKIAEHLKSLSEKTRVIFLSCPPLNEEMLRTSTSSTILSEIVRTNETCHLYSDACVALCKEMNLKVVDLWHAMQKREDWMTACFTDGLHLSEEGSNIVVEEILKVLKEADDWDPCLHWKALPTEFAEDSPYDLVSSSGDATVNPSEWTIHRKIPWD

SEQ ID NO: 8939 - DNA, 1568 bp, Panicum virgatum
  misc_feature: Ceres CLONE 2023123
  misc_feature: Encodes the peptide sequence at SEQ ID NO. 8940
aatcgatcgagcccacactgcactagctttctctcttgctcttccgagctccaagcgaaaagatggagtcgctagcacggttgcttctgctggtggccgcggccacgggcgccctggccgcgacgccgccccaccccgccaagggcctgcgcgtgcggctgacgcacgtcgacgcgcacggcaactactcgcggctgcagctgctgcagcgggcggcgcggcggagccaccaccgcatgtcgaggctcgtcgcgcgggccaccggcgtgccgatgtcgagcaaggccgtcgcgcggggcggtgatctgcaggtgccggtgcacgcgggcaacggcgagttcctgctggacctggccatcggcacgccggcgctggcgtacgcggccatcgtggacacaggcagcgacctggtgtggacgcagtgcaagccgtgcgtggagtgcttcaaccagagcacgccggtgttcgaccccgcgtcgtcctccacctactcccccgtgccgtgctccagcgacctgtgcggcgacctgcccacctccagctgcacgtcgtcggcggcgtcggccgggtgcgcgtacgcctacacctacggcgacgcctcgtcgacgcgcggggtgctggccaccgagaccttcacgctggccaagtccaagctccccggcgtggcgttcggctgcggcgacaccaacgagggcgacggcttcgcgcagggcgcggggctcgtggggctcgggcgcggcccgctgtcgctcgtctcccagctcggcctcgacaagttctcctactgcctcacctccctggacgacgccggcggcaagagcccgctgctcctgggctccgccgccggcatcgccgagagcgcggtcacggcgcccgcgcagagcaccccgctggtgaagaacccgagccagccgtccttctactacgtgaccctgacggggctcaccgtggggtccgcccgcatcgccctcccgagctcggcgttcgcgatccaggacgacggcacgggcggcgtcatcgtcgactctggcacctccatcacgtacctggaggcgccgggctaccgcgcgctgaggaaggcgttcgtggcgcagatgtccctgccggtcgccgacgggtcggagatcgggctggacctgtgcttccaggcgccggccaagggcgtggaccaggtgcgggtgcccaagctggtgctccacttcgacggcggcgcggacctggacctccccgccgagaactacatggtgctcgacgccgcgtccggcgcgctgtgcctgacggtgatgtcgtcgaggggcctctccatcatcggcaacttccagcagcagaacttccagttcgtgtacgacgtcgccggcgacacgctctcgttcgcgcccgtgcagtgcgccaagctgtgagccgccgggttcgttcgtagccgtacgcgcgcgagcgcgcggctgtacatgtgtggttgtattggatgggcgattgattggtcttcgctgcttgagcttgacgatggggtggttaccggtcagtgaatcgatgccgacctgtagatataaaaaaaaaaaaaaaaaaaa

SEQ ID NO: 8940 - protein, 445 aa, Panicum virgatum
  misc_feature: Ceres CLONE 2023123
  misc_feature (1)..(346): Pfam Name: Asp Pfam Description: Eukaryotic aspartyl protease
MESLARLLLLVAAATGALAATPPHPAKGLRVRLTHVDAHGNYSRLQLLQRAARRSHHRMSRLVARATGVPMSSKAVARGGDLQVPVHAGNGEFLLDLAIGTPALAYAAIVDTGSDLVWTQCKPCVECFNQSTPVFDPASSSTYSPVPCSSDLCGDLPTSSCTSSAASAGCAYAYTYGDASSTRGVLATETFTLAKSKLPGVAFGCGDTNEGDGFAQGAGLVGLGRGPLSLVSQLGLDKFSYCLTSLDDAGGKSPLLLGSAAGIAESAVTAPAQSTPLVKNPSQPSFYYVTLTGLTVGSARIALPSSAFAIQDDGTGGVIVDSGTSITYLEAPGYRALRKAFVAQMSLPVADGSEIGLDLCFQAPAKGVDQVRVPKLVLHFDGGADLDLPAENYMVLDAASGALCLTVMSSRGLSIIGNFQQQNFQFVYDVAGDTLSFAPVQCAKL

SEQ ID NO: 8941 - DNA, 1228 bp, Panicum virgatum
  misc_feature: Ceres CLONE 2023141
  misc_feature: Encodes the peptide sequence at SEQ ID NO. 8942
gagagataagggccaacagctcaacagaacatccaagcgaggctgcagactggaagaccctctcagagagagagagaggagaccttgcagaggagcgaagcgaggtgggaaagaggcagcagcaagggcggcgggctgccggaaggggaacatgctccctcctcatctcacagtatgaactgataaacaagaattgagaatttccatgagatgagacaaaatggcacaataatgatccaatttggtcatcaaatgcctgattacaactccccagctacccaatcaactagcgagagtcatcaagaagtgtctggaatgagcgaaggaagccttaacgatcataatgatcaatcaggtaatcatgatggttactcgaagagtgatgaaaataagatgatgtcagctttatctcttggcaatccagaaacagcttatgcacatccaaaaactgaccgtagtcagtcctttgctatatcatacccgtatgctgattcatactatggtggtgcagtggcagcttatgggcagcatgctattatgcacccccagcttgtgagcatggtgtcatcctctcgagtgccgttaccaatcgaaccagctgctgaagagcccatttatgtgaacgctaagcaataccatgcaattctccgacgcagacagctccgtgcaaagttagaggctgaaaacaagctggtgaaaagtcgcaagccataccttcacgagtctcggcacctgcatgccatgaagagagctcgggggacaggcgggcggttcctcaacacgaagcagcaatcagactcccctggcggcacctcggacgcgcagcgcatgcccgcgaacggcggcctgttcacgaagcacgagcacagcctcccgcccggcgaccgccattaccacgcgagagggggcgtttaaggaaccccccactggcaactcatccttggcttctcacgatttcgactcggctcttgtctgaactgaacttggggtttcagtaactgtaagcctgtaactaggtgcgaccgaattcgcggtcgttctgttctgggacctggccttgccaatgccggttctttggttccaatgccggttctttggtgaagccggccctttgtgtgacgagggtggaattggcacctgtttcctgtaacttgttctagacgatgactgctctaataagtaaaaactagcatttcgtttgaatcgcgaaaaaaaaaaaaaaaaaaaa

SEQ ID NO: 8942 - protein, 234 aa, Panicum virgatum
  misc_feature: Ceres CLONE 2023141
  misc_feature (1)..(57): Pfam Name: CBFB_NFYA Pfam Description: CCAAT-binding transcription factor (CBF-B/ NF-YA) subunit B
  misc_feature: The sequence is a functional homolog of  SEQ ID NO 1733 in the  11/479,226 US patent application
  misc_feature: The sequence is a functional homolog of  SEQ ID NO 230 in the  10/225,068 US patent application
  misc_feature: The sequence is a functional homolog of  SEQ ID NO 268 in the  10/374,780 US patent application
  misc_feature: Useful for making plants with modulated growth and phenotype characteristics
MRQNGTIMIQFGHQMPDYNSPATQSTSESHQEVSGMSEGSLNDHNDQSGNHDGYSKSDENKMMSALSLGNPETAYAHPKTDRSQSFAISYPYADSYYGGAVAAYGQHAIMHPQLVSMVSSSRVPLPIEPAAEEPIYVNAKQYHAILRRRQLRAKLEAENKLVKSRKPYLHESRHLHAMKRARGTGGRFLNTKQQSDSPGGTSDAQRMPANGGLFTKHEHSLPPGDRHYHARGGV

SEQ ID NO: 8943 - DNA, 1346 bp, Panicum virgatum
  misc_feature: Ceres CLONE 2023198
  misc_feature: Encodes the peptide sequence at SEQ ID NO. 8944
acgtcccgtccccaactcggacgcaactcccgctgcctcagccttgatctagggtttcggcgactggtctcctaccctccccgtgcccaccgtgtccctcgctcgcgttgaactcgccctccggcaaaccggaggcgaaggcgagcgggggcgcctctcttcgggctccggcgcaccgagttaccgatttgaggccgcttgaccatggcagcgacggggcaggaggaggatggcatcgaccactacgaggtgctctgcctgccgtcgggggaggaaggagctgcgctgaccatcgagcagatcgagaaggcctaccggacgcaatcgcggctgcggcaccccgacaagcgccccgacgaccccaacgccaccgcggacttccagcgcctttcgagctcctacaagctcctccgcgacgagtccctccgccgccagttcgacgcccgcctacgtggccgccgggaggcagcggcccgcgccgccgctgcgggcgtcaagcgccgcaaggcggtctccgacctcgaggaacgcgagcgcgccgccgccgcgggccagcccgccgaccccgaagagcttgccaagcgcgagatgaagcggacggccgccgacatccagcgcgagctcgacgagttccgcgtcgccaaggaggctgccacctcaggtgctggagcaacttcggggtatggagataagaagggtggagcctcgcaagatggggtgaaaacagacaagggcaagatcttgaaggttacatgggatgggagtgttgattcttatactgcagcaaagttggaagagctcttccagaaattcggcaaagttgaagatgtagtgatcaagacaaggaaatcaaggagtaagggctcagcaattgtagtcatgggcaccaaagaagctgcactattagcaatgcagaaccatttttctcttttcccattaaatgttgctcctgttcaagaatcgggtgggttaccagcaaggtcaactcaagcccatgaatcgaggacaagcaacattgatggaactggatttagcgatttggaagcatcggtattccggaaacttcaagaggcccagaaaaggaaacaatgtggttgattgcttctttctgaaacatgagtatgaatgacatgtcgcacattggatggtacctgaggattgctgcaccagacgagttacagaaatcagaactacacatttgtttaggtgggagtcttgtcgctgataaatttatccgactcagagcaacgacagatattttttttttggtcaatgcacaaactgtaccatgtatgtatgaatagtttgtaattctaattcctgactaaaaaaaaaaaaaaaaaaaa

SEQ ID NO: 8944 - protein, 297 aa, Panicum virgatum
  misc_feature: Ceres CLONE 2023198
  misc_feature (1)..(68): Pfam Name: DnaJ Pfam Description: DnaJ domain
MAATGQEEDGIDHYEVLCLPSGEEGAALTIEQIEKAYRTQSRLRHPDKRPDDPNATADFQRLSSSYKLLRDESLRRQFDARLRGRREAAARAAAAGVKRRKAVSDLEERERAAAAGQPADPEELAKREMKRTAADIQRELDEFRVAKEAATSGAGATSGYGDKKGGASQDGVKTDKGKILKVTWDGSVDSYTAAKLEELFQKFGKVEDVVIKTRKSRSKGSAIVVMGTKEAALLAMQNHFSLFPLNVAPVQESGGLPARSTQAHESRTSNIDGTGFSDLEASVFRKLQEAQKRKQCG

SEQ ID NO: 8945 - DNA, 705 bp, Panicum virgatum
  misc_feature: Ceres CLONE 2023199
  misc_feature: Encodes the peptide sequence at SEQ ID NO. 8946
gtgctccacgccacgcctctcggctcgccatggccacggcatcgacgcgggcgcacggcggcggccaccaccaccagcagctgccgccgccgcaatcccacgggctgcgatacgagccgctgcgccgcatgcagggcctggacctgaaggccgcgctccgtgccaggagcccgcgcgcgtccaccgtggccacggccgcgctcctcgtcccgctcggcgccgcgctgctgggcgcctcggggttcgcgctggctgcgaccctggcggggctcgcgctggccgcgccgctcctcgtgctcttcagcccggtgatcgtgcccgccgcgctggccgcggctctcgccgtgtcggccttcctggcgtcgggcgggctcggcgtcgcgggcgtctcggtgctcgcgtgggcctccgggtacgtatggcggggcggcggaggcaccggtgggggcctcaccgggatggtggtgcagccgctggaccacggggaaaagcggcgcggcgcggaaggccccgcggcgttcgtcggccaccggccccgggacatcgacatcgcctaggcgcgcggcgtgtcctcggtgttggagggtctgatttggatatatgcgtgatccattactccatcatgttgtagattctagctcggatgatatatgatgtaaatgttgttttaattaagatctcgaataaaaacggatttgtgctaaa

SEQ ID NO: 8946 - protein, 175 aa, Panicum virgatum
  misc_feature: Ceres CLONE 2023199
  misc_feature (5)..(82): Pfam Name: Oleosin Pfam Description: Oleosin
MATASTRAHGGGHHHQQLPPPQSHGLRYEPLRRMQGLDLKAALRARSPRASTVATAALLVPLGAALLGASGFALAATLAGLALAAPLLVLFSPVIVPAALAAALAVSAFLASGGLGVAGVSVLAWASGYVWRGGGGTGGGLTGMVVQPLDHGEKRRGAEGPAAFVGHRPRDIDIA

SEQ ID NO: 8947 - DNA, 838 bp, Panicum virgatum
  misc_feature: Ceres CLONE 2023212
  misc_feature: Encodes the peptide sequence at SEQ ID NO. 8948
gtttcaccagcgctacttgctctgctcggcgtgctcgcaccctgaacttgaacacccggccaccggtcaggcagcggagggaggcatggggtgcgacgacaagtgcgggtgcgcggtgccgtgccccggcggcaaggactgccggtgcgcgtcggcgagcggcgggcagcgggagcagcacgcgacgtgcacctgcggggagcactgcgagtgcagcccctgcacgtgcgggcgtgccactctgccgtccggccgggagaacaggagggccaactgctcctgcgggcccgcctgcaactgcccctcctgcagcgccacggcctgaccgatccatgcgcggcccgaagctgtgaagctctcgtctggtagagtcgccccgtctagacacactccagctggagctggaagctcgcatgttatagtcgcatctcttagtgttaaaagggtaataaagggcttgtgcaagttcaggctcagaactcggcatcaggcgacgcggcgtggtgtatgtcctactcagcagcggcggatgcacaggggggctggggctccagccccctaaaacaaataattatactcaaaatattatagtaaaaatattaatttactattaaaaatccatctcaatccctaactccattgattcagcctctcttgaccccaatcctacctctgccattggtcctactacctccgccactggtcctactattgtaagagaggactgaaggcagcatgtaaattatatagcatataagtttgtaaacacgtgtgagaatatggaataaataaaaaaaactgcacctgaagtcctgaacaaaaaaaaaaaaaaaaaaaa

SEQ ID NO: 8948 - protein, 79 aa, Panicum virgatum
  misc_feature: Ceres CLONE 2023212
  misc_feature (1)..(75): Pfam Name: Metallothio_PEC Pfam Description: Plant PEC family metallothionein
MGCDDKCGCAVPCPGGKDCRCASASGGQREQHATCTCGEHCECSPCTCGRATLPSGRENRRANCSCGPACNCPSCSATA

SEQ ID NO: 8949 - DNA, 1365 bp, Panicum virgatum
  misc_feature: Ceres CLONE 2023218
  misc_feature: Encodes the peptide sequence at SEQ ID NO. 8950
atcgccgccgccattccctccaccaccaactccccatcgcctcgccgccgccgcctcctcccccacactcctcacttcacctccaccctccgagctccagcgcctcccacggtcccaccacccaccacacccatggccgccaccgctatctccgcccgcctccacccggccgccgcgcgccccgtggccgcggcgcggcgcgcccgcctcggcgtcgtgcgcgcgctgtccgcgccgccggcggcggcgctgacgcaggacgacctcaagcgcctggcggcggtgcgcgcggtggagtcggtgcagagcgggatggtgctggggctcgggacggggtccacggccgccttcgccgtcgccgagatcggcgcgctcttcgcctccggcaagctcgagaagatcgtcggcgtgcccacctccaagcgcaccttcgagcaggcgcagtcgctcggcatcccgctctccacgctcgacgaccacccgcacatcgacctcgccatcgacggcgccgacgaggttgacccagaccttaaccttgtgaaagggcggggtggtgctcttctccgtgagaagatggttgaggctgcatcagacaagtttattgttattgttgatgagacaaaacttgttgatggattaggaggaagtggtctagctatgccagtggaggttgtgcagttctgctggaagtacaacctagtaagattgcaggaactgtttaaggaggaaggagtcgaggcaaagctaagattggaaggtgacaagccttatgttactgacaactcaaactacattgtcgatttatacttcaagacgccaattgaggatgcattggcagcagggacacagatcgcagctttggaaggagttgttgaccatgggttgttcttgaacatggcaagttcagtgatcatcgctggatcagatggtgtcagtgtcaaaacgaagtgagtttttgggttacttgttggtgttgaatttatggttcttctttttgttgtggaagctattggtgtaaaagcagtcaataacatgcttcagtagatgcaagcactgtcgcaggctggtggcgactggagtgcactctaagtcagccaaccagggttcgagacttgcattctcttaatgtcaaagcggggggcggtctgcctttcccgtcaagtttttctcttagcatgcttcaataaatatatttctccaatggtccattggttcacatccccgtgtttaggttgtcttcttgaagattgcctgttgtggtaatgtgggataaaagccattttactatattgtaatttctgctggactataagagtaatatttcagtgaaaaaaaaaaaaaaaataaaaaaaaaaaaaaaaaaaa

SEQ ID NO: 8950 - protein, 272 aa, Panicum virgatum
  misc_feature: Ceres CLONE 2023218
  misc_feature (1)..(180): Pfam Name: Rib_5-P_isom_A Pfam Description: Ribose 5- phosphate isomerase A (phosphoriboisomerase A)
MAATAISARLHPAAARPVAAARRARLGVVRALSAPPAAALTQDDLKRLAAVRAVESVQSGMVLGLGTGSTAAFAVAEIGALFASGKLEKIVGVPTSKRTFEQAQSLGIPLSTLDDHPHIDLAIDGADEVDPDLNLVKGRGGALLREKMVEAASDKFIVIVDETKLVDGLGGSGLAMPVEVVQFCWKYNLVRLQELFKEEGVEAKLRLEGDKPYVTDNSNYIVDLYFKTPIEDALAAGTQIAALEGVVDHGLFLNMASSVIIAGSDGVSVKTK

SEQ ID NO: 8951 - DNA, 941 bp, Panicum virgatum
  misc_feature: Ceres CLONE 2023275
  misc_feature: Encodes the peptide sequence at SEQ ID NO. 8952
acaagcaacgagctcaacatctatcctcgcactagagcaaaacagaagctcatctctatctcttgcttgcttcacacaatataataacaaagatcatctagctagctagcaatgactcccatggcgaccaccaccaagtccaagaatgccctggtgctcctcttcctggctctcctcccgctcgccacactctcctcccgcgccggcggcccgtccaagcacaaaagccatggccctgctaagcacccatcatcgcctcctcctccttcatctccaccctcatcaccaccggcaccagccgccgcgctggtgcgctccacctgcaactcgacggcatactacgacctgtgcgtgtccacactgagcaacgacccgtccagcgccacggcggccgacgtgcgggacctctcggccatcgccgtctcggccgccgccgccaacgcctcgggcggcgcggccacggcctccgctctggctgccaacgtctccaacgccacggcggggcagcaggcggcgctgctccgcacctgcgccgccaagtacggccaggcccgggacgcgctgtgggcggcgaggggctccatcgcgaggcaggactacgactccgcgtcggtgcaggtgagcgccgccgcggagtacccgcaggtgtgcagggtgctgttccagcggcagaggcccggcgcctacccgccggagctggcggccagggaggcggcgctccggcagctttgcaccgtcgcgctagacatcatcacgctcctctccaacagcagcacctagaagatcatccattattcccatgcatgcatatttatcctgtccatcatgttaagtagtgataccttaattattatattattacttgattccttcatgtacaagatcccgacacatgtaattaatgacacacgcatgtttacgaaaaaaaaaaaaaaaaaaaa

SEQ ID NO: 8952 - protein, 222 aa, Panicum virgatum
  misc_feature: Ceres CLONE 2023275
  misc_feature (1)..(161): Pfam Name: PMEI Pfam Description: Plant invertase/pectin methylesterase inhibitor
MTPMATTTKSKNALVLLFLALLPLATLSSRAGGPSKHKSHGPAKHPSSPPPPSSPPSSPPAPAAALVRSTCNSTAYYDLCVSTLSNDPSSATAADVRDLSAIAVSAAAANASGGAATASALAANVSNATAGQQAALLRTCAAKYGQARDALWAARGSIARQDYDSASVQVSAAAEYPQVCRVLFQRQRPGAYPPELAAREAALRQLCTVALDIITLLSNSST

SEQ ID NO: 8953 - DNA, 1171 bp, Panicum virgatum
  misc_feature: Ceres CLONE 2023344
  misc_feature: Encodes the peptide sequence at SEQ ID NO. 8954
aggtcagctcgatcagacactcattccactagcaagcttactagcttagcatcgatagccctcagagccacatgtcgtcgttgtcgtcgtcctattccaaggccagcaatggtggtgagccgcagctggtctgcgtcaccggagcaggcggcttcatcgggtcgtgggtcgtgaaggagctcctcctgcgcgggtaccgtgtcaggggaactgcaagggaccctgcggacagcaagaacgcgcacttgcttgcgctggagggggccagggagaggctcaccctctgccgcgccgacgtcctggactacgactcactccgtgcggcgttcaccggctgccatggcgtcctccacgtcgcctccccggtgtccaacaaccctgagctcgtgacggtggccgtggatggcaccaggaacgcgatcaacgccgcggcggacgagggtgttcgccgcgtggtcttcacctcctcgtacggcgccgtgcacatggaccccaaccggagccccgacgccgtcctcgacgagacctgctggagcgactacgaattctgcgagcagacaaacaacctgtactgctgcgccaagatgatggcggagatcacggcggtggagacggcggcggcgcgcgggctgccgctggcggtggtggtgccgagcgtcacgacgggcccgctgctgcagcaggcgctcaacgtcagcagcaaccacgtggcgcgctacctcatgggcaccaagaggacctaccccaacgccgtcgccgcctacgtcgacgtccgcgacgtcgcgcgcgcgcacgtcctggcctacgagcgccccgacgcgcgcggccgctacctctgcatcggcaccgtgctccaccgcgcccagctcatcgccgtgctcagggagctcttcccgcagtaccccgtcacggccaagtgtgaagacgacggcaagccgatggcgaagccgtacaagttttccaaccagagggccagggagttgggcttggagttcactccgctgaagaaaagtttgtacgaggctgtggtgtgcatgcagcagaaggggcaccttccagtcatcagccagcagcagcactcgtacttgtaaaccaaggcatgcgcgcgctgagtttgccactaattaaaataaaacagcgcaaacagaaacaaaaaaaaaaaaaaaaaaaa

SEQ ID NO: 8954 - protein, 339 aa, Panicum virgatum
  misc_feature: Ceres CLONE 2023344
  misc_feature (1)..(239): Pfam Name: Epimerase Pfam Description: NAD dependent epimerase/dehydratase family
MSSLSSSYSKASNGGEPQLVCVTGAGGFIGSWVVKELLLRGYRVRGTARDPADSKNAHLLALEGARERLTLCRADVLDYDSLRAAFTGCHGVLHVASPVSNNPELVTVAVDGTRNAINAAADEGVRRVVFTSSYGAVHMDPNRSPDAVLDETCWSDYEFCEQTNNLYCCAKMMAEITAVETAAARGLPLAVVVPSVTTGPLLQQALNVSSNHVARYLMGTKRTYPNAVAAYVDVRDVARAHVLAYERPDARGRYLCIGTVLHRAQLIAVLRELFPQYPVTAKCEDDGKPMAKPYKFSNQRARELGLEFTPLKKSLYEAVVCMQQKGHLPVISQQQHSYL

SEQ ID NO: 8955 - DNA, 1953 bp, Panicum virgatum
  misc_feature: Ceres CLONE 2023446
  misc_feature: Encodes the peptide sequence at SEQ ID NO. 8956
aatttcgccatcatatcatcaagagcacgggagatgctgagctcatgttgactggacgggggatttgcgggcggggggacacgaagagcacgggagagccgcacgctgcagaaaacgggtagctactgcttgcgagcagtgatcgtccaccgtgtcgcagcgcgggcggttggctccggccaaaaaaaaaaaaaacggaccttttcctgtccacaacccgactcgatagggcagacaggcgatagcggcgccgccgacggcgacgtcgtatccctgcccgaccgccggtgccgtgctccttcttcgtactctttccccggcggccggttcctcttcgacgccggcgagttcccccgccccgggcccttctcgcggacgtcgtcaatcgcctccgctccgactcttcccccactgccggtctgccaccaccgcggccgccgccgccgctaggccgggccggaccggcctccccggcatccctctgcacacaccggagaagatataagaagacatgttatgaagtgatgttcaaggttatcacctgcacctgcagaggtgggagatcgcaatggcgcacgtggaagctggaggatcactaccagtgccaaatgtgcaggcacttgcacaaacttacaacagatcagatgaacagatccctgaaagatacatcagggtggaagaggccactgaggaggttatcattgatcatggtatctcttctgcaattccaatcattgatgtcagcaagttgctggatctgcattcatcaaaagaggagtgcgcgaagcttggatctgcctgtaggcagtggggcttctttcaggtcattaaccatggtgtaccagatgaagtgatcagcaacttcaggaacgacataactgaattctttaaacaaccactggaatcaaagaaggtgtactcgatgatcccgggcaaccttcaaggatatggccagcactttgtagtttctgagaatcaaaaactggattgggcagacttattcagtctcgtgctccgtccaatagattcaagggacatgagattctggccaagtcaccccccatcttttaggaactccatagataggtactcttctgaggcagcaaagttagtatcttgcttgctgaagttcctggccatagacatgggtgttgaaccagagtctttcctggagatattcagaggccagcctcaaaacatgcggatgacctactaccctccatgcagacaggctgacaaggttgtgggcctgtcaccacacactgatagaatgggactgactctattgctccaagcaaatgatgttcaggggctgcagatccgaaaggatggcaagtggatcgctataaacgcccttgatggtgcgttcatcgtcaacatcggagatacacttgagattctaagcaacgggagatacaaaagcgttgagcacagggccatggtgcacccaacaagggagcgcatgtcagcagctgtgttccacgcggtatgctgggatgccacagttggccctctgccggagctcgtgacgaaggacggtgaggtacggtacagctcaatgagctacatggatttcatgaagcgcttctttgcggcaaagctcggtgggaggggtcacatcgagagcctgaagagttcatagtcagcggggatagataatgcttgatctgtgtacatatagcctttgtgagactttttctggtgtttgtattgttctgtgctgtatgcttgcagcttgatcatcttctatttctgttctgtcccccagacttcctttgctgataaagttttttttattttgcatgtaatgtatatatggtgtttgttataattttcattttcagaatgaaaaaaaggagaaaatatagccggtgctgtagtcatactttgctgaaataaaaagtgtacttgcatgaggaacatgtttctcgccaaaaaaaaaaaaaaaaaaaa

SEQ ID NO: 8956 - protein, 357 aa, Panicum virgatum
  misc_feature: Ceres CLONE 2023446
  misc_feature (1)..(99): Pfam Name: 2OG-FeII_Oxy Pfam Description: 2OG-Fe(II) oxygenase superfamily
MAHVEAGGSLPVPNVQALAQTYNRSDEQIPERYIRVEEATEEVIIDHGISSAIPIIDVSKLLDLHSSKEECAKLGSACRQWGFFQVINHGVPDEVISNFRNDITEFFKQPLESKKVYSMIPGNLQGYGQHFVVSENQKLDWADLFSLVLRPIDSRDMRFWPSHPPSFRNSIDRYSSEAAKLVSCLLKFLAIDMGVEPESFLEIFRGQPQNMRMTYYPPCRQADKVVGLSPHTDRMGLTLLLQANDVQGLQIRKDGKWIAINALDGAFIVNIGDTLEILSNGRYKSVEHRAMVHPTRERMSAAVFHAVCWDATVGPLPELVTKDGEVRYSSMSYMDFMKRFFAAKLGGRGHIESLKSS

SEQ ID NO: 8957 - DNA, 840 bp, Panicum virgatum
  misc_feature: Ceres CLONE 2023489
  misc_feature: Encodes the peptide sequence at SEQ ID NO. 8958
aagcaagatcagagcagcagccaaaagttgagagcattagcgaatacgcagcttggtggtgttgtcttcttttctccttatccagttccaccagttcattcattcggtcccgtcgaccgatcatggcggccaactaccaccactaccagatggccgtgcacgccgcggcggcggcggcagcggcgtggagggagccggacagcccgcagctgagcttcgtgagcggctgcagctccctcttctccatctccacgctgcaggacgacgacgacggcgccgtcgtcatcgccggccacgcgctgccctccacgcccatctcgctcgccgggttcgccggcgacgaggtcgacatggaggtgcagcagatcagcggcggcagcggcgacgaccggaggtccatcaggatgatgaggaacagggagtccgcgctccggtccagggccaggaagagggcatacgtagaaaatctggagaaagaggttcgccggctggtggatgagaacttgaagctcaagaagcagtgcaaagagcttaaactggaagtggctgcactggtcctccctaccaagagctcgctgcgaagaacctcatcgacgcaattctgaagggacaaagaaacatgaacacattttatttgccagtacaaaattaagagaagatagatggatcatcgacgcaagagggttgattggacttgtgtgtacatgtgttagtgtgtgtttgtgtgccgtagaggaggggagatagatggatatgcaatgatctgtaccttgacgctagatctctgcaaagatgaacgtcttttaatttcttgagctgcaaaaaaaaaaaaaaaaaaaa

SEQ ID NO: 8958 - protein, 160 aa, Panicum virgatum
  misc_feature: Ceres CLONE 2023489
  misc_feature (1)..(65): Pfam Name: bZIP_1 Pfam Description: bZIP transcription factor
  misc_feature (2)..(53): Pfam Name: bZIP_2 Pfam Description: Basic region leucine zipper
  misc_feature: The sequence is a functional homolog of  SEQ ID NO 933 in the  10/374,780 US patent application
  misc_feature: Useful for making plants with modulated growth and phenotype characteristics
MAANYHHYQMAVHAAAAAAAAWREPDSPQLSFVSGCSSLFSISTLQDDDDGAVVIAGHALPSTPISLAGFAGDEVDMEVQQISGGSGDDRRSIRMMRNRESALRSRARKRAYVENLEKEVRRLVDENLKLKKQCKELKLEVAALVLPTKSSLRRTSSTQF

SEQ ID NO: 8959 - DNA, 664 bp, Panicum virgatum
  misc_feature: Ceres CLONE 2023503
  misc_feature: Encodes the peptide sequence at SEQ ID NO. 8960
attccaaaagcacacgagcacgcagaagcagtgtctcaacttcttgcattgctcgcggcaccacacactgcacagactgccaatggctgccaaggttgccctcttcctggccctgagcctcctcttcgccgccgccgcgcacggctgcgcaccctactgccccggccccgtcgtcccgaccccgccggtcgtgccgaccccgtcccatagccacgggcgctgcccgatcgacgcgctcaagctcagggtgtgcgccaacgtgctgggcctcgtcaaggtcggcctgccccagtacgacgagtgctgcccgctgctgcaggggctcgtcgacctcgacgccgccgtctgcctctgcaccgcgatcaaggccgacgttctgggcatccacctcaacgtgcccatcagcctcaacctcatcctcaacaagtgtggcaagatttgcccggccgacttcacttgccctcagtgagatgggggagctgatcgattgagataatgccagcataaggaacctagatttgtcgatctccactcttgcgattcagcggcgacatatatgtcttgttaaatgattactgtacctttttcttttgcgaggaaccttgtacgaagttgtactaccattttaaattgtcaacgaaaaatgttcaccttttctttgcag

SEQ ID NO: 8960 - protein, 128 aa, Panicum virgatum
  misc_feature: Ceres CLONE 2023503
  misc_feature (1)..(80): Pfam Name: Tryp_alpha_amyl Pfam Description: Protease inhibitor/seed storage/LTP family
MAAKVALFLALSLLFAAAAHGCAPYCPGPVVPTPPVVPTPSHSHGRCPIDALKLRVCANVLGLVKVGLPQYDECCPLLQGLVDLDAAVCLCTAIKADVLGIHLNVPISLNLILNKCGKICPADFTCPQ

SEQ ID NO: 8961 - DNA, 1306 bp, Panicum virgatum
  misc_feature: Ceres CLONE 2023513
  misc_feature: Encodes the peptide sequence at SEQ ID NO. 8962
agctcagcctcagctcagataatagtaacagctcctttcctccctctcgaggtgtctcccaaaacacaccccaccccaccccatcgccgcagtcactgagccaagaacaagagcagcgcgatgagaggaggagcggggcccacggtggcgttcgtcgccggcgactcgcctccggatgcagcggcggaggaggaggtggaggagaactctggcggcgaggaggagcagcaggaggacgacgagctggagctggggctctgcctaggctccaagaagcagcagcagcccccgtcgccagcgccgtgccggatcctgacggccagggacctgcagccgggggccctgtctccggactcctccgtgtcctcctcctcccccgcggcaggggcagcggcggccagcaagagggccaaggcggatacagcgcccaacgccaccacctcgccggggacggtcgcttctggccacccacagagcagctttggagttgtcggatggccacccataagaactttcaggatgaacagcctattcaaccaggccaaagacaatgcttcagaggctggcaccaagaaggctgccgatgaatcttgcatgcagaaagacaagaaggggagcgagaagaaaggacgggttgtcggctgggtgaaggtgaacatggatggagatatcattggaaggaaggtcgatcttaacgcccattgttcgtataagacccttgcgtcagcacttgagctaatgttcatgaagccgtccatcagtctttgcacttctagtagtgcaaagtctctgaatctattggacagctcatcggaatatcaactcacctatgaggacagggatggggattggatgctcgtcggagatgttccatgggagatgtttgtaggttcagtgaagaggctcaagatcatgaggacatcagatgctaatggtctcggtccgcaattccaaggggttcacagagctgcaggttccccaagaggtagaacttgagaagcactgatggcgttcgatctagagagctataccgctggtgaagcttgaaatgtgtttgatatcacataacaacagtccggtctttggcatagttgtgagattacatgtgtctagtggaaatagtagaaatgctgtgaaggagccacaccaccgtgttctattcttttttcttgcccctcggtgcgctctttgagctctcttctcatggctctgagcatcctccccgcctcttctgtccacactgtttttatctgttaagcatggtcgcccaaagtgtcggtttttccaaaaaaaaaaaaaaaaaaaa

SEQ ID NO: 8962 - protein, 291 aa, Panicum virgatum
  misc_feature: Ceres CLONE 2023513
  misc_feature (1)..(232): Pfam Name: AUX_IAA Pfam Description: AUX/IAA family
  misc_feature: The sequence is a functional homolog of  SEQ ID NO 1149 in the  10/412,699 US patent application
  misc_feature: The sequence is a functional homolog of  SEQ ID NO 1780 in the  10/412,699 US patent application
  misc_feature: The sequence is a functional homolog of  SEQ ID NO 2008 in the  10/374,780 US patent application
  misc_feature: The sequence is a functional homolog of  SEQ ID NO 678 in the  11/479,226 US patent application
  misc_feature: The sequence is a functional homolog of  SEQ ID NO 742 in the  10/374,780 US patent application
  misc_feature: Useful for making plants with modulated growth and phenotype characteristics
MRGGAGPTVAFVAGDSPPDAAAEEEVEENSGGEEEQQEDDELELGLCLGSKKQQQPPSPAPCRILTARDLQPGALSPDSSVSSSSPAAGAAAASKRAKADTAPNATTSPGTVASGHPQSSFGVVGWPPIRTFRMNSLFNQAKDNASEAGTKKAADESCMQKDKKGSEKKGRVVGWVKVNMDGDIIGRKVDLNAHCSYKTLASALELMFMKPSISLCTSSSAKSLNLLDSSSEYQLTYEDRDGDWMLVGDVPWEMFVGSVKRLKIMRTSDANGLGPQFQGVHRAAGSPRGRT

SEQ ID NO: 8963 - DNA, 858 bp, Panicum virgatum
  misc_feature: Ceres CLONE 2023560
  misc_feature: Encodes the peptide sequence at SEQ ID NO. 8964
gcaaacctcaaagcttcgaagtcacgggttcacactcactcgtgcttcaacgcagaatcggagcaaaggcgcccgcggtttcttcagcatgggcggcgttcccggcgccgcgcgccgccacatcctgctcctcctctccgtcgccctggccgccatctccctctaccgcggcgccgcggctccctcgccggtgtacgacacggacgggcaggagctgagcgccgacgcggactactacgtgctcccggccgcccgcgggggcggcgggctcaccatggcgcccaacgtgttccggtgcccgctgttcgtggcgcaggaggccgacccgctccgcaagggcttccccgtgcgcctcaccccgctgcacgggcacggcggcgaccgcaccgtgcgcgtctccttcgacgtcggcgtgcacttcgccgccgtgacgacgtgcgtgcagaccaccgagtggcacgtcgccgtccgcggcgacgagggcgggggcggcgcccgccggcacgttgtcactggcccggtcctggccccgaccgcgggcggccgggagagggtgttccgcgtcgaggggcaccgccacgggtacacgctggcgtggtgcggggtccccaccgagtgccaggacctgggcgtgttcagggacgacaggggccgcgcgtggctcaccgtggccgacgaccagccgcctcatgtggtcgtgttcaagaagacgccgcccataccggcgtgatagggggtttccgcttgcagcgtgcgtgagcgtgtgcgtgccgaataagaaggcgcttgttccgttactagcgacgaactctgctgttgtattacgtatacggtatacaagaggttctgtacctgagc

SEQ ID NO: 8964 - protein, 213 aa, Panicum virgatum
  misc_feature: Ceres CLONE 2023560
  misc_feature (1)..(168): Pfam Name: Kunitz_legume Pfam Description: Trypsin and protease inhibitor
MGGVPGAARRHILLLLSVALAAISLYRGAAAPSPVYDTDGQELSADADYYVLPAARGGGGLTMAPNVFRCPLFVAQEADPLRKGFPVRLTPLHGHGGDRTVRVSFDVGVHFAAVTTCVQTTEWHVAVRGDEGGGGARRHVVTGPVLAPTAGGRERVFRVEGHRHGYTLAWCGVPTECQDLGVFRDDRGRAWLTVADDQPPHVVVFKKTPPIPA

SEQ ID NO: 8965 - DNA, 964 bp, Panicum virgatum
  misc_feature: Ceres CLONE 2023641
  misc_feature: Encodes the peptide sequence at SEQ ID NO. 8966
gcgactaagccagcgtggtccacgtgatgctctagttccgtctctatatatatgcgtgctgcgtgctacgcttaaccagcacacaataatcagcatcgtcagactattccacgcataggccgccggacgagagcatggccaagcagctggaagaccaccggagcaacgacggcgaggtcgagttgggggcgatgatgatgacggagtggaagctggaaccgggcgtcgccagcaagctgttcgacgccttcaccgtcgccggcctctgcgtcgacgccatcgagcccggccgcgccatgatctgctctttcacggtgccgccgcgccttacggacgcgagcaagcgcatgcatggaggggccttggcgtctctggtcgacctggtgggctcggccgtgttcttcgctggcggctcgccgacgacgggggtgtccctggagatcaccatctcgtacctaaccgcggcccgtgcaaacgaggagatcgagatcgacgcgagggtcctgggcatcggcgcgacggcggggtgcgtgacggtggaggtcaggaagaaggccaccggcgaggtgatcgcgcacggccggcacaccaagtacctcgccgtctccagcaaactgtgatgtatggatggatatcacgatcaggatcggatggatggagcgcgtacgtacgcgcgcgcattaggtcgctctcgcctatatatatgcattccctcgtgtaatacacactacaagaaaagtgtgcattagtaccgggcggaaacccttggttagtaccggtttctcgcccggtaccgccccatcggtactaaatgcgtttgcatttagtacaggttgggctgaccagtactaaatagtatatttagtaccggtcaccaataccaggcggtattaaagaaattgtggcgcaaaaaaaaatttaaattgcttctcccgcttctcatcaaaaaaaaaaaaaaaaaaaa

SEQ ID NO: 8966 - protein, 161 aa, Panicum virgatum
  misc_feature: Ceres CLONE 2023641
  misc_feature (1)..(75): Pfam Name: 4HBT Pfam Description: Thioesterase superfamily
MAKQLEDHRSNDGEVELGAMMMTEWKLEPGVASKLFDAFTVAGLCVDAIEPGRAMICSFTVPPRLTDASKRMHGGALASLVDLVGSAVFFAGGSPTTGVSLEITISYLTAARANEEIEIDARVLGIGATAGCVTVEVRKKATGEVIAHGRHTKYLAVSSKL

SEQ ID NO: 8967 - DNA, 1407 bp, Panicum virgatum
  misc_feature: Ceres CLONE 2023655
  misc_feature: Encodes the peptide sequence at SEQ ID NO. 8968
agtagcttaacctagatcccccgtcctgtcacgtcaccctccagctccaggccaccctccaaccttcccagccatggactccgccgaaatccccaaccccagcccggacgctaccaccaaccccgccgccgccgccgccgccgcccccgcccccgcccccggctccgatccctcctcgtcgccgccgctcccgccgcgcaagcgccgcctctccccttccccctcccccaggcgctccgcctcccgctctcggtccccccgctcccctcacggccgccgctcccgctcccgctcccgctccccgcgcggccgccgctcccgctcccgctctcgctcccgcagccgcagccacagccctcagtacccgcccgatggcaagcggcggcgccataacgacctcaacgtcgaggcgtgccgcgacttcctgcgcgacaggtgcacccgctccgacctcgagtgcagatacgcgcacccgcacccttccgtctccgtcgacagggagaacaaggtgacggcatgcgcggattcgctgaggaacagttgcttccgggggaggacatgccgctactaccacccgcctccgcatatccaggaacaattactgagatcaattggtgtggaagactcaaagttgaagacgatctgcagagattttgcacgtggaaagtgttcaagatcagcaaatgagtgccgattcatgcaccattcatctgttgaagggcttacaattgtttgccaagatttcttgcgtggacagtgcaaccgcaaatcatgtaggtactctcatgtagtagcacatccagtgccaccaatgagccatgttcctatgccatatcccgagatgctttacatgccaccgccgccaccaccaccccttggagtaccaatgatgggacctccaccttcacctcctagaccatttgcagataataagaacagagtggaagtctgtagggacttcttgaagaatatgtgtaatagagaatcctgccgatatttgcaccctgatccacatacctcggcaatgagtgacaatgttgaagtttgccgtgattttaaacgaggagaatgcaaccgacctgcctgtcgctttttccatccatatacaagctgaagttgccgttagctaaatctgagtgccctgccctgcgctgctgctgctgctgtgctgctgccgccgccgccgccacctatcctgctgctgctgctgccaaagaactctgctgtgctcgctattgtgttgctgctaaggtgccatagagtatggaaaccttagaaggtgctatgtatgcatggaataaagattactatcatcgtgtgatgttctaatggttgcttgaacttgactcggtgctcgagagtagtacccctgtacactggggatcgcaaaaaaaaaaaaaaaaaaaa

SEQ ID NO: 8968 - protein, 346 aa, Panicum virgatum
  misc_feature: Ceres CLONE 2023655
  misc_feature (1)..(26): Pfam Name: zf-CCCH Pfam Description: Zinc finger C-x8-C-x5-C-x3-H type (and similar)
MDSAEIPNPSPDATTNPAAAAAAAPAPAPGSDPSSSPPLPPRKRRLSPSPSPRRSASRSRSPRSPHGRRSRSRSRSPRGRRSRSRSRSRSRSHSPQYPPDGKRRRHNDLNVEACRDFLRDRCTRSDLECRYAHPHPSVSVDRENKVTACADSLRNSCFRGRTCRYYHPPPHIQEQLLRSIGVEDSKLKTICRDFARGKCSRSANECRFMHHSSVEGLTIVCQDFLRGQCNRKSCRYSHVVAHPVPPMSHVPMPYPEMLYMPPPPPPPLGVPMMGPPPSPPRPFADNKNRVEVCRDFLKNMCNRESCRYLHPDPHTSAMSDNVEVCRDFKRGECNRPACRFFHPYTS

SEQ ID NO: 8969 - DNA, 943 bp, Panicum virgatum
  misc_feature: Ceres CLONE 2023729
  misc_feature: Encodes the peptide sequence at SEQ ID NO. 8970
aattccagccgctagcaccgacgacgccagccgagagcggtcgatcgaggcgtcgtagagaagctgcccgcaaaaccatccccggctacggatcgattgtggattggacaacctttaggcaaatttggttgtaatctggagtcttgaggctaattacaggcagaactgaactgaacctaatatggcttctttgccattggccaccgccgaagtatgtgactccaatgctggtttaattctgaatggtgatcttcgtgccctccaaccaatcttccgtatctatggaaggcgacagatttttgctggccctgttgtgacactgaagatcttcgaggacaacgttctgctccgtgagttactggaggagaaaggtcatggcagggtcctggtggtcgatggtggcgggagcacgcgctgcgctattttgggcagcaacctcgctcagctagcgcagaacaatgggtgggctggcattgtgattgatggttgcatcagggacgtcgatgagatcaacggctgtgatgttggcatccgtgctctaaactcacatcccatgaagtcgaacaagaagggtgtcggtgagaagcatgtccctgtgacctttgcaggaaccagaatttgtgatggcgagtggctgtatgctgattctgatggtatccttctctcaaattcagaattaacagtgtagacctgctccatccgtatccagtgtgtagtgggcgcttcaaaggaaggcatatcacatgtcatgttggtgctatatattgtctgaactttatgtaactagtatcctgttgaatcacatgactagtgggaataatttgtatttccatagttactaagtcttttcaattcaccgtttgtaaaattttttttgtggcttcccggtttcatatttgtaattttttcagttactaatttgtaaaaaaaaaaaaaaaaaaaa

SEQ ID NO: 8970 - protein, 168 aa, Panicum virgatum
  misc_feature: Ceres CLONE 2023729
  misc_feature (1)..(158): Pfam Name: Methyltransf_6 Pfam Description: Demethylmenaquinone methyltransferase
MASLPLATAEVCDSNAGLILNGDLRALQPIFRIYGRRQIFAGPVVTLKIFEDNVLLRELLEEKGHGRVLVVDGGGSTRCAILGSNLAQLAQNNGWAGIVIDGCIRDVDEINGCDVGIRALNSHPMKSNKKGVGEKHVPVTFAGTRICDGEWLYADSDGILLSNSELTV

SEQ ID NO: 8971 - DNA, 1020 bp, Panicum virgatum
  misc_feature: Ceres CLONE 2023763
  misc_feature: Encodes the peptide sequence at SEQ ID NO. 8972
atgccagatactccacctccaatttaaagcgcgtattaacgagagcatcaagccaccaacgctagacaagtcgcaaacaaacgtagaggacgacgatggacgttgtggtgagaaggtcaccgtcaatggtggtgaggccgtcagccgcaacgagcggcggcgccataaagctctcgtctttcgacaggcctaatgccacggtgccggtcacggcgttcctcgtgttcgagaatccgatccgcgacgccgccgagaccatcaagagagcactctcccgagcattggtcccctactaccctatctcgggtcgtattgttgcagggcctggctgcggcggcggcgatgactacgaggagctccacatccggtgcagcggcaagggcggcgtggcattcgtcgccgcgtccgccaaccgtgccttgaaggacgccgaattcttcgccagattgcctgacacaaggacaccgccgctggtggaagagctcgccgtctactacccggccgggcaatgcggcgctgccgacccgttgctgctgatgcaagtgacggagttctcctgcggcgggttcgtcgtgggtgtgacctggaaccatggcgccgccgacggcaccgggatggcccagttcttgcaggccgtgaatgtttctgcagggtccagcggtttgtcctgattctctggctccatcttttttcgcttctttggcggtggcggaggaggtgagccaggagatggcggctcgacaggagtagtcgacggctgcctaggagatgaagacgaaggagagtgttctggggcatgtcccaaagacggtggcggaggaggtgaatgacgatcgggttgcgatgccggccttgatccctgatcgttaggcttcaggatgatgtactgcttgtctcatggtatgtaaccatgaacggcgtctgctagtattgtctccccgtcacctctaggaatatcaagctcgagattcttccaatcaatgcacacctcctcgaccccaaaaaaaaaaaaaaaaaaaa

SEQ ID NO: 8972 - protein, 191 aa, Panicum virgatum
  misc_feature: Ceres CLONE 2023763
  misc_feature (2)..(176): Pfam Name: Transferase Pfam Description: Transferase family
MDVVVRRSPSMVVRPSAATSGGAIKLSSFDRPNATVPVTAFLVFENPIRDAAETIKRALSRALVPYYPISGRIVAGPGCGGGDDYEELHIRCSGKGGVAFVAASANRALKDAEFFARLPDTRTPPLVEELAVYYPAGQCGAADPLLLMQVTEFSCGGFVVGVTWNHGAADGTGMAQFLQAVNVSAGSSGLS

SEQ ID NO: 8973 - DNA, 1175 bp, Panicum virgatum
  misc_feature: Ceres CLONE 2023837
  misc_feature: Encodes the peptide sequence at SEQ ID NO. 8974
ggcgcgttttttcccccgtcccctctctcgcttcgcatccatggcttcctcatctatccaccaccccctgctcgccggcggcgatatccgccgaaccctagagggctcctccccctcccgctccgcgtcctactgctccgacgacgccttcgtccccgtcttccgcccggacccctccgcgccctccgcctcggcggcggccgcggcggtcgaccgcgtccgcaggctgttcagctccgtggacgccgccctcttccgcgacgcgatcctcgcgcccgcgcccgggggcgaggacctcgggttcaccgaggtcgacgcggaggcggactacgacggggatctcacctcgatctgctgggattgcctcgagatcgaggacgcagacgagccggatctgccgctcgtcgtgggctcccccgccgaggagttcgagtgggaggaggtcgcgtccccctcgggtgccgccggggaggccccggagcccgagtgggaggtgctcgccgacgagccccttccggccgacgccgacgccgaggaggggttcgtgtacacctcccacagggggatggcagaggtgctggtcgccggcggggacgggctgttcctgaagaacaagccgccggcggccagatcggccgtggaatcgttacgttccgccgtcgtcgcggccggcgaggaaggggagggggaggagtgctcggtctgcaaggacggggtcgcggctgggcagcgcgtgaagaggctgctgtgctcgcaccggtaccacgacgagtgcatcgtaccgtggctccaggtgagcaactcgtgcccgctctgccggttcgagctgcctaccgacgacccggagtacgagacctggaaagccgggcggaccgtggctgcctgaatcagcttcgcggttagggcaaagttctactggtatggttttatagagttgtgtggtttggttttgaatcggccgctccgattacaaggttgttactcagttgtatgaaagtataggcagctgcagagatggttttgcatcgagaggaatttgatgttgtcttaacgacagagaggttgacatatactagttgctactgctgtatttattctaagttgatagagggtagctgtatatcttgatcagaaaatttcatttgcttggtactgaaaaaaaaaaaaaaaaaaaa

SEQ ID NO: 8974 - protein, 281 aa, Panicum virgatum
  misc_feature: Ceres CLONE 2023837
  misc_feature (1)..(41): Pfam Name: zf-C3HC4 Pfam Description: Zinc finger, C3HC4 type (RING finger)
MASSSIHHPLLAGGDIRRTLEGSSPSRSASYCSDDAFVPVFRPDPSAPSASAAAAAVDRVRRLFSSVDAALFRDAILAPAPGGEDLGFTEVDAEADYDGDLTSICWDCLEIEDADEPDLPLVVGSPAEEFEWEEVASPSGAAGEAPEPEWEVLADEPLPADADAEEGFVYTSHRGMAEVLVAGGDGLFLKNKPPAARSAVESLRSAVVAAGEEGEGEECSVCKDGVAAGQRVKRLLCSHRYHDECIVPWLQVSNSCPLCRFELPTDDPEYETWKAGRTVAA

SEQ ID NO: 8975 - DNA, 872 bp, Panicum virgatum
  misc_feature: Ceres CLONE 2023871
  misc_feature: Encodes the peptide sequence at SEQ ID NO. 8976
aatccctcctcctacccccacctgcaggcatccagccgccacccaccccagcccccctcccgacgcaacaattggtggagctccgcggcgagcagcgcagcagtcgtcgcggctccaatgtgctcaccgcaccgttcctgctagccgagggatgggtcatgcggagctagttgctcggcgccggcggtagatccagcggcaccccaacggatcgaggggctcgcatgtccagcaatgccaatatggtcgcgcggccgtaggagccatgccgctgaggtctacaagaagtttagaagctaattttgctgctagacctcaacatggagaagctaattccgttgcagctgggcctcaaagagtacgccgaggaggtgctggacctcaacatggagaagcccgacgccatcgccataagcgaccaggagaagcgggacctggagcggggccaggtcgggtatgccgtcgtcgacacctacatgtcctacaggctgggcgagagatccagtgccagatccggcatcagttccagccattgcgcgacgccctcgacccctagagcggacgtgccagatctggcggcggcggcgaccctcggccccctccccgacggcgagcatgatctggagcggcgacccctgggtccctggacccccgggtctatggacccgcggcggaaggggacggggcagcggcggattcgcgacgagcatctcgttccccattcccgcttggagttcaaaattcctccttttttccgcagggatgcatagtggcattttctatgatatgtactttgagtttctatgacttactgttgcatttaatcatgtacagattcaattagcattttccaaaaaaaaaaaaaaaaaaaa

SEQ ID NO: 8976 - protein, 149 aa, Panicum virgatum
  misc_feature: Ceres CLONE 2023871
  misc_feature (127)..(179): Pfam Name: 3_5_exonuc Pfam Description: 3'-5' exonuclease
MEKLIPLQLGLKEYAEEVLDLNMEKPDAIAISDQEKRDLERGQVGYAVVDTYMSYRLGERSSARSGISSSHCATPSTPRADVPDLAAAATLGPLPDGEHDLERRPLGPWTPGSMDPRRKGTGQRRIRDEHLVPHSRLEFKIPPFFRRDA

SEQ ID NO: 8977 - DNA, 1273 bp, Panicum virgatum
  misc_feature: Ceres CLONE 2023907
  misc_feature: Encodes the peptide sequence at SEQ ID NO. 8978
ataaccaaactctctattttatttttttctttatttacaaagaaaaaaatatctcttttataagcgctcaacttttttttgttacgaattttttttcttttaacgaccccttttttttttctttaacgaaaaactcccttttttaacgaaacttttactttttttttaacgaactttaacaattttaaacatgactgtcaacgctggtattaatggttttggtcgtattggccgtattgtcttacgtgcatctctcgataaccccgatgtaaacgttgttgctattaacgacccatttattgaccttgattacatggtttacatgtttaaatacgactcaactcatggccgattcaaaggcacagttgagaaaaaagatggcaagcttgttgtaaacggccaatcaatctctgttcacactgaacgtgatcctgccaatattccttggggacaagacggtgctgattatgtggttgagtccactggtgtctttacgactgtccaggctgcctctgctcatctcaaaggtggggcgaaaaaggttattatttcggctccctcggcagatgcgcccatgtttgtatgtggtgtgaatttggaaaagtacacgtctgacctgactgtgatttcaaacgcttcttgtacaaccaattgcttggctcccttggcaaaggtgattcatgataactatggtatccttgaaggcttgatgacgacagtgcacgcgacgacggccactcagaaaacagtcgatggtccttccaataaagactggagaggtggtcgtggcgcgggtgcgaacatcattccttcctcgacaggtgctgctaaagcagttggcaaggtaattcctgagctcaatggtaaattaaccggtatggcattcagagtacccactccggatgtctccgtagttgatctaacagtgcgactggaaaagcctgcgtcctatgatgaaattaaagctgtcatcaaacaagcgtctgaaagtgaagctctaaagggcattctcggttatactgaggatcaagtagtcagtaccgactttgtcagtgacacgcattcttctatgttcgatgctaaagctggtattcaattatctcctaccttcgtgaaacttgtctcgtggtatgataatgaatatggttatagtacgagagtagtcgatttgctagcttacgtggcgaaagtcgatggtgccctgtaaaaattgtagttattcaatacccacctccaaaatacatacaaactcaaaaaaaaaaaaaaaaaaaaa

SEQ ID NO: 8978 - protein, 338 aa, Panicum virgatum
  misc_feature: Ceres CLONE 2023907
  misc_feature (1)..(159): Pfam Name: Gp_dh_C Pfam Description: Glyceraldehyde 3-phosphate dehydrogenase, C-terminal domain
  misc_feature (1)..(337): SWISSPROT Homolog: EC 1.2.1.12 Glyceraldehyde-3-phosphate dehydrogenase 2
  misc_feature (2)..(338): SWISSPROT Homolog: EC 1.2.1.12 Glyceraldehyde-3-phosphate dehydrogenase 3
MTVNAGINGFGRIGRIVLRASLDNPDVNVVAINDPFIDLDYMVYMFKYDSTHGRFKGTVEKKDGKLVVNGQSISVHTERDPANIPWGQDGADYVVESTGVFTTVQAASAHLKGGAKKVIISAPSADAPMFVCGVNLEKYTSDLTVISNASCTTNCLAPLAKVIHDNYGILEGLMTTVHATTATQKTVDGPSNKDWRGGRGAGANIIPSSTGAAKAVGKVIPELNGKLTGMAFRVPTPDVSVVDLTVRLEKPASYDEIKAVIKQASESEALKGILGYTEDQVVSTDFVSDTHSSMFDAKAGIQLSPTFVKLVSWYDNEYGYSTRVVDLLAYVAKVDGAL

SEQ ID NO: 8979 - DNA, 1032 bp, Panicum virgatum
  misc_feature: Ceres CLONE 2023955
  misc_feature: Encodes the peptide sequence at SEQ ID NO. 8980
cgttcggctccaaaagaactcgggacggggaaggcacgacggacggagatggcggaggcggtgtcgtacgaggagcagcggcggaggcaggtggaggcgaacaagcgcaagctcgaggagctccagctccaccacctctccgccgccgtcagagaggccgccgccaagccctcgccggccaagaaacggacggctcgggtgccgcgggacgccgccgcggagccgctccggcggtccggccgcgtcgccaacctcccggagaagcccaagtaccgcgaagaagttttggatttcgggaggaaggtcagaaggacgtacggctcggggaggaaggacctggtgaaccgggtgtacgcgaccgacgaggagcggagccacgccatcacgaaggccgaggagctggccggcgagttgggctctcgctcccgcttccccatcttcgtgaaacccatgacccagtcccatgtcaccggaggcttctggctgggcctcccaaccccgttctgccggaagtacctgccgaagcgcgacgagacaatcatgctggaggacgaggaggatgacgagttcgagacgctctacctcgtcaggaagatgggcctcagtgccggatggagaggattcgccattgagcacaagctggtcgatggagattgcctagtcttccagttgattgagcgcaccaagttcaaggtctacataatacgagcaagttcctactatgaagatgaggagtgatgaaactagtagcttctaatatggtgattggatattttggagcgcagctcaggtgacggttgcactccacaaaaccagtgtgagcaggatggaacaggctcgcatgtggggggaatgctgcgcgtcttcaaccttttgactggcgaaaatactgatgtgttctaccagttgctaatttgttggcttgggattatgacctgcacggttcagaaacctgcactatgtaaggggaggtggatggcaattagccccattttgtaaattgatgcccgtcctggttcctgttgggtcccg

SEQ ID NO: 8980 - protein, 229 aa, Panicum virgatum
  misc_feature: Ceres CLONE 2023955
  misc_feature: Great-hit functional homolog of the protein sequence given in SEQ ID NO 9516
  misc_feature (1)..(95): Pfam Name: B3 Pfam Description: B3 DNA binding domain
  misc_feature: Useful for making plants with altered terpenoid content
MAEAVSYEEQRRRQVEANKRKLEELQLHHLSAAVREAAAKPSPAKKRTARVPRDAAAEPLRRSGRVANLPEKPKYREEVLDFGRKVRRTYGSGRKDLVNRVYATDEERSHAITKAEELAGELGSRSRFPIFVKPMTQSHVTGGFWLGLPTPFCRKYLPKRDETIMLEDEEDDEFETLYLVRKMGLSAGWRGFAIEHKLVDGDCLVFQLIERTKFKVYIIRASSYYEDEE

SEQ ID NO: 8981 - DNA, 921 bp, Panicum virgatum
  misc_feature: Ceres CLONE 2023990
  misc_feature: Encodes the peptide sequence at SEQ ID NO. 8982
accagagaggggaaggtcagccagacaccgccgccgccttgctcgcgccgcacgctactctcgaactccgcgcgcgcgcgagagagagagagagagagagagagagagagatagagagggagcggggccaaggaagaaagaggacaggtgccttacgggaaggagggagtgcgaggatgggcgctggggacggggagtccgccgcgagcaaggataagggcggcggcgggggcggtgccgagcgggcgtcgctggacggcgtccgggacaagaacgtgatgcagctcaagaagctcaacacggcgctcttccccgtccgctataacgacaagtactaccaggacaccatcgcatccaaggacttctccaagctcgcttactacagtgatatatgtgtcggtgcgatagcgtgtcgcctggagaagaaggaaggaggggctgtccgagtttacatcatgaccttgggtgtattggcaccatatcgtggccttggtatcgggacgaagttgctgaaccatgtttttgatctctctgcgaagcagaacatctctgagatatacttgcatgttcagacaaacaacgacgatgccatcgctttctacaagaagtttgggttcgaaataacacagacgatacataactactacatgaacataacgccaccagattgctatgtccttacgaaatttattggacaggctgctacaaagaaatgatcagccgcctgcccatcttttgtaagaccaccatcacctgagttatggcagaaggtagtcgtggttctgtcgcagtttgtgctgtgtttccatttttgtgagctctaaagctatagacgcctgggtagctttgctacagaactgagactatcgtttacattgagactgctccttttttttccctcaaaaaaaaaaaaaaaaaaaa

SEQ ID NO: 8982 - protein, 179 aa, Panicum virgatum
  misc_feature: Ceres CLONE 2023990
  misc_feature (1)..(84): Pfam Name: Acetyltransf_1 Pfam Description: Acetyltransferase (GNAT) family
MGAGDGESAASKDKGGGGGGAERASLDGVRDKNVMQLKKLNTALFPVRYNDKYYQDTIASKDFSKLAYYSDICVGAIACRLEKKEGGAVRVYIMTLGVLAPYRGLGIGTKLLNHVFDLSAKQNISEIYLHVQTNNDDAIAFYKKFGFEITQTIHNYYMNITPPDCYVLTKFIGQAATKK

SEQ ID NO: 8983 - DNA, 1379 bp, Panicum virgatum
  misc_feature: Ceres CLONE 2024036
  misc_feature: Encodes the peptide sequence at SEQ ID NO. 8984
aaacgctagagccaagccaacacagctagccccacaaccccaaaccctcccaatccgcaccgcacacaaaccatccgcacggccgccggccgccggccgagcaccacaggaacctagcgaccagcgtgccgccacccaccgtccagcacctctcgccgtcctcgcccatcgcggctgtgcggccgtgcccctcgcggactcactccttgccgggtgcggcaggcggcagcgcatcgctccttgcttcgctcccctcgaccctcgcctcgccggccgcgtatatggtcgtgccaataacaaacctgcttcgccgccaccggacttcccctcctcccctaccccgctcccttcctcccagccatcgctgcccgatccaacgccgccggagcgccctcgactgcaatacctccgggtaaactccctctccccaaattgggatctcctctcgtcctagtgctccagtccttgtggaagtaagagatcggctactgaggatgtacgctgttttcgtttgcggcgagaggggggaaacctaggagatgaggctggtggggttgacgggcgggatcgcgtccgggaagagcaccgtgtccaacctcttcaaggacgccggagtccctgtcgtcgacaccgacgtcgttgctcggaatgtagtgcagaaaggtactggaggttggaagaagattgtaaaagcctttggggatgaaattttgttagacgacggagaaatcgacagagctcgcttgggacaaattgtgttttctgacccatcaaagcggcaacttcttaaccgtcttctggcgccacatatttcttctggcatattctgggagatagcaaaactgtggatgaagggatgcaaggttatcgtcctcgacatccccctgttgtttgaaacaaagatggatagatggacaaatccagtcattgttgtctgggttaatccagaaacccagatcgagaggctcatgtctagagatggttgctctgaagaacaggctcagaacaggatcaacgcgcagcttgctgtggactggaagaagtcggaagcggacatagtgatcgacaattctgggtcactggatgacaccaaacaacagtttcaggaggtgttgaggaaagtctctgagcccttgacatggaaggagcgcttgcgatctcgagatggtcttatctctattgtcatgtgtacagcagtgggggtattacttgcccagaagaacctgctatgatcctgataagtttgaggaggttaaaaccagtgctgtgtttctggagaccagcacaaatgagcttgtctggtgtcataagagtggaaattggatgggtgcatttgaaccacaatgataaaaataaaatttcatatgatttagtgtttt

SEQ ID NO: 8984 - protein, 230 aa, Panicum virgatum
  misc_feature: Ceres CLONE 2024036
  misc_feature (1)..(182): Pfam Name: CoaE Pfam Description: Dephospho-CoA kinase
MRLVGLTGGIASGKSTVSNLFKDAGVPVVDTDVVARNVVQKGTGGWKKIVKAFGDEILLDDGEIDRARLGQIVFSDPSKRQLLNRLLAPHISSGIFWEIAKLWMKGCKVIVLDIPLLFETKMDRWTNPVIVVWVNPETQIERLMSRDGCSEEQAQNRINAQLAVDWKKSEADIVIDNSGSLDDTKQQFQEVLRKVSEPLTWKERLRSRDGLISIVMCTAVGVLLAQKNLL

SEQ ID NO: 8985 - DNA, 969 bp, Panicum virgatum
  misc_feature: Ceres CLONE 2024111
  misc_feature: Encodes the peptide sequence at SEQ ID NO. 8986
tttgaccccaactctaatttcttgctaccctgtgctgcattagcgatacttcttgcaaacctacctgagttccaacaacgaccctagcgcttctctgttttagcaaaacaccatgtcgaccgccgcccgccgccgcctaatgcgagacttcaagcgcatgcaaacagacccgcctgctggcgtctccgcatctcccgtccctgacaatgtcatgacctggaacgccgtcattatcggtcccgcagatacccccttcgaagacgggaccttccgacttgtgatgcatttcgaggaacagtacccaaacaagccgccatccgtcaagtttatcagccagatgttccacccaaacgtctacgccacgggcgagctatgtctcgatattctccagaaccgctggagtccgacctacgatgttgcagccgtgcttaccagtattcagagtttgctcaacgacccgaacaccggatctcccgcgaacgtcgaagcgtccaacctatacaaagacaaccgcaaggagtatacgaagcgggttagggagaccgtggagaagagctgggacgactgaaaagcccggtgaccacctcgcgagatgtactgaatcggcggggattaatatccggcaacggcggccgcaagatctacgggggggagaagcaacatcacccacccggagcgtgtagcatgggctgtttaagcctggcccactctttttatttcggagttctggcgttttggccggcgtctgtcagcatttggaaggcatgtcattacattagtgtcgggcgttgcgtagcaacactcctcctggttgggcgcctcgagggtcagttgggatttcgatagggagaggggaaggcggggcgcgtccacgggtggttggagttctgacccacatcatcgcaggagaaactctgggtacctagctaatgcatttaatggtgtttccaaaaaaaaaaaaaaaaaaaa

SEQ ID NO: 8986 - protein, 151 aa, Panicum virgatum
  misc_feature: Ceres CLONE 2024111
  misc_feature (1)..(151): SWISSPROT Homolog: EC 6.3.2.19 Ubiquitin-conjugating enzyme E2 2
MSTAARRRLMRDFKRMQTDPPAGVSASPVPDNVMTWNAVIIGPADTPFEDGTFRLVMHFEEQYPNKPPSVKFISQMFHPNVYATGELCLDILQNRWSPTYDVAAVLTSIQSLLNDPNTGSPANVEASNLYKDNRKEYTKRVRETVEKSWDD

SEQ ID NO: 8987 - DNA, 1149 bp, Panicum virgatum
  misc_feature: Ceres CLONE 2024113
  misc_feature: Encodes the peptide sequence at SEQ ID NO. 8988
acagccgccacccagcctcatctccccccttccttctgagagaccactacccccaatcccccccactgcaaccaaccaaccaaatccgccgccatggcttccgatggcaccggcgtcgtggccctctacggcggcggcggcggcggcggcaacaacaacaacaaggtcaaggtcgtcgacgcctcctccaagtccccagccgccgccgccaccttctccgtcaaggtgggcctggcgcagatgctgcgcggcggcgtcatcatggacgtggtcacgccggagcaggcgcgcctcgccgaggaggccggggcctgcgccgtcatggcgctggagcgcgtccccgccgacatccgcgcgcagggcggcgtggcccgcatgtccgacccggccctcatccgcgacatcaagcgcgccgtcaccatcccggtcatggccaaggcgcgcatcggccacttcgtcgaggcccagatcctggaggccgtcggcgtcgactacgtggacgagagcgaggtgctcacccccgccgacgacgcgcaccacatcaacaagcacaacttccgcgtccccttcgtgtgcggctgccgcgacctcggcgaggcgctgcgccgcatccgcgagggcgccgccatgatccgcaccaagggcgaggccggcaccggcaacgtcgtcgaggccgtgcgccacgtccgctccgtcatgggggccgtccgcgccctgcgcagcatggacgacgacgaggtcttcgcctacgccaagcgcatcgccgcgccctacgacctcgtcatgcagaccaagcagctgggccgcctccccgtcgtccagttcgccgccgggggagtcgccacccccgccgacgccgcgctcatgatgcagctcggctgcgacggcgtcttcgtcggctcggggatcttcaagagcggcgaccccgcgcgccgcgcccgtgccatcgtgcaggccgtcacgcactacagcgacccggagatcctcgccgacgtcagcgcagggctcggggaggcaatggtcgggatcaacctctccgacccaaaactcggggtggagcgctacgccgcgcgctccgagtagcgccatccatcaccatcaccatccccatccccccggttgacgttacaaaaaaaaaaaaaaaaaaaa

SEQ ID NO: 8988 - protein, 329 aa, Panicum virgatum
  misc_feature: Ceres CLONE 2024113
  misc_feature (1)..(47): Pfam Name: Trp_syntA Pfam Description: Tryptophan synthase alpha chain
  misc_feature (1)..(38): Pfam Name: IGPS Pfam Description: Indole-3-glycerol phosphate synthase
MASDGTGVVALYGGGGGGGNNNNKVKVVDASSKSPAAAATFSVKVGLAQMLRGGVIMDVVTPEQARLAEEAGACAVMALERVPADIRAQGGVARMSDPALIRDIKRAVTIPVMAKARIGHFVEAQILEAVGVDYVDESEVLTPADDAHHINKHNFRVPFVCGCRDLGEALRRIREGAAMIRTKGEAGTGNVVEAVRHVRSVMGAVRALRSMDDDEVFAYAKRIAAPYDLVMQTKQLGRLPVVQFAAGGVATPADAALMMQLGCDGVFVGSGIFKSGDPARRARAIVQAVTHYSDPEILADVSAGLGEAMVGINLSDPKLGVERYAARSE

SEQ ID NO: 8989 - DNA, 819 bp, Panicum virgatum
  misc_feature: Ceres CLONE 2024185
  misc_feature: Encodes the peptide sequence at SEQ ID NO. 8990
cagtctcttctcttctcccaatcatcaccatcttccattcctccccaactccatctctctcgttcttgaatcgctcgtgcgccgccgcgtgccgtgccgtagtcaagggaggaggagcgcgaaggcggcaatggcgaagggcgggctggggaagctgcggtgcatgatgaggaggtggcactcgtccagccgcatcgcccgcgcgccgtcgcccggcgaggacgccggcgcccggggcgcgtcgttccacggcgccgcggacgaggtgcccaagggcctgcacccggtctacgtcggcaggtcgcgccgccggtacctcgtcgccgaggagctcgtggcccacccgctgttccagaccctcgtccaccgcgccggcggcgccgccgaggccggctgcaccgtcgtcggctgcgaggtcgtcctcttcgagcacctcctctggatgctcgagaacgcggacccgcagcccgagtccctcgacgagctcgtcgagtactacgcgtgctgaccgctggcgagccaccgcgccctgcccggcctggccgccggtgttgggaggagcttcacgaatctcccggccgcggcggtggatcgctctgcgattcctgtgttcctgagccgtaggattagagtaggggaaaccattgttaatcaccgtgctgtgcagctcacggacgctgctcttccggctccgttgatccgattcgattgcctctagtttgctacaattttttttaatgctatcctcctaataagatctctggagtctgggcacatgtctccatgtatattgcgatgcaaaaaaaaaaaaaaaaaaaa

SEQ ID NO: 8990 - protein, 125 aa, Panicum virgatum
  misc_feature: Ceres CLONE 2024185
  misc_feature (1)..(103): Pfam Name: Auxin_inducible Pfam Description: Auxin responsive protein
MAKGGLGKLRCMMRRWHSSSRIARAPSPGEDAGARGASFHGAADEVPKGLHPVYVGRSRRRYLVAEELVAHPLFQTLVHRAGGAAEAGCTVVGCEVVLFEHLLWMLENADPQPESLDELVEYYAC

SEQ ID NO: 8991 - DNA, 520 bp, Panicum virgatum
  misc_feature: Ceres CLONE 2024196
  misc_feature: Encodes the peptide sequence at SEQ ID NO. 8992
acacggaggaggcagcaggcacttgaaaggattgcttggatccacctcttcctctcccgcacgccgccgccgccgccgccgcgatgggcctcttcgacgtgctctaccgcgtggtgatgcgccgcaacgccgtctacgtcaccttcgtcgtcgccggcgccttcgcgggcgagagggcggtggattacggagtccacaagctctgggagatgaacaacgtcgggaaaaggtatgaagatataccagttctggggcaaaggccagccgaagaatgagagcattggagctcagactacccagaatgtcgctttccgtgaaattagattccatttaagcaacggttttatcattcctttttgacatataataacaaccaatgtaaaatccaaactctttcttggagttgctacccgttcagttactcagcaagtcagcatgctgtgggagtttcctgatgcattgtcagaacctgttatctagccagggatcggcatgtttggtcgaaaacttgaaattccag

SEQ ID NO: 8992 - protein, 63 aa, Panicum virgatum
  misc_feature: Ceres CLONE 2024196
  misc_feature (2)..(63): SWISSPROT Homolog: EC 1.10.2.2 Ubiquinol-cytochrome c reductase complex 8.0 kDa protein
MGLFDVLYRVVMRRNAVYVTFVVAGAFAGERAVDYGVHKLWEMNNVGKRYEDIPVLGQRPAEE

SEQ ID NO: 8993 - DNA, 666 bp, Panicum virgatum
  misc_feature: Ceres CLONE 2024263
  misc_feature: Encodes the peptide sequence at SEQ ID NO. 8994
atatcacaagcagctggctaaccaccttagctagttatagcttgttggcttagcagctagcaatggcgtccaaggcgttggtgctattcctggccgtgaacctggtgctgctgggcgtggccacgcctggggcgttcggcaccacatgccccatcgacacgctcaagctgggcgtgtgcgtcgacttgctgaccctccttaaggccaatctaggcgtgccgcccacgcagcagtgctgccccctcatcagcgggctcgccgacctcgaggccgccgcctgcctctgcaccaccttaaaggccagcgtcctcggcatcaacctgatcctccccgccgacatcagcctcatcctcaactactgcggcaagagcctgccctccggcttcgtgtgctgatcgatcatcgcctctagacatgtatgaatatacacgagaggcagccttgcttcccgtttgttgcatggtttgcttgctcttgtttattccacgtgccggtcatgggatcggtttgcctgcagtgcatggtagtagcgcgctagcgctgttatcatatttggattttctctacctcatctctatgcttttgttgtaataataaagggccggtactcacttgtgtgccggtactcacttgtgtgccggtgtttcaatgaagtttcgtttgcgg

SEQ ID NO: 8994 - protein, 110 aa, Panicum virgatum
  misc_feature: Ceres CLONE 2024263
  misc_feature (1)..(82): Pfam Name: Tryp_alpha_amyl Pfam Description: Protease inhibitor/seed storage/LTP family
MASKALVLFLAVNLVLLGVATPGAFGTTCPIDTLKLGVCVDLLTLLKANLGVPPTQQCCPLISGLADLEAAACLCTTLKASVLGINLILPADISLILNYCGKSLPSGFVC

SEQ ID NO: 8995 - DNA, 520 bp, Panicum virgatum
  misc_feature: Ceres CLONE 2024323
  misc_feature: Encodes the peptide sequence at SEQ ID NO. 8996
agttcgcaaccatgacacaagtcttttttgacattaccattggaggacaagccgctggaagaatcaccttcaaactctacaccgacaccaacccaattaccaccgagaacttcagagcactctgtaccggtgaaaaaggatttggatacaaaggatgtggattccaccgagtcatcaaagacttcatgcttcaaggaggagacttcactgcaggaaacggaactggtggaaagtccatctatggagctaagttcaaggatgagaacttcatccacaaacactccaaaccatttctcttatccatggctaacgctggaccaaacaccaatggatctcaattcttcatcaccactgttgtcacctcctggttagatggaaaacacaccgtttttggagaagtcgtcagtggacaagaaattgttaagagaatcgaagcactcccaaccagacaagataagccaacccaagctgtcgtaattgctgactgtggtcaattgtaaataaacaattgattgatttc

SEQ ID NO: 8996 - protein, 162 aa, Panicum virgatum
  misc_feature: Ceres CLONE 2024323
  misc_feature (3)..(159): Pfam Name: Pro_isomerase Pfam Description: Cyclophilin type peptidyl- prolyl cis-trans isomerase/CLD
  misc_feature (2)..(162): SWISSPROT Homolog: EC 5.2.1.8 41 kDa peptidyl-prolyl cis-trans isomerase
  misc_feature (5)..(162): SWISSPROT Homolog: EC 5.2.1.8 Peptidyl-prolyl cis-trans isomerase
MTQVFFDITIGGQAAGRITFKLYTDTNPITTENFRALCTGEKGFGYKGCGFHRVIKDFMLQGGDFTAGNGTGGKSIYGAKFKDENFIHKHSKPFLLSMANAGPNTNGSQFFITTVVTSWLDGKHTVFGEVVSGQEIVKRIEALPTRQDKPTQAVVIADCGQL

SEQ ID NO: 8997 - DNA, 632 bp, Panicum virgatum
  misc_feature: Ceres CLONE 2024540
  misc_feature: Encodes the peptide sequence at SEQ ID NO. 8998
atgatcgcagctctcgcagcagcagcaccaccaccaccaaacagctagagcagcagcaacactagcaaggaagctagagagatcgtcgagatggcgaggaagggcggtgcggcggcggcggctgtcgtggtgctggcggcgctcctggtcctggcggcggcgaggccggccgagggcgccgtggcgtgcgcggaggtggacttgagcctgcgcccctgcgtcgggtacgtgacggggaaggacgcggcgccgcccgccgagtgctgcgccggcgtgcggcggatccgggcgctgccgtcgggcacggcggagcggcggcaggcgtgcgagtgcgtgaagcaggcggcggcgaggttcccggggctcaacgccgatgccatccgcgtcctcccggcgcagtgcggctcgccgctgccgttcccgctcaccctcaacttcgactgcaccacaattccatgagctaatgatgaacaacacatgaagcaaagaggccatcctgaaaatggagagaaagatctgctagacgggttcactctgaatgaactagttgcttgctagctcttgcaataaggcccttgctttgcaagctagtttctatctaatgcactattgaaataatgtattggtccccc

SEQ ID NO: 8998 - protein, 122 aa, Panicum virgatum
  misc_feature: Ceres CLONE 2024540
  misc_feature (1)..(86): Pfam Name: Tryp_alpha_amyl Pfam Description: Protease inhibitor/seed storage/LTP family
MARKGGAAAAAVVVLAALLVLAAARPAEGAVACAEVDLSLRPCVGYVTGKDAAPPAECCAGVRRIRALPSGTAERRQACECVKQAAARFPGLNADAIRVLPAQCGSPLPFPLTLNFDCTTIP

SEQ ID NO: 8999 - DNA, 623 bp, Panicum virgatum
  misc_feature: Ceres CLONE 2024543
  misc_feature: Encodes the peptide sequence at SEQ ID NO. 9000
agaactgaaatatacacttaaacaaattgagcaatgcctcaagcttgcgggcaatgacgttcaaaccagtagctggctggattacaaagttgcatcttggaaggtcagacaagtaaaagagataccagagcaaacagacatgtcgtcatgtggacttttcatgatcaagtacctcgagtactggacaggagaaaagttgaaccaagaatttacgcagtcggacatagaccacttcaggcttaaattggcatatgaactgatgagcagtccactcaacaaggctcgcaggtagaaagcttccagggagatggtttgcaaggaaaaaaaaggctggcaacgaagaggctgtctagaataggttgctcggcagcttgcactgctgaattagaataattgcagccactaaaatatgtttggtaagctccggctggcccctccgttcgcccccctgattgttatcttttgttcctggagattcgtagccaactgtagtcgaagctccatgtttacctgctctgcaccatctcttaggggtgttgttgttttcgcaagattgcaacttgttgtatccgtgtcttcggttattcgatttgtaatgcgcttttccttcaaaaaaaatttgt

SEQ ID NO: 9000 - protein, 50 aa, Panicum virgatum
  misc_feature: Ceres CLONE 2024543
  misc_feature (6)..(41): Pfam Name: Peptidase_C48 Pfam Description: Ulp1 protease family, C-terminal catalytic domain
MSSCGLFMIKYLEYWTGEKLNQEFTQSDIDHFRLKLAYELMSSPLNKARR

SEQ ID NO: 9001 - DNA, 611 bp, Panicum virgatum
  misc_feature: Ceres CLONE 2024617
  misc_feature: Encodes the peptide sequence at SEQ ID NO. 9002
aatactcaaaccagtgttcagcagccagctctcaggtagcaaagagcagacatctagccaactagcttggagtagaagtccggtcagccagccatggctgcagctccggtgacggtgccgcgcatgaagctggggtcgcaggggttggaggtctcggcgcttggcctcggctgcatgggcatgtccgcctactacggcccgccgaagcctgagccggacatgatcgcgctcatccaccacgccgtcgccgccggcgtcaccctcctcgacacctccgacgtctacggccctcacaccaacgagatcctccttggcaaggctctgcagggtggggtgagggagaaggtgcagctggccaccaagttcggcatacgcctgggcgtcgacgacggcacccgtgagatccgcggggacccggcgtacgttcgcgccgcgtgcgagggcagcctcaagcggttgggcgtggactgcatcgacctctactaccagcatcgcatcgacacaagggtacccatcgaggtcacggtgaggatatacactttcatgctcatcagataaaatttcatacggatacaaaagttcaaggggtgtctttggcacctatttacttc

SEQ ID NO: 9002 - protein, 154 aa, Panicum virgatum
  misc_feature: Ceres CLONE 2024617
  misc_feature (1)..(130): Pfam Name: Aldo_ket_red Pfam Description: Aldo/keto reductase family
MAAAPVTVPRMKLGSQGLEVSALGLGCMGMSAYYGPPKPEPDMIALIHHAVAAGVTLLDTSDVYGPHTNEILLGKALQGGVREKVQLATKFGIRLGVDDGTREIRGDPAYVRAACEGSLKRLGVDCIDLYYQHRIDTRVPIEVTVRIYTFMLIR

SEQ ID NO: 9003 - DNA, 1044 bp, Panicum virgatum
  misc_feature: Ceres CLONE 2024655
  misc_feature: Encodes the peptide sequence at SEQ ID NO. 9004
gagccaagcaagccatatgcgagcgctgcctcgcgttgaccagcccgtgcgctggatgatggcctcgcgcgcgcggccgcggcgggcgatggggtcggcggcggcgggcggcgggagggatcccgccgagaacccgaaggtggggaggctgcgggagctcttcgtcggcgacgcggcagatgggtgggagaagtcttgggagtttggtgtgaccccgtgggatttgggaaagccaacacctgtcatcgaacatcttgttagatcaggaacactgccgaatggaagagctttggttcctggatgcggaatgggatacgatgtggtggctctggcatgccctgaacgatttgttattggcttggatatttctgatatggctgttaagaaggctaagcagtggtcatcctctttgcccaatgcagattattttacttttctggcagaagatttcttcaactgggtaccaagtgaacaattcgaccttatatttgattacacgttcttctgtgcgcttgacccaagcttgagggtggcttgggcagagacagttaaccggctgctaaaacctgatggagagcttctcaccttgatttatctgatcagtgatcaagagggaggaccaccatacaataatacagttgctgactatcagaaggtactggaaccgttgggattcagggctgttcttatggaagataatgaactggccattaaaccacggaagggctgcgagaaacttgggagatggaagagatttacccaccaatcatctctgtgagaaagcagaagcattttcctaaataaacaaagaaaaaagaattcatgaagagaggatcaacttcttacatttattagaccgtgtgtataattgttttagacttgcttttggcgtatgtacggaggttcagtcctgaaacatgagtagagcgtgctgtccaaggagcatgactagagtgttttttagactcaagatgttccagaattacagaccttggcttcgaaatagaattgcagttcttacagcaaaaaaaaaaaaaaaaaaaa

SEQ ID NO: 9004 - protein, 253 aa, Panicum virgatum
  misc_feature: Ceres CLONE 2024655
  misc_feature (1)..(196): Pfam Name: TPMT Pfam Description: Thiopurine S-methyltransferase (TPMT)
MRALPRVDQPVRWMMASRARPRRAMGSAAAGGGRDPAENPKVGRLRELFVGDAADGWEKSWEFGVTPWDLGKPTPVIEHLVRSGTLPNGRALVPGCGMGYDVVALACPERFVIGLDISDMAVKKAKQWSSSLPNADYFTFLAEDFFNWVPSEQFDLIFDYTFFCALDPSLRVAWAETVNRLLKPDGELLTLIYLISDQEGGPPYNNTVADYQKVLEPLGFRAVLMEDNELAIKPRKGCEKLGRWKRFTHQSSL

SEQ ID NO: 9005 - DNA, 1514 bp, Panicum virgatum
  misc_feature: Ceres CLONE 2024662
  misc_feature: Encodes the peptide sequence at SEQ ID NO. 9006
gcgaggtctccagctaccgcgcgccctccagctgcgtcgcgcgcgcattcgtcagatccagaatcgagcccccggccgagatccggctggctctctagcgagcttcgggccgagcagcagcggggatcggagagagggagaccaggatgaagcggaggacgcggaacaagatcatcctctggtcgctggccgtgacggcggtggcggtgctggtgggcggcacgatcgcgctggtgctgacggcggggacgtggaaggccaagatcaagaagtcgcaggagaagatctgcaacaaggggtgggagtgctcggggagcaagtactgctgcaacgacaccatcaccgacttcttcaaggtctaccagttcgagaacctcttcgccaagcgcaacacccccgtcgcgcacgccgtcgggttctgggactaccaggccttcatcaccgccgccgcgttcttcgagccgcaggggttctgcaccaccggcggcaagcagatgcagatgatggagctctgcgccttcctcggccacgtcggcgccaagacctcctgtgggtatggcgtggcgaccggagggccgacggcgtgggggctctgctacaaccacgagatgagccccgaccagatctactgtgacaagacctacacccagtacccctgcgtcgagggcgccgagtactacggccgtggcgcgatccccgtctactggaactacaactacggtgcggcgggcgacgggatcaaggaggacctgttgcaccaccccgagtacttggagcagaatgcaacgctggcattcatggcggcaatgtggcggtggatgacaccgatcaagaagagtcagccatcagcgcacgaagcgtttgtgggcacctggaagcccaccaagaatgacacgctcagcaagcgcctgcctgggttcggagccaccatgaacatactctacggcgaatcaatctgtggcaggggattcatcgacgccatgaacgtcatcatctcgcactaccagtactaccttgacctcatgggggttggccgtgagcactctggagacaaccgcgactgcgctgagcaggccccgttcaatccctccagcaaaccagatgaccagcagcagcaacagcagcaatcaggaagctagaatggacccattaccgcggccacacgtgttgtacacctgttcttgccattgccactgatcaagcttcatgtgctacagcaagctgctgattcttcagtatgcgtgaagctgctttggattgatgttgttttgagtggctgatcagtatgtgctgtctatgggaattgggaaatttgtaaccattgtaccatggtgtccatagatagtctgtttttgtttccttgattttgtcagatacaacatacatgtgttaaagaggatggttaaactgaacgtagcaaggcttcttttctgaacttatgtacgtctgctacgaaaagtatgtctgcttaattgaacatactttgactttcgctaaaaaaaaaaaaaaaaaaa

SEQ ID NO: 9006 - protein, 330 aa, Panicum virgatum
  misc_feature: Ceres CLONE 2024662
  misc_feature: Great-hit functional homolog of the protein sequence encoded by LOCUS At1g05850
  misc_feature (1)..(239): Pfam Name: Glyco_hydro_19 Pfam Description: Chitinase class I
  misc_feature: Useful for making plants with altered cell wall content and/or composition
MKRRTRNKIILWSLAVTAVAVLVGGTIALVLTAGTWKAKIKKSQEKICNKGWECSGSKYCCNDTITDFFKVYQFENLFAKRNTPVAHAVGFWDYQAFITAAAFFEPQGFCTTGGKQMQMMELCAFLGHVGAKTSCGYGVATGGPTAWGLCYNHEMSPDQIYCDKTYTQYPCVEGAEYYGRGAIPVYWNYNYGAAGDGIKEDLLHHPEYLEQNATLAFMAAMWRWMTPIKKSQPSAHEAFVGTWKPTKNDTLSKRLPGFGATMNILYGESICGRGFIDAMNVIISHYQYYLDLMGVGREHSGDNRDCAEQAPFNPSSKPDDQQQQQQQSGS

SEQ ID NO: 9007 - DNA, 631 bp, Panicum virgatum
  misc_feature: Ceres CLONE 2024752
  misc_feature: Encodes the peptide sequence at SEQ ID NO. 9008
ctctttcgaggacacctcacagcgacgccgcctcccgccgccgaactcgcctgcggctccgcccgcgccttcgcctcgtcccctctctgcttcagagccaggcaggagcaaccatggagcacgggtcgctgaaggattcgagtgcatcggcgttctccatcatggaggaggaccacaccctcgccaactccgtcagattcgttctcaaccaggacccaagggtggcattttgtggatatagcatcccccatccttctgaaaacagagttaacataagggttcagactacaggagatccagccaaggatgttctgaaagattcgttgcaggacctgatggtgatgtgccagcatataagagggacgtttgacactgcagtggctgatttccgggggaacaaaccagcagacgccatggacattgatttgaacaaaaagtagaaggttcttgatgattgttagccagatggcagaaatgcgcaaatgtttaattgtgcaactgagttataaactagtctagtaatatgggatgtagtccttaaacccaaagtgtgaaatgtcattggctggattcttggcattgtgacttcagatttcttggtcaatatatggcacttgatcttgtttggagc

SEQ ID NO: 9008 - protein, 108 aa, Panicum virgatum
  misc_feature: Ceres CLONE 2024752
  misc_feature (1)..(74): Pfam Name: RNA_pol_L Pfam Description: RNA polymerase Rpb3/Rpb11 dimerisation domain
  misc_feature (7)..(85): SWISSPROT Homolog: EC 2.7.7.6 DNA-directed RNA polymerases I and III 16 kDa polypeptide
MEHGSLKDSSASAFSIMEEDHTLANSVRFVLNQDPRVAFCGYSIPHPSENRVNIRVQTTGDPAKDVLKDSLQDLMVMCQHIRGTFDTAVADFRGNKPADAMDIDLNKK

SEQ ID NO: 9009 - DNA, 713 bp, Panicum virgatum
  misc_feature: Ceres CLONE 2024898
  misc_feature: Encodes the peptide sequence at SEQ ID NO. 9010
aaaacgcacactggccctgtctgcacccaattcaattgagaaccaagctcttctgagccagcccatccggaagaaaaatgtcggcctccctgctccgcgtcgccgctcgcggcccctccaacttgctccgcgccaacctggtcgctgcccggccgcaacccatcaccgcacgcgccgtcctcgccgccccgagcttcagcacatccgcccgtctgcgctccgagcaccaggaggagacttttgaggagttttctgcccgttatgagaaggagtttgacggtgttcaggacgttttcgagctccagcgcaacctgaacaacgccttcgcctacgatctcgtcccctctcccgccgttgtgtccgctgccctcagggctgcgcggagagtcaacgacttccccaccgctgtccggatcttcgagggcatcaaggccaaggttgagaacaagggccagtaccagcagtatctggacgagctcaagccgttgcgcgaggagcttggaatcccgctcaaggaggacatgtacccggaggagtccaaataaacgaagtaccggggtttcctcgttgaggaaatcgcacaccctccggacaacgccgtgggtgataccatagacaccctgtcttccatcgggttgtggagggttgtgcaaatcaatctgtatatgtcaccgtacctagacttcgtttgccaaaaaaaaaaaaaaaaaaaa

SEQ ID NO: 9010 - protein, 155 aa, Panicum virgatum
  misc_feature: Ceres CLONE 2024898
  misc_feature (1)..(105): Pfam Name: COX5A Pfam Description: Cytochrome c oxidase subunit Va
  misc_feature (3)..(154): SWISSPROT Homolog: EC 1.9.3.1 Cytochrome c oxidase polypeptide VI, mitochondrial precursor
MSASLLRVAARGPSNLLRANLVAARPQPITARAVLAAPSFSTSARLRSEHQEETFEEFSARYEKEFDGVQDVFELQRNLNNAFAYDLVPSPAVVSAALRAARRVNDFPTAVRIFEGIKAKVENKGQYQQYLDELKPLREELGIPLKEDMYPEESK

SEQ ID NO: 9011 - DNA, 832 bp, Panicum virgatum
  misc_feature: Ceres CLONE 2024922
  misc_feature: Encodes the peptide sequence at SEQ ID NO. 9012
aagccgtgtcagttcatctcgaagcccaagtgaagcttcaccggctttcaccggttgctgcaagtacttcttcttccttggaggaagctaatactactaataatacggttgcgatcggcatggccgggcgcaacatcatcgtggcggtggacttctcgccgtgcagcaagaacgcgctgcggtgggcggcgaacctggcggcgcccggcgaccgcctcatcctcatcctcatccacgccaagccctcgtaccagtacgaggagggcgtggcgcacctgtgggagcgcgacggctcgccgctgatcccgctgctggagctgtcggacccccgggtgagcaagatctacggcctggcgccggaccgggagacgctggaggtcctcgcgcgggcggccgcccagcgaggggtccaggtcttcgccaaggtgctctggggcgacccggccaagaagctcacggaggcggtgcacaaggtcccactccagtggctggtcgtcggcaacagagggctcagcaccgtcaagagggttctgatggggagcgtgagcacctacgtggtgaaccacgcggcctgccccgtcaccgtcgtcagggagaacatgctgccatcggcgccgacaaccagctactgattgatttcctacggtcctaccctaccatggggatggcacgacggcagtgcgcagtgcagctgttttgcctgctctgctctagtacgttgacgcccgtgtaaacctgggagtaggatgtcttgtgccatgtcactctgtaagaaaataatctgcgtcatatatgaataagaaacggattataaaaaaaaaaaaaaaaaaaa

SEQ ID NO: 9012 - protein, 170 aa, Panicum virgatum
  misc_feature: Ceres CLONE 2024922
  misc_feature (1)..(155): Pfam Name: Usp Pfam Description: Universal stress protein family
MAGRNIIVAVDFSPCSKNALRWAANLAAPGDRLILILIHAKPSYQYEEGVAHLWERDGSPLIPLLELSDPRVSKIYGLAPDRETLEVLARAAAQRGVQVFAKVLWGDPAKKLTEAVHKVPLQWLVVGNRGLSTVKRVLMGSVSTYVVNHAACPVTVVRENMLPSAPTTSY

SEQ ID NO: 9013 - DNA, 726 bp, Panicum virgatum
  misc_feature: Ceres CLONE 2024930
  misc_feature: Encodes the peptide sequence at SEQ ID NO. 9014
gatcgcagctcgcagcagcagcagcaccaccaccaccaaacagctagagcagcagcaacactagcaaggaagctagagagattcgtcgagatggcgaggaagggcggtgcagcggcggcggcggtcgtggcgctggcggcgctcctggtcctggcggcggcgaggccggccgagggcgccgtgacgtgcgcggaggtggacttgaacctgcgcccctgcgtcgggtacgtgacgggcaaggaggcggcgccgcccgccgagtgctgcgccggcgtgcggcggatccgggcgctgccgtcgggcacggcggagcggcggcaggcgtgcgagtgcgtgaagcaggcggcggcgaggttcccggggctcaacgccgacgccatccgcgtcctcccggcgcagtgcggctcgccgctgccattcccgctcaccctcaacttcgactgcaccacaattccatgagctgataaacaagacatgaatcaaagaggccattctgaaaatggagagaaagatctgctagacgggttcactctaaatgaactactagagtattagctgcttgctctcgcaataaggcccttgcttttgtacatgtactaataaaacccatggaataatggtattggtcccccatgcttttgtggtgtagtttcgcatctctccctgcgtggagaggagttgtctcgagttgttcatcaacactggtgatgatcttcagttgtttgc

SEQ ID NO: 9014 - protein, 122 aa, Panicum virgatum
  misc_feature: Ceres CLONE 2024930
  misc_feature (1)..(86): Pfam Name: Tryp_alpha_amyl Pfam Description: Protease inhibitor/seed storage/LTP family
MARKGGAAAAAVVALAALLVLAAARPAEGAVTCAEVDLNLRPCVGYVTGKEAAPPAECCAGVRRIRALPSGTAERRQACECVKQAAARFPGLNADAIRVLPAQCGSPLPFPLTLNFDCTTIP

SEQ ID NO: 9015 - DNA, 1254 bp, Panicum virgatum
  misc_feature: Ceres CLONE 2024952
  misc_feature: Encodes the peptide sequence at SEQ ID NO. 9016
gctgcgcgtctgtgccactacaccaaccgtctggtccgcgcgctccacccgtcccgcggattcctcccccactacatagcgccgcgcggccggcctcgcgcagccgcaccgacgccgggaacgagcgatggaggcggcggcggcggcggcggacccggacacggaggtgcaggcggatttcttccccatggtacgccagtaccggagcggccgcgtggagcggttcatgaacatagccccgctcccggccggcgccgacccggccacgggcgtcgtgtccaaggacgtcgtcgtcgacccggccacaggcgtctgggcgcgcctcttcctcccgcccggcaccccgcccggcaagaagctccccgtcgtcgtctactaccacggcggcgcctacgtggtgggctccgccgccgacccgttcacgcacacctacctcaacgcgctcgccgcggaggccggcgtcctcgcggtcgcgcccgagtaccgcctcgcgccggagcacccgctcccggccgcgtacgacgactcgtgggaggcgctcaggtgggtggcctcccacgccgcgggcggcggcggcggcggggcggagccgtggctggccgagcacagcgacttctcccgcctgttcctggccggggccagcgcggggggcaccatcgcgcacgtggtggccacccgcgcgggcgccctcggcgtgcgcgccaggggcctcctgatcgtgcacccctacttcggcggcgcggcggacatcggcgacgaggggggcgcggggaaggagcgcaaggcgcgcgccgacgcgttctggcggttcctctacccgggctcccccggcctcgacgacccgctgtccaacccgttctcggaggccgccggcggcagcgcggcgcgcgccgccgccgaccgcgtgctcatctgcgtcgccgagaaggacgagctccgcgacaggggcgtctggtactacgagagcctcagggccagcgggtaccccggcgaggtggagctgctcgagtccatgggcgagggccacgtcttctactgcatcaacccgctgagcgacagggcgcgggagatgcaggagcgcgtcctcagcttcctgcgcaagtgaactgagcacctagtagtgctctgcaactgcaggggaagatcacaagatctcccgtggtggaataattttagattttatcacccgcaatccgtgtaatttgtggccatgttttggatccagaatcctcctgtaatttgtggttggttgac

SEQ ID NO: 9016 - protein, 325 aa, Panicum virgatum
  misc_feature: Ceres CLONE 2024952
  misc_feature (1)..(226): Pfam Name: Abhydrolase_3 Pfam Description: alpha/beta hydrolase fold
MEAAAAAADPDTEVQADFFPMVRQYRSGRVERFMNIAPLPAGADPATGVVSKDVVVDPATGVWARLFLPPGTPPGKKLPVVVYYHGGAYVVGSAADPFTHTYLNALAAEAGVLAVAPEYRLAPEHPLPAAYDDSWEALRWVASHAAGGGGGGAEPWLAEHSDFSRLFLAGASAGGTIAHVVATRAGALGVRARGLLIVHPYFGGAADIGDEGGAGKERKARADAFWRFLYPGSPGLDDPLSNPFSEAAGGSAARAAADRVLICVAEKDELRDRGVWYYESLRASGYPGEVELLESMGEGHVFYCINPLSDRAREMQERVLSFLRK

SEQ ID NO: 9017 - DNA, 1295 bp, Panicum virgatum
  misc_feature: Ceres CLONE 2025026
  misc_feature: Encodes the peptide sequence at SEQ ID NO. 9018
agcggagagctttgcccgttttattcttgttccgtccttcgtctcgtctctgccttcttctccctgccaccgcccccggcccccgcaccgcgctggagagccgcggcttggctggctccgagtcccgtcctcggcgcgcaacctgagaggtcacgatgttgtggcgcacagtacgcagtatggatgtaatgatgcattcttcgagtttccttcttccaaaactgcatcgacctgtcaacagaccagtcaagaactatgctttagttgttcttaaccagcatcttccacgattcatgcctcgcctctgggatcatgcaaacttaaggatctgtgctgatggaggagctaatcgtatttttgatgagatgtttcagttgaccaatgatgaagatgagataagcatcagaaataggtatattccagaaattattgagggggatatggattctataaggcctgaagtaaaattgttcgactccagtcagggatccaaaatttctgataaatcgcataaccaggagacaacagatttacacaaatgtatttctcgtatccatcgccgtacacctgaacatgaaaaacataatttgtgtgtccttgttactggagcactaggtggaaggtttgatcatgaggcggcaaatatcaatgttctgtatctgttttcggacttgagaattgtgcttctatcagatgattgcttgatccgacttcttcccaaaacgcatcgccatgaactttatattgaatcatctgttgaaggaccacattgtgggctttttcctgttggagcaccatcaacaaacaccacaaccactggactgaaatggaatctaagtgaatcaaagatgagatttgggagcatgataagcacatcgaacattgtgcaattggagaaggtaactgtacagtctgatgcagatcttttgtggacaatttctctacgaaacgtggcctaatgtgctcctatttagttatcatctttagttattctgcctctgtttcctggcgaccaagctcttgtacagctgtttttgtgtttatgagttgtgtgtctggtaaataagtaccgtctgatgactcatgcatagtctgttatcagataggaactcaaaaatcatgaggtagaatgatttcgaacacgatcttttagctgctggcgaattatgtgaataacacgaccagacaggcatgttgtaacctcttggcctgtataactatattgttgaatctgcaagagggtttgttatatgaaaagggtattctgaagatttcaaaaaaaaaaaaaaaaaaaa

SEQ ID NO: 9018 - protein, 267 aa, Panicum virgatum
  misc_feature: Ceres CLONE 2025026
  misc_feature (1)..(141): Pfam Name: TPK_catalytic Pfam Description: Thiamin pyrophosphokinase, catalytic domain
MLWRTVRSMDVMMHSSSFLLPKLHRPVNRPVKNYALVVLNQHLPRFMPRLWDHANLRICADGGANRIFDEMFQLTNDEDEISIRNRYIPEIIEGDMDSIRPEVKLFDSSQGSKISDKSHNQETTDLHKCISRIHRRTPEHEKHNLCVLVTGALGGRFDHEAANINVLYLFSDLRIVLLSDDCLIRLLPKTHRHELYIESSVEGPHCGLFPVGAPSTNTTTTGLKWNLSESKMRFGSMISTSNIVQLEKVTVQSDADLLWTISLRNVA

SEQ ID NO: 9019 - DNA, 444 bp, Panicum virgatum
  misc_feature: Ceres CLONE 2025068
  misc_feature: Encodes the peptide sequence at SEQ ID NO. 9020
cccgtgggggtgtactacggctgggcttttgtgccctcccgtgacacggttccgcgcaaggcggccgtgtccatcgggtggaatcccttctacaagaacacccacaaaacactcgaagtgcacttgatgcactgttacgaggaggacttttatggcgaggagctgcgtgtcgtgctcttggggtacacccgccccgaatgcgacttctcctcccttgacgccctgatcgaggccatcaacgaagatattgcgtggacaagtcgcacactggatcagcctgagcacgccgcctacccatcacactcgtttttttctgccgcttcaccaccaacttctgccgcctcgtcctcttccgccacaacgttgcccgcatcctgatcggcttccgtttcgtgactcaagcccgctactgagaaaagagaagagaagatgaaaaggaaaagg

SEQ ID NO: 9020 - protein, 83 aa, Panicum virgatum
  misc_feature: Ceres CLONE 2025068
  misc_feature (83)..(131): Pfam Name: Flavokinase Pfam Description: Riboflavin kinase
MHCYEEDFYGEELRVVLLGYTRPECDFSSLDALIEAINEDIAWTSRTLDQPEHAAYPSHSFFSAASPPTSAASSSSATTLPAS

SEQ ID NO: 9021 - DNA, 985 bp, Panicum virgatum
  misc_feature: Ceres CLONE 2025413
  misc_feature: Encodes the peptide sequence at SEQ ID NO. 9022
atcacccatcctagagaatacagatgagatgacaaggcgacgttgcatcacttactaacctgcaggtgaggtgatgcttggctgaatggctggatgccaacctctgcaagaaggcaaggaaccgcaggggctgcagccgtatgatgccagcgatccttcagtgttcatagggccagttctgctgccccggcaggccagatcgggtcctccggcgccgccgaagatgtcgtcgtcgtcggggtctggtaggagcgttacggaggcgagggctctgaagatccacagcgaggccgagcggcgccgccgggagaggatcaatgctcatctgactacgcttaggaggatggtccctgatactaggcagatggacaaggccaccttgcttgccagagtggtagaccaagtgaagctgctgaagaggaaagcaggtgaggccactcaaagcatggccctcccaccggagaccaacgaagtctccatcgagctcgacaccggcgacaacggcttcgtcgtcgccggcaccggcaccggcaccgacaagatgatctacatgaaggcttccatcagctgcgacgaccggccggacctcatcgccgggctcacccaggcgttccatggcctgaggctgaggacggtgagggcggacttgacctcgttaggaggaagggcgcagcatgtgttcgtgctgtgcagggaggaaggctgctggggcagcgcaggtgcaagcctccggtctctgaaggaggctgtcaggcaggcggtagccagggtcgcttccccagaaatggcatatgggagtagtccctttcagagcaagaggcagaggattctggagtcacgttactcgattatgtccatatagaagatttttatttaattcctggggattcaggaactgcaaaagtctgtaagaaacggcataaaattcttcagattaagagtgctaattgtgtttgctgcgtaccaaaaaaaaaaaaaaaaaaaa

SEQ ID NO: 9022 - protein, 258 aa, Panicum virgatum
  misc_feature: Ceres CLONE 2025413
  misc_feature (1)..(50): Pfam Name: HLH Pfam Description: Helix-loop-helix DNA-binding domain
MAGCQPLQEGKEPQGLQPYDASDPSVFIGPVLLPRQARSGPPAPPKMSSSSGSGRSVTEARALKIHSEAERRRRERINAHLTTLRRMVPDTRQMDKATLLARVVDQVKLLKRKAGEATQSMALPPETNEVSIELDTGDNGFVVAGTGTGTDKMIYMKASISCDDRPDLIAGLTQAFHGLRLRTVRADLTSLGGRAQHVFVLCREEGCWGSAGASLRSLKEAVRQAVARVASPEMAYGSSPFQSKRQRILESRYSIMSI

SEQ ID NO: 9023 - DNA, 966 bp, Panicum virgatum
  misc_feature: Ceres CLONE 2025446
  misc_feature: Encodes the peptide sequence at SEQ ID NO. 9024
aaatcaaagtctttgggttccggggggagtcccgtgcagcacagccgcgccgcgtctcgtctcgtgccatcgcgtagccgactagccgccgtacgtccttgccgccgacgacagcccggcgcgtgccaccatggcgtggcggcggctccaggtgctggctctcgccctcgccgtcgtggtcacggcgacgacgctgacctcggcgcagcagcagcagccgccggcggcggcgttcccggctctgcccagctgcccgccggcgccgctcagcctgtccccgtgcatcggctacgtcttcggcgtcggctcggcgacgctcaccgcctgctgctcccagctccggggcttcctccgcgcgcaggcgccctgcctctgcgccgcgtccaagctcgcgcccagccccgtcggcctgctcctcggccaggcgcagaccatcatccccaacgtctgcgacctgcccaacccatgcgacgacgatgccgccgccggcgacggcgagggctctgcgccggcggcggcctccacgccgtcggtggcaggtacttcgcctccgtcctccgagacgacgactgcggcagccaccacgccggcaactgagacgtcgtcgggcacgccggcggccgatccagacgcgtcatcaggagcgccgccacaaccggccgaggattctcctgccaccgcgacggcaccggccggcgccgggtcgaagctcccccagctgctgcatgcagcaggcgccactagctccagaggcacggcagcaggtactgtgttcatcaccgtgtttctcgcttcagctgcagccatgtatgtgtagctgtaacctgctaagctattgcaagttcgcaacagcaaatgtactgatgtaatatgtgatgtggtacattataagttgaaagtgcaccctgtttttgtgcagttacaataaaaacgtttattctacagaaaaaaaaaaaaaaaaaaaaa

SEQ ID NO: 9024 - protein, 228 aa, Panicum virgatum
  misc_feature: Ceres CLONE 2025446
  misc_feature (1)..(75): Pfam Name: Tryp_alpha_amyl Pfam Description: Protease inhibitor/seed storage/LTP family
MAWRRLQVLALALAVVVTATTLTSAQQQQPPAAAFPALPSCPPAPLSLSPCIGYVFGVGSATLTACCSQLRGFLRAQAPCLCAASKLAPSPVGLLLGQAQTIIPNVCDLPNPCDDDAAAGDGEGSAPAAASTPSVAGTSPPSSETTTAAATTPATETSSGTPAADPDASSGAPPQPAEDSPATATAPAGAGSKLPQLLHAAGATSSRGTAAGTVFITVFLASAAAMYV

SEQ ID NO: 9025 - DNA, 650 bp, Panicum virgatum
  misc_feature: Ceres CLONE 2025895
  misc_feature: Encodes the peptide sequence at SEQ ID NO. 9026
ataaaagccggggtgctggggttgaggctcttcattcagctgagtgtgctcgatcatcaagcaatcaacaaagcctcccaattatcctttcatccgatcatcttccttcttccaagatgtcttgcagctgcaactgcggctccaactgcaagtgcggcaagatgtaccctgaccttgaggagaagagcagcggcggcgctcaggccaccgtcgtcctcggcgtggccccggagaagaaggccggccagttcgaggcggcggcggagtccggcgagaccgcccacgcctgcaagtgcggtaacagctgcagctgcgacccctgcaactgctgatttcgatggggaacgtcagaacacacctgcatgcatgctagctactacctactactctgcttgtgtgtgacttgatgattgaacaagaataaggatgagcctgagccatcatgtctcatgtatcggtttggctccggcctcatcaagcatgcatgcgtcgtctgcccctctgtgtgctttgcgtccgtcctgtgtctgtatgtgttgatcattgcaaagaaaccatgcaggcatacatctctgcatgtgtctctgtaatgatcggtccagagtgatgaatatataaaactggtttgctttatctgcctaatgcgtatt

SEQ ID NO: 9026 - protein, 71 aa, Panicum virgatum
  misc_feature: Ceres CLONE 2025895
  misc_feature (1)..(74): Pfam Name: Metallothio_2 Pfam Description: Metallothionein
MSCSCNCGSNCKCGKMYPDLEEKSSGGAQATVVLGVAPEKKAGQFEAAAESGETAHACKCGNSCSCDPCNC

SEQ ID NO: 9027 - DNA, 618 bp, Panicum virgatum
  misc_feature: Ceres CLONE 2025948
  misc_feature: Encodes the peptide sequence at SEQ ID NO. 9028
ctcatcacaagcgaagcagagcacacaggaagcactccaccttcttcagccgcgctacctgctttccttcctgcttgctcgtgatcaccgagatcaggatgtctggttgcggcggcggcaactgcgggtgcggctccgcctgcaactgcggcggcggatgcaacggtattgtatgcagctgcaagatgttccctgacgtggaggccgcctccaccaccaccaccatggtcatcgccgccgccagcaacaaggcgagctccggcgggttcgaggcggccaccgagagcggcggctgcgactgcaacacctgcaagtgcggcaccagctgcggctgctcctgctgcagctgcaactgaggcggccatgcgccgccgccatggaagcacgaggagaaagccccccggcgtagtatataggagcagcgtctaaataagatcttgccaactgcgccatccatcatctaccgtgtcgtgtcgtgacatccatggtcgcctgccgtgtctcagctggggttgttgtctgaacgtctctggtgatcgacgacgcatgccggtcgtcgatctttagcttgtgtgtccgtcctcctcgtgcacgccacctttaatatatgtatttcag

SEQ ID NO: 9028 - protein, 85 aa, Panicum virgatum
  misc_feature: Ceres CLONE 2025948
  misc_feature (3)..(83): Pfam Name: Metallothio_2 Pfam Description: Metallothionein
MSGCGGGNCGCGSACNCGGGCNGIVCSCKMFPDVEAASTTTTMVIAAASNKASSGGFEAATESGGCDCNTCKCGTSCGCSCCSCN

SEQ ID NO: 9029 - DNA, 772 bp, Panicum virgatum
  misc_feature: Ceres CLONE 2025977
  misc_feature: Encodes the peptide sequence at SEQ ID NO. 9030
agcagccgccagcaggaggcaagcatggagcctcacatggagagcgcgctgcggcagggcctgtcggaggcggagcagcgggagctggagggcgtggtgcgcgcgcaccacgcgttcccggggcgggcggcggggacgtgcacgtcgctggtgacgcagcgcgtggacgcgccgctcgccgctgtgtggcccatcgtgcggggcttcgccatcccgcagcgctacaagcacttcatcaagtcctgcgacctcaaggccggcgacggcgccaccgtcggcagcgtccgcgaggtcaccgtcgtctcgggcctcccggcctccaccagcaccgagcgcctcgagatcctcgacgacgaccgccacatcctcagcttccgcgtcgtcggcggcgaccaccgcctccgcaactaccgctccatcacctccgtcaccgagttccagccggggccctactgcgtcgtcgtcgagtcctacgtcgtcgacgtgcccgaggggaacacggaggaggacacgcgcatgttcaccgacaccgtcgtcaagctcgacctccagaagctcgccgccatcgccacctcctcctcctcctcctcctcgccgcggccctccgccggcagcatggatcactgatccatcatccttgcatgtcttcttcaatcttcatggtgtaccgtaccaccgcacatgcccgcatggtgatgcttcttgcattatattggtgctcatttcggtcctcttttcatcttttcagcagcaaaaaaaaaaaaaaaaaaaa

SEQ ID NO: 9030 - protein, 200 aa, Panicum virgatum
  misc_feature: Ceres CLONE 2025977
  misc_feature (1)..(138): Pfam Name: Polyketide_cyc Pfam Description: Polyketide cyclase / dehydrase and lipid transport
  misc_feature (2)..(152): Pfam Name: Bet_v_I Pfam Description: Pathogenesis-related protein Bet v I family
MEPHMESALRQGLSEAEQRELEGVVRAHHAFPGRAAGTCTSLVTQRVDAPLAAVWPIVRGFAIPQRYKHFIKSCDLKAGDGATVGSVREVTVVSGLPASTSTERLEILDDDRHILSFRVVGGDHRLRNYRSITSVTEFQPGPYCVVVESYVVDVPEGNTEEDTRMFTDTVVKLDLQKLAAIATSSSSSSSPRPSAGSMDH

SEQ ID NO: 9031 - DNA, 445 bp, Panicum virgatum
  misc_feature: Ceres CLONE 2026011
  misc_feature: Encodes the peptide sequence at SEQ ID NO. 9032
ttatgcgcctcgtcggcctctacgggcccttcgcgctcttccggggcgtcttcgacgacgccaacgtggagaggctccggctggccatggcgcccggcgaccgcgccgccttcaacttcgaccccaagaccgtcgactgggacgactacttctacagcatccacatccccggcgtcatgaagtacgtgctcaacaagtgatcgaattgaagccaagcaatggaggaggggaagaactggaataagcgtgccatcacatctcatccatcctcagcgaagaagatgaggatacattattgatggaaatgcatccagtcagcagcttagcttggacttctagttataactaggtcaatagcgcgcgatgccgcgccgtccgacttaatgataatcaatatcatgtgggttgactttgaaacttaaataaacaaaatgtgaataatagc

SEQ ID NO: 9032 - protein, 65 aa, Panicum virgatum
  misc_feature: Ceres CLONE 2026011
  misc_feature (12)..(75): Pfam Name: Sterile Pfam Description: Male sterility protein
MRLVGLYGPFALFRGVFDDANVERLRLAMAPGDRAAFNFDPKTVDWDDYFYSIHIPGVMKYVLNK

SEQ ID NO: 9033 - DNA, 461 bp, Panicum virgatum
  misc_feature: Ceres CLONE 2026012
  misc_feature: Encodes the peptide sequence at SEQ ID NO. 9034
ggcgcatctcccgctcctcgccggctccgcctcgcgcctctcgctgtcggacgccgccccctgtccccgttccccgcggcggcacgcgaagatgactacttcaaggcgtcttgctgacaggaagagtgccaagttccagaagaatatcacaaagaggggttccgtgcctgagactactgtgaagaaggggaatgactaccctgttggaccaattgtgcttggattcttcatttttgtggttattggatcatccttgtttcagataatcaggacagcgaccagcggcgggatggcttgacttgagctaaagcatgtccatccatgcatgcatgtgttcgggagctgggaggtagtgtctgtattctgtagcaaacttgttcctggatgatgtcctgtagtgttgcgaatcttgggtttcttttctgttgtttggagtatcaaagagttttaagtttaaacgg

SEQ ID NO: 9034 - protein, 68 aa, Panicum virgatum
  misc_feature: Ceres CLONE 2026012
  misc_feature: Great-hit functional homolog of the protein sequence given in SEQ ID NO 9418
  misc_feature: Useful for making plants with modulated nitrogen use efficiency
MTTSRRLADRKSAKFQKNITKRGSVPETTVKKGNDYPVGPIVLGFFIFVVIGSSLFQIIRTATSGGMA

SEQ ID NO: 9035 - DNA, 639 bp, Panicum virgatum
  misc_feature: Ceres CLONE 2026121
  misc_feature: Encodes the peptide sequence at SEQ ID NO. 9036
ttcccgcagttcttcttcctcggcgtcgcgtctcctcctccatctcgtaaccctagacaacccatcagatcggggtctcggctcctcttggctcacgagaccagggatttgtctcgcgatcctacaagttccatggcggatgctgaacctgttgatccgaagaattaccttgaggaacgttgcaagccacagtgtgtaaaatcattgtatgattatgagagatgcatgaaaagagttgagaacgatgatagtgggcataagcactgcactggccaatatttcgactactggtcatgcgtcgacaagtgtgttgctccaaagctctttgataagcttaaatgatgtcgctgctttcaatgtgacttctttgccgtagttctcaagctaaataaattgaacatgtaacaaacagtttcattttgctattcaattggcagaagtctttgaataaggcagacacgtactgtactggtgttcagtttaactgtcatacctagagaaggtagatggagcaaggtacccagagtgttggtataactaaccaaacgttttcgtggtggtggtggtggtggatatgagcttcaaaattcaaactttcatcctttattttggcaattgtttccattcaagattgcatcc

SEQ ID NO: 9036 - protein, 69 aa, Panicum virgatum
  misc_feature: Ceres CLONE 2026121
  misc_feature (1)..(69): SWISSPROT Homolog: EC 1.10.2.2 Ubiquinol-cytochrome c reductase complex 7.8 kDa protein
MADAEPVDPKNYLEERCKPQCVKSLYDYERCMKRVENDDSGHKHCTGQYFDYWSCVDKCVAPKLFDKLK

SEQ ID NO: 9037 - DNA, 834 bp, Panicum virgatum
  misc_feature: Ceres CLONE 2026604
  misc_feature: Encodes the peptide sequence at SEQ ID NO. 9038
agcgacacatacagttctatccacagtttctatcataatgtccgtcgatcgtgatgaccacgtttacatggccaagctcgctgagcaggccgagcgctatgacgagatggttgagtccatgaaggctgttgccaagctcgatgtggagctcacagtggaagagcgcaacctgctctccgtcgcctacaagaacgtgattggtgcccgccgtgcctcgtggcgcatcatcagctccatcgaacagaaggaggagaacaagggaaacacacagcacgtccctcgcatcaacgagtaccgtcagaagatcgagaaggagctccgtggaatctgcgacgacatcctcgccgtgatcaacgagcaccttgtcccttccgccagcacttcggagagcaaggtcttttacttcaagatgaagggtgattaccacagatatttggccgagttcctggttggtgacgatcgcaagaccgccgccgatcacgccctcgaagcctacaactctgccagcgagatcgctgttgccaacctcccccctacccaccccatccgtctcggtctcgccctcaacttctcagtcttttactacgaaattttgaacagccctgacaaggcctgccagctcgccaagcaggctttcgatgatgccatcgctgagctcgatgagctctccgaggattcctacaaggactccaccctgatcatgcagctcctccgtgacaacctgaccctctggacctcggacctccaggccgacgaggctgatgattcggatgatggcgccgctgataacgcctaaatccattgtgctaccttcaaaaaaaaaaaaaaaaaaaa

SEQ ID NO: 9038 - protein, 252 aa, Panicum virgatum
  misc_feature: Ceres CLONE 2026604
  misc_feature: The sequence is a functional homolog of  SEQ ID NO 793 in the  11/479,226 US patent application
  misc_feature: Useful for making plants with modulated growth and phenotype characteristics
MSVDRDDHVYMAKLAEQAERYDEMVESMKAVAKLDVELTVEERNLLSVAYKNVIGARRASWRIISSIEQKEENKGNTQHVPRINEYRQKIEKELRGICDDILAVINEHLVPSASTSESKVFYFKMKGDYHRYLAEFLVGDDRKTAADHALEAYNSASEIAVANLPPTHPIRLGLALNFSVFYYEILNSPDKACQLAKQAFDDAIAELDELSEDSYKDSTLIMQLLRDNLTLWTSDLQADEADDSDDGAADNA

SEQ ID NO: 9039 - DNA, 638 bp, Panicum virgatum
  misc_feature: Ceres CLONE 2026743
  misc_feature: Encodes the peptide sequence at SEQ ID NO. 9040
atcacatccatcatccatctcgacgatccaagcagcacaagaacgtcgtctctgatcaccaccaccaccaccactgaatcaacaagctcgcagcagctctgttctagcttaggccggcgtccgtccgcaccgtccaaatggcgcaccacttcctgggcaagcaccacagcaaggccaccgccgccggcgaggcgccgcccaaggtcaccgactggcgcaaggaggagaagcaccacaagcacatggagcagctcgcccagctcggcgccgtcgcagcgggagcgtacgccgtgcacgagaagcacaaggccaagaaggaccccgaccatgcgcactcccacaagatcaaggaggacgtcgccgccgccatcgccgtcggcagcgcaggcttcgccttccacgagcaccacgagaagaaggacgccaagaagcaccgccgcaacggccaccgccattagtgtagtgtgtgtgcaccgcgcaccacatatagcatatatatacagatatatactgtatatatagtacaataaattggacgtactatcgtagtcctactactactgtatgtgtgtcgatcctgtactgcttattcacattgcattgatttattatttattcatgttactgttttttttgtc

SEQ ID NO: 9040 - protein, 106 aa, Panicum virgatum
  misc_feature: Ceres CLONE 2026743
  misc_feature (2)..(54): Pfam Name: ABA_WDS Pfam Description: ABA/WDS induced protein
MAHHFLGKHHSKATAAGEAPPKVTDWRKEEKHHKHMEQLAQLGAVAAGAYAVHEKHKAKKDPDHAHSHKIKEDVAAAIAVGSAGFAFHEHHEKKDAKKHRRNGHRH

SEQ ID NO: 9041 - DNA, 509 bp, Panicum virgatum
  misc_feature: Ceres CLONE 2026905
  misc_feature: Encodes the peptide sequence at SEQ ID NO. 9042
gtaacagcagttctagcactgtcccacacagatcacaactcgcaccatcggccattcctctccgttctcccatcccatcctcaacctcgtaccgggctgctgccgaggagggccaccacgccggccatgtcgacggcggcgcacaaggtggtggcgaaggcgaagacggcggggaggcggccgccgagcgtgctgagggatatcgcgtacggtatgagcctcggcctcttcgcgggttacctgtggaagctgcaccactggagcaaccagcgccgcacccgcgagttctacagcctgctcgaccagggcaaggtcagcgtcgtcgccgacgactgacggtacacgcacgcttcagtagctcgatcaccggcgccagctgatcgctctccgtgcatgctgcttggcatgcatgtcacttcagttcagtactgtactctcatgctcatcatcagtagtttactgctcccttcgttccaaattataagacattataaaaattttagagagtt

SEQ ID NO: 9042 - protein, 69 aa, Panicum virgatum
  misc_feature: Ceres CLONE 2026905
  misc_feature (2)..(62): Pfam Name: COX5C Pfam Description: Cytochrome c oxidase subunit Vc (COX5C)
  misc_feature (20)..(69): SWISSPROT Homolog: EC 1.9.3.1 Cytochrome c oxidase polypeptide Vc
  misc_feature (4)..(69): SWISSPROT Homolog: EC 1.9.3.1 Cytochrome c oxidase polypeptide Vc-2
MSTAAHKVVAKAKTAGRRPPSVLRDIAYGMSLGLFAGYLWKLHHWSNQRRTREFYSLLDQGKVSVVADD

SEQ ID NO: 9043 - DNA, 704 bp, Panicum virgatum
  misc_feature: Ceres CLONE 2027024
  misc_feature: Encodes the peptide sequence at SEQ ID NO. 9044
gtgctctctcagaggtgggttggcttctcctccccctcttaccaagtcctcggctctagggttttaatgggaagggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcctccgagcagtcgatgctggacgccatcgaagccatgaacggcaaggatctcgacggccgcaacatcaccgtcaaccaggctcagtcccgcggcggcggcggcggcggcggcggctacggcggcggtcgtcagggtggctacggcggcggcggcggcggcggctacggaggcggtggtggctacggcggtggtcgccgtgagggcggctacggcggaggcggtggcggcggtcgccgcgagggcggctacggtgatggtggctacggcagccgcggtgactccggtggtaactggaggaactgatggggtggccctcccgtgctggcagccaagttatcctatatatctattagtgtgcgtgtcactgtttgatccgagttacccctgagttttgttcgtgtgttaccgttcgattaggtgttggttcccctgtttaccgttccgagttgtttccg

SEQ ID NO: 9044 - protein, 161 aa, Panicum virgatum
  misc_feature: Ceres CLONE 2027024
  misc_feature: Great-hit functional homolog of the protein sequence given in SEQ ID NO 9183
  misc_feature: Great-hit functional homolog of the protein sequence given in SEQ ID NO 9185
  misc_feature: Great-hit functional homolog of the protein sequence given in SEQ ID NO 9703
  misc_feature: Useful for making plants with altered Lignin content
  misc_feature: Useful for making plants with altered alkaloid content
  misc_feature: Useful for making plants with modulated biomass
  misc_feature: Useful for making plants with modulated nitrogen use efficiency
  misc_feature: Useful for making plants with modulated nitrogen use efficiency
  misc_feature: The plant is abnormally small.
MGREMAAADVEYRCFVGGLAWATDNASLQQAFASYGDVLDSKVITDRETGRSRGFGFVTFSSEQSMLDAIEAMNGKDLDGRNITVNQAQSRGGGGGGGGYGGGRQGGYGGGGGGGYGGGGGYGGGRREGGYGGGGGGGRREGGYGDGGYGSRGDSGGNWRN

SEQ ID NO: 9045 - DNA, 555 bp, Panicum virgatum
  misc_feature: Ceres CLONE 2027273
  misc_feature: Encodes the peptide sequence at SEQ ID NO. 9046
aagcaatagctctgtgctcatcaactcaaagcttccctctctctttgtctagaagctcttgaggttccaggagagaaatacaagttgagaagatgtcttgcggtgggagctgcaactgtggttcgagctgtggctgtggcagtggatgcggaaaaatgtaccctgacttggccgagaagagcgcagccgccgcaccggcggccatggtcctcggcgtcgcacctgcgaaggggcgcctcgaggacgggtttgagaaagccgcagagtccggcgaggccggccatggctgcagctgcggctccggctgcaagtgcagcccctgcaactgctgatggagaaggtgatctgtgtgcatagcatggtccagcatcctcgtcagcctgtatgtgtgtgtgtttgtgtggtgtaagcaaataaagggccatctgatctgtgatgaggtaatctatacgaacatgaactgtcgagtgtgcaacaccttcgtggttgtgtaaaatttgtcagtgcccgtgaccatgttcagttcagtggaatataaacttggtttccttgtgc

SEQ ID NO: 9046 - protein, 79 aa, Panicum virgatum
  misc_feature: Ceres CLONE 2027273
  misc_feature (1)..(79): Pfam Name: Metallothio_2 Pfam Description: Metallothionein
MSCGGSCNCGSSCGCGSGCGKMYPDLAEKSAAAAPAAMVLGVAPAKGRLEDGFEKAAESGEAGHGCSCGSGCKCSPCNC

SEQ ID NO: 9047 - DNA, 645 bp, Panicum virgatum
  misc_feature: Ceres CLONE 2027308
  misc_feature: Encodes the peptide sequence at SEQ ID NO. 9048
atatcgaactgaaaaaaaatagataagaatggatccggatgacaaaactttaggtcctgatcctcagctcatttttcgtggctctgaatcgctttctggccaaaaatctgcttcaccaactctcatctctccctcacagtcaacaacctcaaattggttaccatatttgggagtaggattcggagggattattggaggtgcaacaggtattcttggtggtccagtcggtattgcagcaggtgttggggttggaatgactcttggaggttctgtagctgtagcaattaatgctgcacaagaaaataagagaacaacgaatctgaatcgtcaatttagtcaatcaagaggtgtagaatggaaagatggaccaaattgctcaggatgtaaaagacacttcgtttccagttttctaatgtggcatcattgtagaaattgcggtgagatcttctgtgatgcatgtagtaactatcgtaaacctcttcaacaaagtggattcgatgatgaaggatctcgtgtctgtcgtgcatgttatgaacttttagataaataggaaaagaatcaaaaaaccgaacccaaaaaaaaacccttgtagatatcaacttgtaataaaatcctctttcattctaaaaaaaaaaaaaaaaaaaa

SEQ ID NO: 9048 - protein, 173 aa, Panicum virgatum
  misc_feature: Ceres CLONE 2027308
  misc_feature (2)..(60): Pfam Name: FYVE Pfam Description: FYVE zinc finger
MDPDDKTLGPDPQLIFRGSESLSGQKSASPTLISPSQSTTSNWLPYLGVGFGGIIGGATGILGGPVGIAAGVGVGMTLGGSVAVAINAAQENKRTTNLNRQFSQSRGVEWKDGPNCSGCKRHFVSSFLMWHHCRNCGEIFCDACSNYRKPLQQSGFDDEGSRVCRACYELLDK

SEQ ID NO: 9049 - DNA, 823 bp, Panicum virgatum
  misc_feature: Ceres CLONE 2027478
  misc_feature: Encodes the peptide sequence at SEQ ID NO. 9050
gacagcgccggagaggagaggagaggcatggcgcgcggaccgcccgcagccgccgccgccgcccatgggccgcgcctagccggcgtcggccgcgcgctcctcctcgtcgcggccactgcaaccttcctcccagcagccgagtcatcctgcccgcgagacaactcgctggtgagggacataagccggatgcaccaaagcaactatgggagggaaggattctcgcatataacggttgctggcgcgctcgctcacgggatgaaggaggtggaagtgtggcttcagacatttggtccgggcaaaaggacccccatccacaggcactcctgtgaggagattttcgttgtccttaaagggaaaggcatgctcttgctggggtcaagctcgctcaagcacccaggggagccacaggagattcctgtcttccagaatagcacatttacgatccctgtaaatgatcctcaccagatttggaattctgatgagcatgaagatttgcaagttcttgtgatcatatcacgcccgcctattaagatattcatctatgatgattggagtgtgcctcacacagccgcgaagctgaagttcccctactactgggatgaagactgcttaccggcgcctaaagatgaactctagtttaagtgtttgctacagtatatcagttttgtccacaaccctgctggattatgattgacgtccactagttgtaaaacattaattagtgtgctgtcatgtacagttctgtgttgtgactccggaatatatgcattgtggccatggtttatgaacttaaccgcttctggaaaaaaaaaaaaaaaaaaaa

SEQ ID NO: 9050 - protein, 202 aa, Panicum virgatum
  misc_feature: Ceres CLONE 2027478
  misc_feature (1)..(166): Pfam Name: Auxin_BP Pfam Description: Auxin binding protein
MARGPPAAAAAAHGPRLAGVGRALLLVAATATFLPAAESSCPRDNSLVRDISRMHQSNYGREGFSHITVAGALAHGMKEVEVWLQTFGPGKRTPIHRHSCEEIFVVLKGKGMLLLGSSSLKHPGEPQEIPVFQNSTFTIPVNDPHQIWNSDEHEDLQVLVIISRPPIKIFIYDDWSVPHTAAKLKFPYYWDEDCLPAPKDEL

SEQ ID NO: 9051 - DNA, 573 bp, Panicum virgatum
  misc_feature: Ceres CLONE 2027860
  misc_feature: Encodes the peptide sequence at SEQ ID NO. 9052
aaaccatcccaaagcacagaacgccatcgatctagctagctagctagcttgggcacggtagcaatggcgccatcgtccaagaccaagctggttgtgttcgtcctggccgcagccgccctgtccatggcggcggctcaagcgccaccgcctccgccgggcacctgcgacccgctgaagctgcgcgtgtgcggtgggctcctcctggggggcggcgggggcggcagccagtgctgcccgctgctcggggggctcgtcgacctggacgccgccgcctgcgtctgcgccgccctgagggccaacgacctcggcgtcatcgtcgacctaacgtccccctcgccctggatcgcgtgctcaacacctgcggcagggacgtccccgccggcttcaactgcccgccgccggcttgatcgcggtgctctcagcctagctcatgaaacaaaacaataatgataatcacgctacgtttaatacggtttaccaagcattatagtctgttcgtgtgttatacgtgaatgaaataaaagcttatacaaaagctatatctatataatataaaatggtaactttgagccc

SEQ ID NO: 9052 - protein, 127 aa, Panicum virgatum
  misc_feature: Ceres CLONE 2027860
  misc_feature (4)..(63): Pfam Name: Tryp_alpha_amyl Pfam Description: Protease inhibitor/seed storage/LTP family
MAPSSKTKLVVFVLAAAALSMAAAQAPPPPPGTCDPLKLRVCGGLLLGGGGGGSQCCPLLGGLVDLDAAACVCAALRANDLGVIVDLTSPSPWIACSTPAAGTSPPASTARRRLDRGALSLAHETKQ

SEQ ID NO: 9053 - DNA, 818 bp, Panicum virgatum
  misc_feature: Ceres CLONE 2027874
  misc_feature: Encodes the peptide sequence at SEQ ID NO. 9054
acacacacaatcacacaacaaagactctcatcagtgactagtacgtcttcagttcttccctaatcagtgtcaaccgacttgcttgttgccacgatggttgtcggcaaagtcacactcgagtacccggtggccgtatcggtcgagctgctatggaaggtggcgttctccggcgacgtgtccatcttcaccaaggcctgcgtcggcatgattgacgccgtggaggtcgatggcgacagcgggcccgggaccgtcaccaccatgaagctcaaccctgccgtgggcgacgcgaaggtgttcaagacccggctcttgtcacgtgatgcggcggcacgtgtggtgaagtcagagatggtggtggagggcagcgagctgtccgtgcagttcaagtcgcaggtgtccgaggtgaaggtggtgccggccggcgagggtgccagtgtggtgcacatgacggtggagtacgagctggtggacggcgcgctgctgccgccagaggaggaggccaggatcgggcagggctacctcggcctcatcaagaaggtggaggagtacctcgttgcgcaccccaccgagttcgcctaaagctacctaccattatgcatcgtcgtggcgatggggccagagaaatccgtgttaaataatgatggtgatcatgccatgagcgtgttcttgatttgaaaatcggaataatgagaggaagtgatcctctgcttggtcggttgattgtgcttgtggttgtgaggaaacaacagtttcagtttttgtgataacagtatatgttctactgttgtgtttgggttcaaaaaaaaaaaaaaaaaaaa

SEQ ID NO: 9054 - protein, 161 aa, Panicum virgatum
  misc_feature: Ceres CLONE 2027874
  misc_feature (9)..(155): Pfam Name: Bet_v_I Pfam Description: Pathogenesis-related protein Bet v I family
MVVGKVTLEYPVAVSVELLWKVAFSGDVSIFTKACVGMIDAVEVDGDSGPGTVTTMKLNPAVGDAKVFKTRLLSRDAAARVVKSEMVVEGSELSVQFKSQVSEVKVVPAGEGASVVHMTVEYELVDGALLPPEEEARIGQGYLGLIKKVEEYLVAHPTEFA

SEQ ID NO: 9055 - DNA, 801 bp, Panicum virgatum
  misc_feature: Ceres CLONE 2028056
  misc_feature: Encodes the peptide sequence at SEQ ID NO. 9056
agaaagcacacgcctctctgtctccatcttcttcttcttcttcgagaggcttcttccctccgccgccatggccgccgcacgcctgctcccgctgctcagacgccgcctcgccgccacgatcgccgactcgccctccccctcctcccgaggattttcgtttcctccaaccacatctgcggggctaagatccctcctgacagttaccgaagcaagcaacaatgacaatccttcggaccaagagcaagacggttccaaaaccgacacgcctccagctagttcagcccctgcaccggagcccagcttcaaggtcagagatacctccaacctgaagatctcgcccaggcatgaccttgccatggtcttcacatgcaaggtctgcgagaccaggtctatgaagatggccagccgggattcgtacgagaatggagttgtggttgcgcgctttggtggttgtaacaacctccaccttatagcagataggctaggctggtttggggagccagggagcatcgaggacttcctagcagcgaaaggagaggaggtgaagaaaggttcaacggatactctcaacttctctctcgaggacttggttgggtctcaggtcagttcaaaggggccttctgaacaaaattaggattcccaaaacacagtagcttttggtccagcaagtacctgtagaaccaacgttaatattgggaactcccacaagttttgttcaacttcatggcttctcatgtgtatctctcaagcccatcgagtatatgccattgtgatctattgcaaaaaaaaaaaaaaaaaaaa

SEQ ID NO: 9056 - protein, 188 aa, Panicum virgatum
  misc_feature: Ceres CLONE 2028056
  misc_feature (1)..(65): Pfam Name: zf-DNL Pfam Description: DNL zinc finger
MAAARLLPLLRRRLAATIADSPSPSSRGFSFPPTTSAGLRSLLTVTEASNNDNPSDQEQDGSKTDTPPASSAPAPEPSFKVRDTSNLKISPRHDLAMVFTCKVCETRSMKMASRDSYENGVVVARFGGCNNLHLIADRLGWFGEPGSIEDFLAAKGEEVKKGSTDTLNFSLEDLVGSQVSSKGPSEQN

SEQ ID NO: 9057 - DNA, 719 bp, Panicum virgatum
  misc_feature: Ceres CLONE 2028108
  misc_feature: Encodes the peptide sequence at SEQ ID NO. 9058
gagcagagaaccagagccaagcaaagctagcctagtagtagccatggcggaggaggcgtcgtccgcgccagcgccggcccagccgcagcagcagcagtaccgcctcgtcgtcgtcaccgccaagccctccgccgcgtccgccgtcggcctcgccggcccgggcgcggcggaggtgctgccgttcgtggaggcggacctcaagcgcgtcgcgctgcgcgtcgtcgacaaggccagggagctctgcgccgccgcgcaggtggccgacgccgagttcgaggcgctcgagggcgacgccaggaacgtcctctgcgacgccgtcgagaggcaccacgccgagatgctcgttgtcggcagccacggctacggtgccatcaaaagggctgttcttggaagcgtgagcgattactgcgcccaccatgcgcactgcaccgtgatgatcgtgaagaagcccaagcccaagcactgagcaccgatcgatgcggcgatctgactcgtcagtattccacaagcaaacatctctatatgtattgtcaagctgcatgtgtgtctgtttgtgcataagcagaagatcaacgagcttcaaataaccggttacttggtcgagtaaccggatatatgtaatcctactacttacggattgacatgtacaaaataattgctgtgcagcacctcaaaaataatgttattttttcttcatggaaaaaaaaaaaaaaaaaaaa

SEQ ID NO: 9058 - protein, 140 aa, Panicum virgatum
  misc_feature: Ceres CLONE 2028108
  misc_feature (28)..(150): Pfam Name: Usp Pfam Description: Universal stress protein family
MAEEASSAPAPAQPQQQQYRLVVVTAKPSAASAVGLAGPGAAEVLPFVEADLKRVALRVVDKARELCAAAQVADAEFEALEGDARNVLCDAVERHHAEMLVVGSHGYGAIKRAVLGSVSDYCAHHAHCTVMIVKKPKPKH

SEQ ID NO: 9059 - DNA, 449 bp, Panicum virgatum
  misc_feature: Ceres CLONE 2028248
  misc_feature: Encodes the peptide sequence at SEQ ID NO. 9060
acacatcggtgagcagcttccccacattctcgttctccgtccaccaacctacccacctgcggcggcgcaaggaagcgaagcgacgcgatgtcggcgacgacggcggcggtgcccttctggcgcgcggcggggatgacctacatcggctactccaacatctgcgccgcgctggtgcggaactgcctcaaggagcccttcaagtccgaggccgcgtcccgcgagaaggttcacttctccgtctccaagtggacggacggcaagcaggagaagcccattgtttttgttgcagctgtccgcacggagtcagatgaataaagatctggtgcaatgatgatagtccttctacagatgttttgaagtgttgttgcaagctctggaacttgctgtttatctggcttgattttatggtcaacactgaagaataaatactttttgtaacaattgatctt

SEQ ID NO: 9060 - protein, 75 aa, Panicum virgatum
  misc_feature: Ceres CLONE 2028248
  misc_feature (1)..(49): Pfam Name: ATP-synt_Eps Pfam Description: Mitochondrial ATP synthase epsilon chain
  misc_feature (1)..(75): SWISSPROT Homolog: EC 3.6.3.14 ATP synthase epsilon chain, mitochondrial
MSATTAAVPFWRAAGMTYIGYSNICAALVRNCLKEPFKSEAASREKVHFSVSKWTDGKQEKPIVFVAAVRTESDE

SEQ ID NO: 9061 - DNA, 544 bp, Panicum virgatum
  misc_feature: Ceres CLONE 2028271
  misc_feature: Encodes the peptide sequence at SEQ ID NO. 9062
agcacaacaagcagagcagagcctagcttcttcctgaacccaactccatcaaccaacgcaggctcgtcctcgtcctagctagttccaccagcaacatgtcggacaagtgcggcaactgcgactgtgctgacaggagcaagtgcacccgcgtcgagcgccgcgaggaggaggaggtcgccgccggcgagaacgacggcaagtgcaagtgcggcaccagctgcggctgcggcgccagctgcaactgcggccactgaagaagcccgccgcgtcgtccatggcctgcgtgcacactccccatccagtacccatcctgtacctgtatgtacgtcgtcgatcacagcgtataaataaaattaaataaaccgccatgcccgtgttgaatacgtacgtacgtcgtgtcctatgtgacctgctgcgtctccgctgctgtcgtgcatgtgaccagcaaccacctgtagctacctacctgtctttgtgacgacgcatgcatgtacgtatctctgttatgtgcaatgaaatctactgtgtgctttgactactaggc

SEQ ID NO: 9062 - protein, 52 aa, Panicum virgatum
  misc_feature: Ceres CLONE 2028271
  misc_feature (1)..(60): Pfam Name: Metallothio_2 Pfam Description: Metallothionein
MSDKCGNCDCADRSKCTRVERREEEEVAAGENDGKCKCGTSCGCGASCNCGH

SEQ ID NO: 9063 - DNA, 848 bp, Panicum virgatum
  misc_feature: Ceres CLONE 2028310
  misc_feature: Encodes the peptide sequence at SEQ ID NO. 9064
aacaatctccatctttcccgcccaacaactaaggcatcactgagaaacacccttgcatcgacatctactccattaatcaatcaatcacaaccccatcaaaatgcgcagcaagtttaaggacgagcacccctttgagaagcgcaaggccgaagccgagcgcatccgccaaaaatatgcggatcgtattccggtcatctgcgagaaggtcgaaaagagcgacatcgcgacgatcgataagaagaagtacctcgtaccatccgacctcaccgtgggccagttcgtgtacgtgattcgcaagcggatcaagctctccccagagaaggccatcttcatcttcgtcgatgaggttctaccgcctaccgctgcactcatgagcagcatctacgaggagcacaaggatgaggacgggtttctttacatcacatactcgggcgagaacacctttggaaacttcgagtccgcctgagccatgaaccctcggctttgttcttgcatttcctagatgcgttcgcggcgttttcggttattggtttgggaagactcgagactgaaggatcgctgggggagagaacggaccggactattatgcactgcatttttcttttgctggacttttttgggcagtggctgcgtggctatgaggccttgaagacgggattacctacacaccacaacgcgcttggttaggcagtgatcaggcggcgggcgagaatggctccttgccggcttggtttaccggttatcggatctcttacctagagagcattgttgttggccctggttcacgccgcaaagccacttttaaaaaaaaaaaaaaaaaaaaaaaataaaaaaaaaaaaaaaaaaaa

SEQ ID NO: 9064 - protein, 121 aa, Panicum virgatum
  misc_feature: Ceres CLONE 2028310
  misc_feature: Great-hit functional homolog of the protein sequence given in SEQ ID NO 9436
  misc_feature: Useful for making plants with modulated nitrogen use efficiency
MRSKFKDEHPFEKRKAEAERIRQKYADRIPVICEKVEKSDIATIDKKKYLVPSDLTVGQFVYVIRKRIKLSPEKAIFIFVDEVLPPTAALMSSIYEEHKDEDGFLYITYSGENTFGNFESA

SEQ ID NO: 9065 - DNA, 651 bp, Panicum virgatum
  misc_feature: Ceres CLONE 2028343
  misc_feature: Encodes the peptide sequence at SEQ ID NO. 9066
atatcacaagcagctggctaatcactagctcgctgatcaagagctctaaccaccttagctagttatagcttgttggcttagcagctagcaatggcgtccaaggcgttggtgctgttcctggccgtgaacctggtgctgctgggcgtggccacgcctggggcattcggcaccacatgccccatcgacacgctcaagctgggcgtgtgcgtcgacttgctgaccctccttaaggccaatctaggcgtgccgcccacgcagcagtgctgccccctcatcagcgggctcgccgacctcgaggccgccgcctgcctctgcaccaacctgatcctccccgccgacatcagcctcatcctcaactactgcggcaagagcctgccctccggcttcgtgtgctgatcgatcatcgcctctagacgtgtatgaatatacacgagaggcggccttgcttcccgtttgttgcatggtttgcttgctcttgtttattccacgtgccggtgatgggatcggtttgcctgcagtgcatggtagtagcgcgctagcgctgttatcttatttggattttctctacctcatctctatgcttttgttgtaataataaagggccggtactcacttgtgtgccggtgtttcaatgaagtttcgtttgcagcg

SEQ ID NO: 9066 - protein, 101 aa, Panicum virgatum
  misc_feature: Ceres CLONE 2028343
  misc_feature (1)..(82): Pfam Name: Tryp_alpha_amyl Pfam Description: Protease inhibitor/seed storage/LTP family
MASKALVLFLAVNLVLLGVATPGAFGTTCPIDTLKLGVCVDLLTLLKANLGVPPTQQCCPLISGLADLEAAACLCTNLILPADISLILNYCGKSLPSGFVC

SEQ ID NO: 9067 - DNA, 736 bp, Panicum virgatum
  misc_feature: Ceres CLONE 2028608
  misc_feature: Encodes the peptide sequence at SEQ ID NO. 9068
aacagcacactcgatcctcaccaccatcactccccaccacttgatcgggcggtgctgcagagagatcgatcggcatcaacgcatcatcggccatgggcaaggcgacggccaccaccgtgctcgcgctcgcgctctgcagcgccgccctgctgctgctggccgcgcggccgctggacgcggcggcgtgcaacccggccgcgctgagcccgtgcggcggcgcgctgttcggccgcgcggtggcgccggggtgctgcgtgcagctcaaggcccagcagccgtgcctctgccagtacgcgcgcaaccccgcctacagcagctacgtcaacggccccgccgcgcagcgcgtcgccaacgcgtgcggcatacccaagatgaaatgctgatgagagagatcgagctcctgctcggccgccggcgcgtcaccggccgggccgccggcaccacgccgcacaccgctactactacgagtccacggcagatcgacggcggtggacgcctaaataaaaggccgcgcgacggcgagctctagcttgagctgtttgccgccggtcgccaactccggcagctcatcagctagctcagctttgagcctatgttttatatatgccggttagtttggtggttttcgtgatgtttttgagtcttgtttcgtgcgagcaaagttgtgtttgtgtcctcaatctgcttttcatctgcaacagcagctacgaccttggaaaaaaaaaaaaaaaaaaaa

SEQ ID NO: 9068 - protein, 96 aa, Panicum virgatum
  misc_feature: Ceres CLONE 2028608
  misc_feature (1)..(65): Pfam Name: Tryp_alpha_amyl Pfam Description: Protease inhibitor/seed storage/LTP family
MGKATATTVLALALCSAALLLLAARPLDAAACNPAALSPCGGALFGRAVAPGCCVQLKAQQPCLCQYARNPAYSSYVNGPAAQRVANACGIPKMKC

SEQ ID NO: 9069 - DNA, 582 bp, Panicum virgatum
  misc_feature: Ceres CLONE 2028609
  misc_feature: Encodes the peptide sequence at SEQ ID NO. 9070
ctcatcacaagcgaagcagagcacacaggaagcactccaccttcttcagccgcgctacctgctttccttcctgcttgctcgtgatcaccgagatcaggatgtctggttgcagcggcggcaactgcgggtgcggatgcaacggctgcaagatgttccctgacgtggaggccgcctccaccaccaccaccatggtcatcgccgccgccagcaacaaggcgagctccggcgggttcgaggcggccaccgagagcggcggctgcgactgcaacacctgcaagtgcggcaccagctgcggctgctcctgctgcagctgcaactgaggcggccatgcgccgccgccatggaagcacgaggagaaagccccccggcgtagtatataggagcagcgtctaaataagatcttgccaactgcgccatccatcatctaccgtgtcgtgtcgtgacatccatggtcgcctgccgtgtctcagctggggttgttgtctgaacgtctctggtgatcgacgacgcatgccggtcgtcgatctttagcttgtgtgtccgtcctcctcgtgcacgccacctttaatatatgtatttcag

SEQ ID NO: 9070 - protein, 73 aa, Panicum virgatum
  misc_feature: Ceres CLONE 2028609
  misc_feature (3)..(83): Pfam Name: Metallothio_2 Pfam Description: Metallothionein
MSGCSGGNCGCGCNGCKMFPDVEAASTTTTMVIAAASNKASSGGFEAATESGGCDCNTCKCGTSCGCSCCSCN

SEQ ID NO: 9071 - DNA, 551 bp, Panicum virgatum
  misc_feature: Ceres CLONE 2028612
  misc_feature: Encodes the peptide sequence at SEQ ID NO. 9072
aatctcatcgatcgagccatccatccatccatccagccgcctctcctcgcctgctgcgcgcgtctctctgctctccgagggagatctcgcgcagcccggaaacccgtcgacccagctcgtcctcgtcgcagatggccggcctcaggatgaagttcgtcgccgccgccgccgtggccgccgcgctcgtggcgtcggccgccgccgccactgaggcccccgccccggcgcccgcctccggcgccgccgccgcggtgcccctcgcggcggcgtccctcgccgccgccgccttcggctacctcttctgctagatccgtcggccgttctccgcgggtggtcctgctgatgatatgatgattcgttttggcgtgagtcgagtccgtgtccgtggcgtgtggggatgatgtcggtgggcgtgtgtatgtacgagttcggcggcggtgggggtggtgtgcgagcggtgggggcgtgcgtcgacgcgccgttctctgtggcgtcgatcatgtactcactccgtttctggttattgatgagatcatttatttgattctttc

SEQ ID NO: 9072 - protein, 58 aa, Panicum virgatum
  misc_feature: Ceres CLONE 2028612
  misc_feature: Great-hit functional homolog of the protein sequence encoded by LOCUS At4g26320
  misc_feature: Useful for making plants with altered cell wall content and/or composition
MAGLRMKFVAAAAVAAALVASAAAATEAPAPAPASGAAAAVPLAAASLAAAAFGYLFC

SEQ ID NO: 9073 - DNA, 735 bp, Panicum virgatum
  misc_feature: Ceres CLONE 2028712
  misc_feature: Encodes the peptide sequence at SEQ ID NO. 9074
gaccagccctctcactctcaagtctcaacgcccactcgatccccatctcaccaccatcactccccaccacttgctcgggcggcgctgcagagagatcgatcggcatcggccatgggcaaggcaacggccaccaccgtgctcgcgctcgcgctctgcggcgccgccctgctgctgctggccgcgcgcccgctggacgcggcggcgtgcaacccggccgcgctgagcccgtgcggcggcgcgctgttcggcggagcggtgacgccggggtgctgcgtgcagctcaaggcgcagcagccgtgcctctgccagtacgcgcgcaaccccgcctacaggagctacgtcaacggccccgccgcgcagagcgtcgccaaggcgtgcggcatccccaagatgaaatgctgatgagagagctcctctgccggcgcgtcaccggccggccgccggcacgccgtacaccgttactacgacggcagatcgacgatggtgaacgtctaaataaaaggccacgacggcgagctctagcttgagctgtttgtcgccggtcgccaactccggcagctcgtcagctagcttagctcagctttgagcttgtgtgttatgccggttagtttggttgttttcgtaatgttgttgagttttgtttcgtgcgagtaaagttgtgttggtgtcctctatctgcttttcatctaactgcaacagcagctacgaccttgtgaaaaaaaaaaaaaaaaaaaa

SEQ ID NO: 9074 - protein, 96 aa, Panicum virgatum
  misc_feature: Ceres CLONE 2028712
  misc_feature (1)..(65): Pfam Name: Tryp_alpha_amyl Pfam Description: Protease inhibitor/seed storage/LTP family
MGKATATTVLALALCGAALLLLAARPLDAAACNPAALSPCGGALFGGAVTPGCCVQLKAQQPCLCQYARNPAYRSYVNGPAAQSVAKACGIPKMKC

SEQ ID NO: 9075 - DNA, 806 bp, Panicum virgatum
  misc_feature: Ceres CLONE 2028957
  misc_feature: Encodes the peptide sequence at SEQ ID NO. 9076
gacctgaaccagtccagaagaggtgccatcgattcaccggtcgacagctttgtacgcaatataattctcccgtaaaaaaaataccatggccatggggtccgatgaggagcctggcgctgcagtccctctcgtccgcctgaaccacgtctcgttccagtgcgcctccgtcgaagagtcggccgccttctaccagcgcgtgctcggcttccagctcgtcaaacgcccggcgtccctcgacttcagaggagcgtggctgcacaggtacgggatgggggtacacctgctgcagcgtggctcggatcccgacgcgccgccggtcgccaggcggccggcggcgatcaacccaaaaggcaaccacatttcctttcagtgcgcggacatggggctcatgaaggcgaggctgggggacatgcggctggagttcgtcgcggcgagggtgcgcgacggcgagacggtggtggagcagctcttcttccacgaccccgacggtaatatgatcgagatctgcgactgcgagaagctccccgtggtacccctcgccgccggtgccgcagcggccggcctccccgatctggtggtgccggcgccaagggatgtgcatggctagttcgtggtgcttcttcgtagattattagcacgactatttatttgattcgttggatttgtgagttgtaacaaaagccatttgctgccgaatgccaagtgtgcgttatgtactgtgtaatataaaaaaacagtatgtgttatgtacttatgtatatatacaagttgggaaaattccggttgaaaaaaaaaaaaaaaaaaaa

SEQ ID NO: 9076 - protein, 173 aa, Panicum virgatum
  misc_feature: Ceres CLONE 2028957
  misc_feature (1)..(125): Pfam Name: Glyoxalase Pfam Description: Glyoxalase/Bleomycin resistance protein/ Dioxygenase superfamily
MAMGSDEEPGAAVPLVRLNHVSFQCASVEESAAFYQRVLGFQLVKRPASLDFRGAWLHRYGMGVHLLQRGSDPDAPPVARRPAAINPKGNHISFQCADMGLMKARLGDMRLEFVAARVRDGETVVEQLFFHDPDGNMIEICDCEKLPVVPLAAGAAAAGLPDLVVPAPRDVHG

SEQ ID NO: 9077 - DNA, 623 bp, Panicum virgatum
  misc_feature: Ceres CLONE 2028986
  misc_feature: Encodes the peptide sequence at SEQ ID NO. 9078
atagtcgggtttcagaaaacagaagctccattagtagtttcaagaacaaggggacaagggagaagacatctgccgatcgaggatgacaggaacggcaccggcggcgtggttcatcttcttcttgctggttttcgtcggcggcgtctccgccgcggcgttctcgttccgcctcctcgtctacctcgcgctctgcctgagccggccaaaggacctgcgccgccggtacggcgcgtgggccttggtcaccggcccgacgtccggcatcggccggtccgtggcgctggagctcgcgcgccgcggcctcaacctcgtcctcctcgacctcgacgccgcgcacgactggctccgcctgcgcgagcacctgcggttcagagcgctgttccagagagagagggcggcgatggcgtcggcagctgatcggggagagaaaacgacgcacgccaaaaaatgagttttttttttagtttggctaataatgtgcttgcttggcctgccggaactgatgtggttcctacggttcaccccaaactgtgtgcatcatgaagctgtacgtggttcatttgcctctccttgcttgagcctgagattacaagcgggagaacaaaaaatgagttttgtgagtt

SEQ ID NO: 9078 - protein, 122 aa, Panicum virgatum
  misc_feature: Ceres CLONE 2028986
  misc_feature (1)..(35): Pfam Name: adh_short Pfam Description: short chain dehydrogenase
MTGTAPAAWFIFFLLVFVGGVSAAAFSFRLLVYLALCLSRPKDLRRRYGAWALVTGPTSGIGRSVALELARRGLNLVLLDLDAAHDWLRLREHLRFRALFQRERAAMASAADRGEKTTHAKK

SEQ ID NO: 9079 - DNA, 633 bp, Panicum virgatum
  misc_feature: Ceres CLONE 2029177
  misc_feature: Encodes the peptide sequence at SEQ ID NO. 9080
atcacacagatagcccaagcttgacgagctcgtcccaaacaagtagagtaactcgccactgatccttgcaaaagagaaacaaccatgaagccccaggtgctgctcgtcgcggtggccgtcctcgccgtcctcgcagctctgcccctcgccgaaagcaaagggcacgggatcggggagggcgcggaggccgcgacggcgagcgcgtggccgtgctgcaacacctgcggctcgtgcaccaggtccctcccgccgcggtgcgtgtgcgcggacgaggcgcccggcgggtgccacccggcgtgcaggaactgcgtcaagtccaccgccggcggcagcgacgtcttccgctgcgccgaccgcatcaccaacttctgcaagcgcagctgcaagccggccgcgtgattggttggacgccgggatcctgctctgctgtcacctgaataatgccggcagctgccgatcgattagctccggcctgcctttggtttcagtcttccagtgttccctctgcatcctgctctgaatggggagaaaaaatcagtgctgtcgttgttgttgtattttcctaaggtctggtactctggccatggactcatggatttcttactgtttctggaataaagacccataaggacc

SEQ ID NO: 9080 - protein, 104 aa, Panicum virgatum
  misc_feature: Ceres CLONE 2029177
  misc_feature (1)..(27): Pfam Name: Bowman-Birk_leg Pfam Description: Bowman-Birk serine protease inhibitor family
MKPQVLLVAVAVLAVLAALPLAESKGHGIGEGAEAATASAWPCCNTCGSCTRSLPPRCVCADEAPGGCHPACRNCVKSTAGGSDVFRCADRITNFCKRSCKPAA

SEQ ID NO: 9081 - DNA, 843 bp, Panicum virgatum
  misc_feature: Ceres CLONE 2029251
  misc_feature: Encodes the peptide sequence at SEQ ID NO. 9082
ggggacgcgattaatctccatcgccaagccttgacgaagtcctcctccatccccaccgccaacacccagacagatcctgccgaccacgggggcctccatgtccaccggcggcgcggcgagcccggcgctggcgccggacgcggacgcgccggccggcgagggcctggcgctggcgcagttcgccgcggggtgcttctggagcgtggagctggtgtaccagcggctccccggcgtggcgcgcacggaggtgggctactcgcagggccgccgccacgcgcccacctaccgcgacgtctgcggcggcggcacggggcacgccgaggtggtgcgcgtgcactacgaccccgaggcctgcccctacggcgccctcctcgacgtcttctgggccaagcacaaccccaccacgctcaacagacagggcaacgacgtcgggacgcagtacaggtcggggatctactactacacggcggagcaggagaggctggcgcgggagtcgctggcggagaagcagaaggagtggaaggacgccaccatcgtcaccgaggtcctgccggcgcggcggttctaccccgccgaggactaccaccagcagtacctggaaaagggcggccagtccgccaggaaggggtgcagcgaccccatccgatgctacgggtgagaggccacctgacgacgcccgtgctgcactgagtcactgtcaccggcagggccggctgaaaacactgtgctgtggttagtttgtgattgtatcagtacgtgtcacgatggatgtctgcgttgggagcttggaataacgaagtggatcgcaaatttaattaagtacaaaaaaaaaaaaaaaaaaaa

SEQ ID NO: 9082 - protein, 186 aa, Panicum virgatum
  misc_feature: Ceres CLONE 2029251
  misc_feature (2)..(156): Pfam Name: PMSR Pfam Description: Peptide methionine sulfoxide reductase
  misc_feature (1)..(186): SWISSPROT Homolog: EC 1.8.4.11 Peptide methionine sulfoxide reductase
MSTGGAASPALAPDADAPAGEGLALAQFAAGCFWSVELVYQRLPGVARTEVGYSQGRRHAPTYRDVCGGGTGHAEVVRVHYDPEACPYGALLDVFWAKHNPTTLNRQGNDVGTQYRSGIYYYTAEQERLARESLAEKQKEWKDATIVTEVLPARRFYPAEDYHQQYLEKGGQSARKGCSDPIRCYG

SEQ ID NO: 9083 - DNA, 686 bp, Panicum virgatum
  misc_feature: Ceres CLONE 2029287
  misc_feature: Encodes the peptide sequence at SEQ ID NO. 9084
gtgtgagctacgactttccccatcctctcctctcctgagcagaagggcaaaaccccccacagctttctcgtctttttcgcgagttccccagctgcggcggccgcatcgatttctagggtaaaaatccgctcaaatcccacggcgatttgaggctctcgggcgaaggtaggaggagccgcgcgaaggattccgccgcgtgctagtgtcaagatggcggggcgcaaggagactgcactcgacctggcgaagttcgtcgacaagggcgtccaggtgaagctcaccggcggccggcaagtgacaggaactttaaaaggatacgaccagctactcaacttagtgctagatgaagcagtggagtacgaaagagagcaagatgacccattgaagctatctgggaaaaccagacagcttggcctcattgtgtgcaggggcacggctgtgatgctggtctcaccaactgatggaaccgatgagatcgcgaaccctttcctcgccgatggggcataagcttgcactggttgattatttagaaccgtgctctcaaagcaccctcagaaccatctgttccagtggaaaagaactccaatctcatgtattatttacccgttgctgatgaagttgtatttttcattgtgcaacttaaaatgttgacccttttgttgctaatgtattgttgctaagttctc

SEQ ID NO: 9084 - protein, 98 aa, Panicum virgatum
  misc_feature: Ceres CLONE 2029287
  misc_feature: Great-hit functional homolog of the protein sequence given in SEQ ID NO 9281
  misc_feature: Useful for making plants with modulated biomass
  misc_feature: Useful for making plants with modulated flowering time
  misc_feature: The plant flowers significantly late compared to wild-type.
  misc_feature: The plant is abnormally small.
MAGRKETALDLAKFVDKGVQVKLTGGRQVTGTLKGYDQLLNLVLDEAVEYEREQDDPLKLSGKTRQLGLIVCRGTAVMLVSPTDGTDEIANPFLADGA

SEQ ID NO: 9085 - DNA, 689 bp, Panicum virgatum
  misc_feature: Ceres CLONE 2029288
  misc_feature: Encodes the peptide sequence at SEQ ID NO. 9086
atcccacccagcaaacaagacccgcgcgttcacacctgaacgaccgaccctccgctgcgacggtggggcccgccgccgtagccgactcgcggttcgcttccccccgcccgccgccggcgcagcagcaggagagatgaactggggactggccgccgccgtggcgtccgccgctgccgtcgcggccgcgtccggcgccgagctcctcgcctgcgactgcgacgcctccgcgccgccggccgtcgggaggtgcgacggcctgctcctctcgcggcagcaccacgacgaggcggtccgggaggggtcggcgtcgtcagcgtcgagggagaagcatagcggcggaggcggcaacaggttcgcgccgcgctacgacgggctgcgcttcatcgagactctcgtcacggcgcaccgctgaaaaaacgacgcatcgtccgctagtacttcccgccatgattcggcgatcgattgttggtggcgcttaggccagccagttttgttagaccagattctcgggattccctttctccttcggttgtgttttcttcctcctgttgttgatgacgacgattactgtgtccatcacgtgcgtttgcgtgtgtgtgtgtttgagagagaggatgaagactataagcggcatgtaaatttaagcacatactcttaatactatgttccaaaaaaaaaaaaaaaaaaaa

SEQ ID NO: 9086 - protein, 92 aa, Panicum virgatum
  misc_feature: Ceres CLONE 2029288
  misc_feature: Great-hit functional homolog of the protein sequence given in SEQ ID NO 9184
  misc_feature: Useful for making plants with modulated cold sensitivity
MNWGLAAAVASAAAVAAASGAELLACDCDASAPPAVGRCDGLLLSRQHHDEAVREGSASSASREKHSGGGGNRFAPRYDGLRFIETLVTAHR

SEQ ID NO: 9087 - DNA, 622 bp, Panicum virgatum
  misc_feature: Ceres CLONE 2029342
  misc_feature: Encodes the peptide sequence at SEQ ID NO. 9088
ggaagctccaaaagcccacgcacctcggcacctgacaagcccccggcatctccagccccacctccgcgaggggcgacccgagaacacaaccgccgccacggccgccgccgccgccatgtggcgccgcctccaaaccctagcctcctccctccggcgcgccgccgccgccacatcgtcgtcctccgcccgcgccgcgcccctctccacggcgccggccacgttccggcgcacctcgcccctcctctcctctcctggcgacaagccggcgccgaccaaggtcgaggatgtcatgccgatcgccacggggctggagcgcgaggagctcgaggcggagctccaggggaagaagaggttcgacatggatcctcccgtcggcccctttggcactaaggagccagctgtgattgaatcctactataacaagagaatagttggttgtcctggtggccaaggaggtcattggtgatggaggtgatccagatgggcacgatgatgatgaagatgagcatcactgaggctgtgtcagttggcgataataagaacttggtgatacatggtttcagccttatctttgcagcatcaggctgctctatagtgttgtagttgatgagtttcatttcag

SEQ ID NO: 9088 - protein, 116 aa, Panicum virgatum
  misc_feature: Ceres CLONE 2029342
  misc_feature (1)..(53): Pfam Name: COX5B Pfam Description: Cytochrome c oxidase subunit Vb
MWRRLQTLASSLRRAAAATSSSSARAAPLSTAPATFRRTSPLLSSPGDKPAPTKVEDVMPIATGLEREELEAELQGKKRFDMDPPVGPFGTKEPAVIESYYNKRIVGCPGGQGGHW

SEQ ID NO: 9089 - DNA, 836 bp, Panicum virgatum
  misc_feature: Ceres CLONE 2029437
  misc_feature: Encodes the peptide sequence at SEQ ID NO. 9090
acaagcacaagcttgctctccacaagtgaagtgcagcaccaacaaattacaaatatatgtgcacacgcaagctagccacccaccagcacaagcacgtctctgcattccgatcatgatgggctccctcaagctgacggagatcgtgtccaagaagctcggcggcggcgggaagcaggtcacctcgccgagcgcggcgccgtgcccgcggggccacttcgcggcctacacacgggacgggcgccggttcttcatccccatcgcctacctcggcagcgacaccttccgggagctgctcaacacggccgaggaggagttcggcgcgcccggcggccgccccatcgtgctgccgtgctccgccgaccgcctcgagcagatcctcgacgcattccgcagcggcggcggcggcgccaagaagaagtgcgccggcgccgccggcaggatcggcaagatctggtagcggcagcagtggcattgcagaacacactgcagcttagccctggtgccgtgttgctgctgcaagcaggctgatcaatcgattagtctggacgacgatgactgtgagattattaattagcttcgatccattgattcattggcactgaactgctgatcaatctaggtgttgtgatcgatctgtttagttgatgtttttttttgctgctctcctggccgtacatgccaatgggcgtgttttcaggagaccagctgtggctggcagtactatggccaacttgccatgatgtaacatctccgtacatgttcattcgttgggttttttttttcctaacttcttttttttctctcttctttgagatcaaaaaaaaaaaaaaaaaaaa

SEQ ID NO: 9090 - protein, 114 aa, Panicum virgatum
  misc_feature: Ceres CLONE 2029437
  misc_feature (44)..(102): Pfam Name: Auxin_inducible Pfam Description: Auxin responsive protein
MMGSLKLTEIVSKKLGGGGKQVTSPSAAPCPRGHFAAYTRDGRRFFIPIAYLGSDTFRELLNTAEEEFGAPGGRPIVLPCSADRLEQILDAFRSGGGGAKKKCAGAAGRIGKIW

SEQ ID NO: 9091 - DNA, 798 bp, Panicum virgatum
  misc_feature: Ceres CLONE 2029491
  misc_feature: Encodes the peptide sequence at SEQ ID NO. 9092
acaaacaccccgcaccgccccgccccgccccgccgcgaattccgaggcgcccctccgatccgccctccccaccgcgtccctagggttagggctccccgtccccgtcctcccggcctcccgacgcggccccgccacgccatgagggtccacccggcgccgcggaagcgcaccatcgccgtgcagcgctgcgcggccgccgcgggcgcgctcggcgggaagaagctgcgccgcctgccgcacatcttcgccaaggtgctggagctcccgttcgcggccgatgcggacgtctccgtcgaggaggacgcggccgcgctgcggttcgtcgccgccgccgtcgacgggttctcccccgcgggcgccagcgcgcacgccgtcgagatccacccgggggtcaccaaggtcgtcgtccgggacctcgcctccggcggcgccgacgacgacggggccgcggccttcgagctcgaccggtggcgcttccgcctcccgccctgcacgcgccccgccatggccaccgccacctacgctgagggcgagctcgtcgtcaccgtccccaagggcgccaaccccgacgacggcgacggcgagggggccaccgtcctcggaggcgcggagagcgtccttgtgcttgtatagtatatttgtgccatgactcaactgttttgctgatgcgcctgtttctactactgctaatatcaatatttatgccatgcgagataatgatgatgataatatgctgctgatgataatatgctaataacagagcagtgagagtatgaacaaaaaaaaaaaaaaaaaaaa

SEQ ID NO: 9092 - protein, 164 aa, Panicum virgatum
  misc_feature: Ceres CLONE 2029491
  misc_feature: Great-hit functional homolog of the protein sequence given in SEQ ID NO 9401
  misc_feature: Useful for making plants with modulated heat sensitivity
MRVHPAPRKRTIAVQRCAAAAGALGGKKLRRLPHIFAKVLELPFAADADVSVEEDAAALRFVAAAVDGFSPAGASAHAVEIHPGVTKVVVRDLASGGADDDGAAAFELDRWRFRLPPCTRPAMATATYAEGELVVTVPKGANPDDGDGEGATVLGGAESVLVLV

SEQ ID NO: 9093 - DNA, 858 bp, Panicum virgatum
  misc_feature: Ceres CLONE 2029627
  misc_feature: Encodes the peptide sequence at SEQ ID NO. 9094
gcagtctcttctcttctcccaatcatcaccgtcttccattcctccccaactccatctctgtctccaaaacttccgcctttctctctctcccgttcttggatcgcgcgtgcgcctggtgtgccttggccgccgccgggtcccgtgccgtcgtcgtcggaggaggaggagcgggaaggcggcaatgtcgaagggcgggctggggaagctgcggtgcatgatcaggcggtggcactcgtccagccgcatcgcccgcgcgccgtcgcccggcgaggacggccacgacggtggcggcggcggcgacgcccggggcgcgtcgttccacggcaccgcggacgaggtgcccaagggcctgcacccggtctacgtcggcaagtcgcggcgccggtacctcgtcgccgaggagctcgtgggccacccgctgttccggaccctcgtccaccgcaccggcggcgccgccgaggcgggctgcaccgtcgtcggctgcgaggtcgtcctcttcgagcacctcctctggatgctggagaacgcggacccgcagccggagtccctcgacgagctcgtcgagtactacgcgtgctgaccgctgcgagccaccgcccaccgcgccggccgccggagtcggcagcctctctcgaatctcccagccgcggcggtgaatcgctctgcaattcctgtgtcctgagccgtaggattagagtaggggaaaccattgttaatcaccgtgctgtgcagctcacggacgctgctcttccggctccgttgattcgattcgatggcctctagcttgctacaaatttttttaatgctatcctcctaataagatctctggagtctggacaaaaaaaaaaaaaaaaaaaa

SEQ ID NO: 9094 - protein, 132 aa, Panicum virgatum
  misc_feature: Ceres CLONE 2029627
  misc_feature (1)..(103): Pfam Name: Auxin_inducible Pfam Description: Auxin responsive protein
MSKGGLGKLRCMIRRWHSSSRIARAPSPGEDGHDGGGGGDARGASFHGTADEVPKGLHPVYVGKSRRRYLVAEELVGHPLFRTLVHRTGGAAEAGCTVVGCEVVLFEHLLWMLENADPQPESLDELVEYYAC

SEQ ID NO: 9095 - DNA, 510 bp, Panicum virgatum
  misc_feature: Ceres CLONE 2029762
  misc_feature: Encodes the peptide sequence at SEQ ID NO. 9096
atcattccgttcttgagcgatcgaaacgagctgctgctgcagatggcagggaagctggggcatctgatgacgaggctgcacctggcgaggagccgggcgtcgtcgccgtcggcggcggcggacgtgccgacgggccacctggcggtgtacgccggcgaggggcggaagcggctggtgatcccgacggcgtgcctgagccacccggcgttcgtgacgctgctgaagcgggtggaggacgagttcggcttcgaccaccgctgcggcggcctcaccatcccctgcgcctccgagggcgacttcgccgacatcgtcggcggcatggacgtgcactgatcgatcgtcaggctccgtttcccggcgaggacaagactggttgctgttgaggaataacctattcttctagctaggaatgtaggggcaatagcagggcctgctgcttgaattggaacctgtaattctgtaaagatcattgattggaacgagatctgctaagaattgtgttgagcaatc

SEQ ID NO: 9096 - protein, 96 aa, Panicum virgatum
  misc_feature: Ceres CLONE 2029762
  misc_feature (1)..(97): Pfam Name: Auxin_inducible Pfam Description: Auxin responsive protein
MAGKLGHLMTRLHLARSRASSPSAAADVPTGHLAVYAGEGRKRLVIPTACLSHPAFVTLLKRVEDEFGFDHRCGGLTIPCASEGDFADIVGGMDVH

SEQ ID NO: 9097 - DNA, 561 bp, Panicum virgatum
  misc_feature: Ceres CLONE 2029918
  misc_feature: Encodes the peptide sequence at SEQ ID NO. 9098
aaaaaaaaaaaaaaatcactcgctagcagctagctctaacttaactaaagcggcaagtgtagtgtgctggtttgatcgtccatcggcggccggagatggacacggtgatgaggaagcaagctgtgatggcgtgcgcggtgctgctgctggtggtgctggccggcggcggcgcgtccgcggcgtcgtgcaacgccgggcagctggcggtgtgcgcggcggcgctgacgtcgggcgccaagccctcgatggcgtgctgctccaacctcaaggcgcagcagggctgcttctgccagttcgcaaagaaccccgcatacagccgctacatcaacagccccaacgcgcgcaaggtcgtcgcagcctgcggcgtcgctctgccacgctgcagctagctagctacttgaattgatcaccatcatcaccatcatcatgtctctgctatcctagctagctacatcacatatatatacagtcgtgtatgtacgtggctgcttgctgttcatcgagccgctacggatacaagaaataaaagatggctgctccctactttgttgtgtatcaatc

SEQ ID NO: 9098 - protein, 97 aa, Panicum virgatum
  misc_feature: Ceres CLONE 2029918
  misc_feature (1)..(66): Pfam Name: Tryp_alpha_amyl Pfam Description: Protease inhibitor/seed storage/LTP family
MDTVMRKQAVMACAVLLLVVLAGGGASAASCNAGQLAVCAAALTSGAKPSMACCSNLKAQQGCFCQFAKNPAYSRYINSPNARKVVAACGVALPRCS

SEQ ID NO: 9099 - DNA, 866 bp, Panicum virgatum
  misc_feature: Ceres CLONE 2030117
  misc_feature: Encodes the peptide sequence at SEQ ID NO. 9100
accacacaacgatcttgttccgcttagtgtaaagaagcagctaggcaaccatcatggcttccaggagcaccgtacctgcctaccttctcctcctcatggcgctgctgctctcgtgcagcggcatgagcggagcggcacggttgctggaggcggcgcccaaggaggagtacccgcaccctgaagtcccggagctgccaaaagccgagctgccgccgcaccccacggtccccgagctgccggcacaccccgtcgtacccgagctgcctaaacccgaggtgccggcgcaccccgccgtacctgagcttccgaagcctgagataccagctcaccctactgtccctgagctaccaaagccggaggtgcaggatcaccctgccgtgccggagctgccgaagcctgaggtgcccaagcctgaattgcctcctcaccccaccgagccagagctgccaaagcctgaggagccgcacccagtcgcgccggagctgccaaagcctgaactcccccctcaccccgtcgtgccagagctccccaagcccgatgtgccgaagcacgagctgccaccgaagccagagggccactacccggagccggaggcaagaccatgagcgggctacggacttgcagtccccgacatttatatattctatctataccattttacgcgtgcatatatatattgtgtctatatatgcacagctatatgtgtgagttgtgatgatgtgtacttgcattcgagcttccttgtgatgagctaggatagtgtgtttcagaagtatatatgtatgagtatgtatatctttgtttggatccatatatatgtgtgtaaatgaataaagagttctagtcaaaaaaaaaaaaaaaaaaaa

SEQ ID NO: 9100 - protein, 183 aa, Panicum virgatum
  misc_feature: Ceres CLONE 2030117
  misc_feature (62)..(122): Pfam Name: Trypan_PARP Pfam Description: Procyclic acidic repetitive protein (PARP)
MASRSTVPAYLLLLMALLLSCSGMSGAARLLEAAPKEEYPHPEVPELPKAELPPHPTVPELPAHPVVPELPKPEVPAHPAVPELPKPEIPAHPTVPELPKPEVQDHPAVPELPKPEVPKPELPPHPTEPELPKPEEPHPVAPELPKPELPPHPVVPELPKPDVPKHELPPKPEGHYPEPEARP

SEQ ID NO: 9101 - DNA, 742 bp, Panicum virgatum
  misc_feature: Ceres CLONE 2030215
  misc_feature: Encodes the peptide sequence at SEQ ID NO. 9102
gtttttgtgtttcagccatgtttgcaagagccctcctcagaaacgttagagctgctcgtagtgttgtcgctcgccgaaccatttttcaagctgctcgcaacacccaacgtaactactggcttgcagctgccattgctggggcatcagcaacctatgttgcatctcaattaacctctgttgaagctgaggctaaagttccaattgcaggaatcccaggaactgcacaagaaagaactttcatcgctgtcaaaccagatggtgtccaaagacaattggttggagaaattattcaacgatttgagaagaaaggatacaaattggttgctttgaaactcgtcactgtcactcctgcttttgctgctgagcattatgatgacctcaaggctaagccattcttcaaaagcttgactgcattctttgcatcaggaccaatctgtgctatggtttgggaaggacctggagttattaaaggtggaagaagacttttgggagaaaccaacccagccgactctctccctggaacaattcgtggagatttgtgcgttactattggaagaaacatctgtcatggatctgattctccggaaggagctcttcatgaaattccacactggtttaaggaatcagaaattaacaactggacaccagctcaagaagggtgggttctcgaaaagaaataagttgatatctttgttaccaaattaaaatttgatatctatcctaaaaaaaaaaaaaaaaaaaa

SEQ ID NO: 9102 - protein, 220 aa, Panicum virgatum
  misc_feature: Ceres CLONE 2030215
  misc_feature (1)..(135): Pfam Name: NDK Pfam Description: Nucleoside diphosphate kinase
  misc_feature (70)..(218): SWISSPROT Homolog: EC 2.7.4.6 Nucleoside diphosphate kinase
MFARALLRNVRAARSVVARRTIFQAARNTQRNYWLAAAIAGASATYVASQLTSVEAEAKVPIAGIPGTAQERTFIAVKPDGVQRQLVGEIIQRFEKKGYKLVALKLVTVTPAFAAEHYDDLKAKPFFKSLTAFFASGPICAMVWEGPGVIKGGRRLLGETNPADSLPGTIRGDLCVTIGRNICHGSDSPEGALHEIPHWFKESEINNWTPAQEGWVLEKK

SEQ ID NO: 9103 - DNA, 848 bp, Panicum virgatum
  misc_feature: Ceres CLONE 2030236
  misc_feature: Encodes the peptide sequence at SEQ ID NO. 9104
gctttcgaggaagaagaatccagaaatcactaacactgaggcctgaccggatctgccgccctccccgtcgccagaggcaatggcgagtcccaactacggaatccccatcaaggctgagcaagattccgatggctcggcccaaagcactgcggatatgactgcttttcaaaccaggttccaagctatgtcggagaacatcattacaaagatagatgagatgggtatgagaatagatgaattggagcagagcatcaatgacctcaaggctgagatgggcagcgacgggatgacaacactgtctaagacaaaagatgaaggttcaaaacctgcagacagttctgcagcatgaacgcaggacagcagaagcagctgatagcatcatgattcgtatcgtacaccagtgctgtattggtatcttaggcattcgtgactaacaaatacctgttatgaggtctcatatgagagaaggttgttactgatgtgattagggatggcaacgggtacccgaaacccgatgggtttttgctccattagggtgcggacatagactaaattctatacccgcgggttttttaatggaataaacttcgtacccgtcgggtttacgggtgcgggtttgttcttcaagtacccaaacccgcaaacccgtgggtacaataaacccgacaacatataacctaaaatactaatgtcacaaggtcttgtatcaaaataaggtccaatcacatgctaagagagacttaggcttatgtacttccatttccatcgatgattacctattcatagactcatttggctataatgcattgtgtatttgtttatgttttcaaaaaaaaaaaaaaaaaaaa

SEQ ID NO: 9104 - protein, 89 aa, Panicum virgatum
  misc_feature: Ceres CLONE 2030236
  misc_feature (1)..(54): Pfam Name: HSBP1 Pfam Description: Heat shock factor binding protein 1
MASPNYGIPIKAEQDSDGSAQSTADMTAFQTRFQAMSENIITKIDEMGMRIDELEQSINDLKAEMGSDGMTTLSKTKDEGSKPADSSAA

SEQ ID NO: 9105 - DNA, 664 bp, Panicum virgatum
  misc_feature: Ceres CLONE 2030250
  misc_feature: Encodes the peptide sequence at SEQ ID NO. 9106
aattttataacaatatacatgtaaaagcctccatctccacccccacctccgcgaggggcgacccgagaacacaaccgccgccgccgccatgtggcgccgcctccaaaccctagccccttccctccgccgtgccgccgcgtcgtcgtcctccgcccgcgccgcgcccctttccacggcgccggccgtgttcaggcggacctcgcccctcctctcctctcttggcgacaagccggcgccgaccaaggtcgaggatgtcatgccgatcgccacggggctggagcgcgaggagctcgaggcggagctccaggggaagaagaggttcgacatggatcctccggtcggcccctttggcactaaggaggaaccagctgtgattgaatcctactataagagaatagttggctgtcctggtggcgaaggagaggatgaacatgacgttgtctggttttggttagaaaaggataaaccacatgagtgcccagtctgctcgcaatactttgtgctcaaagtcattggtaatggaggtgatccagatgggcacgatgatgatgaagatgagcatcactgagttggcgataataagaacttgtgatacatggtttcggccttatctttgcagcatcagactgctctatagtgttgtagttgatgagtgtttcatttc

SEQ ID NO: 9106 - protein, 159 aa, Panicum virgatum
  misc_feature: Ceres CLONE 2030250
  misc_feature (1)..(87): Pfam Name: COX5B Pfam Description: Cytochrome c oxidase subunit Vb
MWRRLQTLAPSLRRAAASSSSARAAPLSTAPAVFRRTSPLLSSLGDKPAPTKVEDVMPIATGLEREELEAELQGKKRFDMDPPVGPFGTKEEPAVIESYYKRIVGCPGGEGEDEHDVVWFWLEKDKPHECPVCSQYFVLKVIGNGGDPDGHDDDEDEHH

SEQ ID NO: 9107 - DNA, 1165 bp, Panicum virgatum
  misc_feature: Ceres CLONE 2030521
  misc_feature: Encodes the peptide sequence at SEQ ID NO. 9108
cccgagtcccgaccgcgggtccgtgacgatcgcccaccacacccccaccgcgccgcctccctcacgccgggaatggcctgctcccacctcgccgcggcgccttccgcggggtccgccgcggcccgggcgcgctcgccggcgtcctcgccggcacccgccttctcgcgcgtcccggcggcgcgccgatacgcgagaggcgggctgtcagttaggggcgggaaggcagcgtcccccgtggccgtcggcgcggccgcggcggcgccggtggcggacctggacggccgcccggccacggagaagcagcccatcatcgtcatcgataactacgacagctttacctacaacctgtgccagtatatgggggagcttggattaaacttcgaggtatatcgcaatgatgaactgaccatagaggatgtaaaaaggaagaacccaagaggaatacttatttctccagggcctggtgaaccgcaagattctggtatatcattgcagactgttcttgaattgggcccaaccatcccaatttttggagtttgtatgggtctgcagtgcatcggggaggcatttggaggaaagattatccgtgctccttctggagtgatgcatggaaaaagctctccagtttattacgatgaggaattaggaaaggccttattcaatggcttgccaaacccttttactgccgcgaggtaccacagtttggtgatcgaggaagaaaccttcccacatgatgctctagaggccactgcatggactgaagatgggcttatcatggccgcccgccacaagaagtacaagcacatccagggagtccaattccacccggagagcatcatcacccctgagggcaagaaaatcatccacaacttctacaaattcattgaggaactggagaagcagcgttcgtagggaagatgtgccaccagtggctccatagatcaggcagaagcataggaaagtcgcttgaaacgcacggttgcaggattggcaccgaaagttaacttggaagcagctttcctctcttcattcgttgcgttcattgtaatgtaagccacgtggccccagattccgaataaactcatatgatgaaataagcaccggtgctggtgatcttccgatgaataaatccggttattttcagcaaaaaaaaaaaaaaaaaaaa

SEQ ID NO: 9108 - protein, 279 aa, Panicum virgatum
  misc_feature: Ceres CLONE 2030521
  misc_feature: Great-hit functional homolog of the protein sequence given in SEQ ID NO 9204
  misc_feature (1)..(191): Pfam Name: GATase Pfam Description: Glutamine amidotransferase class-I
  misc_feature (79)..(267): SWISSPROT Homolog: EC 4.1.3.27 Anthranilate synthase component II
  misc_feature: Useful for making plants with altered carbon content
MACSHLAAAPSAGSAAARARSPASSPAPAFSRVPAARRYARGGLSVRGGKAASPVAVGAAAAAPVADLDGRPATEKQPIIVIDNYDSFTYNLCQYMGELGLNFEVYRNDELTIEDVKRKNPRGILISPGPGEPQDSGISLQTVLELGPTIPIFGVCMGLQCIGEAFGGKIIRAPSGVMHGKSSPVYYDEELGKALFNGLPNPFTAARYHSLVIEEETFPHDALEATAWTEDGLIMAARHKKYKHIQGVQFHPESIITPEGKKIIHNFYKFIEELEKQRS

SEQ ID NO: 9109 - DNA, 782 bp, Panicum virgatum
  misc_feature: Ceres CLONE 2030658
  misc_feature: Encodes the peptide sequence at SEQ ID NO. 9110
gctcagcagctcagtccagaccgaagatcgaaatcgcaccgaacaacgcgcacataatctcatctccttttccgatcgcacgcgaacgtttcaggttcccattcacagcaacctccgccgacaatgtcgctggtgaggcgcagcagcgtgttcgaccccttctccctcgacctctgggaccccttcgacagcatgctccgctccgtcgtcccgtcggccggcgcctccgactccgacaccgccgccttcgccgccgcccgcatcgactggaaggagacgcccgaggcgcacgtgttcaaagccgacctccccggcgtcaagaaggaggaggtcaaggtggaggtggaggacggcaacgtgctggtcatcagcggccagcgcagcaaggagaaggaggacaagaacgacaagtggcaccgcgtggagcgcagcagcggccagttcatgaggcggttccgcctcccggagaacaccaaggtcgaccaggtgaaggctgggttggagaacggcgtgctcaccgtcaccgtgcccaaggcggaggagaagaagcctgaggtcaaggctatcgagatctctggttaagcggccatggacgccggttgaagatggtgcgaatgtgatgctacgagtcgtgcttgcagcttgcttgatctcggtgtgtgtgtgtgtgttcatgagcgtgtggtgtgtgtacttcccttgccgctgtacttactttcgctctgttcttccgtgtaaacgtccagtgcttcctctgagaaataaataaagagctttcattc

SEQ ID NO: 9110 - protein, 152 aa, Panicum virgatum
  misc_feature: Ceres CLONE 2030658
  misc_feature (1)..(104): Pfam Name: HSP20 Pfam Description: Hsp20/alpha crystallin family
MSLVRRSSVFDPFSLDLWDPFDSMLRSVVPSAGASDSDTAAFAAARIDWKETPEAHVFKADLPGVKKEEVKVEVEDGNVLVISGQRSKEKEDKNDKWHRVERSSGQFMRRFRLPENTKVDQVKAGLENGVLTVTVPKAEEKKPEVKAIEISG

SEQ ID NO: 9111 - DNA, 642 bp, Panicum virgatum
  misc_feature: Ceres CLONE 2030735
  misc_feature: Encodes the peptide sequence at SEQ ID NO. 9112
atcacaagcgaagcagagcacaagcatcaagaagcaccacaccttcttcagcaccagttcctgctcgtgatcaacaggatcagcatgtcttgctgcggcggcaactgcgggtgcggcgccggctgcaagtgcacctcatgcaccggctgcaagatgttccctgacgtggaggccacctccgctaccaccaccatggtcatcgccgccgccgccagcaaggcgtaagtcgtcgggatcgtttgtttgattcttcttcgattcatcgccgccgctgttgtccttcagtgcgctcgccgctcaactcaacctcacctgcgcgtccgttgcaggagctccggcgggttcgaggcggcgatggagagcggcggctgcgactgcaacacctgcaagtgcggcaccagctgcggctgctcctgctgcagctgcaactgaggcagcgccgcgatggagcacgagggggaaagagaacccccacagcgtactatactatatagtagcaggccagcgtttaaataagatcttgattggaaactggaaatcgtggttaattgaacactactgtatcaaggaaattgatgtgcctgcctgttggggaagaagttacatgccctcttgaaatgaagacattactacagtttggct

SEQ ID NO: 9112 - protein, 46 aa, Panicum virgatum
  misc_feature: Ceres CLONE 2030735
  misc_feature (1)..(47): Pfam Name: Metallothio_2 Pfam Description: Metallothionein
MSCCGGNCGCGAGCKCTSCTGCKMFPDVEATSATTTMVIAAAASKA

SEQ ID NO: 9113 - DNA, 813 bp, Panicum virgatum
  misc_feature: Ceres CLONE 2030738
  misc_feature: Encodes the peptide sequence at SEQ ID NO. 9114
acaccaagaatcaccaaagcgcaagaacaatccccaagataaagaaaccaagcagtccagagcagttcaagaggagagaccgagagagcgacatggatgcgaggatgttcgggctggaggctcccctgatggcggcgctgcagcacctgctggacatcccggacggcgaggccggcgcgggcggcgacaaggcgggcgcggcggcgagcggccccacgcgtacctacgtccgcgacgcgcgcgccatggcggcgaccccggccgacgtcaaggagcttcccggtgcctactcgttcgtggtgggcatgccggggctgggcacgggcgacatcaaggtgcaggtggaggacgagcgggtgctggtgatcagcggcgagcggcgccgggaggagcgcgaggacgccaagtacctgcgcatggagcgccggatgggcaagttcatgcgcaagttcgtgctgccggacaacgccgacatggacaagatctctgccgtgtgcaaggatggcgtgctgacggtggacgtggagaagctgccgccgccggagcccaagaagcccaagaccatcgaggtcaaggtcgcctgaaaggatgagcgagtgaggatcgatcgaacctaataagtttaggcagtgcgagtggggtgaagatgagagcagcgatgtgtggactgtggaggcatgagtggtagtgagtgtgttcatgagtgttccgctctgtttgtggttttgtgctacgagaaacgcaagagctgatgtgagctgctttctgaataattaaatccgtaatcttgttcaaaaaaaaaaaaaaaaaaaa

SEQ ID NO: 9114 - protein, 163 aa, Panicum virgatum
  misc_feature: Ceres CLONE 2030738
  misc_feature: Great-hit functional homolog of the protein sequence given in SEQ ID NO 9388
  misc_feature: Great-hit functional homolog of the protein sequence given in SEQ ID NO 9432
  misc_feature (1)..(104): Pfam Name: HSP20 Pfam Description: Hsp20/alpha crystallin family
  misc_feature: Useful for making plants with modulated drought sensitivity
  misc_feature: Useful for making plants with modulated heat sensitivity
MDARMFGLEAPLMAALQHLLDIPDGEAGAGGDKAGAAASGPTRTYVRDARAMAATPADVKELPGAYSFVVGMPGLGTGDIKVQVEDERVLVISGERRREEREDAKYLRMERRMGKFMRKFVLPDNADMDKISAVCKDGVLTVDVEKLPPPEPKKPKTIEVKVA

SEQ ID NO: 9115 - DNA, 931 bp, Panicum virgatum
  misc_feature: Ceres CLONE 2030818
  misc_feature: Encodes the peptide sequence at SEQ ID NO. 9116
gcccgatgcctccgctcctcacctcaccggcctcctccacccctctcctcctcgcctctcgcctcggcggcgccctccaccgccccgtcccccaccaccgggccgccgtccgcttcctcgcgcccacgaacacccaaccggtgtccgggggcctcacggcgatgagctggctcgggaagctgggccttggtgggctgggcggcagcccgcgcgcgtcggaggcgtcggcggcgctggcacagggccccgacgaggaccagccggcgcccgggaacgagttcgcgcagttcggcgcgggatgcttctggggcgtggagctcgcgttccagcgcgtgcccggggtgacccgcaccgaggtcggctacagccagggcaacgtccacgacccgacctacgaggacgtctgcaccggcgccaccaaccacaacgaggtcatccgcgtgcagtacgaccccgccgcctgcaagtacgacgacctcctcgacgtcttctgggtgcgccacgacccgaccacgctcaatcgccagggcaatgacgttggcacccagtacaggtcaggaatctactactacacccctgagcaggagaaggcggctacagaatccctgaagaagcagcaggagcttctgaaccggaagattgtcaccgagatactcccggcgaagaggttctacagggcagaggagtaccaccagcaatatcttgcgaagggtggccgcttcggtttccggcagtctgcagagaagggttgcaatgaccccatccgttgctacggctgaacctgaactgcattatattcccctaataaggatggttcagagccaaattttactaaatctgcactgtagcttcgttttgtgcacaaatcttatcaagcttaggaacgcaagtccatttgagtgcttgaacctaaaaaaaaaaaaaaaaaaaa

SEQ ID NO: 9116 - protein, 257 aa, Panicum virgatum
  misc_feature: Ceres CLONE 2030818
  misc_feature (1)..(154): Pfam Name: PMSR Pfam Description: Peptide methionine sulfoxide reductase
  misc_feature (6)..(257): SWISSPROT Homolog: EC 1.8.4.11 Peptide methionine sulfoxide reductase
MPPLLTSPASSTPLLLASRLGGALHRPVPHHRAAVRFLAPTNTQPVSGGLTAMSWLGKLGLGGLGGSPRASEASAALAQGPDEDQPAPGNEFAQFGAGCFWGVELAFQRVPGVTRTEVGYSQGNVHDPTYEDVCTGATNHNEVIRVQYDPAACKYDDLLDVFWVRHDPTTLNRQGNDVGTQYRSGIYYYTPEQEKAATESLKKQQELLNRKIVTEILPAKRFYRAEEYHQQYLAKGGRFGFRQSAEKGCNDPIRCYG

SEQ ID NO: 9117 - DNA, 800 bp, Panicum virgatum
  misc_feature: Ceres CLONE 2030894
  misc_feature: Encodes the peptide sequence at SEQ ID NO. 9118
gtaccagcctagtttagtcacccggtgccttgggtgtttctgccttgcaagaagtgcaaagttgtgatctcgaggttgaagatgctggagaagctgtgggacgaggtggtagcggggcctcacccggagaccggcctcgagaagctccgcaaggccaccacctcccgcccgctcgtcatcaacaaagatgtggacgcagggcccgccgccggcggctacaagcgggcgcagtcgatgccgacgaccccgaccacgccggtgacgccgtcgtcgtcgtcctccacgccacgcggcggcaacaacgtgtggcgcagcgtgttccacccggggagcaacctggcgaccaagggcgttggagcaaacatcttcgaccgcccacagcccaactcgcccaccgtctacgactggctctacagcgacgagaccaggagcaatcaccgctagatgatgggccatccgacgacggaggcggatgacgaataaggtctgctgtgttggcctgtctctgtctggccttgtttgctggtccttgtggttatctaaaacgtagtacgggttgctgtccgaggctacgtgttaattaaaacgtcgctgtttagtttgtcttttatggtgattggagtactctagtactactcctatactgttagtagtgctgctactttgtcagttcttagtcatagcctggacgctacatgctcgcgactgccgtgtgatgtgtgtactttaactgcttttatttgtaaaaatagtgccgtatcatatgggtgtgtaatagttaaaaaaaaaaaaaaaaaaaa

SEQ ID NO: 9118 - protein, 120 aa, Panicum virgatum
  misc_feature: Ceres CLONE 2030894
  misc_feature (1)..(121): Pfam Name: Auxin_repressed Pfam Description: Dormancy/auxin associated protein
MLEKLWDEVVAGPHPETGLEKLRKATTSRPLVINKDVDAGPAAGGYKRAQSMPTTPTTPVTPSSSSSTPRGGNNVWRSVFHPGSNLATKGVGANIFDRPQPNSPTVYDWLYSDETRSNHR

SEQ ID NO: 9119 - DNA, 805 bp, Panicum virgatum
  misc_feature: Ceres CLONE 2031083
  misc_feature: Encodes the peptide sequence at SEQ ID NO. 9120
actccaaaccgaagatcgaaatcgcaccgagctcgaacagcgcacacatcatcatcgtctcttttctgatcccacgcaaacgtttcaggttcccgttcgcagcaacccccgccgacaatgtcgctggtgaggcgcagtagcgtgttcgaccccttctccctcgacctctgggaccccttcgacagcatgttccgctccgtcgtcccgtcggccggcgcctccgtctccgagaccgccgccttcgccaacgcccgcattgactggaaggagacgcccgaggcgcacgtcttcaaggccgacctccccggcgtcaagaaggaggaggtcaaggtcgaggtggaggacggcaacgtcctggtcatcagcggccagcgcagcaaggagaaggaggacaagaatgacaagtggcaccgcgtcgagcgcagcagcggccagttcatgaggcggttccgcctgccggagaacgccaaggtcgaccaggtgaaggccgggctggagaacggcgtgctcaccgtcaccgtgcccaaggcggaggagaagaagcctgaggtgaagagcatccagatctccagttaagcggccatggacgcgggttgaagatgatgcgatgtgatgctacgagtcgtgcgtgcttggctgcgtactctgtctgtgtgtgttattgtcttcttgagtgtgtggtgtggacgatgtgtgcttcccttgccgctgtacttgtttttgcttcttccgtgtaaacgtcctgtggttcctctgacaaataaataaaagcagctttcaaatttaaaaaaaaaaaaaaaaaaaa

SEQ ID NO: 9120 - protein, 152 aa, Panicum virgatum
  misc_feature: Ceres CLONE 2031083
  misc_feature (1)..(104): Pfam Name: HSP20 Pfam Description: Hsp20/alpha crystallin family
MSLVRRSSVFDPFSLDLWDPFDSMFRSVVPSAGASVSETAAFANARIDWKETPEAHVFKADLPGVKKEEVKVEVEDGNVLVISGQRSKEKEDKNDKWHRVERSSGQFMRRFRLPENAKVDQVKAGLENGVLTVTVPKAEEKKPEVKSIQISS

SEQ ID NO: 9121 - DNA, 739 bp, Panicum virgatum
  misc_feature: Ceres CLONE 2031101
  misc_feature: Encodes the peptide sequence at SEQ ID NO. 9122
tcgcgacacgttccttaaatctgggtggcttcacgttcgcgattacggatgctcagcctcctgcaccgccgacggccgccgccgccgagcccccaccccgatgacggctccctcgcctgctacggcatcgtcgtcgccaccgcgtcgctgctcctgttcaccatcctcgccgccacggtcagcctcgccaaggcgggcgcgctcgccggcgcggccgcggtcgtgttcgtcgccgccggctgcgtctcccggtgctacgcgggcggcggcggggcgggtcccgcgctgccgacgaccgtggcgccggcgcgcgcgagggcggcgtgcgggctggtggacgcggcgatcgacgcgctgccggcgttcgcctacgcgcggcctggcacgtgtggcgcggagggcggcgacggcagcaagtccgggaggtgcgccctgtgcgccgtgtgcatggaggacgtcgaggccggcgagatggtgcggcagctgccggcttgccggcacctgttccaagtggagtgcatcgacatgtggctgcactcgcacgcgacgtgccccctgtgccggtgccaagtctcgccgcagcaagttggtgtgaagctcacggcggcagcggatccaccggatgatgcgccgccggtgtgatcctacttagggaagaaggtcatgtcatgtggagactaagatcgtcgattttgctcaatcctgcaacgattttttgctgaaacagaagtttgttcat

SEQ ID NO: 9122 - protein, 197 aa, Panicum virgatum
  misc_feature: Ceres CLONE 2031101
  misc_feature (1)..(42): Pfam Name: zf-C3HC4 Pfam Description: Zinc finger, C3HC4 type (RING finger)
MLSLLHRRRPPPPSPHPDDGSLACYGIVVATASLLLFTILAATVSLAKAGALAGAAAVVFVAAGCVSRCYAGGGGAGPALPTTVAPARARAACGLVDAAIDALPAFAYARPGTCGAEGGDGSKSGRCALCAVCMEDVEAGEMVRQLPACRHLFQVECIDMWLHSHATCPLCRCQVSPQQVGVKLTAAADPPDDAPPV

SEQ ID NO: 9123 - DNA, 558 bp, Panicum virgatum
  misc_feature: Ceres CLONE 2031146
  misc_feature: Encodes the peptide sequence at SEQ ID NO. 9124
attaaattaaagctagtagtactgatcgatcggcatcgccggccggagatcgacatgacgacgatgatgaagaagcagcagcaagctgtggtgctgctgctgctgctggtggtggccgccggcggcgcgtctgcggcgtcgtgcaacgccgggcagctgacggtgtgcgcttcggcgctgacgtcgggcggcaagccctcggcggcgtgctgctccaacctcaaggcgcagcaggggtgcttctgccagttcgccaagaaccccgcattcgcgcgctacatcaacagccccaccgcgcgcaaggtcgtcgcatcctgcggcgtcgcactcccacgctgctagatagctacctcgctcattagttagctagctagctagctagctagcttatctgtatctatacatacatacatacatatgatcgctcgctcgctcgatcgatcttagtcgtctacgtgtggcttgctgctgttcatccagccgctcgctgcgtgtgtgtctatatatatatatatacacacacacgacggataaataaaagatgcatgggttgcctcg

SEQ ID NO: 9124 - protein, 95 aa, Panicum virgatum
  misc_feature: Ceres CLONE 2031146
  misc_feature: Great-hit functional homolog of the protein sequence given in SEQ ID NO 9541
  misc_feature (1)..(66): Pfam Name: Tryp_alpha_amyl Pfam Description: Protease inhibitor/seed storage/LTP family
  misc_feature: Useful for making plants with modulated biomass
  misc_feature: The plant is abnormally small.
MTTMMKKQQQAVVLLLLLVVAAGGASAASCNAGQLTVCASALTSGGKPSAACCSNLKAQQGCFCQFAKNPAFARYINSPTARKVVASCGVALPRC

SEQ ID NO: 9125 - DNA, 628 bp, Panicum virgatum
  misc_feature: Ceres CLONE 2031176
  misc_feature: Encodes the peptide sequence at SEQ ID NO. 9126
aagaccagcacgatctgttccccaatctcgcaggctctccttcctccgtcccggctgccgatcccgctcgcccgcccgctcagatccagatccagctgaaagatggacgcgagcaggcgccagagtgggattcagcaattgttggctgcagagcaggaggctcagcaaattgtcaatgcggccagggctgctaagtcagcaaggcttaggcaagcaaaggaggaggctgagagggagatagctgagtatcgtgcccagatggaggccgagttccagaggaaggttgcagagagcagcggtgactctggtgcaaacgtcaagcgtcttgaggaggagactgctgcgaaaatagaacagctcagccaacaggctgcgaccatctcccctgaagtcattcagatgcttctgaggcatgtcaccaccgtgaagaactgaacactgctttcacggtcacaaagttgtattatctagtacctgtttgtttattttggagagtggtacaaaataatgtcacttctggctgtaattcattgttcttaaccacggaataagctgcagtttagcagcaaccgtgtctggtactatctgacttgaccattatttggtatattggtaaatatttgttttc

SEQ ID NO: 9126 - protein, 110 aa, Panicum virgatum
  misc_feature: Ceres CLONE 2031176
  misc_feature (1)..(110): SWISSPROT Homolog: EC 3.6.3.14 Vacuolar ATP synthase subunit G 1
MDASRRQSGIQQLLAAEQEAQQIVNAARAAKSARLRQAKEEAEREIAEYRAQMEAEFQRKVAESSGDSGANVKRLEEETAAKIEQLSQQAATISPEVIQMLLRHVTTVKN

SEQ ID NO: 9127 - DNA, 1036 bp, Panicum virgatum
  misc_feature: Ceres CLONE 2031269
  misc_feature: Encodes the peptide sequence at SEQ ID NO. 9128
tgtctcgagtctcgtcccttcttcgcgcatctagcctcaaccgccagtccgccaccaccgcagcctgggagagagagagcagagcacgagggcgggggcggatggcgagctcccagtgctgcgagaacccgccgacgctgaacccggccggcggggcgggcaaggtcgtggacagcttcggcgggctcaaggcctacgtcgccggccccgaggactccaaggccgccgtcgtcctcgtcgccgacgtcttcgggtttgaagcgccgaatctgaggaagatagccgacaaggttgctctgtcaggatactttgttgtggtaccagatttcttccgtggggatccttacgcaccagagaatactgagaggcccattcctgagtggctaaagtcgcatactccggaaaaagggtttgaagatgcaaaacctgttattgctgctctaaaggagaagggagtgtctgctgttggagctgcaggttattgctggggtgcgaaggttgttgtggagttggcaaaagctaaggagatccaggctgctgtactgttgcacccttcgtttgtttctgttgatgatatcaaagaggtcaaatgcccgatttctgtactgggagctgagattgacaaaatgtccccgccagaattagtcaagcaatttgagcaggttctttctgccaattcaggggttggtcacttcgtcaagattttccctggtgtgtctcatggatggagcgtgaggtacagcgaagatgatgcggctgccgtgaagagtgctgaggaagccctggcggacatgatcgactggttcaacaagaacctgaaatgaactctggagtggcactctgccttgtaataaagcacatcctagtgcgcttgtcgtcggagtattgtgggattatcagctgtgttagtgttagggcctgcttcgtcaggtcattgtagttctcacggtctatgtgtttgtacacgttcgccgtagactggttgtgctcaatccgtaatagaaaggtaaattacgaaaaaaaaaaaaaaaaaaaa

SEQ ID NO: 9128 - protein, 240 aa, Panicum virgatum
  misc_feature: Ceres CLONE 2031269
  misc_feature (1)..(211): Pfam Name: DLH Pfam Description: Dienelactone hydrolase family
MASSQCCENPPTLNPAGGAGKVVDSFGGLKAYVAGPEDSKAAVVLVADVFGFEAPNLRKIADKVALSGYFVVVPDFFRGDPYAPENTERPIPEWLKSHTPEKGFEDAKPVIAALKEKGVSAVGAAGYCWGAKVVVELAKAKEIQAAVLLHPSFVSVDDIKEVKCPISVLGAEIDKMSPPELVKQFEQVLSANSGVGHFVKIFPGVSHGWSVRYSEDDAAAVKSAEEALADMIDWFNKNLK

SEQ ID NO: 9129 - DNA, 1096 bp, Panicum virgatum
  misc_feature: Ceres CLONE 2031281
  misc_feature: Encodes the peptide sequence at SEQ ID NO. 9130
aaatcgcccgaggaaaagcgcgcggcagggcaggagacgccgatcccccgtgtccgttggcgagcgagaccgaggcccgaccaaacaaccgccccgcctttttagccagccggccgttcgtcgcccccgctctcccccccactcgccccacgtctcctctgtctctccgatcggcaggagggaaaagtggacggctccagcgaagcgagcgccaccgtcgccttcgcctcgccatggagaggtctctcgacagcagctactccgcctccatcaaggacgtcacatacagctgcgggtactgcggctacgcgctgcacctgagctcctcggcgcgggacacggcgggcatcggctccaagtaccgcaagcagatcaagaagggcgtggtcgccttcgtcgccgtcgacgagagccgcttcacgctcaccgacgaggtcacctgcatgccctacttccgctccaggcgtgcctggggcctcctcaggaagcgttcgcgcctgctctgccgcaagtgcggcggccgcatcggcgacgcctacgaggaggaggacagggactccggcctcagcgacggcgacgccttctcggacgacctgcgcgcgagcttgggctccggtggcagcggcagcagcgcgtcgagccagaggaactacgtgatcaagatcagcgcgctgcagccgtcgtcagacgattctgacgcagctgccttcacactatgatgaagatagatggcgtcgggttgctgcaaggcgctcttcttccagcttggttgaattcgacttttgtgttatcagggatgcgactttgtaagcgcgggaggaaatacagcaagaaagagcttggcacagctgagaacttttcagatggtaaccaactgcatgctgttttcagacatcttgctgtcagtagtgctcttcgtttcctatgtaaatttgtgaaatgtacagcttggttattgaatttttctttgtattaggaaatgattaggtttgctgtatgttagttgatcccatagaatttgtactgtgtcataactcatgatccaccacggttgcaattttgagtagtcttgcttcaaaaaaaaaaaaaaaaaaaa

SEQ ID NO: 9130 - protein, 161 aa, Panicum virgatum
  misc_feature: Ceres CLONE 2031281
  misc_feature: Great-hit functional homolog of the protein sequence given in SEQ ID NO 9412
  misc_feature: Useful for making plants with modulated light quality response
MERSLDSSYSASIKDVTYSCGYCGYALHLSSSARDTAGIGSKYRKQIKKGVVAFVAVDESRFTLTDEVTCMPYFRSRRAWGLLRKRSRLLCRKCGGRIGDAYEEEDRDSGLSDGDAFSDDLRASLGSGGSGSSASSQRNYVIKISALQPSSDDSDAAAFTL

SEQ ID NO: 9131 - DNA, 659 bp, Panicum virgatum
  misc_feature: Ceres CLONE 2031355
  misc_feature: Encodes the peptide sequence at SEQ ID NO. 9132
atcgagcagagcacacagacagagcaaacgcatacaaccttcagcaatccactcgcactcgaccgcgctcagtcacctaaccgacgacgatgtcgctggtgaggcgcagcaacgtgttcgaccccttcgccgacttctgggaccccttcgacggcgtcttccgctccctggtcccgtccgtcgcgccgtcgggccgcgacaccgccgccttcgccaacgcgcgcatcgactggaaggagacccccgaggcgcacgtcttcaaggccgacctccccggtgtcaagaaggaggaggtcaaggtcgaggtgttggacggcaacgtcctggtcatcagcggcgagcgcagtaaggagaaggaggacaagaacgacaagtggcaccgcgtcgagcgcagcagcggcaagttcctccgccggttccgcctgccggagaacgccaagacggacgaggtgaaggccgggctggagaacggcgtgctcacggtcaccgtgcccaaggccgaggtcaagaagcctgaggtgaaggccatcgagatctccggttaagcaaccctggtccctgactccctggacgtgggaagaagctgtgatgatgatgctccggttctggtcgtgatcggttgatgtctgtgtcatgcataagcataacctgctgcctgc

SEQ ID NO: 9132 - protein, 151 aa, Panicum virgatum
  misc_feature: Ceres CLONE 2031355
  misc_feature (1)..(104): Pfam Name: HSP20 Pfam Description: Hsp20/alpha crystallin family
MSLVRRSNVFDPFADFWDPFDGVFRSLVPSVAPSGRDTAAFANARIDWKETPEAHVFKADLPGVKKEEVKVEVLDGNVLVISGERSKEKEDKNDKWHRVERSSGKFLRRFRLPENAKTDEVKAGLENGVLTVTVPKAEVKKPEVKAIEISG

SEQ ID NO: 9133 - DNA, 860 bp, Panicum virgatum
  misc_feature: Ceres CLONE 2031545
  misc_feature: Encodes the peptide sequence at SEQ ID NO. 9134
aacctcaagcacaacgactcaacgagatagatcacacgagctcagatcaccagccatttgttgctgttgatcagcaaagcaagcttaggctaggcaatggagttctcgttcggcggcttcggcgacccggtcttgtcggcggcgctgcagcagctgatggacctccccgacgagctggagcggcagctgaacccgccgacgcgtgcctacgtgcgcgaccgccgcgccatggccaacacgcccatggacgtcaaggagctcccctccggcgcgctcgtgctcgccgtcgacatgcccggggttagccccgccgatgtcagggtccaggtcgaggagggcaacgtgctcaccatcagcggcgagcgcaagcgccccgccgaggacgccggcgccgaggccggcagcaagcagcagcagcagcagggggccgacggaggcaccggcgagaagcagggggtgaggtacctgcggatggagcggcggatgggcaagttcatgaggcggttcccgctgccggagagcgccgacctggacagcatcagggccgagtacaaggacggcgtgctcaccgtcaccgtcgacaagaagccgccgccggagcccaagaagccacgcattgtccagatcacggccggcgaccgccagggcaagtgaaggagacgacgtgcgcgttatcagatcagctggatgttgagcgaataatgtgatgaggggtgtgataccgtggagcgagcctgtgttccgcttgcgcttggtgtattagtgtgccatcgaataaaagtaatagtcgtagtacatgcatgtagccatgtactcgactacttcagtgtttcttcttgtaaaaaaaaaaaaaaaaaaaa

SEQ ID NO: 9134 - protein, 185 aa, Panicum virgatum
  misc_feature: Ceres CLONE 2031545
  misc_feature (44)..(104): Pfam Name: HSP20 Pfam Description: Hsp20/alpha crystallin family
MEFSFGGFGDPVLSAALQQLMDLPDELERQLNPPTRAYVRDRRAMANTPMDVKELPSGALVLAVDMPGVSPADVRVQVEEGNVLTISGERKRPAEDAGAEAGSKQQQQQGADGGTGEKQGVRYLRMERRMGKFMRRFPLPESADLDSIRAEYKDGVLTVTVDKKPPPEPKKPRIVQITAGDRQGK

SEQ ID NO: 9135 - DNA, 978 bp, Panicum virgatum
  misc_feature: Ceres CLONE 2031663
  misc_feature: Encodes the peptide sequence at SEQ ID NO. 9136
acggcatctgtccacacgagcacgagctagagatttttgcaaagcaatcaaccaagcgcgcgagcgattgagcacttccgatccatcaagctgataataatagaaatggctgctgcatcaaggaaggcgccggcttccggagccgccgtcctcgcgtcggcgacggtggtggtggcgctgctggcgcaggccgtgcccgccgcggcgctggtgccgtacgggcgcgggctggcgtgggacttgctcgacgacccgttccgggtgctcgagcagtcgccgttcttggctgtctcggcggcgccgagcagggtggcgggcggcgccgaggaggcgggggtggccctggcacgttgcgactggaaggagacccccgacgcgcacgtcatctcggtggacgtgcccggggtgcggcgggaggacgtgaggatcgaggttgaggagggcagccgggtgctccgcgtgtccggcgagcggcgggcggaggaggagaaggagggcgagcggtggcaccgcgccgagcgcgccgcgggccggttctggcgccggttccggatgcccgccggcgccgacgtcgaccgcgtcgcggccaggctggaggccggcgtgctcaccgtcaccgtgcccaaggtcgccgggcaccgcgggcgggagccgcgcgtcatcagcatcgccggcggcgacgagggcggcgccgaggcgacggaggtcagggcgtccaaggccgagatgtgatcgtgaattcctgacgaggcgtgtgttcgcgacttggcgttgaccgtagtgtgtgtttgttgcgtacgatcgtgttgtccaatgtccagcatcttctcgtaccaacccttggatcaaagccctaatgaatagtccaagccagaatctccaagttggatgatattttattcatcaaaatttctggttctataacaatttctggttctataatgagaaagatataaacaatctcttaaaattgctcag

SEQ ID NO: 9136 - protein, 208 aa, Panicum virgatum
  misc_feature: Ceres CLONE 2031663
  misc_feature (1)..(112): Pfam Name: HSP20 Pfam Description: Hsp20/alpha crystallin family
MAAASRKAPASGAAVLASATVVVALLAQAVPAAALVPYGRGLAWDLLDDPFRVLEQSPFLAVSAAPSRVAGGAEEAGVALARCDWKETPDAHVISVDVPGVRREDVRIEVEEGSRVLRVSGERRAEEEKEGERWHRAERAAGRFWRRFRMPAGADVDRVAARLEAGVLTVTVPKVAGHRGREPRVISIAGGDEGGAEATEVRASKAEM

SEQ ID NO: 9137 - DNA, 717 bp, Panicum virgatum
  misc_feature: Ceres CLONE 2031709
  misc_feature: Encodes the peptide sequence at SEQ ID NO. 9138
aaaaaaaaaaaaaaaattgcatcgcatctcctctcgctctctgttgtgtgactgattgccaagaaagctctctgcttgcttgtgttccagcctctgaatctcgtgaggatgtcgtgctgcggaggcaactgcgggtgcggctccggctgcaagtgcggctccggctgcggagggtgcaagatgtacccggacatgactgagcagggcaccaccaccaccagccagactgtcatcatgggcgttgcaccaaccaacaaggggcacgccgagggcggatttgaggccggcgccggagccgagaacggctgcaagtgcggtgccaactgcacctgcaacccctgcacctgcaagtgaggagctcatggccatggccggaccggaggagatctgaagctagtatagcggcgttgtgtgtgcgtcgttcgtttgtctgaaagtgtgtgtggcatgcttaataacggtgttgcgcgtgctgctagtagatggtactgatggggaacaataataatgatggtgctgagatgtcgtcggcgtcgccgccgccgtcgtgtccttcctccccggccggtcgggcacctgtggcggtgctctagcagtgtgttgtgtgtgcagcagaccatgctctgatctttgtggtgtatgtgtgtggcctgctgcttggtgtccctagtgtcatgtgtaaccatccatctatatctatctacatccatcttgtgt

SEQ ID NO: 9138 - protein, 81 aa, Panicum virgatum
  misc_feature: Ceres CLONE 2031709
  misc_feature (1)..(80): Pfam Name: Metallothio_2 Pfam Description: Metallothionein
MSCCGGNCGCGSGCKCGSGCGGCKMYPDMTEQGTTTTSQTVIMGVAPTNKGHAEGGFEAGAGAENGCKCGANCTCNPCTCK

SEQ ID NO: 9139 - DNA, 606 bp, Panicum virgatum
  misc_feature: Ceres CLONE 2031756
  misc_feature: Encodes the peptide sequence at SEQ ID NO. 9140
acaccagtcaactttttcaaatcatctgcaactctaaggagacagtacactagctagctgtgctgatcgagtctagaacactctagaaggttccattggatcgacgatggaccgcgtggcgaggctggtgtcggagcgggcggtggtggtgttcacggcgagcaactgcagcatgtgcgacgtggtgacgtcgctgctgggcagcctgggcgtgaacgcggccgtgcacgagctggacagggacccccgcggccgggagatggagcgggagctcgccaggaggctcggcgccggcgccgccggtgccgtgcgcggcggcgtcacacccaccgtgccggcggtgttcgtgggcggcgacctcgtcggcggcaccaacagggtcatggcgctgcacctcgccggcgagctcgtgcccatgctcaggaacgccggcgcgctctggctctaggagctcagaacgccggcgtcgctcatgcaaagcatgtcttagctctttttcgtcagacgtgtacgagtgcgtgaatgccaggttttttttgtattctgtgcttgtaataagtcaaataaatatcgcatcagtattaaacatgattttcgatatctatt

SEQ ID NO: 9140 - protein, 113 aa, Panicum virgatum
  misc_feature: Ceres CLONE 2031756
  misc_feature (1)..(69): Pfam Name: Glutaredoxin Pfam Description: Glutaredoxin
MDRVARLVSERAVVVFTASNCSMCDVVTSLLGSLGVNAAVHELDRDPRGREMERELARRLGAGAAGAVRGGVTPTVPAVFVGGDLVGGTNRVMALHLAGELVPMLRNAGALWL

SEQ ID NO: 9141 - DNA, 976 bp, Panicum virgatum
  misc_feature: Ceres CLONE 2031921
  misc_feature: Encodes the peptide sequence at SEQ ID NO. 9142
atccagtccccaaaccgagcaccgagaccggccgccgccacccctgtcggcgcatcccgccatctcccaccgccggcacctctcccgccgcctcccgcgcagcttcggggcccgcgcggctgctgggcgccgggcgcaggcggcctcggtcccggccgccacgggcgtgggcgcgggcgagctcggccccagccgccgtgggcgctcgcggaccaaaatgacatccactttgccggaatccatcgccgccgttggggaaatcaacgattccatccacatccgtcgcctcgagctgtctgaccacgagaggggcttcgtcgccctgctctcccagctctccgcctgcccggatctcactgcgtccgagttcgccacgcgcttcgccgagctcgcggcgcaaggcgaggaccacgtcatcctagtggccgaggacacctccgccccggagcggcggattctcgccacggggtgcctcttcgtggagcgcaagttcctgagaggcggcggcaaggtgggccacgtggaggacgtggtggtcgatgccgccgcgcgcggcagtgggctcgggctccgcatcgtgcgccgcctcgtcgagatcgccagggacgccggctgctacaagatcatcctagactgcactcctgagctgcgcgcctactacgccaagtgcgggtttgtggaaaagggggttcagatggccatctacttctgaacctcaaccagacttccagaggtaatataccttgcattgatatggttcatctgtttaagtgctgaatgaaatgtcgtacttgatttaaatactgtagcacttgtttgtagtagtgcggcctaggtgtatcaaggtgcaaatgcatttgaaacaaatgcccaaacactgctgacagtgatgtgcataccttttctgtatctagagtcaatttggcttactacagttattggcttgtcgccacccgaaaaaaaaaaaaaaaaaaaa

SEQ ID NO: 9142 - protein, 164 aa, Panicum virgatum
  misc_feature: Ceres CLONE 2031921
  misc_feature (1)..(83): Pfam Name: Acetyltransf_1 Pfam Description: Acetyltransferase (GNAT) family
MTSTLPESIAAVGEINDSIHIRRLELSDHERGFVALLSQLSACPDLTASEFATRFAELAAQGEDHVILVAEDTSAPERRILATGCLFVERKFLRGGGKVGHVEDVVVDAAARGSGLGLRIVRRLVEIARDAGCYKIILDCTPELRAYYAKCGFVEKGVQMAIYF

SEQ ID NO: 9143 - DNA, 693 bp, Panicum virgatum
  misc_feature: Ceres CLONE 2031950
  misc_feature: Encodes the peptide sequence at SEQ ID NO. 9144
gtctctcgttcgacaaaaaaaaagggtttcgcccgcgaagcaatctcgccgcaaccagccgcgctcgatcgaggtttgggcgaaggatccgtgtgagggcttccgccgttcgcgaaggaggaggaagagatggcgaagggggaggggccggcgatcgggatcgacctggggacgacctactcgtgcgtcggcgtgtggcagcacgaccgcgtcgagatcatcgccaacgaccaggggaaccgcaccacgccgtcctacgtcgccttcaccgacaccgagcggctcatcggcgacgccgccaagaaccaggtcgccatgaaccccaccaacaccgtcttcggtacgtgccaggcgccctccactcctctccccttccttcagtagcaaactagcgatgtttgattcctctagatttcgagcgtagtcgatttgcctggttttgtgccccggagttttcgaagatgtttgtagatctgctggaatgtgttatcttgtcagcattagctgctctgttcctattggcgatacagtagcatagcagaaaccattggaaaatgatttgttcagtgtgagtagtagctgctttgtttgtgtgctctgcatgagtagcattaaccattgagaaggcgaacctatctgtgaaatctgtaggtctgaattagatgctatgctggcatgttgccgttttcgtgc

SEQ ID NO: 9144 - protein, 84 aa, Panicum virgatum
  misc_feature: Ceres CLONE 2031950
  misc_feature (1)..(64): Pfam Name: HSP70 Pfam Description: Hsp70 protein
MAKGEGPAIGIDLGTTYSCVGVWQHDRVEIIANDQGNRTTPSYVAFTDTERLIGDAAKNQVAMNPTNTVFGTCQAPSTPLPFLQ

SEQ ID NO: 9145 - DNA, 836 bp, Panicum virgatum
  misc_feature: Ceres CLONE 2031965
  misc_feature: Encodes the peptide sequence at SEQ ID NO. 9146
aagagcaggcaagaaagcccgaagcatatcgatcagaagttcagaactcagaggaagcctcttcgatcgcacaagccactcgatcccaagcactgttccaacgttcagttcaaaacaccaactcgcatcatgtcgctgatcccccgtgccaacgctttcgaccccttctccctcgacctctgggaccctttccagggcttcccgttcggttcaagcggcggcagcctgttccctcgcatcccctccgactacgagaccgcggcgttcgccggtgcgcgcatcgactggaaggagacgccggaggcccatgtcttcacggcggacgtgccggggctgaagaaggaggaggtcaaggtggaggttgaggacggcaacgtcctccagatcagcggcgagcgcagcaaggagcacgaagagaagagcgaccggtggcaccgggtggagcgcagcagcggcagcttccttcgcaggttcaggctgccggagaacgccaaggcagagcagatcaagtcgtccatggagaacggcgtgctcaccgtcaccgtgcccaaggaggagggtaagaggcccgacgtcaagcccgtccagatcaccggctaggacgggaggagcacgcgtggtctgtggagctccaagtaaccgttctggaaacgaatgcgttctgtttttgtgcggtggtgtcagtttagtctgtgtggttcttctgtaagcctgcttgtttgcgtgatcgtcgaggctcaagtacctgagtccattgtgtctttgttccactagtaatttcataaataaacgagtgatacagaatgccggttctgtaaaaaaaaaaaaaaaaaaaa

SEQ ID NO: 9146 - protein, 156 aa, Panicum virgatum
  misc_feature: Ceres CLONE 2031965
  misc_feature (1)..(104): Pfam Name: HSP20 Pfam Description: Hsp20/alpha crystallin family
MSLIPRANAFDPFSLDLWDPFQGFPFGSSGGSLFPRIPSDYETAAFAGARIDWKETPEAHVFTADVPGLKKEEVKVEVEDGNVLQISGERSKEHEEKSDRWHRVERSSGSFLRRFRLPENAKAEQIKSSMENGVLTVTVPKEEGKRPDVKPVQITG

SEQ ID NO: 9147 - DNA, 554 bp, Panicum virgatum
  misc_feature: Ceres CLONE 2032012
  misc_feature: Encodes the peptide sequence at SEQ ID NO. 9148
atcacaagcagcacaagcacaagaagcacttcaccttcttcagtagcattacctgcttcgtcccttgcttgtgcttgagaagatgtcttgctgcggtggcaactgcgggtgcggcgccggctgcaagtgcggcaacggctgcggcggttgcaagatgttccctgacgtcgaggcgtctgccactaccacgaccatggtcatcgctgcggccaccaacaagggcagctccggcggcatgatgatggcggaggccgagaacggcggctgcgactgcaacacctgcaaatgcggcaccagctgcggctgctcctgctgctcgtgcaactgaggcagccacgcgctgcctccggccacgacgaggaccccatcacccagcctcgcttattactatcgtataaataagagcttgtcatttgcatcttgtgtgcgtgtatgtgtgcgcgtcctggggtcatctgatctgaatattcctcacctgaaacacctgatgattagatgatgtcgtggatcttgtcctcctcgtccgacccggtttaatatatgtatctcaatcg

SEQ ID NO: 9148 - protein, 81 aa, Panicum virgatum
  misc_feature: Ceres CLONE 2032012
  misc_feature (1)..(83): Pfam Name: Metallothio_2 Pfam Description: Metallothionein
MSCCGGNCGCGAGCKCGNGCGGCKMFPDVEASATTTTMVIAAATNKGSSGGMMMAEAENGGCDCNTCKCGTSCGCSCCSCN

SEQ ID NO: 9149 - DNA, 596 bp, Panicum virgatum
  misc_feature: Ceres CLONE 2032214
  misc_feature: Encodes the peptide sequence at SEQ ID NO. 9150
aggctcatctctgttccgttcctcctttcccttctggcggcgacgattgggcgagcggcggcgccattcatcacgtcttcacccagccctttgccggcgacgagcatccaccagcaatggagaagtataacagcaacactcgatttgcacccttgagagccacgccatttgctctccgtggtgctcttggtagctcaagctcaaatctggagcaagccaggggctacacatcttcgcctctagcagtgctgcgaccaaatatgtctccaactggaagccgaaccctgcacacaagccgccccctgtcatctcctgttgcgaaccgcccattgtcgccccacctaccgctgaagaagccacagtttagcgctacgttctcaatctcgcaccgtattttcggtgtcgcattgggagttgccatcatatccgtccctcttgccaccaagttcagcctgatgtgtggtgtgtgagagtgaactgctgcattggcgagaaacgttgtttcctatttctgcgactgtttcattgtctgggttatcttcaaactcgactgtgggtgtggttggaataatatctttgttatgcttgcaaacttc

SEQ ID NO: 9150 - protein, 117 aa, Panicum virgatum
  misc_feature: Ceres CLONE 2032214
  misc_feature (1)..(49): Pfam Name: Sdh_cyt Pfam Description: Succinate dehydrogenase cytochrome b subunit
MEKYNSNTRFAPLRATPFALRGALGSSSSNLEQARGYTSSPLAVLRPNMSPTGSRTLHTSRPLSSPVANRPLSPHLPLKKPQFSATFSISHRIFGVALGVAIISVPLATKFSLMCGV

SEQ ID NO: 9151 - DNA, 885 bp, Panicum virgatum
  misc_feature: Ceres CLONE 2032233
  misc_feature: Encodes the peptide sequence at SEQ ID NO. 9152
aacctgaagcccaacgactcaacgagacagatcacacgagctcagatcaccagccatccagccattattgctgttgatcagcaaggcaagcttaggccaggagcaatggagttctcgttcggcggcccggtgctgtcggtggcgctgcagcagctgatggacctccccgacgagctggagcggcagctgaacgcgccgacgcgcgcctacgtgcgcgaccgccgcgccatggccaacacgcccatggacgtcaaggagctcccctccggcgcgctcgtgctcgccgtcgacatgcccggggtcagcctcgccgacgtcagggtccaggtcgaggacggcaacgtgctcaccatcagcggcgagcgcaagcgcccgcccgaggacgccgtcggcgccgaggccgacaagcagcagcagggcgccgacggaggcgccggcgagaagcagggggtgaggtacctgcggatggagcggcggatgggcaagttcatgcggcggttcccgctgccagagagcgccgacctggacagcatcagggccgagtacaaggacggcgtgctcaccgtcaccgtcgacaagaagcccccgccggagcccaagaagccacgcgtcgtccagatcaccgacggcggcgaccaccagggtaagtgaaggagacgacgtacgcgtcagcagatcagcgggatgctgagagaataatgcgagggtgtgatgccgtggagcctgtgctccgcttggtgtattagtgtgccatcgaataaaagtaagtcctagtacatgcatgtagccatgtactcgactacttcagtgtttcttcttgtatctctgttctctgggactgaatgggatggatgctttgcttgacaaaaaaaaaaaaaaaaaaaa

SEQ ID NO: 9152 - protein, 181 aa, Panicum virgatum
  misc_feature: Ceres CLONE 2032233
  misc_feature (1)..(111): Pfam Name: HSP20 Pfam Description: Hsp20/alpha crystallin family
MEFSFGGPVLSVALQQLMDLPDELERQLNAPTRAYVRDRRAMANTPMDVKELPSGALVLAVDMPGVSLADVRVQVEDGNVLTISGERKRPPEDAVGAEADKQQQGADGGAGEKQGVRYLRMERRMGKFMRRFPLPESADLDSIRAEYKDGVLTVTVDKKPPPEPKKPRVVQITDGGDHQGK

SEQ ID NO: 9153 - DNA, 573 bp, Panicum virgatum
  misc_feature: Ceres CLONE 2032340
  misc_feature: Encodes the peptide sequence at SEQ ID NO. 9154
ccaacaactcgagaacagagcaaagcatcaatcgattgatcgcaagcgaaccggcagcgaggagcagctctcgatttcgaatcgcgatcggagaagaaaggggaggaggtaggagagatggcgagcaagaacggcggcggcaagggggagggcccggcgatcggcatcgacctcggcaccacctactcgtgcgtcggggtgtggcagcatgaccgggtggagatcatcgccaacgaccagggcaaccgcaccacgccctcctacgtggccttcaccgacaccgagaggctcatcggcgacgccgccaagaaccaggtcgccatgaaccccaccaacaccgtcttcggtaagttctccccttcgagcttcggaaacgattccaggttgttttcctgtaatcgtgctagcatatgataatcggatgatcatcgtagttataaataattcagcactaatcagatgattcacctgatgatcacaattgcacggctccttgctctgctctcactctgttttggaggcacaacatggctaacttcacttagtaaataaaatactagatttttttgacac

SEQ ID NO: 9154 - protein, 98 aa, Panicum virgatum
  misc_feature: Ceres CLONE 2032340
  misc_feature (1)..(85): Pfam Name: HSP70 Pfam Description: Hsp70 protein
MASKNGGGKGEGPAIGIDLGTTYSCVGVWQHDRVEIIANDQGNRTTPSYVAFTDTERLIGDAAKNQVAMNPTNTVFGKFSPSSFGNDSRLFSCNRASI

SEQ ID NO: 9155 - DNA, 722 bp, Panicum virgatum
  misc_feature: Ceres CLONE 2032454
  misc_feature: Encodes the peptide sequence at SEQ ID NO. 9156
tgcccactacacagtacacacacgacgcgcaccaccagcacgccgacgactgaacgaggcgagaaccggccgaggcggaggcgatgggcggcggcggcggcgcgcacggcggcaccacctacaagggctacaccatcccgcacaacaagcgctggcataccgtcgccggcaagggcctctgcgccgtcatgtggttttgggttttctacagagctaagcaggacggtgctgtgctcttgggcttgcgccatccttgggatgggcatgatgatcactctcatggacatggacatggacatggacatgaggcatcatcatcgtcatcgtcttcttctcattgagttcactacaacttgcagctgacggtgatgcgatgcttggcatgttccgactaaagtttcatttaataaattctgccccgctgcagggagtcatgttgtttgcgagttgcttagcacaaactgtttgcctgacaattgtgcttgtgtatttgatttcaagcttcagttgatatgttgtgggaaagaattcggtgtatgtcgcttctcgttgtgaccactacttgtgccccttgctctgctttttcccataagacccaaacatctttggacagcctctgtttgtattttgtatttactggggcttgatagcaactcaggcgagaagaggaatggcgactcttggtgcgtctatttttggtcgaaaaaaaaaaaaaaaaaaaa

SEQ ID NO: 9156 - protein, 85 aa, Panicum virgatum
  misc_feature: Ceres CLONE 2032454
  misc_feature: Great-hit functional homolog of the protein sequence given in SEQ ID NO 9351
  misc_feature: Useful for making plants with modulated flowering time
  misc_feature: The plant flowers significantly late compared to wild-type.
MGGGGGAHGGTTYKGYTIPHNKRWHTVAGKGLCAVMWFWVFYRAKQDGAVLLGLRHPWDGHDDHSHGHGHGHGHEASSSSSSSSH

SEQ ID NO: 9157 - DNA, 742 bp, Panicum virgatum
  misc_feature: Ceres CLONE 2032577
  misc_feature: Encodes the peptide sequence at SEQ ID NO. 9158
attcaagccgagagcaacgccccaattcagcagacacctcgatcgatcaaacgacgcaactcgaataatcgatccttattctctctcgcagtcgcagagccccagtgcgacgagatcgacgatggcgtacatgcgcgtgacgcaccgcgacgaggagggcaagaaggtgacggagaagctgcccgtcccggaggcgcgccgcccggacaccgccaagtacatcgagcgcaagctcgaggagcagggcttccaccgcttcgagcgccaccccgccaacgcgccccgcggcgtcggcatcggcaccccgccgcccaagtcgggccgcggcggcaagtacacctgggagggccccggcggcctcgtcgaggacgagctcgacccggcgccgcccgccatcgaccccaacgaccccaactacgaggacgacgacggagccgtggacgaggtggccaaggacgtggtcgtcggggaggtggaggtcgccaaggtggccgagggcagggacggcgtcgccagggttgacgtcgcgccgcccctgctccaggaacagcagcagtagctagctccagtacttctagctggcttctgagacctcacctagcaactcattgctcatcctcatccatgtggtgactgttgagcttggacgtgaactgtgttctggtgcactaagccgctaatcaatcaataatcgaatgtgaattaaactcagattaactttcaaaaaaaaaaaaaaaaaaaa

SEQ ID NO: 9158 - protein, 145 aa, Panicum virgatum
  misc_feature: Ceres CLONE 2032577
  misc_feature: Great-hit functional homolog of the protein sequence given in SEQ ID NO 9730
  misc_feature: Useful for biocontainment applications
  misc_feature: The plant produces a reduced number of seeds.
MAYMRVTHRDEEGKKVTEKLPVPEARRPDTAKYIERKLEEQGFHRFERHPANAPRGVGIGTPPPKSGRGGKYTWEGPGGLVEDELDPAPPAIDPNDPNYEDDDGAVDEVAKDVVVGEVEVAKVAEGRDGVARVDVAPPLLQEQQQ

SEQ ID NO: 9159 - DNA, 637 bp, Panicum virgatum
  misc_feature: Ceres CLONE 2034233
  misc_feature: Encodes the peptide sequence at SEQ ID NO. 9160
aacacacagcaacaagctactgctcgctagaacacaagacgcaaagagtttctacaggaaacagggagctgaagcgccaagcgaagcgaccatgaagagcagcacgctcctggtgctcctgtagtcctgtgcctgcaggccgccctggtcatggggatcttcgcagccgtggcaaaagaaaatgccgtggtcgagagcaaggccatcgacatcaacccgggtcagctcaagtgctgcaccaactgcaacttctccttctcggggctctacacctgcgacgacgtcaagaaggactgcgaccccgtctgcaagaagtgcgtcgccgtcaagacctactccggcaacaagttcaggtgcaccgacaccttcctcggcatctgcggacccaagtgctagactagatgcatgagccaccatcccagcatgggcagctgctggatcgaatttggcttgggaaatgcaggaccgaggccatgcggtcctccgatcctactacacgagcatacataagattattgtgtgttgtgagtttgtgtcattgtgtaatggtacgtgcttgttctcgacgatgcacgcgaacaataagccgttgtttgcgataaataaaagtgatgcagcatgcaaaagttacgtttcg

SEQ ID NO: 9160 - protein, 81 aa, Panicum virgatum
  misc_feature: Ceres CLONE 2034233
  misc_feature (1)..(23): Pfam Name: Bowman-Birk_leg Pfam Description: Bowman-Birk serine protease inhibitor family
MGIFAAVAKENAVVESKAIDINPGQLKCCTNCNFSFSGLYTCDDVKKDCDPVCKKCVAVKTYSGNKFRCTDTFLGICGPKC

SEQ ID NO: 9161 - DNA, 615 bp, Panicum virgatum
  misc_feature: Ceres CLONE 2034408
  misc_feature: Encodes the peptide sequence at SEQ ID NO. 9162
atcagagttcatctcagtgcagtgtagtgaaggcagcagagtgttgtgacttgtgaagcgctaccaggcaggcatgatcaaagcaatggagctccaggcgacgaggtgcctctgcgtcgtcgcgatgctcctggtggccggcctggcggggatggagacggcgcacggcgcaggggagtgcggccgcgcgcccgtggaccaggtggcactcaagctggccccgtgcgcggcggcgacgcaggacccgcgcgccgcggtgccgccggcctgctgcgcgcaggtgcgcgccatcgggcgcaaccccaagtgcctctgcgccgtcatgctgtccggcacggcgcggaaggccggcgtcaagcccgccgtggccatgaccatccccaagcgctgcgccatcgccaactgccccgttggctacaaatgcggcccatataccctgccatgagaggtgatgatgatgagcaggaacaaagtgatggcgccggcacctgaagggctccaaactctgagtgtccaatatgctgcgttctgtcgtgtgggactttccacagatccctgaataatgtggctgtaacaatgcctcaactttgctttggaataaactacttttttctg

SEQ ID NO: 9162 - protein, 123 aa, Panicum virgatum
  misc_feature: Ceres CLONE 2034408
  misc_feature (1)..(82): Pfam Name: Tryp_alpha_amyl Pfam Description: Protease inhibitor/seed storage/LTP family
MIKAMELQATRCLCVVAMLLVAGLAGMETAHGAGECGRAPVDQVALKLAPCAAATQDPRAAVPPACCAQVRAIGRNPKCLCAVMLSGTARKAGVKPAVAMTIPKRCAIANCPVGYKCGPYTLP

SEQ ID NO: 9163 - DNA, 565 bp, Panicum virgatum
  misc_feature: Ceres CLONE 2034838
  misc_feature: Encodes the peptide sequence at SEQ ID NO. 9164
tcttccccggatcgaaacgaaggctcgggtcctcctctcgcggcggcggcgcactcctcctcctccatctccggcaaggcatttggcatctgacctcaacagcaagcaaatggcaggtggcagggttgcacatgctaccctcaagggcccaagtgtcgtgaaggagatcttcattggactcacccttgggctggtcgctggtggcatgtggaagatgcaccactggaacgagcagaggaagactagatccttctacgacatgcttgacaagggccagatcagcgttgttgttgaggagtagttttcgtgtcagatctgaagctgtctcgtctttgttttggcctgttattttccaaaactctgtggagagcatgatgaagtgaaatgctgtggagatttgtcgtgaaaataagcataaccatttgagaacatcagatttttgttgagttttcttgtcatgaatacttcaaacatgtggatggcttcccctagatgttactctgatctagtttacctaaatttatgtcatcattttgagagtgcttttgttcactactttcctgtt

SEQ ID NO: 9164 - protein, 63 aa, Panicum virgatum
  misc_feature: Ceres CLONE 2034838
  misc_feature (1)..(62): Pfam Name: COX5C Pfam Description: Cytochrome c oxidase subunit Vc (COX5C)
  misc_feature (1)..(63): SWISSPROT Homolog: EC 1.9.3.1 Cytochrome c oxidase polypeptide Vc
MAGGRVAHATLKGPSVVKEIFIGLTLGLVAGGMWKMHHWNEQRKTRSFYDMLDKGQISVVVEE

SEQ ID NO: 9165 - DNA, 679 bp, Panicum virgatum
  misc_feature: Ceres CLONE 2034876
  misc_feature: Encodes the peptide sequence at SEQ ID NO. 9166
tcttttctcttccacaccaacccagccatggccaaggtaactccctccctcctcgccgtcgtcgacagcggcgctgccttcactgcccagccatcggccaggaaaggtgccagtttgttccgtgatcgcgtcatcagcaggcgtgccaggatatcagctaagcttggtggagatggggagctgaagcctccaggcaagaagaagttcatcaccagggatgaggagcccgaacagtactggcagactgcaggggagagggagggtgagaaccccatgaagacgcccctgccctacatcatcatcttcggcatgtccacccccttcgtcatccttgccatcgcatttgccaatggctggatcaaggtccctgtacgatgaaacttgcgcgatcacattttgggagcttccagccaaacaccttgtcacttcctctgcatcctctccagcgagagacctgcatgtttttaccttcatagagataaagagtcaacactttgtaagcatagtatcaatcttccgttcttcacacaagacaaggtttgtaccatcagcagtagtcaggcaatcacttgtccaactatttcttggtttccagaacacctcaactgattctgctatacaaatggcatatactgtatctaaaataaactaatgttcagtccatgccatgttcaaggtc

SEQ ID NO: 9166 - protein, 116 aa, Panicum virgatum
  misc_feature: Ceres CLONE 2034876
  misc_feature: Great-hit functional homolog of the protein sequence given in SEQ ID NO 9634
  misc_feature: Useful for making plants with modulated biomass
  misc_feature: The plant is abnormally small.
MAKVTPSLLAVVDSGAAFTAQPSARKGASLFRDRVISRRARISAKLGGDGELKPPGKKKFITRDEEPEQYWQTAGEREGENPMKTPLPYIIIFGMSTPFVILAIAFANGWIKVPVR

SEQ ID NO: 9167 - DNA, 604 bp, Panicum virgatum
  misc_feature: Ceres CLONE 2034913
  misc_feature: Encodes the peptide sequence at SEQ ID NO. 9168
aattactccccggccctccttccctggctccttcctccgagcgagaggtttcaaacagagggggagggcgatccatccacccatcgagtctctggcgccggatcggttcgtcgtcgatggcggactggggccccgtggtgatcgcgacggtgctgttcgtgctgctgacgccggggctgctgttccagctccccgcgcaaggccgcatcgtgggcttcggcaccatgcacaccagcggcctcgccatcctcgtccacgccgtcctctacttcgcgctcatcaccatcttcctcatcgccatcggagtccacatctacgccggctagctggagctgcggagcccggtcgtctcttccgctcgcccgcggcccgcccgcggcccgcccttcgccaagtcttctctctcctctcctctcctctcgtcgcttccctttccgatctactcctcctagtagtagaatatgtgacgcctgcctgcctgcttgctcgtgctagcagggttagcagtgccgttgctggtggtgttatcttgttaatttaactgcagcgaaagcaatccggtggatggatgctgcagtgtgttgtataatgaagggattatcgt

SEQ ID NO: 9168 - protein, 69 aa, Panicum virgatum
  misc_feature: Ceres CLONE 2034913
  misc_feature: Great-hit functional homolog of the protein sequence encoded by LOCUS At5g63500
  misc_feature: Useful for making plants with altered cell wall content and/or composition
MADWGPVVIATVLFVLLTPGLLFQLPAQGRIVGFGTMHTSGLAILVHAVLYFALITIFLIAIGVHIYAG

SEQ ID NO: 9169 - DNA, 582 bp, Panicum virgatum
  misc_feature: Ceres CLONE 2035242
  misc_feature: Encodes the peptide sequence at SEQ ID NO. 9170
atccaaaagaaccctaaaccctgcgggccgcggcaaccggagaagcaggaagagccatccccccgcttcaacttgctccccaagaagaaaacagcggcgatggcgaagcgtctgatcccgtcgctgaaccgggtgctggtggagaagctgctgcagcccaagaagagcgccggcggcatcctcctcccggagaccaccaagcaggtacgcggcacacagatctcgctcgtttccctccgctttcggtggtgggcccttgctccatccgcgcgcgattggtgcggcattttttgcgagagcggccttcgtggcgtggggtttgggtttgtagatttgggccggggaagttcagaagattcctgttgcggagggaggggagaatgtatagggagttgcttgggggaaagttgtataggtttgagccggtgacgtgtcgtgattattaggaattgatcagattggatgggagtgtagtgagggtgttgagcattctgtaaactagtcgactgaggagagctagcttggtgtgatttgagcttgcaactaatcttcattattcatgcgtgaatttcaaaattgtgc

SEQ ID NO: 9170 - protein, 109 aa, Panicum virgatum
  misc_feature: Ceres CLONE 2035242
  misc_feature (1)..(41): Pfam Name: Cpn10 Pfam Description: Chaperonin 10 Kd subunit
MAKRLIPSLNRVLVEKLLQPKKSAGGILLPETTKQVRGTQISLVSLRFRWWALAPSARDWCGIFCESGLRGVGFGFVDLGRGSSEDSCCGGRGECIGSCLGESCIGLSR

SEQ ID NO: 9171 - DNA, 622 bp, Panicum virgatum
  misc_feature: Ceres CLONE 2038816
  misc_feature: Encodes the peptide sequence at SEQ ID NO. 9172
accgaagaacacacaacaccaccaaagagataacaaagccttcttcctatagcactcttgcaatccacagagctagttcagttcatccaagcacacagaagcatcagcaatgtcgctcgtcaggcgcggcaacgtgttcgaccccttctccatggacctctgggaccccttcgacagcatgttccgctccatcgtcccatcgtcctcctccggctccgacaccgccgccttcgccaatgcccgcatcgactggaaggagacccccgaggcgcacgtcttcaaggccgacctccccggcgtcaagaaggaggaggtcaaggtggaggtggaggacggcaatgtgctggtcatcagcggccagcgcagcaaggagaaggaggacaagaacgacaagtggcaccgcgtcgagcgcagcagcggccagttcatgaggcgcttccgcctgccggaggacgccaaggcgctactacagtctgtcgttgctctgctttggtgtgtgtactgttgttcagcctgccatggtagtgcctgctctggtgtcatgtgctagtctgtattttctatttagtctgtatgttcgactttctgcgagtgaataaataaataataaagcagttcttgt

SEQ ID NO: 9172 - protein, 146 aa, Panicum virgatum
  misc_feature: Ceres CLONE 2038816
  misc_feature (1)..(71): Pfam Name: HSP20 Pfam Description: Hsp20/alpha crystallin family
MSLVRRGNVFDPFSMDLWDPFDSMFRSIVPSSSSGSDTAAFANARIDWKETPEAHVFKADLPGVKKEEVKVEVEDGNVLVISGQRSKEKEDKNDKWHRVERSSGQFMRRFRLPEDAKALLQSVVALLWCVYCCSACHGSACSGVMC

SEQ ID NO: 9173 - DNA, 619 bp, Panicum virgatum
  misc_feature: Ceres CLONE 2039631
  misc_feature: Encodes the peptide sequence at SEQ ID NO. 9174
atcttctcagtagtacactcgctagctagctaagctgctatataaattaaattaaagctagtagtactgatcgatcggcatcgccggccggagatcgacatgacgacgatgatgaagaagcagcagcaagctgtggtgctgctgctgctgctgctgctggccgccggcggcgcgtctgcggcgtcgtgcaacgccgggcagctgacggtgtgcgcttcggcgctgacgtcgggcggcaagccctcggcggcgtgctgctccaacctcaaggcgcagcaggggtgcttctgccagttcgccaagaaccccgcattcgcgcgctacatcaacagccccaccgcgcgcaaggtcgtcgcatcctgcggcgtcgcactcccacgctgctagatagctacctcgctcattagttagctagctagctagctagctagctagcttatctgtatctatacatacatacatatatatgatcgctcgctcgctcgatcgatcttagtcgtctacgtgtggcttgctgctgttcatccagccgctcgctacgtgtgtgtgtgcgcgtatacacacacacacgacggataaataaaagatgcatgggttgcctccgggccgctccctatac

SEQ ID NO: 9174 - protein, 95 aa, Panicum virgatum
  misc_feature: Ceres CLONE 2039631
  misc_feature (1)..(66): Pfam Name: Tryp_alpha_amyl Pfam Description: Protease inhibitor/seed storage/LTP family
MTTMMKKQQQAVVLLLLLLLAAGGASAASCNAGQLTVCASALTSGGKPSAACCSNLKAQQGCFCQFAKNPAFARYINSPTARKVVASCGVALPRC

SEQ ID NO: 9175 - DNA, 464 bp, Panicum virgatum
  misc_feature: Ceres CLONE 2048136
  misc_feature: Encodes the peptide sequence at SEQ ID NO. 9176
ccatagctaaaacttcattgcctttttttttgttagccatagtgttttggaaaactgtaacctgtttctgatcaacttgggagggacatggctgggaggaacattggagttgcagtggacttctcatcatgcagcaaagcagctctgagatgggcatcgacgaaccttaccaggagtggtgataaactcatacttatccatgtgaagagctcctatcagaatgaacagggcgcagttcacctctgggaacagagtggttctccactcatccctctggctgagttctcagatgtcaccaagacatatggtgtgtctccagacaaggagacaatcgagttcgtggacctaagtggcacatcatgacaaattcgagggccgctggtgtatttaactcataaataaaccttcctgcccttgagattgctggataaatgaattactgactgaatccttacttccaccag

SEQ ID NO: 9176 - protein, 91 aa, Panicum virgatum
  misc_feature: Ceres CLONE 2048136
  misc_feature (1)..(82): Pfam Name: Usp Pfam Description: Universal stress protein family
MAGRNIGVAVDFSSCSKAALRWASTNLTRSGDKLILIHVKSSYQNEQGAVHLWEQSGSPLIPLAEFSDVTKTYGVSPDKETIEFVDLSGTS

SEQ ID NO: 9177 - protein, 513 aa, Arabidopsis thaliana
  misc_feature: CDNA 2032973
  misc_feature: Useful for making plants with modulated biomass
  misc_feature: Useful for making plants with modulated heat sensitivity
MFETEHHTLLPLLLLPSLLSLLLFLILLKRRNRKTRFNLPPGKSGWPFLGETIGYLKPYTATTLGDFMQQHVSKYGKIYRSNLFGEPTIVSADAGLNRFILQNEGRLFECSYPRSIGGILGKWSMLVLVGDMHRDMRSISLNFLSHARLRTILLKDVERHTLFVLDSWQQNSIFSAQDEAKKFTFNLMAKHIMSMDPGEEETEQLKKEYVTFMKGVVSAPLNLPGTAYHKALQSRATILKFIERKMEERKLDIKEEDQEEEEVKTEDEAEMSKSDHVRKQRTDDDLLGWVLKHSNLSTEQILDLILSLLFAGHETSSVAIALAIFFLQACPKAVEELREEHLEIARAKKELGESELNWDDYKKMDFTQCVINETLRLGNVVRFLHRKALKDVRYKGYDIPSGWKVLPVISAVHLDNSRYDQPNLFNPWRWQQQNNGASSSGSGSFSTWGNNYMPFGGGPRLCAGSELAKLEMAVFIHHLVLKFNWELAEDDKPFAFPFVDFPNGLPIRVSRIL

SEQ ID NO: 9178 - protein, 410 aa, Arabidopsis thaliana
  misc_feature: CLONE 28635
  misc_feature: Useful for making plants with altered sterol content
MGSLGTMLRYPDDIYPLLKMKRAIEKAEKQIPPEPHWGFCYSMLHKASRSFSLVIQQLNTELRNAVCVFYLVLRALDTVEDDTSIPTDEKVPILIAFHRHIYDTDWHYSCGTKEYKILMDQFHHVSAAFLELEKGYQEAIEEITRRMGAGMAKFICQEVETVDDYDEYCHYVAGLVGLGLSKLFLAAGSEVLTPDWEVISNSMGLFLQKTNIIRDYLEDINEIPKSRMFWPREIWGKYADKLEDLKYEENTNKSVQCLNEMVTNALMHIEDCLKYMVSLRDPSIFRFCAIPQIMAIGTLALCYNNEQVFRGVVKLRRGLTAKVIDRTKTMADVYGAFYDFSCMLKTKVDKNDPNASKTLNRLEAVQKLCRDAGVLQNRKSYVNDKGQPNSVFIIMVVILLAIVFAYLRAN

SEQ ID NO: 9179 - protein, 431 aa, Arabidopsis thaliana
  misc_feature: CLONE 21240
  misc_feature: Useful for making plants with altered Lignin content
  misc_feature: Useful for making plants with altered sterol content
  misc_feature: Useful for making plants with altered terpenoid content
  misc_feature: Useful for making plants with modulated flowering time
MAFHHNHLSQDLSFNHFTDQHQPPPPQPPPPPPQQQQHFQEAPPPNWLNTALLRSSDNNNNFLNLHTATANTTTASSSDSPSSAAAAAAANQWLSLSSSFLQRNNNNNASIVGDGIDDVTGGADTMIQGEMKTGGGENKNDGGGATAADGVVSWQNARHKAEILSHPLYEQLLSAHVACLRIATPVDQLPRIDAQLAQSQHVVAKYSALGAAAQGLVGDDKELDQFMTHYVLLLCSFKEQLQQHVRVHAMEAVMACWEIEQSLQSLTGVSPGEGMGATMSDDEDEQVESDANMFDGGLDVLGFGPLIPTESERSLMERVRQELKHELKQGYKEKIVDIREEILRKRRAGKLPGDTTSVLKAWWQSHSKWPYPTEEDKARLVQETGLQLKQINNWFINQRKRNWHSNPSSSTVLKNKRKSNAGDNSGRERFA

SEQ ID NO: 9180 - protein, 107 aa, Arabidopsis thaliana
  misc_feature: Ceres CLONE 1001761
  misc_feature: Useful for making plants with altered Lignin content
  misc_feature (92)..(92): Xaa is any aa, unknown, or other
MSSRGKRKDEDVRASDDESETHAPAKKVAKPADDSDQSDDIVVCNISKNRRVSVRNWNGKIWIDIREFYVKDGKTLPGKKGISLSVDQWNTXRNHAEDIEKALSDLS

SEQ ID NO: 9181 - protein, 363 aa, Arabidopsis thaliana
  misc_feature: Ceres CLONE 100245
  misc_feature: Useful for biocontainment applications
  misc_feature: Useful for making plants with modulated biomass
  misc_feature: Useful for making plants with modulated time to senescence
  misc_feature: No seed is being produced by the plant
  misc_feature: The plant is abnormally small.
  misc_feature: The plant senesces significantly late compared to wild-type.
MDKYELVKDIGAGNFGVARLMKVKNSKELVAMKYIERGPKIDENVAREIINHRSLRHPNIIRFKEVVLTPTHLAIAMEYAAGGELFERICSAGRFSEDEARYFFQQLISGVSYCHAMQICHRDLKLENTLLDGSPAPRLKICDFGYSKSSLLHSRPKSTVGTPAYIAPEVLSRREYDGKMADVWSCGVTLYVMLVGAYPFEDQEDPKNFRKTIQKIMAVQYKIPDYVHISQDCKNLLSRIFVANSLKRITIAEIKKHSWFLKNLPRELTETAQAAYFKKENPTFSLQTVEEIMKIVADAKTPPPVSRSIGGFGWGGNGDADGKEEDAEDVEEEEEEVEEEEDDEDEYDKTVKEVHASGEVRIS

SEQ ID NO: 9182 - protein, 263 aa, Arabidopsis thaliana
  misc_feature: Ceres CLONE 100319
  misc_feature: Useful for biocontainment applications
  misc_feature: Useful for making plants with altered alkaloid content
  misc_feature: The plant produces a reduced number of seeds.
MLSIPDTRMWNLASSYLTGNIGPKNDIRRPVHAHAECSDDDVSSVGSKDEGLECPICWESFNIVENVPYVLWCGHTMCKNCILGLQWAIVKLPTHPVQLPLFISCPWCNLLSFRLVFRGTLRFPHKNYFVLWMVERMNGERRNSPGGAQTDGNNDHTRETPSPCLHNRHHRSQPEPSRSVNDHRIPRDNIQTSLRKSLVFFVQLTAKFPLVVIFLLIILYAIPTSAAILAMYILVTLLLALPSFLILYFAYPCLDWLVREIVT

SEQ ID NO: 9183 - protein, 128 aa, Arabidopsis thaliana
  misc_feature: Ceres CLONE 1003205
  misc_feature: Useful for making plants with altered Lignin content
  misc_feature: Useful for making plants with modulated biomass
  misc_feature: Useful for making plants with modulated nitrogen use efficiency
  misc_feature: The plant is abnormally small.
MSEVEYRCFVGGLAWATNDEDLQRTFSQFGDVIDSKIINDRESGRSRGFGFVTFKDEKAMRDAIEEMNGKELDGRVITVNEAQSRGSGGGGGGRGGSGGGYRSGGGGGYSGGGGGGYSGGGGGGYERR

SEQ ID NO: 9184 - protein, 80 aa, Arabidopsis thaliana
  misc_feature: Ceres CLONE 10077
  misc_feature: Useful for making plants with modulated cold sensitivity
MKKTGIIAASISVAASATAISAGSTNTSVSFSSPESNLSRQEAKEKQRKKKGSSEDGGYEKFAPRFDGLRFIETLVTAHR

SEQ ID NO: 9185 - protein, 130 aa, Arabidopsis thaliana
  misc_feature: Ceres CLONE 1011900
  misc_feature: Useful for making plants with altered Lignin content
  misc_feature: Useful for making plants with modulated nitrogen use efficiency
MASGDVEYRCFVGGLAWATDDRALETAFAQYGDVIDSKIINDRETGRSRGFGFVTFKDEKAMKDAIEGMNGQDLDGRSITVNEAQSRGSGGGGGHRGGGGGGYRSGGGGGYSGGGGSYGGGGGRREGGGW

SEQ ID NO: 9186 - protein, 464 aa, Arabidopsis thaliana
  misc_feature: Ceres CLONE 101686
  misc_feature: Useful for making plants with modulated nitrogen use efficiency
MSRLLQTPFLPSVSLPTKTRSSVTGFRVKPRIIPIQAKIREIFMPALSSTMTEGKIVSWVKSEGDKLNKGESVVVVESDKADMDVETFYDGYLAAIMVEEGGVAPVGSAIALLAETEDEIADAKAKASGGGGDSKAPPPASPPTATVVAPVAVEKKIAAPPVAIKAVAASAVHPASEGGKRIVASPYAKKLAKELNVELAGLVGSGPMGRIVAKDVEAVAAGGGVQAAVAVKEVVAVPGVELGSVVPFTTMQGAVSRNMVESLAVPTFRVGYTISTDALDALYKKIKSKGVTMTALLAKATALALAKHPVVNSSCRDGNSFVYNSSINVAVAVAIDGGLITPVLQNADKVDIYSLSRKWKELVDKARAKQLQPQEYNTGTFTLSNLGMFGVDRFDAILPPGTGAIMAVGASQPSVVATKDGRIGMKNQMQVNVTADHRVIYGADLAQFLQTLASIIEDPKDLTF

SEQ ID NO: 9187 - protein, 599 aa, Arabidopsis thaliana
  misc_feature: HVG ID no. 102
  misc_feature: Useful for making plants with modulated drought sensitivity
MASFTATAAVSGRWLGGNHTQPPLSSSQSSDLSYCSSLPMASRVTRKLNVSSALHTPPALHFPKQSSNSPAIVVKPKAKESNTKQMNLFQRAAAAALDAAEGFLVSHEKLHPLPKTADPSVQIAGNFAPVNEQPVRRNLPVVGKLPDSIKGVYVRNGANPLHEPVTGHHFFDGDGMVHAVKFEHGSASYACRFTQTNRFVQERQLGRPVFPKAIGELHGHTGIARLMLFYARAAAGIVDPAHGTGVANAGLVYFNGRLLAMSEDDLPYQVQITPNGDLKTVGRFDFDGQLESTMIAHPKVDPESGELFALSYDVVSKPYLKYFRFSPDGTKSPDVEIQLDQPTMMHDFAITENFVVVPDQQVVFKLPEMIRGGSPVVYDKNKVARFGILDKYAEDSSNIKWIDAPDCFCFHLWNAWEEPETDEVVVIGSCMTPPDSIFNESDENLKSVLSEIRLNLKTGESTRRPIISNEDQQVNLEAGMVNRNMLGRKTKFAYLALAEPWPKVSGFAKVDLTTGEVKKHLYGDNRYGGEPLFLPGEGGEEDEGYILCFVHDEKTWKSELQIVNAVSLEVEATVKLPSRVPYGFHGTFIGADDLAKQVV

SEQ ID NO: 9188 - protein, 195 aa, Arabidopsis thaliana
  misc_feature: Ceres CLONE 1025179
  misc_feature: Useful for making plants with modulated low light sensitivity
MDHIIGFMGTTNMSHNTNLMIAAAATTTTTSSSSSSSSGGSGTNQLSRYENQKRRDWNTFGQYLRNHRPPLSLSRCSGAHVLEFLRYLDQFGKTKVHTHLCPFFGHPNPPAPCACPLRQAWGSLDALIGRLRAAFEENGGSPETNPFGARAVRLYLREVRDSQAKARGISYEKKKRKRPPPPLPPAQPAISSSPN

SEQ ID NO: 9189 - protein, 819 aa, Arabidopsis thaliana
  misc_feature: HVG ID no. 103
  misc_feature: Useful for making plants with modulated drought sensitivity
MEAFLKEFGDYYGYPDGPKNIQEIRDTEFKRLDKGVVYLDHAGSTLYSELQMEYIFKDFTSNVFGNPHSQSDISSATSDLIADARHQVLEYFNASPEDYSCLFTSGATAALKLVGETFPWTQDSNFLYTMENHNSVLGIREYALAQGASACAVDIEEAANQPGQLTNSGPSIKVKHRAVQMRNTSKLQKEESRGNAYNLFAFPSECNFSGLRFNLDLVKLMKENTETVLQGSPFSKSKRWMVLIDAAKGCATLPPDLSEYPADFVVLSFYKLFGYPTGLGALLVRNDAAKLLKKTYFSGGTVAASIADIDFVKRRERVEEFFEDGSASFLSIAAIRHGFKLLKSLTPSAIWMHTTSLSIYVKKKLQALRHGNGAAVCVLYGSENLELSSHKSGPTVTFNLKRPDGSWFGYLEVEKLASLSGIQLRTGCFCNPGACAKYLELSHSELRSNVEAGHICWDDNDVINGKPTGAVRVSFGYMSTFEDAKKFIDFIISSFASPPKKTGNGTVVSGRFPQLPSEDLESKESFPSHYLKSITVYPIKSCAGFSVIRWPLCRTGLLHDREWMVQGLTGEILTQKKVPEMSLIKTFIDLEEGLLSVESSRCEDKLHIRIKSDSYNPRNDEFDSHANILENRNEETRINRWFTNAIGRQCKLLRYSSSTSKDCLNRNKSPGLCRDLESNINFANEAQFLLISEESVADLNRRLEAKDEDYKRAHEKLNPHRFRPNLVISGGEPYGEDKWKTVKIGDNHFTSLGGCNRCQMINISNEAGLVKKSNEPLTTLASYRRVKGKILFGTLLRYEIDEKRQCWIGVGEEVNPDIE

SEQ ID NO: 9190 - protein, 106 aa, Arabidopsis thaliana
  misc_feature: Ceres CLONE 10381
  misc_feature: Useful for making plants with modulated nitrogen use efficiency
  misc_feature: Useful for making plants with modulated oxidative stress sensitivity
MSSAVDATGNPIPTSAVLTASAKHIGMRCMPENVAFLKCKKNDPNPEKCLDKGRDVTRCVLGLLKDLHQKCQKEMDDYVGCMYYYTNEFDLCRKEQEAFEKVCPLK

SEQ ID NO: 9191 - protein, 210 aa, Glycine max
  misc_feature: CLONE 674166
  misc_feature: Useful for making plants with modulated cold sensitivity
MGRGGTAAAAAEVAEPGLRPVYFKEQRYRGVRKRPWGRFAAEIRDPLKKARVWLGTFDTAEEAARAYDTAARTLRGPKAKTNFPLSPPFYHPDPFSDHRHFANTGEDFHDHRRPTSSGMSSTVESFSGPRAAVPATAPVATGRRYPRTPPVIPEDCRSDCDSSSSVVDDGEGDNVASSFPREPLPFDLNALPLDDADVATDDLFCTVLCL

SEQ ID NO: 9192 - protein, 326 aa, Arabidopsis thaliana
  misc_feature: Ceres CLONE 105162
  misc_feature: Useful for making plants with altered Lignin content
MSRSLVFFFLFLVLVVPCLSHGTGGDHDDDEAPHVKSSDLKSKSLISVKIACLVIIFVLTFISGVSPYFLKWSQGFLVLGTQFAGGVFLATALMHFLSDADETFRDLLTAEGESEPSPAYPFAYMLACAGFMLTMLADSVIAHIYSKTQNDLELQGEDKSNQRSATTETSIGDSILLIVALCFHSVFEGIAIGISETKSDAWRALWTITLHKIFAAIAMGIALLRMIPDRPLFSSITYSFAFAISSPIGVAIGIVIDATTQGSIADWIFALSMSLACGVFVYVSVNHLLAKGYRPNKKVHVDEPRYKFLAVLFGVVVIAIVMIWDT

SEQ ID NO: 9193 - protein, 130 aa, Arabidopsis thaliana
  misc_feature: Ceres CLONE 10525
  misc_feature: Useful for making plants with modulated nitrogen use efficiency
MAFDLHHGSASDTHSSELPSFSLPPYPQMIMEAIESLNDKNGCNKTTIAKHIESTQQTLPPSHMTLLSYHLNQMKKTGQLIMVKNNYMKPDPDAPPKRGRGRPPKQKTQAESDAAAAAVVAATVVSTGSA

SEQ ID NO: 9194 - protein, 789 aa, Arabidopsis thaliana
  misc_feature: HVG ID no. 106
  misc_feature: Useful for making plants with modulated flowering time
MVSFSAPKKRRRGRSQRSMSSLNSLPVPNVGLLPGNSNFVSSSASSSGRFNVEVVNGSNQTVKSYPGIGDEIITINKEATTEALLALTAGFPADSLTEEEIEFGVVPIVGGIEQVNYILIRNHIISKWRENISSWVTKEMFLNSIPKHCSSLLDSAYNYLVTHGYINFGIAQAIKDKFPAQSSKSSVIIVGAGLSGLAAARQLMRFGFKVTVLEGRKRPGGRVYTKKMEANRVGAAADLGGSVLTGTLGNPLGIIARQLGSSLYKVRDKCPLYRVDGKPVDPDVDIKVEVAFNQLLDKASKLRQLMGDVSMDVSLGAALETFRQVSGNDVATEEMGLFNWHLANLEYANAGLVSKLSLAFWDQDDPYDMGGDHCFLPGGNGRLVQALAENVPILYEKTVQTIRYGSNGVKVTAGNQVYEGDMVLCTVPLGVLKNGSIKFVPELPQRKLDCIKRLGFGLLNKVAMLFPYVFWSTDLDTFGHLTEDPNYRGEFFLFYSYAPVAGGALLIALVAGEAAHKFETMPPTDAVTRVLHILRGIYEPQGINVPDPLQTVCTRWGGDPFSLGSYSNVAVGASGDDYDILAESVGDGRLFFAGEATTRRYPATMHGAFVTGLREAANMAQSAKARGIRKRIDRNPSRNAHSCAILLADLFRDPDLEFGSFCIIFSRRNPDPKSPAILRVTLSEPRKRNEDPKADQHSNKILFQQLQSHFNQQQQIQVYTLLTRQQALDLREVRGGDEKRLYYLCETLGVKLVGRKGLGVGADSVIASIKAERTGRKLPSSSTSGTKSG

SEQ ID NO: 9195 - protein, 231 aa, Glycine max
  misc_feature: CLONE 708396
  misc_feature: Useful for making plants with modulated flowering time
MVKSEHKIKTEPSSKAMRLSSPSSSTSDCKKKKYKGVRMRSWGSWVSEIRAPNQKTRIWLGSYSTPEAAARAYDAALLCLKGSSANLNFPLSSSQQYIPGDAVMSPKSIQRVAAAAANSFIDNATTPPSPPPASTPSSSSLASSPSLVSSPSDQIDDDALLISSFQAYTSCGQANQSMAVNVMEPWYTFGDGLQSPKYADQMLSGDFFHVDSSHLLDDLYEESDIRLWSFC

SEQ ID NO: 9196 - protein, 461 aa, Arabidopsis thaliana
  misc_feature: Ceres CLONE 106263
  misc_feature: Useful for making plants with modulated oxidative stress sensitivity
  misc_feature (88)..(88): Xaa is any aa, unknown, or other
  misc_feature (180)..(180): Xaa is any aa, unknown, or other
  misc_feature (243)..(243): Xaa is any aa, unknown, or other
  misc_feature (370)..(370): Xaa is any aa, unknown, or other
  misc_feature (377)..(377): Xaa is any aa, unknown, or other
MGKKAKWFSSVKKAFSPDSKKSKQKLAEGQNGVISNPPVVDNVRQSSSSPPPALAPREVRVAEVIVERNRDLSPPSTADAVNVTATDXPVVPSSSAPGVVRRATPTRFAGKSNEEAAAILIQTIFRGYLARRALRAMRGLVRLKLLMEGSVVKRQAANTLKCMQTLSRVQSQIRARRIRXSEENQARQKQLLQKHAKELAGLKNGDNWNDSIQSKEKVEANLLSKYEATMRRERALAYSYSHXQNWKNNSKSGNPMFMDPSNPTWGWSWLERWMAGRPLESSEKEQSNSNNDNAASVKGSINRNEAAKSLTRNGSTQPNTPSSARGTPRNKNSFFSPPTPSRLNQSSRKSNDDDSKSTISVLSERNRRHXIAGSSVXDDESLAGSPALPSYMVPTKSARARLKPQSPLGGTTQENEGFTDKASAKKRLSYPTSPALPKPRRFSAPPKVESGGVTVTNGAGS

SEQ ID NO: 9197 - protein, 291 aa, Arabidopsis thaliana
  misc_feature: Ceres CLONE 106887
  misc_feature: Useful for making plants with altered Lignin content
MQEAALGMMGASVGGDGDAAVVAEQNRQLKGEIATHPMYEQLLAAHVACLRVATPIDQLPIIEAQLSQSHHLLRSYASTAVGYHHDRHELDNFLAQYVMVLCSFKEQLQQHVRVHAVEAVMACREIENNLHSLTGATLGEGSGATMSEDEDDLPMDFSSDNSGVDFSGGHDMTGFGPLLPTESEKSLMERVRQELKLELKQGFKSRIEDVREEIMRKRRAGKLPGDTTTVLKNWWQQHCKWPYPTEDDKAKLVEETGLQLKQINNWFINQRKRNWHNNSHSLTSLKSKRKH

SEQ ID NO: 9198 - protein, 444 aa, Arabidopsis thaliana
  misc_feature: Ceres CLONE 107731
  misc_feature: Useful for making plants with modulated flowering time
  misc_feature: The plant flowers significantly late compared to wild-type.
MREILHIQGGQCGNQIGAKFWEVICDEHGIDHTGQYVGDSPLQLERIDVYFNEASGGKYVPRAVLMDLEPGTMDSLRSGPFGQIFRPDNFVFGQSGAGNNWAKGHYTEGAELIDSVLDVVRKEAENSDCLQGFQVCHSLGGGTGSGMGTLLISKIREEYPDRMMMTFSVFPSPKVSDTVVEPYNATLSVHQLVENADECMVLDNEALYDICFRTLKLANPTFGDLNHLISATMSGVTCCLRFPGQLNSDLRKLAVNLIPFPRLHFFMVGFAPLTSRGSQQYSALSVPELTQQMWDAKNMMCAADPRHGRYLTASAVFRGKLSTKEVDEQMMNIQNKNSSYFVEWIPNNVKSSVCDIAPKGLKMASTFIGNSTSIQEMFRRVSEQFTAMFRRKAFLHWYTGEGMDEMEFTEAESNMNDLVAEYQQYQDATAGEEEYEEEEEEYET

SEQ ID NO: 9199 - protein, 309 aa, Arabidopsis thaliana
  misc_feature: Ceres CLONE 107973
  misc_feature: Useful for making plants with modulated salt sensitivity
  misc_feature: Useful for making plants with modulated nitrogen use efficiency
MTTPPVLSLALPSDTGRVLSIQSHTVQGYVGNKSAVFPLQLLGYDVDPINSVQFSNHTGYPTFKGQVLNGQQLCDLIEGLEANDLLFYTHVLTGYIGSVSFLDTILEVINKLRSVNPNLTYVCDPVMGDEGKLYVPEELVHVYREKVVPLASMLTPNQFEAEKLTGLRINSEEDGREACAILHAAGPSKVVITSITIGGILLLIGSHQKEKGLKPEQFKILIHKIPAYFTGTGDLMTALLLGWSNKYPDNLDKAAELAVSTLQALLRRTLDDYKRAGYDPTSSSLEIRLIQSQEDIRNPKVELKAERYS

SEQ ID NO: 9200 - protein, 311 aa, Zea mays
  misc_feature: CLONE 375578
  misc_feature: Useful for making plants with modulated oxidative stress sensitivity
  misc_feature: Useful for making plants with modulated salt sensitivity
  misc_feature: Useful for making plants with modulated salt sensitivity
MTRVQTQIYSRRVKLEEEKQALQRQLQLKHQRELEKMKIDEDWDHSHQSKEQIEANLMMKQEAALRRERALAYAFSHQWRNSGRTITPTFTEPGNPNWGWSWMERWMTARPWESRLAAASDKDPKERAVTKNASTSAVRVPVSRAISIQRPATPNKSSRPPSRQSLSTPPSKTPSASGKARPASPRNSWLYKEDDLRSITSIRSERPRRQSTGGGSVRDDTSLTSTPPLPSYMQSTESARAKSRYRSLLLTEKLEVPERAPLAHSVVKKRLSFPVVEKPSVVPTEKPRERVRRHSDPPKVDPATLKDAPAA

SEQ ID NO: 9201 - protein, 311 aa, Zea mays subsp. mays; identical to SEQ ID NO: 9200
  misc_feature: CLONE 375578
  misc_feature: Useful for making plants with modulated oxidative stress sensitivity
  misc_feature: Useful for making plants with modulated salt sensitivity
  misc_feature: Useful for making plants with modulated salt sensitivity

SEQ ID NO: 9202 - protein, 151 aa, Arabidopsis thaliana
  misc_feature: Ceres CLONE 108200
  misc_feature: Useful for making plants with modulated nitrogen use efficiency
MGRMHSRGKGISASALPYKRSSPSWLKTTPQDVDESICKFAKKGLTPSQIGVILRDSHGIPQVKSVTGSKILRILKAHGLAPEIPEDLYHLIKKAVAIRKHLERNRKDKDSKFRLILVESRIHRLARYYKKTKKLPPVWKYESTTASTLVA

SEQ ID NO: 9203 - protein, 193 aa, Arabidopsis thaliana
  misc_feature: Ceres CLONE 108362
  misc_feature: Useful for making plants with altered Lignin content
  misc_feature: Useful for making plants with altered cell wall content and/or composition
MTAALSTALFNDGASCGECYRITCDHAADSRWCLKGASVVITATNFCPPNFALPNNNGGWCNPPLKHFDMAQPAWEKIGIYRGGIVPVVFQRVSCYKKGGVRFRINGRDYFELVNIQNVGGAGSIKSVSIKGSKTGWLAMSRNWGANWQSNAYLDGQALSFSITTTDGATRVFLNVVPSSWSFGQIYSSNVQF

SEQ ID NO: 9204 - protein, 276 aa, Arabidopsis thaliana
  misc_feature: HVG ID no. 109
  misc_feature: Useful for making plants with altered carbon content
MAASTLYKSCLLQPKSGSTTRRLNPSLVNPLTNPTRVSVLGKSRRDVFAKASIEMAESNSIPSVVVNSSKQHGPIIVIDNYDSFTYNLCQYMGELGCHFEVYRNDELTVEELKKKNPRGVLISPGPGTPQDSGISLQTVLELGPLVPLFGVCMGLQCIGEAFGGKIVRSPFGVMHGKSSMVHYDEKGEEGLFSGLSNPFIVGRYHSLVIEKDTFPSDELEVTAWTEDGLVMAARHRKYKHIQGVQFHPESIITTEGKTIVRNFIKIVEKKESEKLT

SEQ ID NO: 9205 - protein, 303 aa, Arabidopsis thaliana
  misc_feature: CLONE 105319
  misc_feature: Useful for making plants with modulated salt sensitivity
MEAAITQRIQYPSWVDCRKVECKPQRGSLRYSQQVKVDRRFRGLSLARLQPERRIDQRRAVSPAVSCSDNNSSALLETGSVYPFDEDILKRKAEEVKPYLNGRSMYLVGMMGSGKTTVGKLMSKVLGYTFFDCDTLIEQAMNGTSVAEIFVHHGENFFRGKETDALKKLSSRYQVVVSTGGGAVIRPINWKYMHKGISIWLDVPLEALAHRIAAVGTDSRPLLHDESGDAYSVAFKRLSAIWDERGEAYTNANARVSLENIAAKRGYKNVSDLTPTEICIEAFEQVLSFLEKEETMEIPDGDL

SEQ ID NO: 9206 - protein, 593 aa, Arabidopsis thaliana
  misc_feature: Ceres CLONE 109490
  misc_feature: Useful for making plants with altered Lignin content
  misc_feature: Useful for making plants with altered alkaloid content
MVEQTVVREHIKARVMSLVRSAEPSSYRNPKLYTLNENGNNNGVSSAQIFDPDRSKNPCLTDDSYPSQSYEKYFLDSPTDEFVQHPIGSGASVSSFGSLDSFPYQSRPVLGCSMEFQLPLDSTSTSSTRLLGDYQAVSYSPSMDVVEEFDDEQMRSKIQELERALLGDEDDKMVGIDNLMEIDSEWSYQNESEQHQDSPKESSSADSNSHVSSKEVVSQATPKQILISCARALSEGKLEEALSMVNELRQIVSIQGDPSQRIAAYMVEGLAARMAASGKFIYRALKCKEPPSDERLAAMQVLFEVCPCFKFGFLAANGAILEAIKGEEEVHIIDFDINQGNQYMTLIRSIAELPGKRPRLRLTGIDDPESVQRSIGGLRIIGLRLEQLAEDNGVSFKFKAMPSKTSIVSPSTLGCKPGETLIVNFAFQLHHMPDESVTTVNQRDELLHMVKSLNPKLVTVVEQDVNTNTSPFFPRFIEAYEYYSAVFESLDMTLPRESQERMNVERQCLARDIVNIVACEGEERIERYEAAGKWRARMMMAGFNPKPMSAKVTNNIQNLIKQQYCNKYKLKEEMGELHFCWEEKSLIVASAWR

SEQ ID NO: 9207 - protein, 270 aa, Arabidopsis thaliana
  misc_feature: Ceres CLONE 110428
  misc_feature: Useful for making plants with altered Lignin content
MGDTAEDQDDRAMMEAEGVTSFSELLMFSDGVLSSSSDHQPEGNVGDGGEDSLGFVFSGKTGSRMLCFSGGYQNDDESLFLEPSVPTSGVSDLDPSCIKIDCRNSNDACTVDKSTKSSTKKRTGTGNGQESDQNRKPGKKGKRNQDKSSVGIAKVRKERLGERIAALQQLVSPYGKTDAASVLHEAMGYIKFLQDQIQVLCSPYLINHSLDGGVVTGDVMAAMKAKDLRSRGLCLVPVSSTVHVENSNGADFWSPATMGHTTSPSLPQGF

SEQ ID NO: 9208 - protein, 304 aa, Brassica napus
  misc_feature: Ceres CLONE 1105554
  misc_feature: Useful for making plants with modulated biomass
  misc_feature: Useful for making plants with modulated flowering time
  misc_feature: The plant flowers significantly late compared to wild-type.
  misc_feature: The plant is abnormally small.
  misc_feature: The rosette leaves do not appear in the normal fashion, i.e., their phyllotaxy may be abnormal or too many leaves may be emerging in comparison to the control.
MMTNLSLAREGEAEAKKPIEKVEREHMFDKVVTPSDVGKLNRLVIPKQHAERYFPLDSSSNGKGLLLNFEDLTGKSWRFRYSYWNSSQSYVMTKGWSRFVKDKKLDAGDIVSFQRCVGDSRLFIDWRRRPKVPDYPTSTAHFAGGVMFPRFYSFPTATTSTCYDLYNHQPPRHHHIGYGYPQIPREFGYGYFVRSVDQRSVVADPLVIESVPVMMRGGARVSQEVVGTAGKRLRLFGVDMECGESGVTNSTEEESSSSGGSLPRAGGGGASSSSSLFQLRLGSSCEDDHFSKKGKSSLPFDLDQ

SEQ ID NO: 9209 - protein, 254 aa, Arabidopsis thaliana
  misc_feature: Ceres CLONE 11114
  misc_feature: Useful for making plants with altered Lignin content
  misc_feature: Useful for making plants with altered cell wall content and/or composition
MAKMQLSIFIAVVALIVCSASAKTASPPAPVLPPTPAPAPAPENVNLTELLSVAGPFHTFLDYLLSTGVIETFQNQANNTEEGITIFVPKDDAFKAQKNPPLSNLTKDQLKQLVLFHALPHYYSLSEFKNLSQSGPVSTFAGGQYSLKFTDVSGTVRIDSLWTRTKVSSSVFSTDPVAVYQLNRVLLPEAIFGTDVPPMPAPAPAPIVSAPSDSPSVADSEGASSPKSSHKNSGQKLLLAPISMVISGLVALFL

SEQ ID NO: 9210 - protein, 204 aa, Arabidopsis thaliana
  misc_feature: Ceres CLONE 11130
  misc_feature: Useful for making plants with altered alkaloid content
  misc_feature: Useful for making plants with altered terpenoid content
RRTTTTTTTTHEEEEEKLMAGGGTEAFPDLGEHCQDPDCKLLDFLPFTCDGCKLVFCLEHRSYKSHNCPKSDHGSRTVSICETCSIAIETTGFDERGIKSLLEKHERSGDCDPNKKKKPTCPVKRCKEILTFANNLTCKDCGVKFCLKHRFPTDHVCNKKTINTAGTRSRWNERFMEALSLRNQKGCGRGSSVSSKSPASVRSF

SEQ ID NO: 9211 - protein, 259 aa, Arabidopsis thaliana
  misc_feature: Ceres CLONE 111598
  misc_feature: Useful for making plants with altered alkaloid content
MEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRSINPQTIMLGQEPRQTTSNLGHLNKPSIQALIHGLNRHYYSIAINYRKNELEEKMLLNLHKKKWTDGLTLRRFDTHSKTNEQTVQEMLSLAAKYNKAVQEEDELSPEKLAIVNVGRQDAKKHLEEHVSNLMSSNIVQTLGTMLDTVVF

SEQ ID NO: 9212 - protein, 246 aa, Arabidopsis thaliana
  misc_feature: Ceres CLONE 112194
  misc_feature: Useful for making plants with altered Lignin content
  misc_feature (98)..(98): Xaa is any aa, unknown, or other
MKIQCNVCEAAEATVLCCADEAALCWACDEKIHAANKLAGKHQRVPLSASASSIPKCDICQEASGFFFCLQDRALLCRKCDVAIHTVNPHVSAHQRFXLTGIKVGLESIDTGPSTKSSPTNDDKTMETKPFVQSIPEPQKMAFDHHHHQQQQEQQEGVIPGTKVNDQTSTKLPLVSSGSTTGSIPQWQIEEIFGLTDFDQSYEYMENNGSSKADTSRRGDSDSSSMMRSAEEDGEDNNNCLGGETS

SEQ ID NO: 9213 - protein, 121 aa, Arabidopsis thaliana
  misc_feature: Ceres CLONE 112423
  misc_feature: Useful for making plants with modulated biomass
  misc_feature: Useful for making plants with modulated nitrogen use efficiency
  misc_feature: The plant is abnormally small.
MAASASSLALSSFNPKSLPFGVSRPASVSLLSPSLSFKLNSDSVSFSIAAKWNSPASRFARNVAITSEFEVEEDGFADVAPPKEQSFSADLKLFVGNLPFNVDSAQLAQLFESAGEFHLAA

SEQ ID NO: 9214 - protein, 228 aa, Brassica napus
  misc_feature: Ceres CLONE 1125760
  misc_feature: Useful for making plants with modulated nitrogen use efficiency
MGRAPCCDKENVKRGPWSPEEDAKLKDYIEKQGTGGNWITLPRKAGLRRCGKSCRLRWLNYLRPNIRHGDFTEEEDNIICSLFASIGSRWSVIAAHLHGRTDNDIKNYWNTKLKKKLMATMAPPRNHHLSAIASSSSSSPSPSSHYNMINSLLPYDPSMSTNQLITPHRGMMTMMGQQQQLLYQEDMGSLVNSPNNNKFVMSHQDDSQKQSTNKGIMLLSDVRSGGRE

SEQ ID NO: 9215 - protein, 92 aa, Glycine max
  misc_feature: CLONE 560948
  misc_feature: Useful for making plants with altered Lignin content
  misc_feature: Useful for making plants with modulated nitrogen use efficiency
MSSRRSRQHSGSTRISDDQIIELVSKLRQLVPEIRNRRSDKVSASKVLQETCNYIRGLHREVSDLSERLSQLLTTIDADSAEAGIIRSLLNQ

SEQ ID NO: 9216 - protein, 359 aa, Arabidopsis thaliana
  misc_feature: Ceres CLONE 113719
  misc_feature: Useful for making plants with modulated biomass
  misc_feature: The plant is abnormally small.
MGIGKYVTSDTFMVGGYSWAIYFYPDGKSPEDNSVYVSLFIALASEGADVRALFELTLVDQSGNERHKVHSHFGRTLESGPYTLKYRGSMWGYKRFFKRSLLESSDYLKDNGLLVRCCVGVVKSRTEGPRCYNIPVPVSGLGQQFGKLLESGKGADVTFEVDGETFPAHKLVLAARSAVFRAQLFGPLRSENTNCIIIEDVQAPIFKMLLHFIYWDEMPDMQDLIGTDLKWASTLVAQHLLAAADRYALERLRTICESKLCEGISINTVATTLALAEQHHCFQLKATCLKFIALPENLKAVMETDGFDYLKESCPSLLSELLEYVARLSEHSLTSSGHRKELFADGCDLNGRRVKQRLH

SEQ ID NO: 9217 - protein, 74 aa, Arabidopsis thaliana
  misc_feature: Ceres CLONE 11394
  misc_feature: Useful for making plants with altered cell wall content and/or composition
  misc_feature: Useful for making plants with modulated salt sensitivity
  misc_feature: Useful for making plants with modulated nitrogen use efficiency
  misc_feature: Useful for making plants with modulated salt sensitivity
MASRNSVAVIALFAFVFAVISPFAGAQSLAPAPSPTSDGTSIDQGIAYLLMVVALVLTYLIHPLDASSSSYTFF

SEQ ID NO: 9218 - protein, 87 aa, Zea mays
  misc_feature: CLONE 336524
  misc_feature: Useful for making plants with altered terpenoid content
  misc_feature: Useful for making plants with modulated nitrogen use efficiency
MSSGGRRGRISDDEINELISKLQALLPESSRRRNASRSSASKLLKETCAYVKSLHREVDDLSERLSGLMETMDNDSPQAEIIRSLLR

SEQ ID NO: 9219 - protein, 269 aa, Arabidopsis thaliana
  misc_feature: Ceres CLONE 114015
  misc_feature: Useful for making plants with altered alkaloid content
MQTEELLSPPQTPWWNAFGSQPLTTESLSGEASDSFTGVKAVTTEAEQGVVDKQTSTTLFTFSPGREKSSRDVPKPHVAFAMQSACFEFGFAQPMMYTKHPHVEQYYGVVSAYGSQRSSGRVMIPLKMETEEDGTIYVNSKQYHGIIRRRQSRAKAEKLSRCRKPYMHHSRHLHAMRRPRGSGGRFLNTKTADAAKQSKPSNSQSSEVFHPENETINSSREANESNLSDSAVTSMDYFLSSSAYSPGGMVMPIKWNAAAMDIGCCKLNI

SEQ ID NO: 9220 - protein, 433 aa, Arabidopsis thaliana
  misc_feature: Ceres CLONE 114130
  misc_feature: Useful for making plants with altered Lignin content
  misc_feature: Useful for making plants with altered cell wall content and/or composition
MKINIRDSTMVRPATETPITNLWNSNVDLVIPRFHTPSVYFYRPTGASNFFDPQVMKEALSKALVPFYPMAGRLKRDDDGRIEIDCNGAGVLFVVADTPSVIDDFGDFAPTLNLRQLIPEVDHSTGIHSFPLLVLQVTFFKCGGASLGVGMQHHAADGFSGLHFINTWSDMARGLDLTIPPFIDRTLLRARDPPQPAFHHVEYQPAPSMKIPLDPSKSGPENTTVSIFKLTRDQLVALKAKSKEDGNTVSYSSYEMLAGHVWRSVGKARGLPNDQETKLYIATDGRSRLRPQLPPGYFGNVIFTATPLAVAGDLLSKPTWYAAGQIHDFLVRMDDNYLRSALDYLEMQPDLSALVRGAHTYKCPNLGITSWVRLPIYDADFGWGRPIFMGPGGIPYEGLSFVLPSPTNDGSLSVAIALQSEHMKLFEKFLFEI

SEQ ID NO: 9221 - protein, 427 aa, Arabidopsis thaliana
  misc_feature: Ceres CLONE 115366
  misc_feature: Useful for making plants with altered Lignin content
MQNPRLKQHQQQQQQQAMMQQQALMQQHSLYHPGVLAPPQLEPVPSGNLPPGFDPSTCRSVYVGNIHTQVTEPLLQEIFTSTGPVESSKLIRKDKSSYGFVHYFDRRSAALAILSLNGRHLFGQPIKVNWAYATGQREDTSSHFNIFVGDLSPEVTDATLYQSFSVFSSCSDARVMWDQKTGRSRGFGFVSFRNQQDAQTAINEMNGKWLSSRQIRCNWATKGATSGDDKLSSDGKSVVELTTGSSEDGKETLNEETPENNSQFTTVYVGNLAPEVTQLDLHRYFHALGAGVIEEVRVQRDKGFGFVRYNTHPEAALAIQMGNTQPYLFNRQIKCSWGNKPTPPGTASNPLPPPAPAPVPGLSAADLLNYERQLALSKMASVNALMHPQGQHPLRQAHGINAAGATAAMYDGGFQNVAAAQQLMYYQ

SEQ ID NO: 9222 - protein, 286 aa, Arabidopsis thaliana
  misc_feature: Ceres CLONE 115924
  misc_feature: Useful for making plants with altered Lignin content
  misc_feature: Useful for making plants with altered terpenoid content
MEADNGGPNSSHASKQRLRWTHELHERFVDAVAQLGGPDRATPKGVLRVMGVQGLTIYHVKSHLQKYRLAKYLPDSSSEGKKTDKKESGDMLSGLDGSSGMQITEALKLQMEVQKRLHEQLEVQRQLQLRIEAQGKYLKKIIEEQQRLSGVLGEPSAPVTGDSDPATPAPTSESPLQDKSGKDCGPDKSLSVDESLSSYREPLTPDSGCNIGSPDESTGEERLSKKPRLVRGAAGYTPDIVVGHPILESGLNTSYHQSDHVLAFDQPSTSLLGAEEQLDKVSGDNL

SEQ ID NO: 9223 - protein, 612 aa, Arabidopsis thaliana
  misc_feature: Ceres CLONE 115946
  misc_feature: Useful for making plants with altered alkaloid content
QGYCKVKAGSEQREAAAAVMDSSANINKALTETRFSDLEPPLSGDIIEALNQSDFEFCTPVQAATIPLLCSYKDVAVDAATGSGKTLAFVVPLVEILRRSTSFPPKPHQVMGVIISPTRELSTQIYNVAQPFVSTLANVNSVLLVGGREVKADMKIIEEEGCNVLIGTPGRLSDIMERMEILDFRNLEILILDEADRLLEMGFQRQVNYIISRLPKQRRTGLFSATQTEGVEELAKAGLRNPVRVEVRAKSKSESSQQLTNSKTPSGLHLEYMECEADKKSSQLVDLLIKNSDKKLIVFFMTCASVDYWGLVLSKIPALKSISLIPIHGDMKQNARDKALASFTKASSGALLCTDVAARGLDIPGIDYVVQYDPPQDPNMFNHRAGRTARLGRQGRAIVFLLPKEEAYVEFMRIRRVPLEERKCSEDASDVIPIIRSAAMKDRAVMEKGLKAFVSFVRAYKEHHCSFIFRWKDLEIGKLAMGYGLLYLPSMSEVKQHRLSSEGFTPVEGVKFEEIKFKDKYREKQRQQNLQVRKEKRQEEKKEKGKRKRVDASASNDPKKASRKLTGKQRQTIQTAEDEEVMDRDYKLMIKVKKGLIKEDEYERLTGDDDLF

SEQ ID NO: 9224 - protein, 379 aa, Arabidopsis thaliana
  misc_feature: Ceres CLONE 116117
  misc_feature: Useful for making plants with modulated biomass
  misc_feature: The plant is abnormally small.
MERKLVVLGIPWDIDSDGLKDYMSKFGDLEDCIVMKDRSTGRSRGFGYVTFASAEDAKNALKGEHFLGNRILEVKVATPKEEMRQPAKKVTRIFVARIPSSVSESDFRSHFERYGEITDLYMPKDYNSKQHRRIGFITFSSADSVEDLMEDTHDLGGTTVAVDRATPKEDDHPPRPPPVARMSRPPVAIAGGFGAPGGYGAYDAYISAATRYAALGAPTLYDNPATFYGRGEPTTRGIGNKIFVGRLPQEASVDDLRDYFGRFGHIQDAYIPKDPKRSGHRGFGFVTFAENGVADRVARRSHEICGQEVAIDSATPLDEAGPSAGASSMLSSSRPEYFGGYGGPMRAFGRMYGGMSLDDWGYGMPNARPSRPDRRYRPY

SEQ ID NO: 9225 - protein, 130 aa, Arabidopsis thaliana
  misc_feature: Ceres CLONE 11694
  misc_feature: Useful for making plants with modulated nitrogen use efficiency
MTFKRRNGGRNKHNRGHVKPIRCSNCGKCCPKDKAIKRFIVRNIVEQAAIRDVQEASVYEGYTLPKLYAKTQYCVSCAIHSHVVRVRSRTNRRVRTPPPRFARRKEDTPKPAQPGQAPRPAGGAPAAPRA

SEQ ID NO: 9226 - protein, 343 aa, Arabidopsis thaliana
  misc_feature: Ceres CLONE 117089
  misc_feature: Useful for making plants with altered alkaloid content
  misc_feature: Useful for making plants with altered terpenoid content
  misc_feature (113)..(113): Xaa is any aa, unknown, or other
MSDSGEPKPSQQEEPLPQPAAQETQSQQVCTFFKKPTKSKNIRKRTIDADEEDGDSKSESSILQNLKKVAKPDSKLYFSSGPSKSSTTTSGAPERSVFHYDSSKEIQVQNDSXATATLETETDFNQDARAIRERVLKKADEALKGNKKKASDEKLYKGIHGYTDHKAGFRREQTISSEKAGGSHGPLRASAHIRVSARFDYQPDICKDYKETGYCGYGDSCKFLHDRGDYKPGWQIEKEWEEAEKVRKRNKAMGVEDEDDEADKDSDEDENALPFACFICREPFVDPVVTKCKHYFCEHCALKHHTKNKKCFVCNQPTMGIFNAAHEIKKRMAEERSKAEEGL

SEQ ID NO: 9227 - protein, 124 aa, Arabidopsis thaliana
  misc_feature: Ceres CLONE 11843
  misc_feature: Useful for making plants with modulated biomass
  misc_feature: The plant is abnormally small.
MRLITHNMLSCNIKGVTSGFPLRIEAGNVIEKEVDFNPDFIRHMFAKIEWKALVEGARSMGYAELPEESPDAAVLKSDEPFLKKLHHALLELHLEEGALVCPETGRKFPVNKGIPNMLLHEDEV

SEQ ID NO: 9228 - protein, 87 aa, Arabidopsis thaliana
  misc_feature: CLONE 5750
  misc_feature: Useful for making plants with altered oil content
MGQIQYSEKYFDDTFEYRHVVLPPEVAKLLPKNRLLSENEWRAIGVQQSRGWVHYAVHRPEPHIMLFRRPLNYQQQQENQAQNMLVK

SEQ ID NO: 9229 - protein, 295 aa, Arabidopsis thaliana
  misc_feature: Ceres CLONE 119104
  misc_feature: Useful for making plants with altered terpenoid content
MDDLHGRNGRMHIGVAQNPMHVQYEDHGLHHIDNENGMMDDHADGGMDEGVETDIPSHPGNSADNRGEVVDRGIENGDQLTLSFQGQVYVFDRVSPEKVQAVLLLLGGREVPHTLPTTLGSPHQNNRGLSGTPQRLSVPQRLASLLRFREKRKGRNFDKTIRYTVRKEVALRMQRKKGQFTSAKSSNDDSGSTGSDWGSNQSWAVEGTETQKPEVLCRHCGTSEKSTPMMRRGPDGPRTLCNACGLMWANKGTLRDLSKVPPPQTPQHLSVNKNEDANLEADQMMEVTGDISNTQ

SEQ ID NO: 9230 - protein, 430 aa, Arabidopsis thaliana
  misc_feature: Ceres CLONE 119256
  misc_feature: Useful for biocontainment applications
  misc_feature: The plant produces a reduced number of seeds.
MEVNVLASKRSLLLFLLIVSLSLSQKVRHISAFNDTKPYRQVSSLRLARIQKHLNKINKSPVFTIQSPDGDVIDCVPKRKQPALDHPLLKHHKIQKAPKKMPKMKGKDDDVKEAENVLEGAWQMWHVNGTRCPKGTVPIRRNTMNDVLRAKSLFDFGKKRRSIYLDQRTEKPDALGTNGHEHAIAYTESSSEIYGAKATINVWDPKIEEVNEFSLSQIWILSGSFVGPDLNSIEAGWQVSPELYGDNRPRLFTYWTSDSYQATGCYNLLCSGFIQTNNKIAIGAAISPLSTFKGNQFDITILIWKDPKMGNWWMGLGDSTLVGYWPAELFTHLADHATTVEWGGEVVNTRASGRHTTTQMGSGHFPDEGFGKASYFRNLEVVDSDNSLVPVHDVKILAENTECYDIKSSYSNEWGTYFYYGGPGFNPRCN

SEQ ID NO: 9231 - protein, 236 aa, Arabidopsis thaliana
  misc_feature: Ceres CLONE 119300
  misc_feature: Useful for making plants with modulated nitrogen use efficiency
MASSRFQSGFCPISSCPSLENFIERIKDACRFTLSAVLGTILSAVLTFFFALVGTLLGALTGALIGQETESGFIRGAAVGAISGAVFSIEVFESSLVLWKSNESRFGCLLYLIDVIVSLISGRLVRERIGPAMLSAVQSQMGAVDSTFEELSSIFDTGGSKGLTGDLVDKIPKIKITGKNNLDASGNKDSCSVCLQDFQLGETVRSLPHCHHMFHLPCIDNWLFRHGSCPMCRRDL

SEQ ID NO: 9232 - protein, 141 aa, Arabidopsis thaliana
  misc_feature: Ceres CLONE 11938
  misc_feature: Useful for making plants with altered alkaloid content
MKGAKSKAETRSTKLSVTKKPAKGAKGAAKDPNKPKRPSSAFFVFMEDFRVTYKEEHPKNKSVAAVGKAGGEKWKSLSDSEKAPYVAKADKRKVEYEKNMKAYNKKLEEGPKEDEESDKSVSEVNDEDDAEDGSEEEEDDD

SEQ ID NO: 9233 - protein, 92 aa, Arabidopsis thaliana
  misc_feature: Ceres CLONE 119790
  misc_feature: Useful for making plants with altered Lignin content
  misc_feature: Useful for making plants with modulated nitrogen use efficiency
MMEWDNQLQPNNHHSSNLQGIDVNGGSGAGGGMYVKVMTDEQYETLRKQIAIYGTICERLVEMHKTLTAQQDLAGGRMGGLYADPNDVIFRS

SEQ ID NO: 9234 - protein, 402 aa, Arabidopsis thaliana
  misc_feature: Ceres CLONE 119803
  misc_feature: Useful for making plants with modulated oxidative stress sensitivity
  misc_feature: Useful for making plants with modulated oxidative stress sensitivity
MQTLHQSQLLLNPAEAANNQSESDAPPKQVAQAMERLNQAARVIADIRLGADRILEAMFVASQPRHTDMPLQLFLREDASMRQHLQDLRLIGKKLEESGVLTESLRSRSNSWGLHMPLVCPDGAVVAYAWKRQLAGQAGASAVDRTRLALKAFTDQKRRFFPHIDDGLKMEPSSKKHRASHLLLENGREEPVDYKTLPDIQSRLEKLVPSVKVSTYGRLNWLKRANSLPGSGSDDPTEASKPIFQSSSKLRSGLQTEVVDKIAVIELSFPSLFRAIVSLSPAASVDPDAVAFFSPDEGGSYLHARGFSVYHVYKHITEHAATALQYFLGFGTGTALYSLLLWICSFESVFSKPCTKCGRLLAMDKKSALILPPLHRAYQELPLALNLDVCEAYHSSCSQDDT

SEQ ID NO: 9235 - protein, 425 aa, Arabidopsis thaliana
  misc_feature: Ceres CLONE 11988
  misc_feature: Useful for making plants with altered Lignin content
  misc_feature: Useful for making plants with altered cell wall content and/or composition
MASSSLQSLFSLFCLALFSLPLIVSSIGINYGQVANNLPPPKNVIPLLKSVGATKVKLYDADPQALRAFAGSGFELTVALGNEYLAQMSDPIKAQGWVKENVQAYLPNTKIVAIVVGNEVLTSNQSALTAALFPAMQSIHGALVDCGLNKQIFVTTAHSLAILDVSYPPSATSFRRDLLGSLTPILDFHVKTGSPILINAYPFFAYEENPKHVSLDFVLFQPNQGFTDPGSNFHYDNMLFAQVDAVYHALDAVGISYKKVPIVVSETGWPSNGDPQEVGATCDNARKYNGNLIKMMMSKKMRTPIRPECDLTIFVFALFNENMKPGPTSERNYGLFNPDGTPVYSLGIKTSSTHSSGSGSSNSTGGSSSGGGGNTGGSSSGGGIYQPVTGNPSPDYMSISSAGGKGRFVECVLFFFLLCIIKLRL

SEQ ID NO: 9236 - protein, 358 aa, Arabidopsis thaliana
  misc_feature: Ceres CLONE 119910
  misc_feature: Useful for making plants with modulated oxidative stress sensitivity
MAMAIAMLPALFSSPSILTSRIRCGATANSGGAISSTSSNSDPRRGVPLYKPKSYEVLATDAANSLAFALQDSKSRLEIDFPPLPSSISSYKGSSDDFIDANIQLAVTVVRKLQEKIETRACIVFPDKPEKRRASQRFKAAFDSVDGISIGSLDDIPGTSVTNFFRSIRSTLDFDFENENEGTWEPKEPPTLYIFINCSTRELSFIEKFVETFASSTPALLFNLELDTLRADLGLLGFPPKDLHYRFLSQFIPVFYIRTREYSKTVAVAPFVLNYNGALFRQYPGPWQVMLKQTDGSFACVAESPTRFTLGETKEELLQVLGLQEEKGSSLEFLRRGYKSATWWEEDVELEASSNWRN

SEQ ID NO: 9237 - protein, 693 aa, Glycine max
  misc_feature: HVG ID no. 120
  misc_feature: Useful for making plants with modulated flowering time
MVKSEHKIKTEPSSKAMRLSSPSSSTSDCKKKKYKGVRMRSWGSWVSEIRAPNQKTRIWLGSYSTPEAAARAYDAALLCLKGSSANLNFPLSSSQQYIPGDAVMSPKSIQRVAAAAANSFIDNATTPPSPPPASTPSSSSLASSPSLVSSPSDQIDDDALLISSFQAYTSCGQANQSMAVNVMEPWYTFGDGLQSPKYADQMLSGDFFHVDSSHLLDDLYEESDIRLWSFCMVKSEHKIKTEPSSKAMRLSSPSSSTSDCKKKKYKGVRMRSWGSWVSEIRAPNQKTRIWLGSYSTPEAAARAYDAALLCLKGSSANLNFPLSSSQQYIPGDAVMSPKSIQRVAAAAANSFIDNATTPPSPPPASTPSSSSLASSPSLVSSPSDQIDDDALLISSFQAYTSCGQANQSMAVNVMEPWYTFGDGLQSPKYADQMLSGDFFHVDSSHLLDDLYEESDIRLWSFCMVKSEHKIKTEPSSKAMRLSSPSSSTSDCKKKKYKGVRMRSWGSWVSEIRAPNQKTRIWLGSYSTPEAAARAYDAALLCLKGSSANLNFPLSSSQQYIPGDAVMSPKSIQRVAAAAANSFIDNATTPPSPPPASTPSSSSLASSPSLVSSPSDQIDDDALLISSFQAYTSCGQANQSMAVNVMEPWYTFGDGLQSPKYADQMLSGDFFHVDSSHLLDDLYEESDIRLWSFC

SEQ ID NO: 9238 - protein, 454 aa, Zea mays
  misc_feature: CLONE 218626
  misc_feature: Useful for making plants with altered oil content
MGTQAPENYPAEKVQDARSAREKAIDDWLPITSSRNAKWWYSAFHNVTAMVGAGVLSLPYAMSELGWGPGIAVLVVSWVITLYTLWQMVEMHEMVPGKRFDRYHELGQHAFGDRLGLWIVVPQQLVVEVGVNIVYMVTGGKSLKKFHDVLVCGDTGVCEGKDNIKTTYFIMIFASVHFVLSQLPNFNSISGVSLAAAVMSLSYSTIAWGASVHKGRMSGVDYHLRATTTPGKVFGFFGALGDVAFAYAGHNVVLEIQATIPSTPDKPSKKPMWKGVVVAYVVVALCYFPVALIGYWAFGNTVEDNILITLSKPKWLIALANMMVVVHVIGSYQIYAMPVFDMIETVLVKKLRFPPGLTLRLIARTLYVAFTMFIAITFPFFGGLLGFFGGFAFAPTTYFLPCVMWLAIYKPKRFSLSWLTNWMCIILGVLLMILSPIGGLRQIIMDAKTYQFYS

SEQ ID NO: 9239 - protein, 481 aa, Arabidopsis thaliana
  misc_feature: Ceres CLONE 120310
  misc_feature: Useful for making plants with modulated nitrogen use efficiency
MSLKALDYESLNENVKNCQYAVRGELYLRASELQKECKKIIFTNVGNPHALGQKPLTFPRQVVSLCQAPFLLDDPNVGMIFPADAIARAKHYLSLTSGGLGAYSDSRGLPGVRKEVADFIERRDGYPSDPELIFLTDGASKGVMQILNCVIRGQKDGILVPVPQYPLYSATISLLGGTLVPYYLEESENWGLDVNNLRQSVAQARSQGITVRAMVIINPGNPTGQCLSEANIREILRFCCDERLVLLGDEVYQQNIYQDERPFISSKKVLMDMGAPISKEVQLISFHTVSKGYWGECGQRGGYFEMTNIPPRTVEEIYKVASIALSPNVSAQIFMGLMVSPPKPGDISYDQFVRESKGILESLRRRARMMTDGFNSCKNVVCNFTEGAMYSFPQIKLPSKAIQAAKQAGKVPDVFYCLKLLEATGISTVPGSGFGQKEGVFHLRTTILPAEEEMPEIMDSFKKFNDEFMSQYADNFGYSRM

SEQ ID NO: 9240 - protein, 174 aa, Arabidopsis thaliana
  misc_feature: Ceres CLONE 12071
  misc_feature: Useful for making plants with altered Lignin content
MEGKRSQGQGYMKKKSYLVEEDMETDTDEEEEVGRDRVRGSRGSINRGGSLRLCQVDRCTADMKEAKLYHRRHKVCEVHAKASSVFLSGLNQRFCQQCSRFHDLQEFDEAKRSCRRRLAGHNERRRKSSGESTYGEGSGRRGINGQVVMQNQERSRVEMTLPMPNSSFKRPQIR

SEQ ID NO: 9241 - protein, 121 aa, Arabidopsis thaliana
  misc_feature: CLONE 11852
  misc_feature: Useful for making plants with altered protein content
MASRRSVRYAQLPGDEDDEGYGNGVGERRDFDPRFDYSPKAFDRVPWKSIALAVFLLFLGCLLLLLSFFIFIGHMEGDSSQGYALLVLGILTFLPGFYETRIAYYSWRGAEGYRFAAIPSY

SEQ ID NO: 9242 - protein, 199 aa, Arabidopsis thaliana
  misc_feature: Ceres CLONE 121021
  misc_feature: Useful for making plants with modulated biomass
  misc_feature: The plant is abnormally small.
  misc_feature: There is no branching.
MENGGTIPGQEIGSGLQKPVNPDGFVTIDVESFSSVIHKDFSSSSPRITLQRNVSRKGSPRSNNERKLHFDANGNDKEISFPQSPLRGSSTPEKASTVGPTEHAGTATTAATAVSASPLHQITVTTAATAAGNMITDQNRERRFGFSRKSSFKRSHTSWMLDPKKIVLFFATLSSMGSILLIIFTLSISKSNPGDMPLD

SEQ ID NO: 9243 - protein, 206 aa, Arabidopsis thaliana
  misc_feature: Ceres CLONE 12182
  misc_feature: Useful for making plants with modulated nitrogen use efficiency
  misc_feature: Useful for making plants with modulated phosphate use efficiency
MKHNNVIPNGHFKKHWQNYVKTWFNQPARKTRRRIARQKKAVKIFPRPTSGPLRPVVHGQTLKYNMKVRTGKGFTLEELKAAGIPKKLAPTIGIAVDHRRKNRSLEGLQTNVQRLKTYKTKLVIFPRRARKVKAGDSTPEELANATQVQGDYLPIVREKPTMELVKLTSEMKSFMAFDKIRLERTNKRHAGARAKRAAEAEKEEKK

SEQ ID NO: 9244 - protein, 209 aa, Arabidopsis thaliana
  misc_feature: CLONE 8166
  misc_feature: Useful for making plants with altered protein content
MKDCENHGHSRRKLIRRIFWSIIFVLFIIFLTILLIWAILQPSKPRFILQDATVYAFNVSGNPPNLLTSNFQITLSSRNPNNKIGIYYDRLDVYATYRSQQITFPTSIPPTYQGHKDVDIWSPFVYGTSVPIAPFNGVSLDTDKDNGVVLLIIRADGRVRWKVGTFITGKYHLHVKCPAYINFGNKANGVIVGDNAVKYTFTTSCSVSV

SEQ ID NO: 9245 - protein, 114 aa, Arabidopsis thaliana
  misc_feature: Ceres CLONE 12256
  misc_feature: Useful for making plants with altered Lignin content
MSTMKFCRECNNILYPKEDKEQSILLYACRNCDHQEAADNNCVYRNEVHHSVSEQTQILSDVASDPTLPRTKAVRCAKCQHGEAVFFQATARGEEGMTLFFVCCNPNCSHRWRE

SEQ ID NO: 9246 - protein, 385 aa, Arabidopsis thaliana
  misc_feature: Ceres CLONE 12272
  misc_feature: Useful for making plants with modulated biomass
  misc_feature: Useful for making plants with modulated flowering time
  misc_feature: Useful for making plants with modulated drought sensitivity
  misc_feature: The plant flowers significantly late compared to wild-type.
  misc_feature: The plant is abnormally large.
MVSDQDLAKGVETLLRQSDPSSLTSLSSIVQQLEAKLGLDLTEKTTFIRDQINILLRAHQNPSASVASASSVQQSHPPPPPSSHQQQNLHSGVNVPPMAKGHFTLSHPSQFSVSSQSQQYPSHFALQPPYHSYDLNFRQPYPVYMPPQQHQHQQQSPRQQQSSVMLSHGGNASLSVNQAPKESAPAGTKRKGGPGGLNKVCRVSPELEVVVGEPALPRTEIVRQLWAYIRKNNLQDPSNKRKIICDDALRVVFETDCTDMFKMNKLLAKHILPLDPSKDSGQAKKAKTEVETKTETTEPVSSTAISSTVTLSEPLGKFFGTGETEMADEEIIRRVWEYIKLNNLEDPVNPMAIQCDEKLRDLLGCESISAVGINEMLRRHMYKQS

SEQ ID NO: 9247 - protein, 361 aa, Arabidopsis thaliana
  misc_feature: CLONE 38311
  misc_feature: Useful for making plants with altered Lignin content
  misc_feature: Useful for making plants with altered protein content
  misc_feature: Useful for making plants with altered terpenoid content
MEYSCVDDSSTTSESLSISTTPKPTTTTEKKLSSPPATSMRLYRMGSGGGSVVLDSENGVETESRKLPSSKYKGVVPQPNGRWGAQIYEKHQRVWLGTFNEEEEAASSYDIAVRRFRGRDAVTNFKSQVDGNDAESAFLDAHSKAEIVDMLRKHTYADEFEQSRRKFVNGDGKRSGLETATYGNDAVLRAREVLFEKTVTPSDVGKLNRLVIPKQHAEKHFPLSAMTTAMGMNPSPTKGVLINLEDRTGKVWRFRYSYWNSSQSYVLTKGWSRFVKEKNLRAGDVVCFERSTGPDRQLYIHWKVRSSPVQTVVRLFGVNIFNVSNEKPNDVAVECVGKKRSREDDLFSLGCSKKQAIINIL

SEQ ID NO: 9248 - protein, 285 aa, Arabidopsis thaliana
  misc_feature: Ceres CLONE 123804
  misc_feature: Useful for making plants with altered Lignin content
MALLRLPGISLQILGHKSNQKNPNPNVAFTNHSLSLSTPSLCRLHRHATFPDSIPAKSRNLTSYFSTTTQEISKTRLIAQNVPWTSTPEDIRSLFEKYGSVIDIEMSMHKKERNRGLVFIEMASPEEAATALKSLESCEYEGRRLKVDYAKTKKKKTYAPRETPSPVPTFNLFVANLAFEARAKHLKEFFDADTGNVVSTEVIFHENPRRSSGYGFVSFKTKKQAEAALIEFQGKDFLGRPIRLAKSKQFVKLQAKEGLQPPEEEAEEEPSQSETMTQEHETPAA

SEQ ID NO: 9249 - protein, 313 aa, Arabidopsis thaliana
  misc_feature: Ceres CLONE 1241
  misc_feature: Useful for making plants with modulated nitrogen use efficiency
MDEGVIAVSAMDAFEKLEKVGEGTYGKVYRAREKATGKIVALKKTRLHEDEEGVPSTTLREISILRMLARDPHVVRLMDVKQGLSKEGKTVLYLVFEYMDTDVKKFIRSFRSTGKNIPTQTIKSLMYQLCKGMAFCHGHGILHRDLKPHNLLMDPKTMRLKIADLGLARAFTLPMKKYTHEILTLWYRAPEVLLGATHYSTAVDMWSVGCIFAELVTNQAIFQGDSELQQLLHIFKLFGTPNEEMWPGVSTLKNWHEYPQWKPSTLSSAVPNLDEAGVDLLSKMLQYEPAKRISAKMAMEHPYFDDLPEKSSL

SEQ ID NO: 9250 - protein, 244 aa, Arabidopsis thaliana
  misc_feature: Ceres CLONE 124720
  misc_feature: Useful for biocontainment applications
  misc_feature: Useful for making plants with altered Lignin content
  misc_feature: Useful for making plants with altered cell wall content and/or composition
  misc_feature: The plant produces a reduced number of seeds.
MRKGRGSSVVGPALPVTAGGSVKEPRYRGVRKRPWGRFAAEIRDPLKKSRVWLGTFDSAVDAARAYDTAARNLRGPKAKTNFPIDCSPSSPLQPLTYLHNQNLCSPPVIQNQIDPFMDHRLYGGGNFQEQQQQQIISRPASSSMSSTVKSCSGPRPMEAAAASSSVAKPLHAIKRYPRTPPVAPEDCHSDCDSSSSVIDDGDDIASSSSRRKTPFQFDLNFPPLDGVDLFAGGIDDLHCTDLRL

SEQ ID NO: 9251 - protein, 1051 aa, Arabidopsis thaliana
  misc_feature: HVG ID no. 125
  misc_feature: Useful for making plants with altered lignin content
MAPQEQAVSQVMEKQSNNNNSDVIFRSKLPDIYIPNHLSLHDYIFQNISEFATKPCLINGPTGHVYTYSDVHVISRQIAANFHKLGVNQNDVVMLLLPNCPEFVLSFLAASFRGATATAANPFFTPAEIAKQAKASNTKLIITEARYVDKIKPLQNDDGVVIVCIDDNESVPIPEGCLRFTELTQSTTEASEVIDSVEISPDDVVALPYSSGTTGLPKGVMLTHKGLVTSVAQQVDGENPNLYFHSDDVILCVLPMFHIYALNSIMLCGLRVGAAILIMPKFEINLLLELIQRCKVTVAPMVPPIVLAIAKSSETEKYDLSSIRVVKSGAAPLGKELEDAVNAKFPNAKLGQGYGMTEAGPVLAMSLGFAKEPFPVKSGACGTVVRNAEMKIVDPDTGDSLSRNQPGEICIRGHQIMKGYLNNPAATAETIDKDGWLHTGDIGLIDDDDELFIVDRLKELIKYKGFQVAPAELEALLIGHPDITDVAVVAMKEEAAGEVPVAFVVKSKDSELSEDDVKQFVSKQVVFYKRINKVFFTESIPKAPSGKILRKDLRAKLANGLMAPQEQAVSQVMEKQSNNNNSDVIFRSKLPDIYIPNHLSLHDYIFQNISEFATKPCLINGPTGHVYTYSDVHVISRQIAANFHKLGVNQNDVVMLLLPNCPEFVLSFLAASFRGATATAANPFFTPAEIAKQAKASNTKLIITEARYVDKIKPLQNDDGVVIVCIDDNESVPIPEGCLRFTELTQSTTEASEVIDSVEISPDDVVALPYSSGTTGLPKGVMLTHKGLVTSVAQQVDGENPNLYFHSDDVILCVLPMFHIYALNSIMLCGLRVGAAILIMPKFEINLLLELIQRCKVTVAPMVPPIVLAIAKSSETEKYDLSSIRVVKSGAAPLGKELEDAVNAKFPNAKLGQGYGMTEAGPVLAMSLGFAKEPFPVKSGACGTVVRNAEMKIVDPDTGDSLSRNQPGEICIRGHQIMKGYLNNPAATAETIDKDGWLHTGDIGLIDDDDELFIVDRLKELIKYKGFQVAPAELEALLIGHPDITDVAVVA

SEQ ID NO: 9252 - protein, 578 aa, Arabidopsis thaliana
  misc_feature: HVG ID no. 126
  misc_feature: Useful for making plants with altered lignin content
MGSVEAGEKKALGWAARDPSGVLSPYSYTLRSTGADDVYIKVICCGICHTDIHQIKNDLGMSNYPMVPGHEVVGEVLEVGSDVSKFTVGDVVGVGVVVGCCGSCKPCSSELEQYCNKRIWSYNDVYTDGKPTQGGFADTMIVNQKFVVKIPEGMAVEQAAPLLCAGVTVYSPLSHFGLMASGLKGGILGLGGVGHMGVKIAKAMGHHVTVISSSDKKKEEAIEHLGADDYVVSSDPAEMQRLADSLDYIIDTVPVFHPLDPYLACLKLDGKLILMGVINTPLQFVTPLVILGRKVISGSFIGSIKETEEVLAFCKEKGLTSTIETVKIDELNIAFERLRKNDVRYRFVVDVAGSNLVEEAATTTNMGSVEAGEKKALGWAARDPSGVLSPYSYTLRSTGADDVYIKVICCGICHTDIHQIKNDLGMSNYPMVPGHEVVGEVLEVGSDVSKFTVGDVVGVGVVVGCCGSCKPCSSELEQYCNKRIWSYNDVYTDGKPTQGGFADTMIVNQKFVVKIPEGMAVEQAAPLLCAGVTVYSPLSHFGLMASGLKGGILGLGGVGHMGVKIAKAMGHHVTVISS

SEQ ID NO: 9253 - protein, 283 aa, Arabidopsis thaliana
  misc_feature: SEEDLINE ME09573
  misc_feature: Useful for making plants with modulated flowering time
MYKDRSGGGIMGGGGSSRSEILGGAIDRKRINDALDKHLKKSSPSTSRVFTSKDKDSVPSTSTAKSQLHSRSPDVESDTDSEGSDVSGSEGDDTSWISWFCNLRGNEFFCEVDEDYIQDDFNLCGLSGQVPYYDYALDLILDVESSNGDMFTEEQHEMVESAAEMLYGLIHVRYILTTKGMAAMMEKYKNYDFGRCPRVFCCGQSCLPVGQSDIPRSSTVKIYCPKCEDIYYPRSKYQGNIDGAYFGTTFPHLFLMAYGNMKPQKPAQNYVPKIFGFKVHNKQ

SEQ ID NO: 9254 - protein, 358 aa, Arabidopsis thaliana
  misc_feature: Ceres CLONE 13024
  misc_feature: Useful for making plants with modulated phosphate use efficiency
MSSFTSKFADELIANAAYIGTPGKGILAADESTGTIGKRLASINVENVESNRRALRELLFTTPGALPCLSGVILFEETLYQKSSDGTPFVDMLKSAGVLPGIKVDKGTVELAGTNGETTTQGLDGLGDRCKKYYEAGARFAKWRAVLKIGVNEPSQLAIHENAYGLARYAVICQENGLVPIVEPEILVDGSHDIQKCAAVTERVLAACYKALSDHHVLLEGTLLKPNMVTPGSESAKVAPEVIAEHTVRALQRTVPAAVPAIVFLSGGQSEEEATRNLNAMNQLKTKKPWSLSFSFGRALQQSTLKTWGGKEENVKKAQEAFLVRCKANSEATLGAYKGDAKLGEGAAESLHVKDYKY

SEQ ID NO: 9255 - protein, 173 aa, Arabidopsis thaliana
  misc_feature: Ceres CLONE 13092
  misc_feature: Useful for making plants with modulated flowering time
  misc_feature: The plant flowers significantly late compared to wild-type.
MGASSSSSVSEKSIHQFTVKDSSGKEVDLSVYQGKVLLVVNVASKCGFTESNYTQLTELYRKYKDQGFVVLAFPCNQFLSQEPGTSEEAHQFACTRFKAEYPVFQKVRVNGQNAAPVYKFLKSKKPSFLGSRIKWNFTKFLVGKDGQVIDRYGTTVSPLSIQKDIEKALAQEL

SEQ ID NO: 9256 - protein, 238 aa, Arabidopsis thaliana
  misc_feature: CLONE 16403
  misc_feature: Useful for making plants with modulated salt sensitivity
MAVSSLSIRCGGFSPTISHKTEILCPNPSLKACCLLSSGGKADSSESTYQKGSGNNWKRRQALVGVGTLVATSIPATLLLAEEIPKSYSPFVDREDGYSYYYPSDWREFDFRAHDSAFKDRYLQLQNVRVRFIPTEKNDIHEVGPMEEVVYDLVKHKFAAPNQVATIYDMKERVEDGKNYYTFEYRLRTPIYATTSFATVAVGNNRYYTLIVGANERRWRKVKKQLQVVADSLKILQI

SEQ ID NO: 9257 - protein, 324 aa, Arabidopsis thaliana
  misc_feature: Ceres CLONE 13257
  misc_feature: Useful for making plants with modulated heat sensitivity
MFLEREDLGKVFKGWLEDKTPGKQSNGTVIAVKKLNAESFQGFEEWQCEVNFLGRVSHPNLVKLLGYCLEGEELLLVYEYMQKGSLENHLFRKGSAVQPLSWEIRLKIAIGAAKGLAFLHASEKQVIYRDFKASNILLDGSYNAKISDFGLAKLGPSASQSHITTRVMGTHGYAAPEYVATGHLYVKSDVYGFGVVLAEILTGLHALDPTRPTGQHNLTEWIKPHLSEKRKLRSIMDPRLEGKYPFKSAFRVAQLALKCLGPEPKNRPSMKEVVESLELIEAANEKPLERRTTRASPSIRQQQGHYRPQQLSSFRPRHTVSRAH

SEQ ID NO: 9258 - protein, 323 aa, Arabidopsis thaliana
  misc_feature: Ceres CLONE 1334
  misc_feature: Useful for making plants with modulated heat sensitivity
MESFPIINLEKLNGEERAITMEKIKDACENWGFFECVNHGISLELLDKVEKMTKEHYKKCMEERFKESIKNRGLDSLRSEVNDVDWESTFYLKHLPVSNISDVPDLDDDYRTLMKDFAGKIEKLSEELLDLLCENLGLEKGYLKKVFYGSKRPTFGTKVSNYPPCPNPDLVKGLRAHTDAGGIILLFQDDKVSGLQLLKDGEWVDVPPVKHSIVVNLGDQLEVITNGKYKSVEHRVLSQTDGEGRMSIASFYNPGSDSVIFPAPELIGKEAEKEKKENYPRFVFEDYMKLYSAVKFQAKEPRFEAMKAMETTVANNVGPLATA

SEQ ID NO: 9259 - protein, 209 aa, Brassica napus
  misc_feature: CLONE 965405
  misc_feature: Useful for making plants with modulated salt sensitivity
MSADDSSNATDVDGKLGSDLNVNSDGEDAADNDSSKTLTIPAPAVCLVRFAGDAAGGAVMGSIFGYGSGLFKKKGFKGSFADAGQSAKTFAVLSGVHSLVVCLLKQLRGKDDAINVGVAGCCTGLALSFPGAPQALLQSCLTFGAFSFILEGLNKRQTALAHSVSLRHQTGNFGDHQQRPLQLSLALPIHEEIKGFSSFCKSLTKPKKI

SEQ ID NO: 9260 - protein, 75 aa, Glycine max
  misc_feature: CLONE 590462
  misc_feature: Useful for making plants with altered oil content
MDSNGYLVVGVVAFALLCSFRVSLTDSVPLFSPVHDAASLTRNSFPAGFIFGAGSSAYQFEGAAKEGGRGPSIWY

SEQ ID NO: 9261 - protein, 1110 aa, Arabidopsis thaliana
  misc_feature: HVG ID no. 137
  misc_feature: Useful for making plants with altered lignin content
MSWFLIAVATIAAVVSYKLIQRLRYKFPPGPSPKPIVGNLYDIKPVRFRCYYEWAQSYGPIISVWIGSILNVVVSSAELAKEVLKEHDQKLADRHRNRSTEAFSRNGQDLIWADYGPHYVKVRKVCTLELFTPKRLESLRPIREDEVTAMVESVFRDCNLPENRAKGLQLRKYLGAVAFNNITRLAFGKRFMNAEGVVDEQGLEFKAIVSNGLKLGASLSIAEHIPWLRWMFPADEKAFAEHGARRDRLTRAIMEEHTLARQKSSGAKQHFVDALLTLKDQYDLSEDTIIGLLWDMITAGMDTTAITAEWAMAEMIKNPRVQQKVQEEFDRVVGLDRILTEADFSRLPYLQCVVKESFRLHPPTPLMLPHRSNADVKIGGYDIPKGSNVHVNVWAVARDPAVWKNPFEFRPERFLEEDVDMKGHDFRLLPFGAGRRVCPGAQLGINLVTSMMSHLLHHFVWTPPQGTKPEEIDMSENPGLVTYMRTPVQAVATPRLPSDLYKRVPYDMLAKEVLKEHDQKLADRHRNRSTEAFSRNGQDLIWADYGPHYVKVRKVCTLELFTPKRLESLRPIREDEVTAMVESVFRDCNLPENRAKGLQLRKYLGAVAFNNITRLAFGKRFMNAEGVVDEQGLEFKAIVSNGLKLGASLSIAEHIPWLRWMFPADEKAFAEHGARRDRLTRAIMEEHTLARQKSSGAKQHFVDALLTLKDQYDLSEDTIIGLLWDMITAGMDTTAITAEWAMAEMIKNPRVQQKVQEEFDRVVGLDRILTEADFSRLPYLQCVVKESFRLHPPTPLMLPHRSNADVKIGGYDIPKGSNVHVNVWAVARDPAVWKNPFEFRPERFLEEDVDMKGHDFRLLPFGAGRRVCPGAQLGINLVTSMMSHLLHHFVWTPPQGTKPEEIDMSENPGLVTYMRTPVQAVATPRLPSDLYKRVPYDMMSWFLIAVATIAAVVSYKLIQRLRYKFPPGPSPKPIVGNLYDIKPVRFRCYYEWAQSYGPIISVWIGSILNVVVSSAELAKEVLKEHDQKLADRHRNRSTEAFSRNGQDLIWADYGPHYVKVRKVCTLELFTPKRLESLRPIREDEVTAMVESVFRDCNLPENRAKGLQLRK

SEQ ID NO: 9262 - protein, 240 aa, Glycine max
  misc_feature: CLONE 625035
  misc_feature: Useful for making plants with altered oil content
MYGQSCYESDLALLDSIRRHLLGDSEEHRFGAPNVNSGSTPLYSRSSSFGRLYPCLSNDWGELPLMEDDSEDMLLYGVLRDAVNVGWVPSLDASSPESFSSAFMPPVTVKSETDLFPAPEPICNPPVVQGPAPAVVPAKGKHYRGVRQRPWGKFAAEIRDPAKNGARVWLGTFETAEDAALAYDRAAYRMRGSRALLNFPLRINSGEPEPVRVTAKRASAEPCSSSESGSWVKKRKKVVG

SEQ ID NO: 9263 - protein, 339 aa, Arabidopsis thaliana
  misc_feature: Ceres CLONE 13767
  misc_feature: Useful for biocontainment applications
  misc_feature: Useful for making plants with modulated biomass
  misc_feature: The plant is abnormally small.
  misc_feature: The plant produces a reduced number of seeds.
MAIPLPLTSCSPISTSSSISRTSFVPLTLRNRTFFSNQNYSRRVLISCSSSLSSDNGSSPDSMNGNGNGNGSSLNGQSSFPRLPSFDGTSKPPLKWRRVLLKVSGEALAGDEEQNIDPKVTMAIAREVAAVTRLGIEVAIVVGGGNIFRGSTWAGCSGLDRSSADYIGMLATVMNAIFLQATMESIGIPTRVQTAFRMSEVAEPYIRRRAIRHLEKGRVVIFAAGTGNPFFTTDTAAALRCAEINAEVVLKATNVDGVFDDDPKRNPNARLLDSLTYQEITSKDLSVMDMTAITLCQENNIPVVVFNLSEPGNIAKAIKGERVGTLIGGTWNSIVTTTS

SEQ ID NO: 9264 - protein, 332 aa, Arabidopsis thaliana
  misc_feature: CLONE 5344
  misc_feature: Useful for making plants with altered oil content
MDKTATLLSTLLFLFTFLTTCLSKDLCNQNDKNTLLKIKKSLNNPYHLASWDPQTDCCSWYCLECGDATVNHRVTALTIFSGQISGQIPAEVGDLPYLETLVFRKLSNLTGTIQPTIAKLKNLRMLRLSWTNLTGPIPDFISQLKNLEFLELSFNDLSGSIPSSLSTLPKILALELSRNKLTGSIPESFGSFPGTVPDLRLSHNQLSGPIPKSLGNIDFNRIDLSRNKLQGDASMLFGSNKTTWSIDLSRNMFQFDISKVDIPKTLGILDLNHNGITGNIPVQWTEAPLQFFNVSYNKLCGHIPTGGKLQTFDSYSYFHNKCLCGAPLEICK

SEQ ID NO: 9265 - protein, 143 aa, Arabidopsis thaliana
  misc_feature: CLONE 5426
  misc_feature: Useful for making plants with altered oil content
  misc_feature: Useful for making plants with modulated cold sensitivity
MATVPGQLIWEIVKRNNCFLVKQFGRGNAKVQFSKESNNLVNINSYKHSGLANKKTVTIQAAGKDQGVVLGTTKTKRQNKPKLSVNKSILKKEFSRMSKVVANQVVDNYYRPDLKKAALARLSAISKGLRVAKSGPKRRNRQA

SEQ ID NO: 9266 - protein, 326 aa, Arabidopsis thaliana
  misc_feature: Ceres CLONE 13930
  misc_feature: Useful for making plants with altered Lignin content
  misc_feature: Useful for making plants with altered terpenoid content
MVSLAKFHYCDQTLHLRLDTHRKPQPKPVSYRILHKPPPSRVIRASSFSSNPKPSFLKTTCVTLTTAAALLSASLHLSTKPVTAATLVSPPPPPSTAADLTSDQISSRPKEEEEEAALEKHLTKNPNDVEALQSLMKIKFQTKNIDHALEILNRLIEIQPEEQEWRILKAQVQTYGGDFDSATKGFEEVLSKDPFRVEAYHGLVMAYSESESKLSEIESRINEAIEKCKKENKKDFRDFMLLIAQIRVIKGNPIEALRVYQELVKDEPKDFRPYLCQGLIYTLMKKKDEAEKQFAEFRRLVPENHPYKEYLDANVLNTNKLFAKNQ

SEQ ID NO: 9267 - protein, 190 aa, Arabidopsis thaliana
  misc_feature: SEEDLINE ME11273
  misc_feature: Useful for making plants with altered oil content
MLFSNKVNSLTEQVSRLDIDDNDMGLGGSETMECKCGMPLCICVAPPKSTDKPNPPATIAPVVLPQLKSEASAKSKGSTSSSNARSALNAGLDTPQRDYEASGEGLREAIKNGDSAGAKKLLKEGVDANYRDRQGMSVLHLAVLFNQTDIALMLMDHGASLEYKNAQGETPLDCAPATLQYKMREKMKST

SEQ ID NO: 9268 - protein, 159 aa, Arabidopsis thaliana
  misc_feature: Ceres CLONE 14084
  misc_feature: Useful for making plants with modulated cold sensitivity
MDNLEDLKIVAEQWSKQGLEFVQKIPPPQLYTAIGVLLLATIWLLSIRLFRRTKSNTVLLSGLSGSGKTVLFYQLRDGSSHQGAVTSMEPNEGTFVLHNENNTKKGKVKPVHLIDVPGHSRLISKLEEYLPRAAAVVFVVDALSSSQISGQLQSTFTTF

SEQ ID NO: 9269 - protein, 221 aa, Arabidopsis thaliana
  misc_feature: SEEDLINE ME11278
  misc_feature: Useful for making plants with altered oil content
MEPERLKFGGPRELCGAADLISQFKLVQHHEFFCKKSLPVSLSDSHYLHNVVGDTEIRKGEGMQLDQLIESISQSRETNIRIQPFDIDELQESFQLNDMTPVELPPAEKGAPTIPSKSKSESKDRDRKHKKHKDRDKDKDREHKKHKHKHKDRSKDKDKDKDRDRKKDKNGHHDSGDHSKKHHDKKRKHDGDEDLNDVQRHKKNKHKSSKLDEVGAIRVAG

SEQ ID NO: 9270 - protein, 253 aa, Arabidopsis thaliana
  misc_feature: Ceres CLONE 141806
  misc_feature: Useful for making plants with modulated flowering time
  misc_feature: The plant flowers significantly late compared to wild-type.
MQPETSDQMLYSFLAGNEVGGGGYCVSGDYMTTMQSLCGSSSSTSSYYPLAISGIGETMAQDRALAALRNHKEAERRRRERINSHLNKLRNVLSCNSKTDKATLLAKVVQRVRELKQQTLETSDSDQTLLPSETDEISVLHFGDYSNDGHIIFKASLCCEDRSDLLPDLMEILKSLNMKTLRAEMVTIGGRTRSVLVVAADKEMHGVESVHFLQNALKSLLERSSKSLMERSSGGGGGERSKRRRALDHIIMV

SEQ ID NO: 9271 - protein, 176 aa, Arabidopsis thaliana
  misc_feature: SEEDLINE ME11822
  misc_feature: Useful for making plants with altered oil content
MEEDRENAKRVVFVTVGTTSFDALVKAVVSQNVKDELQKRGFTHLLIQMGRGIFFPTKCDGADGSLVVDYFTFSSSIADYIRSASLVISHAGSGSIFETLKLGKPLIVVVNEDLMDNHQCELAEALEERKHLYYTRPHSLHQTLTKMELGSLVQYTPGDGTPVARIIDRFLGFPDD

SEQ ID NO: 9272 - protein, 163 aa, Arabidopsis thaliana
  misc_feature: Ceres CLONE 14203
  misc_feature: Useful for making plants with altered Lignin content
MAEEHRLQEPRLCANNCGFFGSTATQNLCSKCFRDLQHQEQNSSTAKHALTQSLAAVGAAASSSVSPPPPPPADSKEIVEAKSEKRAAAEPEEADGPPQDPKRCLTCRRRVGITGFRCRCGFVFCGTHRYAEQHECSFDFKRMGKDKIAKANPIVKADKLEKI

SEQ ID NO: 9273 - protein, 184 aa, Arabidopsis thaliana
  misc_feature: Ceres CLONE 14234
  misc_feature: Useful for making plants with altered terpenoid content
MGLWDSLLNWLRSLFFKQEMELSLVGLQNAGKTSLVNAIATGGYSEDMIPTVGFNMRKVTKGNVTIKIWDLGGQRRFRTMWERYCRGVSAIVYVIDAADRDSVPISRSELNDLLTKPSLNGIPLLILGNKIDKSEALSKQALVDQLGLESVTDREVCCYMISCKDSINIDAVIDWLIKHSRTAT

SEQ ID NO: 9274 - protein, 329 aa, Arabidopsis thaliana
  misc_feature: Ceres CLONE 14246
  misc_feature: Useful for making plants with altered Lignin content
  misc_feature: Useful for making plants with altered cell wall content and/or composition
  misc_feature: Useful for making plants with altered terpenoid content
MSSAYCSSAVAVSAAATASSAATFNPLLSSHSNSQLFYRFTPKSFKLVANCPNPLILHSNIRRHRFFCAAETEASSADDEIQASVEEEEEVEEEGDEGEEEVEEEKQTTQASGEEGRLYVGNLPYTITSSELSQIFGEAGTVVDVQIVYDKVTDRSRGFGFVTMGSIEEAKEAMQMFNSSQIGGRTVKVNFPEVPRGGENEVMRTKIRDNNRSYVDSPHKVYAGNLGWNLTSQGLKDAFGDQPGVLGAKVIYERNTGRSRGFGFISFESAENVQSALATMNGVEVEGRALRLNLASEREKPTVSPPSVEEGETEEASLESNEVLSNVSA

SEQ ID NO: 9275 - protein, 67 aa, Arabidopsis thaliana
  misc_feature: Ceres CLONE 14272
  misc_feature: Useful for making plants with modulated nitrogen use efficiency
MDKALTGISAAALTASMVIPEIAEAAGSGISPSLKNFLLSIASGGLVLTVIIGVVVGVSNFDPVKRT

SEQ ID NO: 9276 - protein, 81 aa, Arabidopsis thaliana
  misc_feature: Ceres CLONE 143475
  misc_feature: Useful for making plants with altered Lignin content
  misc_feature: Useful for making plants with modulated low light sensitivity
MASNSMSSSASWTRKENKLFERALATYDQDTPDRWHNVARAVGGKSAEEVRRHYELLIRDVNDIESGRYPHPNYRSNGNNH

SEQ ID NO: 9277 - protein, 258 aa, Arabidopsis thaliana
  misc_feature: Ceres CLONE 14365
  misc_feature: Useful for making plants with modulated biomass
  misc_feature: The plant is abnormally small.
MKIFHVPCLQDNYSYLIIDESTGDAAVVDPVDPEKVIASAEKHQAKIKFVLTTHHHWDHAGGNEKIKQLVPDIKVYGGSLDKVKGCTDAVDNGDKLTLGQDINILALHTPCHTKGHISYYVTGKEGENPAVFTGDTLFVAGCGKFFEGTAEQMYQSLCVTLAALPKPTQVYCGHEYTVKNLEFALTVEPNNGKIQQKLAWARQQRQADLPTIPSTLEEELETNPFMRVDKPEIQEKLGCKSPIDTMREVRNKKDQWRG

SEQ ID NO: 9278 - protein, 315 aa, Zea mays
  misc_feature: Ceres CLONE 1449250
  misc_feature: Useful for biocontainment applications
  misc_feature: Useful for making plants with modulated biomass
  misc_feature: The plant is abnormally small.
  misc_feature: The plant produces a reduced number of seeds.
MEGSRNSPDRQSSGGSPEERGSGGSGGRGAGEPVRSRWTPKPEQILILESIFNSGMVNPPKDETVRIRKLLERFGAVGDANVFYWFQNRRSRSRRRQRQMQAAAAAAATAAAASSAANSSPGASATVGLPSGALQYPLVMSGSGSACQYEQQASSSSSSGSTGGSSLGLFALGAGVPSTGGGFFQESCGASSPLATGLMMGDVDRSGGSDDLFAIFRQMGFAAATPVASASVTPPSTTAHHQQYYSCQSPTGTITVFINGVPMEVPSGPIDMRAIFGQDVLLVHSTGALLPVDDYGILTQSLQTGESYFLVARPT

SEQ ID NO: 9279 - protein, 102 aa, Arabidopsis thaliana
  misc_feature: HVG ID no. 145
  misc_feature: Useful for making plants with altered protein content
MDKVMRMSSEKGVVIFTKSSCCLCYAVQILFRDLRVQPTIHEIDNDPDCREIEKALLRLGCSTAVPAVFVGGKLVGSTNEVMSLHLSGSLVPLIKPYQSILY

SEQ ID NO: 9280 - protein, 434 aa, Zea mays
  misc_feature: CLONE 285705
  misc_feature: Useful for making plants with altered protein content
MEDNAVEEPELSGAAEFAPALVAAHPHGNSVAVAIGPELRVFDLRAGHPVSLSDDCGGHSHSDAIRAICFSVSGALFASAGDDKLVKVWKTDSWRCIQTITSEKRVSAVVISNDDLYVSFADKFGVVWLVTLREDSAEQVSVDNKPVPILGHYCSIITSMKFSPDGRFIATADRDFKIRVTLFPKNPLKGAHEIQSFCLGHTDFVSCITFTSISENQSFLISGGGDSTVRLWDYVNGCLLDTFQAKDKMGELLGPNETDDSSLAITDICPSNDGSLVAVAIQSFSGIMLLACDLVGKKLSFLKVITMEKSYIPTSLASSSASELLWTVMGASNMPSQASSHLLTRLRIITCFQKDRLSSSDAGPATLEDGDVPHGEKLLLALQGSLDVAKQEEVLASVLAALKVSMHKMLVKKHYSEERREQRKRGRNDKKMKN

SEQ ID NO: 9281 - protein, 99 aa, Arabidopsis thaliana
  misc_feature: Ceres CLONE 147358
  misc_feature: Useful for making plants with modulated biomass
  misc_feature: Useful for making plants with modulated flowering time
  misc_feature: The plant flowers significantly late compared to wild-type.
  misc_feature: The plant is abnormally small.
MSGRKETVLDLAKFVDKGVQVKLTGGRQVTGTLKGYDQLLNLVLDEAVEFVRDHDDPLKTTDQTRRLGLIVCRGTAVMLVSPTDGTEEIANPFVTAEAV

SEQ ID NO: 9282 - protein, 258 aa, Arabidopsis thaliana
  misc_feature: Ceres CLONE 14792
  misc_feature: Useful for making plants with modulated nitrogen use efficiency
MGRVIRAQRKGAGSVFKSHTHHRKGPAKFRSLDFGERNGYLKGVVTEIIHDPGRGAPLARVAFRHPFRFKKQKELFVAAEGMYTGQFLYCGKKATLVVGNVLPLRSIPEGAVICNVEHHVGDRGVFARASGDYAIVIAHNPDNDTSRIKLPSGSKKIVPSGCRAMIGQVAGGGRTEKPMLKAGNAYHKYRVKRNCWPKVRGVAMNPVEHPHGGGNHQHIGHASTVRRDAPPGKKVGLIAARRTGRLRGQAAALASKAD

SEQ ID NO: 9283 - protein, 167 aa, Arabidopsis thaliana
  misc_feature: Ceres CLONE 14816
  misc_feature: Useful for making plants with modulated drought sensitivity
MDYEYGGGEYCRRGHVPAFGSWDWNDAVPFTQCFETATTQQPAFLHYASYPQDRDLYLAGDLYDNHHLVAPAVIIVPRRRAKVGQEPAEKKRNVSKQQHNYKTEAREFNAPVSCPTPVVKRRMKAPKPVDEDLYKVSPQLLSVKSKRKRGGGGFGCISRCFLPTRVL

SEQ ID NO: 9284 - protein, 171 aa, Zea mays
  misc_feature: HVG ID no. 149
  misc_feature: Useful for making plants with altered oil content
MGTQAPENYPAEKVQDARSAREKAIDDWLPITSSRNAKWWYSAFHNVTAMVGAGVLSLPYAMSELGWGPGIAVLVVSWVITLYTLWQMVEMHEMVPGKRFDRYHELGQHAFGDRLGLWIVVPQQLVVEVGVNIVYMVTGGKSLKKFHDVAGVRRHGGVRGERTTSRPPTSS

SEQ ID NO: 9285 - protein, 181 aa, Arabidopsis thaliana
  misc_feature: Ceres CLONE 14909
  misc_feature: Useful for making plants with altered Lignin content
  misc_feature: Useful for making plants with altered alkaloid content
MGLSFGKLFSKLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 9286 - protein, 202 aa, Arabidopsis thaliana
  misc_feature: Ceres CLONE 1492
  misc_feature: Useful for making plants with altered Lignin content
MNPEYDYLFKLLLIGDSGVGKSCLLLRFADDSYLDSYISTIGVDFKIRTVEQDGKTIKLQIWDTAGQERFRTITSSYYRGAHGIIVTYDVTDLESFNNVKQWLNEIDRYASENVNKLLVGNKNDLTSQKVVSTETAKAFADELGIPFLETSAKNATNVEEAFMAMTAAIKTRMASQPAGGAKPPTVQIRGQPVNQQSGCCSS

SEQ ID NO: 9287 - protein, 210 aa, Arabidopsis thaliana
  misc_feature: Ceres CLONE 149211
  misc_feature: Useful for making plants with altered alkaloid content
MGQMLKKFPKEELWEPPPKSRRSRSRSPRRSRSPRRSRSPPRRRSPRRSRSPRRRSRDDYREKDYRKQSRSRSYDRRERHEEKDRDHRRRTRSRSASPDEKRRVRGRYDNESRSHSRSLSASPARRSPRSSSPQKTSPAREVSPDKRSNERSPSPRRSLSPRSPALQKASPSKEMSPERRSNERSPSPGSPAPLRKVDAASRSQSPYAAE

SEQ ID NO: 9288 - protein, 333 aa, Arabidopsis thaliana
  misc_feature: SEEDLINE ME11411
  misc_feature: Useful for making plants with altered protein content
MEATDIWGEIERSESYLVCSMYEEAESLSSSILKRIFGNIDVLSDEASQGDHQFHDMLESAGMVLVQSLHGIGRTVEIVNELRDVFGEVAAIPVQVLLTGVCLQISNGSYLGVRDILEEFFRIWVYKDNHYILNDAGVSTKGFHAKNCLDIDEYMEVVELYTFGVLAKFSNDMGLAISWVEKAALPEERRQGILRRLHSLLSLKTASSFEENSKDSSYAVVNNKKSLGNEKNDEIDSFLKLSKQHEPWSLWSSHPLSLKVGNTQFSMSRGKVAVSLVGLIICYALKRKRAALIRIIRRQMESTRKAIVDFWKLAFSYQVNPLAAIQSIPSTTT

SEQ ID NO: 9289 - protein, 324 aa, Arabidopsis thaliana
  misc_feature: Ceres CLONE 151034
  misc_feature: Useful for biocontainment applications
  misc_feature: Useful for making plants with altered cell wall content and/or composition
  misc_feature: Useful for making plants with altered lignin content
  misc_feature: Useful for making plants with modulated biomass
  misc_feature: The plant produces a reduced number of seeds.
MDNIMQSSMPPGFRFHPTEEELVGYYLDRKINSMKSALDVIVEIDLYKMEPWDIQARCKLGYEEQNEWYFFSHKDRKYPTGTRTNRATAAGFWKATGRDKAVLSKNSVIGMRKTLVYYKGRAPNGRKSDWIMHEYRLQNSELAPVQEEGWVVCRAFRKPIPNQRPLGYEPWQNQLYHVESSNNYSSSVTMNTSHHIGASSSSHNLNQMLMSNNHYNPNNTSSSMHQYGNIELPQLDSPSLSPSLGTNKDQNESFEQEEEKSFNCVDWRTLDTLLETQVIHPHNPNILMFETQSYNPAPSFPSMHQSYNEVEANIHHSLGCFPDS

SEQ ID NO: 9290 - protein, 272 aa, Zea mays
  misc_feature: CLONE 400568
  misc_feature: Useful for making plants with altered protein content
MWGFASNAWASGLGKRSPPNCTSSSAACSDDEASSCTSREEGLECPICWESFNIVENVPYVLWCGHTLCKNCVLGLQWAVIKVPTVPMQLPFFVCCPWCNLLSLRILYKGNLTFPRKNYFLLWMVEGMNGERARSRPATHSEQHTPWLSSSSRANGNAGCSNPTRRHLPLPPPVDTTSPTNANHANHGVPVPLLNAERVQASLRKSLSFLVHLTAKFPLVFIFLLIVLYAIPASAAVLLLYILITVLFALPSFLILYFAYPSLDWLVREIFA

SEQ ID NO: 9291 - protein, 196 aa, Arabidopsis thaliana
  misc_feature: Ceres CLONE 152076
  misc_feature: Useful for making plants with modulated biomass
  misc_feature: The plant is abnormally small.
MATSMSLNLIGAFKGLSLSSTSSFLRGELSFSPKTTFTVTLPLENLQAPVPLTIESAHKKGAGSTKNGRDSPGQRLGVKIYGDQVAKPGAIIVRQRGTKFHAGKNVGIGKDHTIFSLIDGLVKFEKFGPDRKKISVYPREIVPENPNSYRARKRENFRLQREKKKARRENYTYTLPTPELVLASASIDDAEANPEC

SEQ ID NO: 9292 - protein, 404 aa, Arabidopsis thaliana
  misc_feature: Ceres CLONE 152141
  misc_feature: Useful for making plants with modulated biomass
  misc_feature: The plant is abnormally small.
MAAALQTNIRTVKVPATFRAVSKQSLAPFRVRCAVASPGKKRYTITLLPGDGIGPEVVSIAKNVLQQAGSLEGVEFNFREMPIGGAALDLVGVPLPEETISAAKESDAVLLGAIGGYKWDNNEKHLRPEKGLLQIRAALKVFANLRPATVLPQLVDASTLKREVAEGVDLMVVRELTGGIYFGEPRGIKTNENGEEVGFNTEVYAHEIDRIARVAFETARKRRGKLCSVDKANVLEASILWRKRVTALASEYPDVELSHMYVDNAAMQLVRDPKQFDTIVTNNIFGDILSDEASMITGSIGMLPSASLSDSGPGLFEPIHGSAPDIAGQDKANPLATILSAAMLLKYGLGEEKAAKRIEDAVLVALNNGFRTGDIYSAGTKLVGCKEMGEEVLKSVDSQVPASV

SEQ ID NO: 9293 - protein, 268 aa, Arabidopsis thaliana
  misc_feature: SEEDLINE ME12384
  misc_feature: Useful for making plants with altered alkaloid content
  misc_feature: Useful for making plants with altered protein content
MVNQRRRLAQKRYKEANPELFPKAEPTPPKDPNKKKKKKSLFKKKKPGSSTDRPQRTGSSTRHPLRVPGMKPGEGCFICHSKTHIAKLCPEKSEWERNKICLQCRRRGHSLKNCPEKNNESSEKKLCYNCGDTGHSLSHCPYPMEDGGTKFASCFICKGQGHISKNCPENKHGIYPMGGCCKVCGSVAHLVKDCPDKFNQESAQPKKTSRFDATPRGKLTKFSGDDLEDDFTEEPKSSKKINTSDDSAQNSVEVKKKKQGPKIVNFVG

SEQ ID NO: 9294 - protein, 244 aa, Arabidopsis thaliana
  misc_feature: CLONE 21863
  misc_feature: Useful for making plants with altered Lignin content
  misc_feature: Useful for making plants with altered alkaloid content
  misc_feature: Useful for making plants with altered lutein content
MPSTPTTPTTTTPITASYWCYSCTRFVSVWADQGTTTVGSVACPHCDGGFIEQINDSSSAATELTIPASTEVRSINNNRRSVIRRRRSGRRPSFNPVIVLQGGAGEREEGEEGDAARDRRAFEFYYDDGSGSGLRPLPDSVSEILMGSGFERLLEQLSQIEASATGIGRSGNPPASKSAIESLPRVEISDCHIGSEANCAVCTEIFETETEAREMPCKHLFHDDCIVPWLSIRNSCPVCRFELP

SEQ ID NO: 9295 - protein, 251 aa, Arabidopsis thaliana
  misc_feature: Ceres CLONE 156298
  misc_feature: Useful for making plants with altered Lignin content
MYYQLTKSSYRDSLKILEADIEHANGLAAEIPMGKSGVRLQMKLVCSNLAPFFIFLLQWMDFSCLLPRYFDFFHILIYKVRADGRWNRSRYGRKATIREFYGVILPSLERLHINFADLPDESLWYPNPKAITKKQYDIEGSRYMNSIDLEREDECGICLEPCTKMVLPNCCHAMCIKCYRNWNTKSESCPFCRGSIKRVNSEDLWVLTCDEDVVDPETVTKEDLLRFYLHINSLPKDYPEAAFLVYNEYLI

SEQ ID NO: 9296 - protein, 349 aa, Arabidopsis thaliana
  misc_feature: CLONE 110454
  misc_feature: Useful for making plants with modulated biomass
  misc_feature: Useful for making plants with modulated low light sensitivity
  misc_feature: The plant is abnormally small.
MDSNFHYSIDLNEDQNHHEQPFFYPLGSSSSLHHHHHHHHHQVPSNSSSSSSSISSLSSYLPFLINSQEDQHVAYNNTYHADHLHLSQPLKAKMFVANGGSSSCDHMVPKKETRLKLTIRKKDHEDQPHPLHQNPTKPDSDSDKWLMSPKMRLIKKTITNNKQLTDQTNNNNHKESDHYPLNHKTNFDEDHHEDLNFKNVLTRKTTAATTENRYNTINENGYSNNNGVIRVCSDCNTTKTPLWRSGPRGPKSLCNACGIRQRKARRAAMAAAAAAGDQEVAVAPRVQQLPLKKKLQNKKKEIKRRGKIQSLSSNGGQGQKVQDQRGRGEGNGSGNGCRRFRDQQIYNFF

SEQ ID NO: 9297 - protein, 379 aa, Arabidopsis thaliana
  misc_feature: Ceres CLONE 158240
  misc_feature: Useful for making plants with altered Lignin content
MCGGAIISDFIPPPRSLRVTNEFIWPDLKNKVKASKKRSNKRSDFFDLDDDFEADFQGFKDDSAFDCEDDDDVFVNVKPFVFTATTKPVASAFVSTGIYLVGSAYAKKTVESAEQAEKSSKRKRKNQYRGIRQRPWGKWAAEIRDPRKGSREWLGTFDTAEEAARAYDAAARRIRGTKAKVNFPEEKNPSVVSQKRPSAKTNNLQKSVAKPNKSVTLVQQPTHLSQQYCNNSFDNSFGDMSFMEEKPQMYNNQFGLTNSFDAGGNNGYQYFSSDQGSNSFDCSEFGWSDHGPKTPEISSMLVNNNEASFVEETNAAKKLKPNSDESDDLMAYLDNALWDTPLEVKAMLGADAGAVTQEEENPVELWSLDEINFMLEGDF

SEQ ID NO: 9298 - protein, 148 aa, Arabidopsis thaliana
  misc_feature: Ceres CLONE 158734
  misc_feature: Useful for making plants with altered alkaloid content
  misc_feature: Useful for making plants with modulated drought sensitivity
  misc_feature: Useful for making plants with modulated heat sensitivity
MPSRYPEAVTQDWEPVVLHKSKQKSQDLRDPKAVNAALRNGVAVQTVKKFDAGSNKKGKSTAVPVINTKKLEEETEPAAMDRVKAEVRLMIQKARLEKKMSQADLAKQINERTQVVQEYENGKAVPNQAVLAKMEKVLGVKLRGKIGK

SEQ ID NO: 9299 - protein, 134 aa, Arabidopsis thaliana
  misc_feature: Ceres CLONE 158765
  misc_feature: Useful for making plants with modulated heat sensitivity
MSALSEKAASNATSLISLFNSKERKDKVGERISALQQIVSPYGKTDTASVLLDAMHYIEFLHEQVKVLSAPYLQTIPDATQEELEQYSLRNRGLCLVPMENTVGVAQSNGADIWAPVKTPLSPAFSVTSQSPFR

SEQ ID NO: 9300 - protein, 245 aa, Parthenium argentatum
  misc_feature: Ceres CLONE 1604678
  misc_feature: Useful for making plants with modulated biomass
  misc_feature: Useful for making plants with modulated flowering time
  misc_feature: The plant flowers significantly earllier than wild-type.
  misc_feature: The rosette leaves do not appear in the normal fashion, i.e., their phyllotaxy may be abnormal or too many leaves may be emerging in comparison to the control.
MGRGRVQLKRIENKISRQVTFSKRRTGLLKKAHEISVLCDADVALIVFSTKGKLFEYSTHSSMEAILERYERYSYAEKLLTGPEAETQGSWALESSKLRTKIEVLEKNIRHYGGEDLEPLNLRELQGVEQQLDTALKRIRTRKNQVMHESISELHKKERVLQEQNNALSKKLKEDDKNTEQQNVGLLLSQAQAPVPTSLPQPPRLVPLAVGSGPFQGSSITREDDSAQVLSAGMMPAWLYRHVNQ

SEQ ID NO: 9301 - protein, 131 aa, Arabidopsis thaliana
  misc_feature: HVG ID no. 161
  misc_feature: Useful for making plants with modulated light quality response
  misc_feature (26)..(26): Xaa is any aa, unknown, or other
  misc_feature (45)..(45): Xaa is any aa, unknown, or other
  misc_feature (54)..(54): Xaa is any aa, unknown, or other
  misc_feature (80)..(80): Xaa is any aa, unknown, or other
MFSPGNLRATFDNSEYSKLIDYYVKXIYTLRYTGGMVPDVNQIIXKEKGIFTNXTSPTAKAKLRLLFEVAPLGLLIENAXGFSSDGHKSVLDKTIINLDDRTQVAYGSKNEIIRFEETLYGTSRLKNVPIG

SEQ ID NO: 9302 - protein, 500 aa, Zea mays
  misc_feature: CLONE 424522
  misc_feature: Useful for making plants with modulated nitrogen use efficiency
  misc_feature: Useful for making plants with modulated nitrogen use efficiency
MGRKPDAVAKSYHSGGGGAAASSPRAARKASPSPVFLGTALFVLGFVSLFTGHVVTDADWARIRSRWRPKQHRNYEPIDIWESKYSSMYYGCSERSASFRSAVPENSSTGYLLIATSGGLNQQRIGITDAVVVAWILNATLVVPELDHHSFWKDDSDFSDIFDVEWFISHLSKDVTIVKRIPYEVMLSMDKLPWTMRAPRKSVPEFYIDEVLPILMRRRALQLTKFDYRLTSDLDEDLQKLRCRVNFHALKFTSSIHAMGQKLVQKLRLMNTRYVAIHLRFEPDMLAFSGCYYGGGEKERKELGEIRKRWDTLPELSAEDERSRGKCPLTPHEVGLMLRALGFGNDTLLYVASGEIYGGDSTLQPLRGLFPNFYTKEKLAGDDLNPFLPFSSRLAAIDFIVCDESDVFVTNNNGNMAKVLAGRRRYMGHKRTIRPNAKKLNVLFQTRNQLSWDTFSRKVQRVQRGLMGEPDDIRPKQDDFHEFPSSCICSRKPGNISATT

SEQ ID NO: 9303 - protein, 500 aa, Zea mays subsp. mays; identical to SEQ ID NO: 9302
  misc_feature: CLONE 424522
  misc_feature: Useful for making plants with modulated nitrogen use efficiency
  misc_feature: Useful for making plants with modulated nitrogen use efficiency

SEQ ID NO: 9304 - protein, 207 aa, Arabidopsis thaliana
  misc_feature: Ceres CLONE 1610
  misc_feature: Useful for making plants with modulated biomass
  misc_feature: Useful for making plants with modulated flowering time
  misc_feature: The plant flowers significantly late compared to wild-type.
  misc_feature: The plant is abnormally small.
MATAADVDAEIQQALTNEVKLFNRWTYDDVTVTDISLVDYIGVQAAKHATFVPHTAGRYSVKRFRKAQCPIVERLTNSLMMHGRNNGKKLMAVRIIKHAMEIIHLLSDLNPIQVIIDAIVNSGPREDATRIGSAGVVRRQAVDISPLRRVNQAIFLITTGAREAAFRNIKTIAECLADELINAAKGSSNSYAIKKKDEIERVAKANR

SEQ ID NO: 9305 - protein, 139 aa, Arabidopsis thaliana
  misc_feature: HVG ID no. 162
  misc_feature: Useful for making plants with modulated biomass
MDHAADAHRTDLMTITRFVLNEQSKYPESRGDFTILLSHIVLGCKFVCSAVNKAGLAKLIGLAGETNIQGEEQKKLDVLSNDVFVNALVSSGRTSVLVSEEDEEATFVEPSKRGKYCVVFDPLDGSSNIDCGVSIGTMF

SEQ ID NO: 9306 - protein, 166 aa, Arabidopsis thaliana
  misc_feature: CLONE 15457
  misc_feature: Useful for making plants with modulated nitrogen use efficiency
  misc_feature: Useful for making plants with modulated oxidative stress sensitivity
  misc_feature: Useful for making plants with modulated nitrogen use efficiency
  misc_feature: Useful for making plants with modulated oxidative stress sensitivity
MRLLVAEAASPLSSAATPTCNSHTCRWKPYSNSTDFTANASVLLILVISALICALSLYAAIRCFLRPTLETEDDHKPDPEAAASSTPTTPTLVYSSDLELAGAEAECAICLSEFEQGESIQVLEKCQHGFHVKCIHKWLSTRSSCPTCRTSIFSQHSETPSSHINA

SEQ ID NO: 9307 - protein, 359 aa, Arabidopsis thaliana
  misc_feature: CLONE 101255
  misc_feature: Useful for making plants with modulated nitrogen use efficiency
MMIGESHRGFNPTVHIPPWPLSEDLTVSDIYGSPDGGSSMMEALAELQRYLPSNEPDPDSDPDLSGPDSPIDAYTCDHFRMYEFKVRRCARGRSHDWTECPYAHPGEKARRRDPRKFHYSGTACPEFRKGCCKRGDACEFSHGVFECWLHPARYRTQPCKDGGNCRRRVCFFAHSPDQIRVLPNQSPDRVDSFDVLSPTIRRAFQFSISPSSNSPPVSPRGDSDSSCSLLSRSLGSNLGNDVVASLRNLQLNKVKSSLSSSYNNQIGGYGSGFGSPRGSVLGPGFRSLPTTPTRPGFMNIWENGLEEEPAMERVESGRELRAQLFEKLSKENCMGRIEPDPDQGAGDTPDVGWVSDLVM

SEQ ID NO: 9308 - protein, 2657 aa, Arabidopsis thaliana
  misc_feature: HVG ID no. 168
  misc_feature: Useful for making plants with altered cell wall content and/or composition
MNTGGRLIAGSHNRNEFVLINADESARIRSVQELSGQTCQICGDEIELTVSSELFVACNECAFPVCRPCYEYERREGNQACPQCKTRYKRIKGSPRVDGDDEEEEDIDDLEYEFDHGMDPEHAAEAALSSRLNTGRGGLDSAPPGSQIPLLTYCDEDADMYSDRHALIVPPSTGYGNRVYPAPFTDSSAPPQARSMVPQKDIAEYGYGSVAWKDRMEVWKRRQGEKLQVIKHEGGNNGRGSNDDDELDDPDMPMMDEGRQPLSRKLPIRSSRINPYRMLILCRLAILGLFFHYRILHPVNDAYGLWLTSVICEIWFAVSWILDQFPKWYPIERETYLDRLSLRYEKEGKPSGLAPVDVFVSTVDPLKEPPLITANTVLSILAVDYPVDKVACYVSDDGAAMLTFEALSDTAEFARKWVPFCKKFNIEPRAPEWYFSQKMDYLKNKVHPAFVRERRAMKRDYEEFKVKINALVATAQKVPEEGWTMQDGTPWPGNNVRDHPGMIQVFLGHSGVRDTDGNELPRLVYVSREKRPGFDHHKKAGAMNSLIRVSAVLSNAPYLLNVDCDHYINNSKAIRESMCFMMDPQSGKKVCYVQFPQRFDGIDRHDRYSNRNVVFFDINMKGLDGIQGPIYVGTGCVFRRQALYGFDAPKKKKPPGKTCNCWPKWCCLCCGLRKKSKTKAKDKKTNTKETSKQIHALENVDEGVIVPVSNVEKRSEATQLKLEKKFGQSPVFVASAVLQNGGVPRNASPACLLREAIQVISCGYEDKTEWGKEIGWIYGSVTEDILTGFKMHCHGWRSVYCMPKRAAFKGSAPINLSDRLHQVLRWALGSVEIFLSRHCPIWYGYGGGLKWLERFSYINSVVYPWTSLPLIVYCSLPAVCLLTGKFIVPEISNYAGILFMLMFISIAVTGILEMQWGGVGIDDWWRNEQFWVIGGASSHLFALFQGLLKVLAGVNTNFTVTSKAADDGAFSELYIFKWTTLLIPPTTLLIINIIGVIVGVSDAISNGYDSWGPLFGRLFFALWVIVHLYPFLKGMLGKQDKMPTIIVVWSILLASILTLLWVRVNPFVAKGGPVLEICGLNCGNMNTGGRLIAGSHNRNEFVLINADESARIRSVQELSGQTCQICGDEIELTVSSELFVACNECAFPVCRPCYEYERREGNQACPQCKTRYKRIKGSPRVDGDDEEEEDIDDLEYEFDHGMDPEHAAEAALSSRLNTGRGGLDSAPPGSQIPLLTYCDEDADMYSDRHALIVPPSTGYGNRVYPAPFTDSSAPPQARSMVPQKDIAEYGYGSVAWKDRMEVWKRRQGEKLQVIKHEGGNNGRGRQPLSRKLPIRSSRINPYRMLILCRLAILGLFFHYRILHPVNDAYGLWLTSVICEIWFAVSWILDQFPKWYPIERETYLDRLSLRYEKEGKPSGLAPVDVFVSTVDPLKEPPLITANTVLSILAVDYPVDKVACYVSDDGAAMLTFEALSDTAEFARKWVPFCKKFNIEPRAPEWYFSQKMDYLKNKVHPAFVRERRAMKRDYEEFKVKINALVATAQKVPEEGWTMQDGTPWPGNNVRDHPGMIQVFLGHSGVRDTDGNELPRLVYVSREKRPGFDHHKKAGAMNSLIRVSAVLSNAPYLLNVDCDHYINNSKAIRESMCFMMDPQSGKKVCYVQFPQRFDGIDRHDRYSNRNVVFFDINMKGLDGIQGPIYVGTGCVFRRQALYGFDAPKKKKPPGKTCNCWPKWCCLCCGLRKKSKTKAKDKKTNTKETSKQIHALENVDEGVIVPVSNVEKRSEATQLKLEKKFGQSPVFVASAVLQNGGVPRNASPACLLREAIQVISCGYEDKTEWGKEIGWIYGSVTEDILTGFKMHCHGWRSVYCMPKRAAFKGSAPINLSDRLHQVLRWALGSVEIFLSRHCPIWYGYGGGLKWLERFSYINSVVYPWTSLPLIVYCSLPAVCLLTGKFIVPEISNYAGILFMLMFISIAVTGILEMQWGGVGIDDWWRNEQFWVIGGASSHLFALFQGLLKVLAGVNTNFTVTSKAADDGAFSELYIFKWTTLLIPPTTLLIINIIGVIVGVSDAISNGYDSWGPLFGRLFFALWVIVHLYPFLKGMLGKQDKMPTIIVVWSILLASILTLLWVRVNPFVAKGGPVLEICGLNCGNMCFMMDPQSGKKVCYVQFPQRFDGIDRHDRYSNRNVVFFDINMKGLDGIQGPIYVGTGCVFRRQALYGFDAPKKKKPPGKTCNCWPKWCCLCCGLRKKSKTKAKDKKTNTKETSKQIHALENVDEGVIVPVSNVEKRSEATQLKLEKKFGQSPVFVASAVLQNGGVPRNASPACLLREAIQVISCGYEDKTEWGKEIGWIYGSVTEDILTGFKMHCHGWRSVYCMPKRAAFKGSAPINLSDRLHQVLRWALGSVEIFLSRHCPIWYGYGGGLKWLERFSYINSVVYPWTSLPLIVYCSLPAVCLLTGKFIVPEISNYAGILFMLMFISIAVTGILEMQWGGVGIDDWWRNEQFWVIGGASSHLFALFQGLLKVLAGVNTNFTVTSKAADDGAFSELYIFKWTTLLIPPTTLLIINIIGVIVGVSDAISNGYDSWGPLFGRLFFALWVIVHLYPFLKGMLGKQDKMPTIIVVWSILLASILTLLWVRVNPFVAKGGPVLEICGLNCGN

SEQ ID NO: 9309 - protein, 148 aa, Arabidopsis thaliana
  misc_feature: Ceres CLONE 16865
  misc_feature: Useful for biocontainment applications
  misc_feature: The plant produces a reduced number of seeds.
MASKRILKELKDLQKDPPTSCSAGPVAEDMFHWQATIMGPAESPYSGGVFLVTIHFPPDYPFKPPKVAFRTKVFHPNINSNGSICLDILKEQWSPALTISKVLLSICSLLTDPNPDDPLVPEIAHMYKTDRAKYKATARNWTQKYAMG

SEQ ID NO: 9310 - protein, 1174 aa, Arabidopsis thaliana
  misc_feature: HVG ID no. 169
  misc_feature: Useful for making plants with altered cell wall content and/or composition
MESEGETAGKPMKNIVPQTCQICSDNVGKTVDGDRFVACDICSFPVCRPCYEYERKDGNQSCPQCKTRYKRLKGSPAIPGDKDEDGLADEGTVEFNYPQKEKISERMLGWHLTRGKGEEMGEPQYDKEVSHNHLPRLTSRQDTSGEFSAASPERLSVSSTIAGGKRLPYSSDVNQSPNRRIVDPVGLGNVAWKERVDGWKMKQEKNTGPVSTQAASERGGVDIDASTDILADEALLNDEARQPLSRKVSIPSSRINPYRMVIMLRLVILCLFLHYRITNPVPNAFALWLVSVICEIWFALSWILDQFPKWFPVNRETYLDRLALRYDREGEPSQLAAVDIFVSTVDPLKEPPLVTANTVLSILAVDYPVDKVSCYVSDDGAAMLSFESLAETSEFARKWVPFCKKYSIEPRAPEWYFAAKIDYLKDKVQTSFVKDRRAMKREYEEFKIRINALVSKALKCPEEGWVMQDGTPWPGNNTRDHPGMIQVFLGQNGGLDAEGNELPRLVYVSREKRPGFQHHKKAGAMNALVRVSAVLTNGPFILNLDCDHYINNSKALREAMCFLMDPNLGKQVCYVQFPQRFDGIDKNDRYANRNTVFFDINLRGLDGIQGPVYVGTGCVFNRTALYGYEPPIKVKHKKPSLLSKLCGGSRKKNSKAKKESDKKKSGRHTDSTVPVFNLDDIEEGVEGAGFDDEKALLMSQMSLEKRFGQSAVFVASTLMENGGVPPSATPENLLKEAIHVISCGYEDKSDWGMEIGWIYGSVTEDILTGFKMHARGWRSIYCMPKLPAFKGSAPINLSDRLNQVLRWALGSVEILFSRHCPIWYGYNGRLKFLERFAYVNTTIYPITSIPLLMYCTLPAVCLFTNQFIIPQISNIASIWFLSLFLSIFATGILEMRWSGVGIDEWWRNEQFWVIGGVSAHLFAVFQGILKVLAGIDTNFTVTSKASDEDGDFAELYLFKWTTLLIPPTTLLIVNLVGVVAGVSYAINSGYQSWGPLFGKLFFAFWVIVHLYPFLKGLMGRQNRTPTIVVVWSVLLASIFSLLWVRIDPFTSRVTGPDILECGINCLFKWTTLLIPPTTLLIVNLVGVVAGVSYAINSGYQSWGPLFGKLFFAFWVIVHLYPFLKGLMGRQNRTPTIVVVWSVLLASIFSLLWVRIDPFTSRVTGPDILECGINC

SEQ ID NO: 9311 - protein, 164 aa, Arabidopsis thaliana
  misc_feature: CLONE 251923
  misc_feature: Useful for making plants with modulated flowering time
MPAGHGVRARTRDLFARPFRKKGYIPLSTYLRTFKVGDYVDVKVNGAIHKGIPHKFYHGRTGRIWNVTKRAVGVEVNKQIGNRIIRKRIHVRVEHVQQSRCAEEFKLRKKQNDVLKADAKARGETISTKRQPKGPKPGFMVEGMTLETVTPIPYDVVNDLKGGY

SEQ ID NO: 9312 - protein, 128 aa, Arabidopsis thaliana
  misc_feature: Ceres CLONE 17002
  misc_feature: Useful for making plants with modulated heat sensitivity
MEDNDKSPPKDYYKILEVDYDATEELIRLNYRKLALKWHPDKHKGDSAATEKFQEINEAYNVLMDPAKRFEYDFTGIYEIHKYTLREYLARFKGMILTCNGLGISQSSSPWTHQLAETTKQQTSKDTV

SEQ ID NO: 9313 - protein, 2526 aa, Arabidopsis thaliana
  misc_feature: HVG ID no. 171
  misc_feature: Useful for making plants with altered cell wall content and/or composition
MNTGGRLIAGSHNRNEFVLINADESARIRSVEELSGQTCQICGDEIELSVDGESFVACNECAFPVCRPCYEYERREGNQSCPQCKTRYKRIKGSPRVEGDEEDDGIDDLDFEFDYSRSGLESETFSRRNSEFDLASAPPGSQIPLLTYGEEDVEISSDSHALIVSPSPGHIHRVHQPHFPDPAAHPRPMVPQKDLAVYGYGSVAWKDRMEEWKRKQNEKYQVVKHDGDSSLGDGDDADIPMMDEGRQPLSRKVPIKSSKINPYRMLIVLRLVILGLFFHYRILHPVNDAYALWLISVICEIWFAVSWVLDQFPKWYPIERETYLDRLSLRYEKEGKPSELAGVDVFVSTVDPMKEPPLITANTVLSILAVDYPVDRVACYVSDDGAAMLTFEALSETAEFARKWVPFCKKYTIEPRAPEWYFCHKMDYLKNKVHPAFVRERRAMKRDYEEFKVKINALVATAQKVPEEGWTMQDGTPWPGNNVRDHPGMIQVFLGNNGVRDVENNELPRLVYVSREKRPGFDHHKKAGAMNSLIRVSGVLSNAPYLLNVDCDHYINNSKALREAMCFMMDPQSGKKICYVQFPQRFDGIDKSDRYSNRNVVFFDINMKGLDGLQGPIYVGTGCVFRRQALYGFDAPKKKKTKRMTCNCWPKWCLFCCGLRKNRKSKTTDKKKKNREASKQIHALENIEEGTKGTNDAAKSPEAAQLKLEKKFGQSPVFVASAGMENGGLARNASPASLLREAIQVISCGYEDKTEWGKEIGWIYGSVTEDILTGFKMHSHGWRSVYCTPKIPAFKGSAPINLSDRLHQVLRWALGSVEIFLSRHCPIWYGYGGGLKWLERLSYINSVVYPWTSIPLLVYCSLPAICLLTGKFIVPEISNYASILFMALFGSIAVTGILEMQWGKVGIDDWWRNEQFWVIGGVSAHLFALFQGLLKVLAGVETNFTVTSKAADDGEFSELYIFKWTSLLIPPTTLLIINVIGVIVGISDAISNGYDSWGPLFGRLFFAFWVILHLYPFLKGLLGKQDRMPTIILVWSILLASILTLLWVRVNPFVAKGGPILEICGLDCLKKKNREASKQIHALENIEEGTKGTNDAAKSPEAAQLKLEKKFGQSPVFVASAGMENGGLARNASPASLLREAIQVISCGYEDKTEWGKEIGWIYGSVTEDILTGFKMHSHGWRSVYCTPKIPAFKGSAPINLSDRLHQVLRWALGSVEIFLSRHCPIWYGYGGGLKWLERLSYINSVVYPWTSIPLLVYCSLPAICLLTGKFIVPEISNYASILFMALFGSIAVTGILEMQWGKVGIDDWWRNEQFWVIGGVSAHLFALFQGLLKVLAGVETNFTVTSKAADDGEFSELYIFKWTSLLIPPTTLLIINVIGVIVGISDAISNGYDSWGPLFGRLFFAFWVILHLYPFLKGLLGKQDRMPTIILVWSILLASILTLLWVRVNPFVAKGGPILEICGLDCLMNTGGRLIAGSHNRNEFVLINADESARIRSVEELSGQTCQICGDEIELSVDGESFVACNECAFPVCRPCYEYERREGNQSCPQCKTRYKRIKGSPRVEGDEEDDGIDDLDFEFDYSRSGLESETFSRRNSEFDLASAPPGSQIPLLTYGEEDVEISSDSHALIVSPSPGHIHRVHQPHFPDPAAHPRPMVPQKDLAVYGYGSVAWKDRMEEWKRKQNEKYQVVKHDGDSSLGDGDDPLSRKVPIKSSKINPYRMLIVLRLVILGLFFHYRILHPVNDAYALWLISVICEIWFAVSWVLDQFPKWYPIERETYLDRLSLRYEKEGKPSELAGVDVFVSTVDPMKEPPLITANTVLSILAVDYPVDRVACYVSDDGAAMLTFEALSETAEFARKWVPFCKKYTIEPRAPEWYFCHKMDYLKNKVHPAFVRERRAMKRDYEEFKVKINALVATAQKVPEEGWTMQDGTPWPGNNVRDHPGMIQVFLGNNGVRDVENNELPRLVYVSREKRPGFDHHKKAGAMNSLIRVSGVLSNAPYLLNVDCDHYINNSKALREAMCFMMDPQSGKKICYVQFPQRFDGIDKSDRYSNRNVVFFDINMKGLDGLQGPIYVGTGCVFRRQALYGFDAPKKKKTKRMTCNCWPKWCLFCCGLRKNRKSKTTDKKKKNREASKQIHALENIEEGTKGTNDAAKSPEAAQLKLEKKFGQSPVFVASAGMENGGLARNASPASLLREAIQVISCGYEDKTEWGKEIGWIYGSVTEDILTGFKMHSHGWRSVYCTPKIPAFKGSAPINLSDRLHQVLRWALGSVEIFLSRHCPIWYGYGGGLKWLERLSYINSVVYPWTSIPLLVYCSLPAICLLTGKFIVPEISNYASILFMALFGSIAVTGILEMQWGKVGIDDWWRNEQFWVIGGVSAHLFALFQGLLKVLAGVETNFTVTSKAADDGEFSELYIFKWTSLLIPPTTLLIINVIGVIVGISDAISNGYDSWGPLFGRLFFAFWVILHLYPFLKGLLGKQDRMPTIILVWSILLASILTLLWVRVNPFVAKGGPILEICGLDCL

SEQ ID NO: 9314 - protein, 147 aa, Panicum virgatum; identical to SEQ ID NO: 2
  misc_feature: Ceres CLONE 1717296
  misc_feature: Useful for biocontainment applications

SEQ ID NO: 9315 - protein, 3678 aa, Arabidopsis thaliana
  misc_feature: HVG ID no. 172
  misc_feature: Useful for making plants with altered cell wall content and/or composition
MNTGGRLIAGSHNRNEFVLINADENARIRSVQELSGQTCQICRDEIELTVDGEPFVACNECAFPVCRPCYEYERREGNQACPQCKTRFKRLKGSPRVEGDEEEDDIDDLDNEFEYGNNGIGFDQVSEGMSISRRNSGFPQSDLDSAPPGSQIPLLTYGDEDVEISSDRHALIVPPSLGGHGNRVHPVSLSDPTVAAHPRPMVPQKDLAVYGYGSVAWKDRMEEWKRKQNEKLQVVRHEGDPDFEDGDDADFPMMDEGRQPLSRKIPIKSSKINPYRMLIVLRLVILGLFFHYRILHPVKDAYALWLISVICEIWFAVSWVLDQFPKWYPIERETYLDRLSLRYEKEGKPSGLSPVDVFVSTVDPLKEPPLITANTVLSILAVDYPVDKVACYVSDDGAAMLTFEALSETAEFARKWVPFCKKYCIEPRAPEWYFCHKMDYLKNKVHPAFVRERRAMKRDYEEFKVKINALVATAQKVPEDGWTMQDGTPWPGNSVRDHPGMIQVFLGSDGVRDVENNELPRLVYVSREKRPGFDHHKKAGAMNSLIRVSGVLSNAPYLLNVDCDHYINNSKALREAMCFMMDPQSGKKICYVQFPQRFDGIDRHDRYSNRNVVFFDINMKGLDGLQGPIYVGTGCVFRRQALYGFDAPKKKKGPRKTCNCWPKWCLLCFGSRKNRKAKTVAADKKKKNREASKQIHALENIEEGRVTKGSNVEQSTEAMQMKLEKKFGQSPVFVASARMENGGMARNASPACLLKEAIQVISCGYEDKTEWGKEIGWIYGSVTEDILTGFKMHSHGWRSVYCTPKLAAFKGSAPINLSDRLHQVLRWALGSVEIFLSRHCPIWYGYGGGLKWLERLSYINSVVYPWTSLPLIVYCSLPAICLLTGKFIVPEISNYASILFMALFSSIAITGILEMQWGKVGIDDWWRNEQFWVIGGVSAHLFALFQGLLKVLAGVDTNFTVTSKAADDGEFSDLYLFKWTSLLIPPMTLLIINVIGVIVGVSDAISNGYDSWGPLFGRLFFALWVIIHLYPFLKGLLGKQDRMPTIIVVWSILLASILTLLWVRVNPFVAKGGPILEICGLDCLRLIAGSHNRNEFVLINADENARIRSVQELSGQTCQICRDEIELTVDGEPFVACNECAFPVCRPCYEYERREGNQACPQCKTRFKRLKGSPRVEGDEEEDDIDDLDNEFEYGNNGIGFDQVSEGMSISRRNSGFPQSDLDSAPPGSQIPLLTYGDEDVEISSDRHALIVPPSLGGHGNRVHPVSLSDPTVAAHPRPMVPQKDLAVYGYGSVAWKDRMEEWKRKQNEKLQVVRHEGDPDFEDGDDADFPMMDEGRQPLSRKIPIKSSKINPYRMLIVLRLVILGLFFHYRILHPVKDAYALWLISVICEIWFAVSWVLDQFPKWYPIERETYLDRLSLRYEKEGKPSGLSPVDVFVSTVDPLKEPPLITANTVLSILAVDYPVDKVACYVSDDGAAMLTFEALSETAEFARKWVPFCKKYCIEPRAPEWYFCHKMDYLKNKVHPAFVRERRAMKRDYEEFKVKINALVATAQKVPEDGWTMQDGTPWPGNSVRDHPGMIQVFLGSDGVRDVENNELPRLVYVSREKRPGFDHHKKAGAMNSLIRVSGVLSNAPYLLNVDCDHYINNSKALREAMCFMMDPQSGKKICYVQFPQRFDGIDRHDRYSNRNVVFFDINMKGLDGLQGPIYVGTGCVFRRQALYGFDAPKKKKGPRKTCNCWPKWCLLCFGSRKNRKAKTVAADKKKKNREASKQIHALENIEEGRVTKGSNVEQSTEAMQMKLEKKFGQSPVFVASARMENGGMARNASPACLLKEAIQVISCGYEDKTEWGKEIGWIYGSVTEDILTGFKMHSHGWRSVYCTPKLAAFKGSAPINLSDRLHQVLRWALGSVEIFLSRHCPIWYGYGGGLKWLERLSYINSVVYPWTSLPLIVYCSLPAICLLTGKFIVPEISNYASILFMALFSSIAITGILEMQWGKVGIDDWWRNEQFWVIGGVSAHLFALFQGLLKVLAGVDTNFTVTSKAADDGEFSDLYLFKWTSLLIPPMTLLIINVIGVIVGVSDAISNGYDSWGPLFGRLFFALWVIIHLYPFLKGLLGKQDRMPTIIVVWSILLASILTLLWVRVNPFVAKGGPILEICGLDCLMNTGGRLIAGSHNRNEFVLINADENARIRSVQELSGQTCQICRDEIELTVDGEPFVACNECAFPVCRPCYEYERREGNQACPQCKTRFKRLKGSPRVEGDEEEDDIDDLDNEFEYGNNGIGFDQVSEGMSISRRNSGFPQSDLDSAPPGSQIPLLTYGDEDVEISSDRHALIVPPSLGGHGNRVHPVSLSDPTVAAHPRPMVPQKDLAVYGYGSVAWKDRMEEWKRKQNEKLQVVRMDEGRQPLSRKIPIKSSKINPYRMLIVLRLVILGLFFHYRILHPVKDAYALWLISVICEIWFAVSWVLDQFPKWYPIERETYLDRLSLRYEKEGKPSGLSPVDVFVSTVDPLKEPPLITANTVLSILAVDYPVDKVACYVSDDGAAMLTFEALSETAEFARKWVPFCKKYCIEPRAPEWYFCHKMDYLKNKVHPAFVRERRAMKRDYEEFKVKINALVATAQKVPEDGWTMQDGTPWPGNSVRDHPGMIQVFLGSDGVRDVENNELPRLVYVSREKRPGFDHHKKAGAMNSLIRVSGVLSNAPYLLNVDCDHYINNSKALREAMCFMMDPQSGKKICYVQFPQRFDGIDRHDRYSNRNVVFFDINMKGLDGLQGPIYVGTGCVFRRQALYGFDAPKKKKGPRKTCNCWPKWCLLCFGSRKNRKAKTVAADKKKKNREASKQIHALENIEEGRVTKGSNVEQSTEAMQMKLEKKFGQSPVFVASARMENGGMARNASPACLLKEAIQVISCGYEDKTEWGKEIGWIYGSVTEDILTGFKMHSHGWRSVYCTPKLAAFKGSAPINLSDRLHQVLRWALGSVEIFLSRHCPIWYGYGGGLKWLERLSYINSVVYPWTSLPLIVYCSLPAICLLTGKFIVPEISNYASILFMALFSSIAITGILEMQWGKVGIDDWWRNEQFWVIGGVSAHLFALFQGLLKVLAGVDTNFTVTSKAADDGEFSDLYLFKWTSLLIPPMTLLIINVIGVIVGVSDAISNGYDSWGPLFGRLFFALWVIIHLYPFLKGLLGKQDRMPTIIVVWSILLASILTLLWVRVNPFVAKGGPILEICGLDCLFRRQALYGFDAPKKKKGPRKTCNCWPKWCLLCFGSRKNRKAKTVAADKKKKNREASKQIHALENIEEGRVTKGSNVEQSTEAMQMKLEKKFGQSPVFVASARMENGGMARNASPACLLKEAIQVISCGYEDKTEWGKEIGWIYGSVTEDILTGFKMHSHGWRSVYCTPKLAAFKGSAPINLSDRLHQVLRWALGSVEIFLSRHCPIWYGYGGGLKWLERLSYINSVVYPWTSLPLIVYCSLPAICLLTGKFIVPEISNYASILFMALFSSIAITGILEMQWGKVGIDDWWRNEQFWVIGGVSAHLFALFQGLLKVLAGVDTNFTVTSKAADDGEFSDLYLFKWTSLLIPPMTLLIINVIGVIVGVSDAISNGYDSWGPLFGRLFFALWVIIHLYPFLKGLLGKQDRMPTIIVVWSILLASILTLLWVRVNPFVAKGGPILEICGLDCL

SEQ ID NO: 9316 - protein, 289 aa, Panicum virgatum; identical to SEQ ID NO: 412
  misc_feature: Ceres CLONE 1724980
  misc_feature: Useful for biocontainment applications
  misc_feature: The plant produces a reduced number of seeds.

SEQ ID NO: 9317 - protein, 333 aa, Craterostigma plantagineum
  misc_feature: HVG ID no. 174
  misc_feature: Useful for making plants with modulated drought sensitivity
MNQQQVKVSKNNKQVNNCEDDDDSSDLRRGPWTVDEDFTLINYIAHHGEGRWNSLARFAGLKRTGKSCRLRWLNYLRPDVRRGNITLEEQLLILELHSRWGNRWSKIAQHLPGRTDNEIKNYWRTRVQKHAKQLKCDVNSKQFKDTMRYLWMPRLVERIQASATTDDGAPPAVASSPSSAMNTACYSAAMAAGDHRRQFMLMPQYYATTTTTHNNSMIAQENSSTVASSESFGSLSSELTAEANYANYHRVINGADHQQIDSSTTSYDWQNCAVGNNGNSDQLGMGFADDRRSNEQWMMMTDDVVDNGGSSDQDNNLWNVDDVWFLQQFSSCF

SEQ ID NO: 9318 - protein, 235 aa, Arabidopsis thaliana
  misc_feature: Ceres CLONE 17482
  misc_feature: Useful for making plants with modulated flowering time
  misc_feature: The plant flowers significantly late compared to wild-type.
MSNVLLSPNGYVFASPKPLGRFINSKSGGRKLFFSVVRASSDDADCNAEECAPEKEVGTVSMEWLAGEKTKVVGTFPPRKPRGWTGYVEKDTAGQTNVYSIEPAVYVAESAISSGTAGSSADGAENTAAIVAGIALIAVAAASSILLQVGKDAPTRPKAVDYSGPSLSYYINKFKPSEIVQPSTPSVTEAPPVAELETSLPETPPVAQQETSLPETMASEAQPEASFVPTTSSTS

SEQ ID NO: 9319 - protein, 1346 aa, Arabidopsis thaliana
  misc_feature: HVG ID no. 175
  misc_feature: Useful for making plants with modulated drought sensitivity
MDQQPERREGRSFPERKGQKRKLEEGAAAVEDREISAVSTDGGQALLSEVAAQVSVLNSAFSWQESDRAAAKRATQVLAELAKNAEDLVNVIVDGGAVPALMTHLQAPPYNDGDLAEKPYEHEVEKGSAFALGLLAIKPEYQKLIVDKGALPHLVNLLKRNKDGSSSRAVNSVIRRAADAITNLAHENSSIKTRVRVEGGIPPLVELLEFSDSKVQRAAAGALRTLAFKNDDNKNQIVECNALPTLILMLGSEDAAIHYEAVGVIGNLVHSSPHIKKEVLTAGALQPVIGLLSSCCPESQREAALLLGQFASTDSDCKVHIVQRGAVRPLIEMLQSPDVQLKEMSAFALGRLAQDAHNQAGIAHSGGLGPLLKLLDSRNGSLQHNAAFALYGLADNEDNVSDFIRVGGIQKLQDGEFIVQVLRHLLYLMRISEKSIQRRVALALAHLWLELLLGLLGSLNTKQQLDGAAALYKLANKSMALSPVDAAPPSPTQRVYLGEQYVNNATLSDVTFLVEDAFRAMFDGGYREKDARDIEIPNIKWEVFELMMRFIYTGSVDITNEISKDLLRAADQYLLEGLKRLCEYTIAQYLTKSDTVTLNMKGYYVGKYRRHVRAIRSIPCDVAEASLYHVHPGAFRMDQQPERREGRSFPERKGQKRKLEEGAAAVEDREISAVSTDGGQALLSEVAAQVSVLNSAFSWQESDRAAAKRATQVLAELAKNEDLVNVIVDGGAVPALMTHLQAPPYNDGDLAEKPYEHEVEKGSAFALGLLAIKPEYQKLIVDKGALPHLVNLLKRNKDGSSSRAVNSVIRRAADAITNLAHENSSIKTRVRVEGGIPPLVELLEFSDSKVQRAAAGALRTLAFKNDDNKNQIVECNALPTLILMLGSEDAAIHYEAVGVIGNLVHSSPHIKKEVLTAGALQPVIGLLSSCCPESQREAALLLGQFASTDSDCKVHIVQRGAVRPLIEMLQSPDVQLKEMSAFALGRLAQDAHNQAGIAHSGGLGPLLKLLDSRNGSLQHNAAFALYGLADNEDNVSDFIRVGGIQKLQDGEFIVQATKDCVSKTLKRLEEKIHGRVLRHLLYLMRISEKSIQRRVALALAHLCSPEDQRTIFIDDNGLELLLGLLGSLNTKQQLDGAAALYKLANKSMALSPVDAAPPSPTQRVYLGEQYVNNATLSDVTFLVEGRTFYAHRICLLASSDAFRAMFDGGYREKDARDIEIPNIKWEVFELMMRFIYTGSVDITNEISKDLLRAADQYLLEGLKRLCEYTIAQDITLESIGDMYELSEAFHAMSLRQACIMFILEHFDKLSSMPWQNELVQRTIPEIREYFCRALTKSTTNLQSLRL

SEQ ID NO: 9320 - protein, 142 aa, Arabidopsis thaliana
  misc_feature: CLONE 41712
  misc_feature: Useful for making plants with modulated heat sensitivity
MAGIGPITQDWEPVVIRKKPANAAAKRDEKTVNAARRSGADIETVRKFNAGTNKAASSGTSLNTKMLDDDTENLTHERVPTELKKAIMQARTDKKLTQSQLAQIINEKPQVIQEYESGKAIPNQQILSKLERALGAKLRGKK

SEQ ID NO: 9321 - protein, 248 aa, Arabidopsis thaliana
  misc_feature: Ceres CLONE 17632
  misc_feature: Useful for making plants with altered terpenoid content
MDTRKRGRPEAGSFNSNGGGYKKSKQEMESYSTGLGSKSKPCTKFFSTSGCPFGENCHFLHYVPGGYNAVSQMTNMGPPIPQVSRNMQGSGNGGRFSGRGESGPGHVSNFGDSATARFSVDASLAGAIIGKGGVSSKQICRQTGVKLSIQDHERDPNLKNIVLEGTLEQISEASAMVKDLIGRLNSAAKKPPGGGLGGGGGMGSEGKPHPGSNFKTKICERFSKGNCTFGDRCHFAHGEAELRKSGIV

SEQ ID NO: 9322 - protein, 135 aa, Panicum virgatum; identical to SEQ ID NO: 2270
  misc_feature: Ceres CLONE 1777966
  misc_feature: Useful for biocontainment applications

SEQ ID NO: 9323 - protein, 475 aa, Panicum virgatum; identical to SEQ ID NO: 3780
  misc_feature: Ceres CLONE 1794784
  misc_feature: Useful for making plants with modulated flowering time
  misc_feature: The plant flowers significantly late compared to wild-type.

SEQ ID NO: 9324 - protein, 393 aa, Arabidopsis thaliana
  misc_feature: SEEDLINE ME10499
  misc_feature: Useful for making plants with altered tocopherol content
MESLLSSSSLVSAAGGFCWKKQNLKLHSLSEIRVLRCDSSKVVAKPKFRNNLVRPDGQGSSLLLYPKHKSRFRVNATAGQPEAFDSNSKQKSFRDSLDAFYRFSRPHTVIGTVLSILSVSFLAVEKVSDISPLLFTGILEAVVAALMMNIYIVGLNQLSDVEIDKVNKPYLPLASGEYSVNTGIAIVASFSIMSFWLGWIVGSWPLFWALFVSFMLGTAYSINLPLLRWKRFALVAAMCILAVRAIIVQIAFYLHIQTHVFGRPILFTRPLIFATAFMSFFSVVIALFKDIPDIEGDKIFGIRSFSVTLGQKRVFWTCVTLLQMAYAVAILVGATSPFIWSKVISVVGHVILATTLWARAKSVDLSSKTEITSCYMFIWKLFYAEYLLLPFLK

SEQ ID NO: 9325 - protein, 135 aa, Arabidopsis thaliana
  misc_feature: Ceres CLONE 18152
  misc_feature: Useful for biocontainment applications
MANTACFIIVGRNDIPIYEAEVGSAAKREDAAQLHQFILHAALDVVQDLAWTTSAMFLKSVDRFNDLVVSVYVTAGHTRLMLLHDSRNEDGIKSFFQEVHELYIKILLNPLYLPGSRITSSHFDTKVRALARKYL

SEQ ID NO: 9326 - protein, 488 aa, Panicum virgatum; identical to SEQ ID NO: 5312
  misc_feature: Ceres CLONE 1818680
  misc_feature: Useful for making plants with modulated flowering time
  misc_feature: The plant flowers significantly late compared to wild-type.

SEQ ID NO: 9327 - protein, 273 aa, Arabidopsis thaliana
  misc_feature: Ceres CLONE 1820
  misc_feature: Useful for making plants with modulated nitrogen use efficiency
  misc_feature: Useful for making plants with modulated oxidative stress sensitivity
MSIEEENVPTTVDSGAADTTVKSPEKKPAAKGGKSKKTTTAKATKKPVKAAAPTKKKTTSSHPTYEEMIKDAIVTLKERTGSSQYAIQKFIEEKHKSLPPTFRKLLLVNLKRLVASEKLVKVKASFKIPSARSAATPKPAAPVKKKATVVAKPKGKVAAAVAPAKAKAAAKGTKKPAAKVVAKAKVTAKPKAKVTAAKPKSKSVAAVSKTKAVAAKPKAKERPAKASRTSTRTSPGKKVAAPAKKVAVTKKAPAKSVKVKSPAKRASTRKAKK

SEQ ID NO: 9328 - protein, 120 aa, Arabidopsis thaliana
  misc_feature: Ceres CLONE 18215
  misc_feature: Useful for making plants with altered Lignin content
  misc_feature: Useful for making plants with altered alkaloid content
MASKALILLGLFSVLLVVSEVSAARQSGMVKPESEETVQPEGYGGGHGGHGGHGGGGGHGHGGHNGGGGHGLDGYGGGGGHYGGGGGHYGGGGGGYGGGGGHHGGGGHGLNEPVQTKPGV

SEQ ID NO: 9329 - protein, 350 aa, Panicum virgatum; identical to SEQ ID NO: 5692
  misc_feature: Ceres CLONE 1824525
  misc_feature: Useful for biocontainment applications
  misc_feature: Useful for making plants with modulated biomass
  misc_feature: The plant is abnormally small.
  misc_feature: The plant produces a reduced number of seeds.

SEQ ID NO: 9330 - protein, 221 aa, Arabidopsis thaliana
  misc_feature: Ceres CLONE 18246
  misc_feature: Useful for biocontainment applications
  misc_feature: The plant produces a reduced number of seeds.
MANSGEEKLKLYSYWRSSCAHRVRIALALKGLDYEYIPVNLLKGDQFDSDFKKINPMGTVPALVDGDVVINDSFAIIMYLDEKYPEPPLLPRDLHKRAVNYQAMSIVLSGIQPHQNLAVIRYIEEKINVEEKTAWVNNAITKGFTALEKLLVNCAGKLATGDEIYLADLFLAPQIHGAINRFQINMEPYPNLAKCYESYKELPVFQNALPEKQPDAPSSTN

SEQ ID NO: 9331 - protein, 246 aa, Arabidopsis thaliana
  misc_feature: CLONE 156373
  misc_feature: Useful for making plants with altered Lignin content
  misc_feature: Useful for making plants with modulated flowering time
MAAAAVSSNPRTVEEIFKDYSARRAALLRALTKDVDDFYSQCDPEKENLCLYGHPNESWEVNLPAEEVPPELPEPALGINFARDGMQRKDWLSLVAVHSDCWLLSVSFYFGARLNRNERKRLFSLINDLPTLFDVVTGRKAMKDNKPSSDSGSKSRNGTKRSIDGQTKSSTPKLMEESYEEEEEEDEHGDTLCGSCGGHYTNEEFWICCDVCERWYHGKCVKITPAKAESIKQYKCPPCCAKKGRQ

SEQ ID NO: 9332 - protein, 162 aa, Arabidopsis thaliana
  misc_feature: SEEDLINE ME10853
  misc_feature: Useful for making plants with altered protein content
  misc_feature: Useful for making plants with modulated cold sensitivity
MRKIIGFRIGRRVSRWIFRKTRIQRSGYNRIHSTQQACMLMRPLAKLKSWGQRLKQSFRRRSTRRSAYIPVDHKKADPVPRGHLAIYVGQKDGDCHRVLVPIVYFNHPLFGELLREAEKEYGFCHEGGITIPCLYSDFERVKTRIASGSSSRVFPWGRHCRN

SEQ ID NO: 9333 - protein, 355 aa, Arabidopsis thaliana
  misc_feature: CLONE 6639
  misc_feature: Useful for making plants with altered Lignin content
  misc_feature: Useful for making plants with modulated cold sensitivity
MGFGLESIKSISGGWGAAARSCDACKSVTAAVFCRVDSAFLCIACDTRIHSFTRHERVWVCEVCEQAPAAVTCKADAAALCVTCDADIHSANPLASRHERVPVETFFDSAETAVAKISASSTFGILGSSTTVDLTAVPVMADDLGLCPWLLPNDFNEPAKIEIGTENMKGSSDFMFSDFDRLIDFEFPNSFNHHQNNAGGDSLVPVQTKTEPLPLTNNDHCFDIDFCRSKLSAFTYPSQSVSHSVSTSSIEYGVVPDGNTNNSVNRSTITSSTTGGDHQASSMDREARVLRYREKRKNRKFEKTIRYASRKAYAESRPRIKGRFAKRTETENDDIFLSHVYASAAHAQYGVVPTF

SEQ ID NO: 9334 - protein, 441 aa, Arabidopsis thaliana
  misc_feature: Ceres CLONE 18612
  misc_feature: Useful for making plants with modulated biomass
  misc_feature: The plant is abnormally small.
MDFDLNGGNKRVFNRLGGGGGVGGGSTRPMAPTDTRQKVCFHWRAGRCNRSPCPYLHRELPGPGPGQGQGPGYTNKRVAEESGFAGPSHRRGPGFNGNSSSSWGRFGGNRTVTKTEKVCNFWVDGNCTYGDKCRYLHCWSKGESFALLTQLDGHEKLVSGIALPSGSDKLYTGSKDETLRVWDCASGQCTGVLKLGGEIGCVLSEGPRLLVGMPNLVKAWNIETNADQSLSGPVGQVYSLVVGTDLLFAGTQDGSILAWRYNAATNCFEPAASLTGHTLAVVTLYVGANRLYSGSMDKTIKVWSLDNLQCIQTLTDHTSVVMSLICWDQFLLSCSLDNTVKIWAAIEGGNLEVTYTHKEEHGVLALCGVHDAEAKPVLLCACNDNTLRLYDLPSFTERGKIFAKQEIRAIQIGPGGIFFTGDGTGQVKVWKWCTEPTAALP

SEQ ID NO: 9335 - protein, 516 aa, Arabidopsis thaliana
  misc_feature: CLONE 41610
  misc_feature: Useful for making plants with modulated UV sensitivity
  misc_feature: Useful for making plants with modulated low light sensitivity
  misc_feature: Useful for making plants with modulated oxidative stress sensitivity
MEGVITCFHTKCVSLPIRSFPLSRVSSLPRWRNNKLISSSRSVHLRSLCVSASSSDTLVAGGSPKEDERQSKVSSKKEGDDSEDLKFWMDKNGLPPCKVILKEKPAHDQKHKPIHYVAASEDLQKGDVAFSVPDSLVVTLERVLGNETIAELLTTNKLSELACLALYLMYEKKQGKKSVWYPYIRELDRQRGRGQLDAESPLLWSEAELDYLTGSPTKAEVLERAEGIKREYNELDTVWFMAGSLFQQYPFDIPTEAFSFEIFKQAFVAIQSCVVHLQNVGLARRFALVPLGPPLLAYCSNCKAMLTAVDGAVELVVDRPYKAGDPIVVWCGPQPNAKLLLNYGFVDEDNPYDRVIVEAAFNTEDPQYQDKRMVAQRNGKLSQQVFQVRVGKEREAVQDMLPYLRLGYMSDPSEMQSVISSQGPVCPMSPCMERAVLDQLANYFMRRLSGYPTTPKEDDALLADPSLSPRKRVATRLVQLEKKILVACLTTTVDLLNQLPDTAISPCPAPYAPSLK

SEQ ID NO: 9336 - protein, 161 aa, Arabidopsis thaliana
  misc_feature: CLONE 24255
  misc_feature: Useful for making plants with modulated nitrogen use efficiency
MAEEHRCETPEGHRLCVNNCGFFGSSATMNLCSNCYGDLCLKQQQQASMKSTVESSLSPVIAPVLENYAAELEIPTTKKTEEKKPIQIPTEQPSPPQRPNRCTVCRKRVGLTGFMCRCGTTFCGSHRYPEVHGCTFDFKSAGREEIAKANPLVIAAKLQKI

SEQ ID NO: 9337 - protein, 405 aa, Arabidopsis thaliana
  misc_feature: Ceres CLONE 19116
  misc_feature: Useful for making plants with modulated biomass
  misc_feature: The plant is abnormally small.
  misc_feature (67)..(67): Xaa is any aa, unknown, or other
  misc_feature (68)..(68): Xaa is any aa, unknown, or other
  misc_feature (233)..(233): Xaa is any aa, unknown, or other
  misc_feature (269)..(269): Xaa is any aa, unknown, or other
MGGLAMEEMPLSVLFEQARKIHLAASESGVDQDVVKKGCEMFQKCEDMIGKLALFSSNETKEDISTXXLKYLLVPYYLAELTEKIIQEDRIQIVKASYAKLKEFFSFCEAMELVPDEELEASSRGGSGAPADRRALKIARFKRQKAAEAKLLEIKERKERRGRSTKASALSTPVESGEDDIPDDDSEEEREAWLSSINLAICKAIDLLEMLKREEEMLSAIKERQLKDGEGGXSRDALDDRTKKAETWHRDAAARIQYSKPAQPITCAXFAQDVLEGRASVSQGHEHKNQPLIFGPASIVGGPLSTERERMIAQVFQPSHRMPTMCIEDAGLTEMNIMNDWQEQTKKAIEEATTSWYNDKPLRRKEEDEEDDDEDDEPVMKARAFDDWKDDNPRGAGNKKLTPCG

SEQ ID NO: 9338 - protein, 251 aa, Glycine max
  misc_feature: CLONE 531679
  misc_feature: Useful for making plants with altered protein content
MVVLSLSSPSLSTALLAKNLPPREHTVKLATFRNNSFRFRCAVDTPYGGNAQKFPRINVWNPYRRLGISPDASEEEIWGSRNFLLQQYSGHERSEESIEAAFEKILMASFVQRRKTKINLKSKLKKKVEESPPWVKNLLSFVELPPTEVILRRLFLFGFMGGWSIMNSAETGPAFQVAISLAACIYFLNEKTKSLARAFIIGFGALVAGWVSGSLLVPNIPSMLLRPTWTLELLTSLVVYLFLFVACTFLK

SEQ ID NO: 9339 - protein, 307 aa, Arabidopsis thaliana
  misc_feature: Ceres CLONE 19340
  misc_feature: Useful for making plants with altered Lignin content
  misc_feature: Useful for making plants with altered terpenoid content
MHRSGTTMAWNVFKFCTALRGLGSIMILLVLGVVGVTYYAVVLTNYGPPLSQGGLDSLAALTILILFHFLLAMLLWSYFSVVFTDPGVVPPNWRPSTDEERGESDPLNSLDFVGLQSDSSSSNPRVRFCRKCNQLKPSRCHHCSVCGRCVLKMDHHCVWVVNCVGALNYKYFLLFLFYTFLETTLVTLVLMPHFIAFFSDEEIPGTPGTLATTFLAFVLNLAFALSVMGFLIMHISLVAGNTTTIEAYEKKTTTKWRYDLGKKKNFEQVFGMDKRYWLIPGYTEEDLRRMPELQGLEYPSKPDFDSQ

SEQ ID NO: 9340 - protein, 92 aa, Arabidopsis thaliana
  misc_feature: CLONE 32430
  misc_feature: Useful for making ornamental plants with delayed petal abscission
  misc_feature: Useful for making plants with modulated nitrogen use efficiency
MVLDGLVSSPSRRQQCLKKQWDELGSWSTLIQRHQYLLTALALLAFLCTVYLYFAVTLGARHSSCYGLTGKDKAMCQLQLVQALSKGKLKFF

SEQ ID NO: 9341 - protein, 298 aa, Arabidopsis thaliana
  misc_feature: Ceres CLONE 19510
  misc_feature: Useful for making plants with modulated biomass
  misc_feature: The plant is abnormally small.
MAEEKKAPISVWTTVKPFVNGGASGMLATCVIQPIDMIKVRIQLGQGSAASITTNMLKNEGVGAFYKGLSAGLLRQATYTTARLGSFKLLTAKAIESNDGKPLPLYQKALCGLTAGAIGACVGSPADLALIRMQADNTLPLAQRRNYTNAFHALTRISADEGVLALWKGCGPTVVRAMALNMGMLASYDQSAEYMRDNLGFGEMSTVVGASAVSGFCAAACSLPFDFVKTQIQKMQPDAQGKYPYTGSLDCAMKTLKEGGPLKFYSGFPVYCVRIAPHVMMTWIFLNQITKFQKKIGM

SEQ ID NO: 9342 - protein, 195 aa, Arabidopsis thaliana
  misc_feature: CLONE 21608
  misc_feature: Useful for making plants with modulated nitrogen use efficiency
MSSSSPSGSGSDLTERRGIPAAKFIQDVETYLSQSGLDPNSALAFHQERLQQYKVVEMKLLAQQRDLQAKIPDIEKCLEVVATLEAKKGTGEALLADFEVSEGIYSRACIEDTDSVCLWLGANVMLEYSCEEASALLKNNLENAKASLEVLVADLQFLRDQVTVTQVTIARVYNWDVHQRRVKQVTPTAIAVADS

SEQ ID NO: 9343 - protein, 261 aa, Arabidopsis thaliana
  misc_feature: Ceres CLONE 19657
  misc_feature: Useful for making plants with modulated nitrogen use efficiency
MAGLFDKQADLYLDARPNYPSEWFSKLADLTDHHGLAWDAATGNGQAALAVAEHYESVVATDVSESQLKLATPHPKINYRLTPTSMTDDELVELIGGENSVDLITVAQGVHWFDLPRFYSVATRLLRKPGGIIAVWGYNDVIVSPEFDAVQYRLHATTLPFWKYPYIQHIFDSYEALPFPFENVGMGSEGEPLKLEMPKTTSFEGIIRMFKSWSAIVTAREKGVELLPESLVRELETAWGGSDLVRSVVYKAFMIAGKVRV

SEQ ID NO: 9344 - protein, 314 aa, Arabidopsis thaliana
  misc_feature: CLONE 29302
  misc_feature: Useful for making plants with modulated nitrogen use efficiency
MESVVATWSREEEKAFENAIALHCVEEEITEDQWNKMSSMVPSKALEEVKKHYQILLEDVKAIENGQVPLPRYHHRKGLIVDEAAAAATSPANRDSHSSGSSEKKPNPGTSGISSSNGGRSGGSRAEQERRKGIPWTEEEHRLFLLGLDKFGKGDWRSISRNFVISRTPTQVASHAQKYFIRLNSMNRDRRRSSIHDITTVNNQAPAVTGGGQQPQVVKHRPAQPQPQPQPQPQQHHPPTMAGLGMYGGAPVGQPIIAPPDHMGSAVGTPVMLPPPMGTHHHHHHHHLGVAPYAVPAYPVPPLPQQHPAPSTMH

SEQ ID NO: 9345 - protein, 124 aa, Arabidopsis thaliana
  misc_feature: Ceres CLONE 19991
  misc_feature: Useful for making plants with modulated phosphate use efficiency
MATAYQPMKPGKAGLEEPLEQIHKIRITLSSKNVKNLEKVCTDLVRGAKDKRLRVKGPVRMPTKVLKITTRKAPCGEGTNTWDRFELRVHKRVIDLFSSPDVVKQITSITIEPGVEVEVTIADS

SEQ ID NO: 9346 - protein, 432 aa, Arabidopsis thaliana
  misc_feature: CLONE 253162
  misc_feature: Useful for making plants with modulated seed size
  misc_feature: Useful for making plants with modulated nitrogen use efficiency
MWDLNDAPHQTQREEESEEFCYSSPSKRVGSFSNSSSSAVVIEDGSDDDELNRVRPNNPLVTHQFFPEMDSNGGGVASGFPRAHWFGVKFCQSDLATGSSAGKATNVAAAVVEPAQPLKKSRRGPRSRSSQYRGVTFYRRTGRWESHIWDCGKQVYLGGFDTAHAAARAYDRAAIKFRGVEADINFNIDDYDDDLKQMTNLTKEEFVHVLRRQSTGFPRGSSKYRGVTLHKCGRWEARMGQFLGKKYVYLGLFDTEVEAARAYDKAAIKCNGKDAVTNFDPSIYDEELNAESSGNPTTPQDHNLDLSLGNSANSKHKSQDMRLRMNQQQQDSLHSNEVLGLGQTGMLNHTPNSNHQFPGSSNIGSGGGFSLFPAAENHRFDGRASTNQVLTNAAASSGFSPHHHNQIFNSTSTPHQNWLQTNGFQPPLMRPS

SEQ ID NO: 9347 - protein, 263 aa, Arabidopsis thaliana
  misc_feature: CLONE 26006
  misc_feature: Useful for making plants with modulated drought sensitivity
MSEEKRKQHFVLVHGACHGAWCWYKVKPLLEALGHRVTALDLAASGIDTTRSITDISTCEQYSEPLMQLMTSLPNDEKVVLVGHSFGGLSLALAMDKFPDKISVSVFVTAFMPDTKHSPSFVEEKFASSMTPEGWMGSELETYGSDNSGLSVFFSTDFMKHRLYQLSPVEDLELGLLLKRPSSLFINELSKMENFSEKGYGSVPRAYIVCKEDNIISEDHQRWMIHNYPANLVIEMEETDHMPMFCKPQVLSDHLLAIADNFS

SEQ ID NO: 9348 - protein, 273 aa, Arabidopsis thaliana
  misc_feature: SEEDLINE ME17567
  misc_feature: Useful for making plants with modulated nitrogen use efficiency
  misc_feature: Useful for making plants with modulated nitrogen use efficiency
MAFLLSNLSSPSIHLQTGKYPNLKPIFSQSLSSSSSVSYEFVEENLSTLSLLSIQSPPLKDTQVQTRHSSQDKHNNHDRDEFYINLGVAVRTLREDLPLLFTRDLNYDIYRDDITFVDPMNTFTGMDNYKIIFWALRFHGKILFRDISLEIFRVWQPSENMILIRWNLKGVPRVPWEAKGEFQGTSRYKLDRNGKIYEHKVDNLAFNFPQQLKPAASVLDLVTASPASSPNPTFFFSPVDSYSSSWVKFYQAVRGTLETEDMFVTTDCLVTCS

SEQ ID NO: 9349 - protein, 155 aa, Arabidopsis thaliana
  misc_feature: Ceres CLONE 2004
  misc_feature: Useful for making plants with modulated cold sensitivity
MNFISDQVKKLSSSTPEEPDHNKPVEGTETATRPATNAELMASAKVVAEAAQAAARNESDKLDKGKVAGASADILDAAEKYGKFDEKSSTGQYLDKAEKYLNDYESSHSTGAGGPPPPTSQAEPASQPEPAAKKDDEESGGGLGGYAKMAQGFLK

SEQ ID NO: 9350 - protein, 162 aa, Arabidopsis thaliana
  misc_feature: SEEDLINE ME10852
  misc_feature: Useful for making plants with altered Lignin content
  misc_feature: Useful for making plants with modulated low light sensitivity
MGLSSLPGPSEGMLCVILVNTALSISIVKGIVRSFLGIVGISLSPSSSSPSSVTVSSENSSTSESFDFRVCQPESYLEEFRNRTPTLRFESLCRCKKQADNECSVCLSKFQGDSEINKLKCGHLFHKTCLEKWIDYWNITCPLCRTPLVVVPEDHQLSSNVW

SEQ ID NO: 9351 - protein, 69 aa, Arabidopsis thaliana
  misc_feature: Ceres CLONE 20257
  misc_feature: Useful for making plants with modulated flowering time
  misc_feature: The plant flowers significantly late compared to wild-type.
MGGGGHGGGITYKGVTVHTPKTWHTVTGKGLCAVMWFWILYRAKQDGPVVMGWRHPWDGHGDHGHGDHH

SEQ ID NO: 9352 - protein, 253 aa, Arabidopsis thaliana
  misc_feature: Ceres CLONE 2036
  misc_feature: Useful for biocontainment applications
  misc_feature: The plant produces a reduced number of seeds.
MASNFWTSTHYKELKDPEEVNVVHPLDAQRGISVEDFRLIKLHMSNYISKLAQHIKIRQRVVATAVTYMRRVYTRKSLTEYEPRLVAPTCLYLACKAEESVVHAKLLVFYMKKLYADEKFRYEIKDILEMEMKVLEALNFYLVVFHPYRSLPEFLQDSGINDTSMTHLTWGLVNDTYRMDLILIHPPFLITLACIYIASVHKEKDIKTWFEELSVDMNIVKNIAMEILDFYENHRLFTEERVHAAFNKLATNP

SEQ ID NO: 9353 - protein, 216 aa, Arabidopsis thaliana
  misc_feature: SEEDLINE ME15935
  misc_feature: Useful for making plants with modulated low light sensitivity
MNSFSAFSEMFGSDYESSVSSGGDYIPTLASSCPKKPAGRKKFRETRHPIYRGVRRRSSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEGMLLPLPSVQWNHNHEVDGDDDDVSLWSY

SEQ ID NO: 9354 - protein, 324 aa, Arabidopsis thaliana
  misc_feature: Ceres CLONE 205648
  misc_feature: Useful for making plants with altered Lignin content
METEEEMKESSISMVEAKLPPGFRFHPKDDELVCDYLMRRSLHNNHRPPLVLIQVDLNKCEPWDIPKMACVGGKDWYFYSQRDRKYATGLRTNRATATGYWKATGKDRTILRKGKLVGMRKTLVFYQGRAPRGRKTDWVMHEFRLQGSHHPPNHSLSSPKEDWVLCRVFHKNTEGVICRDNMGSCFDETASASLPPLMDPYINFDQEPSSYLSDDHHYIINEHVPCFSNLSQNQTLNSNLTNSVSELKIPCKNPNPLFTGGSASATLTGLDSFCSSDQMVLRALLSQLTKIDGSLGPKESQSYGEGSSESLLTDIGIPSTVWNC

SEQ ID NO: 9355 - protein, 194 aa, Arabidopsis thaliana
  misc_feature: SEEDLINE ME16630
  misc_feature: Useful for making plants with modulated low light sensitivity
MEKKLLDITRTDSAEKKRVRDESFDEAVLDSPEVKRLRDDLFDVLDDSDPEPVSQDLDSVMKSFEDELSTVTTTTAQGSSTAGETQPDLGYLLEASDDELGLPPPPSISPVPVAKEEVTTETVTDLVRASSDSSGIDEIWGFEDHVSNYGGLDFGSGVGDGGDYVAVEGLFEFSDDCFDSGDLFSWRSESLPAE

SEQ ID NO: 9356 - protein, 117 aa, Arabidopsis thaliana
  misc_feature: Ceres CLONE 207148
  misc_feature: Useful for making plants with altered alkaloid content
MSTAAHHHQESSFFFPVAARLAGEILPVIRFSELTRPGFGSGSDCCAVCLHEFENEDEIRRLTNCQHIFHRSCLDRWMMGYNQMTCPLCRTPFISDELQVAFNQRVWSESELLAESN

SEQ ID NO: 9357 - protein, 311 aa, Arabidopsis thaliana
  misc_feature: Ceres CLONE 207419
  misc_feature: Useful for making plants with altered Lignin content
  misc_feature: Useful for making plants with altered terpenoid content
MEKLAASTVTDLACVTAINSPPPPLSPISEQSFSNKHQEEFAASFASLYNSIFSPESQFSPSPPSSSSPPSRVDTTTEHRLLQAKLILEYDELNDHYELCLNRLQSLMTELDSLRHENDSLRFENSDLLKLIHISTSSSSSVSPPAPIHNRQFRHQISDSRSAKRNNQERNSLPKSISVRSQGYLKINHGFEASDRQTSQLSSNSVLSSQKVCVVQTKGEREALELEVYRQGMMKTELCNKWQETGACCYGDNCQFAHGIDELRPVIRHPRYKTEVCRMIVTGAMCPYGHRCHFRHSLTDQERMMMMMLTR

SEQ ID NO: 9358 - protein, 72 aa, Zea mays subsp. mays
  misc_feature: Ceres CLONE 207829
  misc_feature: Useful for making plants with modulated nitrogen use efficiency
MGKTPVRMKAVVYALSPFQQKVMPGLWKDITTKIHHKVTENWISATLLLTPVVGTYQYAMWYKEQEKLSHRY

SEQ ID NO: 9359 - protein, 153 aa, Zea mays
  misc_feature: Ceres CLONE 208303
  misc_feature: Useful for making plants with altered terpenoid content
MMNNNSGGGAGGPGGGMGTGVGGGGDGRHDDEAALTEFLSSLMDYTPTIPDELVEHYLGRSGFHCPDLRLTRLVAVATQKFLSDIASDSLQHCKARVAAPIKDNKSKQPKDRRLVLTMDDLSKALREHGVNLKHAEYFADSPSAGMAPSTREE

SEQ ID NO: 9360 - protein, 212 aa, Zea mays
  misc_feature: Ceres CLONE 208429
  misc_feature: Useful for making plants with altered Lignin content
  misc_feature: Useful for making plants with altered alkaloid content
MAGGKSTGNAARSRKRVEATVLKRSRDGSAFTRCEACNKDVPVVLIDMHSCSLDEKIRMTLEAQVVEKTVEVASADRKKSSAKGGGNKDAKRKRSPTAFFLFMDDFRKEFKATHPDNKSVATVAKEGGERWKSMTDEEKKPYIEKAAELKAEAENGEGSGENNVATKKAKTDDQEVDQPAKKLRKCKALHEDEDDDGDQEDEDEKNELDDDM

SEQ ID NO: 9361 - protein, 122 aa, Zea mays
  misc_feature: Ceres CLONE 209313
  misc_feature: Useful for making plants with altered alkaloid content
MDDMTIEPGNTKRQLTQSGDEKSENKAKSKADELASGTDCKSVQKQKIKWKKIITKTLKANADGVMKLKKLQKIVSKELQECGVSKDKEELRATLMDKIASSSRFSVDGKNVRLVAKNEEES

SEQ ID NO: 9362 - protein, 439 aa, Arabidopsis thaliana
  misc_feature: SEEDLINE ME18596
  misc_feature: Useful for making plants with modulated light quality response
MVTLTPSSASTPKTSFDFMKNNNSHSSLYVSSSSYLSSKEDALVTTKKLMEPSKTLNMSINPKQEEFGDEKKMVKKAPEDPEIGVFGAEKYFNGDMDSDQGSSVLSLTNPEVERTVVDSKQSAKKSTGTPSVRSESSWNSQSVLLQNKLVNSCNSSFKEKKNSNGQIQKVTNNKKSFLANLGCKCACSDGDSVDVEEKTSVKRSADPNISVITMRSSADMNTELIKIQKQEELSQRKSLEVFGSPVAIEKKSSVVQKKLPLPPWKSRTEEDDTKSEGSDSSSDLFEIEGLTGNPKPFLTRQGSDPASPTCYAPSEVSVEWSIVTASAADFSVMSECATSPVRRNRPTQIPRIPITAKSAPQRRKSSSSSGGNGFLMSCKSHKSVMVSGDLDRRSSMNKTQPSYVPRFPMETTKPKSFETRRRISNSSISHTQSSLLYSQ

SEQ ID NO: 9363 - protein, 87 aa, Arabidopsis thaliana
  misc_feature: Ceres CLONE 21075
  misc_feature: Useful for making plants with altered alkaloid content
  misc_feature: Useful for making plants with altered terpenoid content
MDSYSSPPMGGSGSSVSPEVMMESVKTQLAQAYAEELIETLRTKCFDKCVTKPGSSLGGSESSCISRCVERYMEATAIISRSLFTQR

SEQ ID NO: 9364 - protein, 100 aa, Zea mays
  misc_feature: Ceres CLONE 211772
  misc_feature: Useful for making plants with modulated flowering time
  misc_feature: The plant flowers significantly late compared to wild-type.
MERHAEKPLLVLPSCLLFLLLAPLVSAVPTPRSLRLGSQHHQQQHPPALKLDSSQDTPAIAAAMMKNTGRPTARVDVEVNDYQPSGPNNRHDPPKGPGRP

SEQ ID NO: 9365 - protein, 138 aa, Arabidopsis thaliana
  misc_feature: Ceres CLONE 21208
  misc_feature: Useful for making plants with modulated drought sensitivity
MSGEEEENAAELKIGDEFLKAKCLMNCEVSLILEHKFEQLQQISEDPMNQVSQVFEKSLQYVKRFSRYKNPDAVRQVREILSRHQLTEFELCVLGNLCPETVEEAVAMVPSLKTKGRAHDDEAIEKMLNDLSLVKRFE

SEQ ID NO: 9366 - protein, 303 aa, Arabidopsis thaliana
  misc_feature: SEEDLINE ME11370
  misc_feature: Useful for making plants with altered protein content
MHALKDKVSQKLSNLFADSPSQSASPRYSNSDSPKARLNSSVGKSLSSYFSFVVPQSGNEEDSELCPPLPIRTESYECIENCKSANGQAKAGTFISIGEDKDCELRVSAKVEESGNDYFDGVKKMRELTESSVFITANLFEFLHASLPNIVRGCKWILLYSTLKHGISLRTLLRRSGELPGPCLLVAGDKQGAVFGALLECPLQPTPKRKYQGTSQTFLFTTIYGEPRIFRPTGANRYYLMCMNEFLAFGGGGNFALCLDEDLLKATSGPSETFGNECLASSTEFELKNVELWGFAHASQYLS

SEQ ID NO: 9367 - protein, 324 aa, Arabidopsis thaliana
  misc_feature: Ceres CLONE 21391
  misc_feature: Useful for making plants with modulated nitrogen use efficiency
  misc_feature (248)..(248): Xaa is any aa, unknown, or other
MGSKMLFSLTSPRLFSAVSRKPSSSFSPSPPSPSSRTQWTQLSPGKSISLRRRVFLLPAKATTEQSGPVGGDNVDSNVLPYCSINKAEKKTIGEMEQEFLQALQSFYYDGKAIMSNEEFDNLKEELMWEGSSVVMLSSDEQRFLEASMAYVSGNPILNDEEYDKLKLKLKIDGSDIVSEGPRCSLRSKKVYSDLAVDYFKMLLLNVPATVVALGLFFFLDDITGFEITYIMELPEPYSFIFTWFAAVXVIVYLALSITKLIIKDFLILKGPCPNCGTENTSFFGTILSISSGGKTNTVKCTNCGTAMVYDSGSRLITLPEGSQA

SEQ ID NO: 9368 - protein, 88 aa, Arabidopsis thaliana
  misc_feature: Ceres CLONE 21485
  misc_feature: Useful for making plants with modulated drought sensitivity
  misc_feature: Useful for making plants with modulated cold sensitivity
MANNPSQLLPSELIDRCIGSKIWVIMKGDKELVGILKGFDVYVNMVLEDVTEYEITAEGRRVTKLDQILLNGNNIAILVPGGSPEDGE

SEQ ID NO: 9369 - protein, 399 aa, Arabidopsis thaliana
  misc_feature: CLONE 151087
  misc_feature: Useful for making plants with modulated oxidative stress sensitivity
MATLFNKFQQAVGVLAKSTTFAKNPRQLQFEADVNKLFMYTSYNRLGREAEETDAEEIIEMAGKATLSEQQKQVQENIHYQVEKFCSLMDGILLPDVRRNESGSQSTSPRPPRRGGLTFAIGSNNAFPHADQPLVPETKPLKLADVSQRLMDQMGYTLEIKPSVIPHKDAGQGCFIKGEADVGTVLAFYPGVIYSPAFYRYIPGYPKVDSQNSYLITRYDGTVINAQPWGLGGESREAWNGSYTPAVKTNTKTAENGSDRLWKALSKPLEGSGKGKEVLERRNPLAFGHLANHPAKEMTPNVMICPYDFPLMAKDLRPYIPNISFGDSGEIKMKRFGSFWFKTGSKDGLEAPVLKTLVLVATRSLCNEELLLNYRLSNSKRRPDWYTPVNEEEDRRRWS

SEQ ID NO: 9370 - protein, 234 aa, Arabidopsis thaliana
  misc_feature: Ceres CLONE 21604
  misc_feature: Useful for making plants with altered Lignin content
  misc_feature: Useful for making plants with altered alkaloid content
MDTNNQQPPPSAAGIPPPPPGTTISAAGGGASYHHLLQQQQQQLQLFWTYQRQEIEQVNDFKNHQLPLARIKKIMKADEDVRMISAEAPILFAKACELFILELTIRSWLHAEENKRRTLQKNDIAAAITRTDIFDFLVDIVPRDEIKDEAAVLGGGMVVAPTASGVPYYYPPMGQPAGPGGMMIGRPAMDPNGVYVQPPSQAWQSVWQTSTGTGDDVSYGSGGSSGQGNLDGQG

SEQ ID NO: 9371 - protein, 485 aa, Zea mays
  misc_feature: CLONE 234510
  misc_feature: Useful for making plants with modulated oxidative stress sensitivity
MMMMMMAGEHVLAALGTLLLASLLTLVLNHFLPLLLNPKAPRGSFGWPLLGETLRFLTPHASNTLGGFLEDHCSRYGRVFKSHLFCTPTVVSCDQDLNHFILQNEERLFQCSYPRPIHGILGKSSMLVVLGEDHKRLRNLALALVTSTKLKPSYLGDIEKIALHVVGAWRRHGSSGGVRVVAFCEEARKFAFSVIVKQVLGLSPEEPVTARILEDFLAFMKGLISFPLYIPGTPYAKAVRARERISSTVKGIIKERRSAGSWNKQGDFLDVLLSSNELSDEEKVSFVLDSLLGGYETTSLLISMVVYFLGQSAQDLDLVKREHDSIRSNKGKEECLTSEDYKKMEYTQQVINEALRCGNIVKFVHRKALKDVKYKEYLIPSGWKVLPVFTAVHLNPSLHGDAQQFQPCRWEGTSQGTSKRFTPFGGGPRLCPGSELAKVETAFFLHHLVLNYRWRIDGDDIPMAYPYVEFQRGLPIEIEPTSPES

SEQ ID NO: 9372 - protein, 170 aa, Arabidopsis thaliana
  misc_feature: Ceres CLONE 21740
  misc_feature: Useful for making plants with modulated nitrogen use efficiency
MDQIFNKVGSYWLGQKANKQFDSVGNDLNSVSTSIEGGTKWLVNKIKGKMQKPLPELLKEYDLPIGIFPGDATNYEFDEETKKLTVLIPSICEVGYKDSSVLKFTTTVTGHLEKGKLTDVEGIKTKVMIWVKVTSISTDASKVYFTAGMKKSRSRDAYEVQRNGLRVDKF

SEQ ID NO: 9373 - protein, 366 aa, Arabidopsis thaliana
  misc_feature: Ceres CLONE 21749
  misc_feature: Useful for making plants with modulated nitrogen use efficiency
MALSAIGFEGYEKRLEVTFFEPSIFQDSKGLGLRALTKSQLDEILTPAACTIVSSLSNDQLDSYVLSESSFFVYPYKVIIKTCGTTKLLLSIPPLLKLAGELSLSVKSVKYTRGSFLCPGGQPFPHRSFSEEVSVLDGHFTQLGLNSVAYLMGNDDETKKWHVYAASAQDSSNCNNNVYTLEMCMTGLDREKAAVFYKDEADKTGSMTDNSGIRKILPKSEICDFEFEPCGYSMNSIEGDAISTIHVTPEDGFSYASFEAVGYDFNTLDLSQLVTRVLSCFEPKQFSVAVHSSVGANSYKPEITVDLEDYGCRERTFESLGEESGTVMYQTFEKLGKYCGSPRSTLKCEWSSNNSCSSEDEKDEGI

SEQ ID NO: 9374 - protein, 184 aa, Arabidopsis thaliana
  misc_feature: SEEDLINE ME03047
  misc_feature: Useful for making plants with modulated oxidative stress sensitivity
MQDQLVCHGCRNLLMYPRGASNVRCALCNTINMVPPPPPPHDMAHIICGGCRTMLMYTRGASSVRCSCCQTTNLVPAHSNQVAHAPSSQVAQINCGHCRTTLMYPYGASSVKCAVCQFVTNVNMSNGRVPLPTNRPNGTACPPSTSTSTPPSQTQTVVVENPMSVDESGKLVSNVVVGVTTDKK

SEQ ID NO: 9375 - protein, 329 aa, Zea mays
  misc_feature: Ceres CLONE 218597
  misc_feature: Useful for making plants with modulated biomass
  misc_feature: The plant is abnormally small.
MAVDEVNSVYVGGLPYEANEEMLRDAFGYYGTIVSVKVINDHAVKGKCYGFVTFTHPRATEQAIAGMDGKKLGNRIVRVNEVRTRGPRDFGRDGFRRDPRRYGRDPYWDRRDRERSYDRERDPYHDRDSDRSREHDRERDYEHGGFNREIDYPMDRDREGDERRPREHDRTAEMHNVDSDNDKDKEHVSRKRFSRPKGRDSRDLSSSSDGLQNDGKHQLDKTIQMREDLENEINQIKDKISGKEQHIADLQKKAQKLEDELVAARKVSSERQLAVTDLYKHFLQLQDYNDRVKTAEQRLQSLVDAALVELDMAEDATTRDGSMYENGVL

SEQ ID NO: 9376 - protein, 185 aa, Arabidopsis thaliana
  misc_feature: Ceres CLONE 21868
  misc_feature: Useful for making plants with altered alkaloid content
MCGGAIISDFIPPPRSLRVTNEFIWPDLKNKVKASKKRSNKRSDFFDLDDDFEADFQGFKDDSAFDCEDDDDVFVNVKPFVFTATTKPVASAFVSTVGSAYAKKTVESAEQAEKSSKRKRKNQYRGIRQRPWGKWAAEIRDPRKGSREWLGTFDTAEEAARAYDAAARRIRGTKAKVNFPEEKNP

SEQ ID NO: 9377 - protein, 199 aa, Zea mays
  misc_feature: Ceres CLONE 222404
  misc_feature: Useful for making plants with altered alkaloid content
MEALLVTVLLLLLSSTLAAAQWCVCRQDASQAALQKTIDYACGSGADCNSIHETGACYNPNTVPAHCSWAANSYYQNNKAKGATCDFAGTATLTTSDPSSSGCSYPTTSASAAGTVTPTTGGTMGGAGGPGTLTPAGTGAGTAGTTGMGTAGTTGTGFGGLGPAGMDTAAAAAGGLLLLPEAGLCAALVALLLSAIVLA

SEQ ID NO: 9378 - protein, 434 aa, Zea mays
  misc_feature: Ceres CLONE 222894
  misc_feature: Useful for making plants with altered terpenoid content
  misc_feature (410)..(410): Xaa is any aa, unknown, or other
  misc_feature (411)..(411): Xaa is any aa, unknown, or other
MQTYLYSVLNSRVSRPSPLLRNPFPSSAEASPPAAETLASAAAVMASSNVSTVYISVIDDVISKVREDFITYGVGDAVLNELQALWEMKMLHCGAISGNIDRTKAAAASVGGTTGTTAPVHDLNVPYEATSEEYATPTADMLFPPTPLQTPIQTPLPGTDTAMYNIPTGPSDYAPSPISDVRNGMAINGADPTAGHPSPYMPPPSPWMNQRPLGVDVNVAYVEGREDPDRGVQPQPLTQDFFMMSSGKRKRDEYPGQLPSGSFVPQQDGSADQIVEFVVSKENVNQLWSSIGNKLETPTKTITPVIPQRDGIQDNYNDQFFFPGVPTEDYNTPGESAEYRAPTPAVGTPKQRNDAGDDDNDDDDDEPPLNEDDDEELDDLEQGEDEPNTQHLVLAQFDKVSRTKNRWKCXXKDGIMHLNGRDVLFNKATGEFDF

SEQ ID NO: 9379 - protein, 135 aa, Arabidopsis thaliana
  misc_feature: Ceres CLONE 22413
  misc_feature: Useful for making plants with modulated nitrogen use efficiency
MYTASLYAAFASLIHNKHNDLAGKRVVMFSYGSGSTATMFSLRLNDNKPPFSISNIASVMDVGGKLKARHEYAPEKFVETMKLMEHRYGAKDFVTTKEGIIDLLAPGTYYLKEVDSLYRRFYGKKGEDGSVANGH

SEQ ID NO: 9380 - protein, 141 aa, Zea mays subsp. mays
  misc_feature: Ceres CLONE 224220
  misc_feature: Useful for making plants with modulated nitrogen use efficiency
MQDPRDDDFLAPKLHKKKVVYRPQPSGHLKGEPELLRREFPQSSGMVQKPPKRSLKGEPRTPPSDRGTPDSLPESGPTDEYRALRRKYLMLEEENFALDKELSMEDEEMKALEDEKLALLDQLVVLEGLVEPSQLQSQPRP

SEQ ID NO: 9381 - protein, 217 aa, Zea mays
  misc_feature: Ceres CLONE 224919
  misc_feature: Useful for making plants with altered Lignin content
MGGRVDHEYSYLFKMVLIGDSGVGKSNILSRFTRNHFSLDSKSTIGVEFATKSLQMDGKTIKAQIWDTAGQERYRAITSAYYRGAVGALLVYDITKRQSFDNVHRWLRELRDHADSSIVIMMVGNKSDLIHLRAISEDEGKALAEKEGLFFLETSAMEAINVEQAFQTIMTEVYGIVNRKALAAKEAAAATASLPSQGKIISIDSTAGNTKRACCST

SEQ ID NO: 9382 - protein, 106 aa, Zea mays
  misc_feature: Ceres CLONE 225321
  misc_feature: Useful for making plants with altered Lignin content
  misc_feature: Useful for making plants with altered terpenoid content
  misc_feature (29)..(29): Xaa is any aa, unknown, or other
MATFELYRRSTIGMCLTETLDEMVSNGTXSPELAIQVLVQFDKSMTDALENQVKSKVTVKGHLHTYRFCDNVWTFILTDASFKNEEATEQVGKVKIVACDSKLLGQ

SEQ ID NO: 9383 - protein, 223 aa, Zea mays
  misc_feature: Ceres CLONE 225597
  misc_feature: Useful for biocontainment applications
  misc_feature: Useful for making plants with modulated biomass
  misc_feature: The plant is abnormally small.
  misc_feature: The plant produces a reduced number of seeds.
MEDLVSSPSFRSVLSSSSEGQAQSGESSWTDYFVDFMLSEEERKRQADASSYSYCATEDEGGSKYGGDGSNRDEEEEEEEESMVSDAASHAPTTAGATALIPAGRYKELKKLKKKPFGKALDHDGSLEDTASSPVNSPKVSVVSQLELSPKRRCNIRDLTKGVVGIGDDHGGEGMDVCTDATTTEGARLGDQYHTSIAPCAELKDKGICLFPFSVLLHYHGPN

SEQ ID NO: 9384 - protein, 397 aa, Zea mays subsp. mays
  misc_feature: Ceres CLONE 226512
  misc_feature: Useful for making plants with modulated oxidative stress sensitivity
MRERLVAMMNPAAGAASRSKIKDMSAEVVDNNPYSRLMALQRMGVVENYERIRDYSVAIVGIGGVGSVAAEMLTRCGIGRLLLYDYDTVELANMNRLFFRPEQVGMTKTDAAVQTLSGINPDVVLESYSLNITTVKGFETFLASLKAQSSHERSTGVDLVLSCVDNYEARMVVNQACNELGQTWMESGVSEDAVSGHIQLLVPGETACFACAPPLVVASGVDERTLKREGVCAASLPTTMGVVAGLLVQNALKYLLNFGQVSPYLGYNSLKDYFPAMEMRPNPQCLNPACVHRQKEYMESKPARDAAAKTKMEAEASTENECPVHLDNEWNISVLDDEETETSSIRNTPDILPEGLVRELPDADSYAGPAAPVSSSAIDDDDDLEELQRQLDALNAS

SEQ ID NO: 9385 - protein, 182 aa, Arabidopsis thaliana
  misc_feature: Ceres CLONE 2267
  misc_feature: Useful for making plants with modulated nitrogen use efficiency
MGILFTRMFSSVFGNKEARILVLGLDNAGKTTILYRLQMGEVVSTIPTIGFNVETVQYNNIKFQVWDLGGQTSIRPYWRCYFPNTQAVIYVVDSSDTDRIGVAKEEFHAILEEDELKGAVVLIFANKQDLPGALDDAAVTEALELHKIKSRQWAIFKTCAVKGEGLFEGLDWLSNTLKSGSG

SEQ ID NO: 9386 - protein, 126 aa, Zea mays
  misc_feature: Ceres CLONE 227651
  misc_feature: Useful for making plants with modulated biomass
  misc_feature: Useful for making plants with modulated flowering time
  misc_feature: The plant flowers significantly late compared to wild-type.
  misc_feature: The plant is abnormally large.
MAAAAVYGGFKGKLGVEDAPELQLNRIRITLSSKNVKNLEKVCADLVKGAKDKHLRVKGPVRIPTKVLHITTRKSPCGEGTNTWDRFEFRIHKRVIDLISSPDVVKQITSITIEPGVEVEVTIADV

SEQ ID NO: 9387 - protein, 222 aa, Arabidopsis thaliana
  misc_feature: Ceres CLONE 22775
  misc_feature: Useful for making plants with altered alkaloid content
MAKMGLKPDPATTNQTHNNAKEIRYRGVRKRPWGRYAAEIRDPGKKTRVWLGTFDTAEEAARAYDTAARDFRGAKAKTNFPTFLELSDQKVPTGFARSPSQSSTLDCASPPTLVVPSATAGNVPPQLELSLGGGGGGSCYQIPMSRPVYFLDLMGIGNVGRGQPPPVTSAFRSPVVHVATKMACGAQSDSDSSSVVDFEGGMEKRSQLLDLDLNLPPPSEQA

SEQ ID NO: 9388 - protein, 155 aa, Arabidopsis thaliana
  misc_feature: Ceres CLONE 2281
  misc_feature: Useful for making plants with modulated heat sensitivity
MDLGRFPIISILEDMLEVPEDHNNEKTRNNPSRVYMRDAKAMAATPADVIEHPNAYAFVVDMPGIKGDEIKVQVENDNVLVVSGERQRENKENEGVKYVRMERRMGKFMRKFQLPENADLDKISAVCHDGVLKVTVQKLPPPEPKKPKTIQVQVA

SEQ ID NO: 9389 - protein, 433 aa, Zea mays
  misc_feature: Ceres CLONE 229604
  misc_feature: Useful for making plants with altered alkaloid content
MAAPNSNDAASASGTGPAGEEDISIEALARRVQEHMTLSSNPAARRHKFWETQPVGQFRDVADTSLPDGPIEPPTPLSEVRADPYPLPAAFEWLTCDLDDDALLADLYSLLAHNYVEDDENMFRFNYSPAFLRWALKPPSFFRAWHIGVRAKESKKLVAFISGVPARIRARDDVVRMAEINFLCVHKKLRSKRLAPVLIREVTRRVHQENIWQAAYTAGVVLPTPITTCRYWHRSLNPKKLIDVGFSRLGPRMTMSRTVRLYKLPDAPLTPGFRRMELRDVAAVTRLLRAYLARFVVAPDFDEVDVEHWLLPQEDVVDSYLVESPETHEVTDFCSFYTLPSSVLNNANYATLKAAYSYYNVSTKTALQQLMNDALIVAKQKNYDVFNALDVMENESFLKELKFGPGDGQLHYYLYNYRIRNGIKPSELGLVLL

SEQ ID NO: 9390 - protein, 326 aa, Arabidopsis thaliana
  misc_feature: SEEDLINE SR01013
  misc_feature: Useful for making plants with modulated drought sensitivity
MSLTTVPTLAIRSGPSGHHSMPVLGFGTAASPLPEPTMLKETVIEAIKLGYRHFDTSPRYQTEEPIGEALAEAVSLGLVRSRSEFFVTTKLWCADAHGGLVVPAIKRSLKNLKLDYLDLYIIHWPVSSKPGKYKFPIDEDDFMPMDFEVVWSEMEECQRLGLAKCIGVSNFSCKKLQHILSIATIPPSVNQVEMSPIWQQRKLRELCRSNDIVVTAYSVLGSRGAFWGTPKIMESDVLKEIAEAKEKTVAQVSMRWAYEQGVSMVVKSFTKERLEENLKIFDWSLTEDETQRISTEIPQFRNVHGEVYTSKKGPIKSVAEMWDGEI

SEQ ID NO: 9391 - protein, 545 aa, Zea mays subsp. mays
  misc_feature: Ceres CLONE 230477
  misc_feature: Useful for making plants with modulated heat sensitivity
  misc_feature (509)..(509): Xaa is any aa, unknown, or other
FLFLLLAPRAADAAAMNGDGSKEDANRRLEWATLNLERGVVVSETTKGDGNGNAGRKAPISIVRLFLACMVSGGIQYGWALQLSLLSPYSQTLGISHSYVSLTWICGPIAGFVVQPIVGYYSDRCTSKMGRRRPFILAGCIIICLSVLVIGFSADIGRRLGDTKEHCSTFTGSRWSAAAVYIVGFWFLDFANNTVQGPARAMMADLAAGQHGPNVGQAIFSLWMALGSVLGYLSGANAKWHDWLPWLKTAACCDACANLKGAFLTAVVLIIISMSVTLWLAGEERLDKESVDTSGGACSAFMDLFKTLKKLPPAMFSVLAVTAVTWLSWFPFFQYNTDWMGREIFHGEPQGAGGKADLYEAGVREGAIGLLFCSVALGVTSFFIPRLCRKLTSRVVWSVSSLMVFVLMTAMVVLGMVSMKGYRPSLAASLSGPDHSFKGGALAIFALIGIPQAVLYSVPWAVASEVATEDGGGQGLTIGVLNIAIVLPQLVIALGAGPIDGAFNKGNTXAFGIGAAFALICAVLALILLPKTRGVSNATVMAGGH

SEQ ID NO: 9392 - protein, 207 aa, Zea mays
  misc_feature: Ceres CLONE 230582
  misc_feature: Useful for making plants with altered alkaloid content
MAGSPRHLSLFPLRLLLLLPLLAAGKPVLEDGYTVTTFADLNPLPASGPHPYAVLPRSRAGDLLLLDSAGSALYTISLSSSPGEPRRLAGGKRGSGFNDGGPGDAAFDRPRSVAVDAADNVYVADRLHGAVRKVAPSGYTTTIAGGFSSGPGHRDGPAQNATFSSDFALVYVPKICALLVADRGNRMVRQINLKPEDCAHEKQSGKY

SEQ ID NO: 9393 - protein, 94 aa, Zea mays
  misc_feature: CLONE 988083
  misc_feature: Useful for making plants with modulated nitrogen use efficiency
MFAWILRGCRDECSASDQLKQAHDVFKAKEVVLQKKISQEVERAKEFTKSGNKQAAMQCLKRKRYYESQMNQVGSVQLRINTKERMIADHTGNK

SEQ ID NO: 9394 - protein, 87 aa, Zea mays subsp. mays
  misc_feature: Ceres CLONE 236035
  misc_feature: Useful for making plants with modulated nitrogen use efficiency
MNVEEEVGRLKEEIHRLGQQQPDGSYKVKFGVLFNDDRCANIFEALVGTLRAAKKRKILTYEGELLLQGVHDNVEITLLPPPAVAAA

SEQ ID NO: 9395 - protein, 257 aa, Zea mays
  misc_feature: Ceres CLONE 237356
  misc_feature: Useful for making plants with altered terpenoid content
MEWRDSFLDLALIPLSLLLPMAYHAWLWREVRLRPLRTAVGINAATRRLWAIGMMKDNAKNAVTVVQSVRNVIMGSTLMATTAILFCTGVAAVLSSTYTIKKPLSDTVFGAHGEYMMALKYVALMLLFLLAFLCHSLAICFLNQASFLINTSACLFSSSADSDAAVLGLPLPPTRDYIGDVLERGFTLNLVGNRLFYAGVPLLLWIFGPLLAFLSSMVMVPILYSLDVVNLMGHSGCVVVSGKSAEMNGGSECARAV

SEQ ID NO: 9396 - protein, 201 aa, Zea mays
  misc_feature: Ceres CLONE 239806
  misc_feature: Useful for making plants with modulated nitrogen use efficiency
MSYYGDRRAESSIVEAFTLSPLPYPVILVLLMVTLLLGASWFFTYDDFIEEASQQLSWALLGVPIALVLLIRWISSVDSFEGYLGFYPRESRWKGRYERGPAEGSSPWGVALLVLLLLVLARAGCGKVVYGNPGRLGRKRRGGDKVKEQAGDEAAKFPWSGMRLATEKRRRVRRSPSKKGIVLKQKSRKVSLQHRSKKLKA

SEQ ID NO: 9397 - protein, 495 aa, Arabidopsis thaliana
  misc_feature: SEEDLINE ME04001
  misc_feature: Useful for making plants with altered sterol content
MVFSVSIFASLAPYLISAFLLFLLVEQLSYLFKKRNIPGPFFVPPIIGNAVALVRDPTSFWDKQSSTANISGLSANYLIGKFIVYIRDTELSHQIFSNVRPDAFHLIGHPFGKKLFGDHNLIYMFGEDHKSVRRQLAPNFTPKALSTYSALQQLVILRHLRQWEGSTSGGSRPVSLRQLVRELNLETSQTVFVGPYLDKEAKNRFRTDYNLFNLGSMALPIDLPGFAFGEARRAVKRLGETLGICAGKSKARMAAGEEPACLIDFWMQAIVAENPQPPHSGDEEIGGLLFDFLFAAQDASTSSLLWAVTLLDSEPEVLNRVREEVAKIWSPESNALITVDQLAEMKYTRSVAREVIRYRPPATMVPHVAAIDFPLTETYTIPKGTIVFPSVFDSSFQGFTEPDRFDPDRFSETRQEDQVFKRNFLAFGWGPHQCVGQRYALNHLVLFIAMFSSLLDFKRLRSDGCDEIVYCPTISPKDGCTVFLSRRVAKYPNFS

SEQ ID NO: 9398 - protein, 338 aa, Zea mays
  misc_feature: Ceres CLONE 240112
  misc_feature: Useful for making plants with altered Lignin content
MGLDVGGIGMGLDLGLDLGLFAARSAGGMAAAAKGAPAEIESCIRSLEEERRKIEVFRRELPLCVRLLADVIDELKDEAAKRGGDAEAKADDGDKRKWMSTAQLWLDSDAKSDESDKEQLSEITSPEPKLLGGAPMPIRAVAAVPPLPPPFFRREDSSAGSGLSLVPPAAKPPIPPMSASDNASGRFCATMPPSGSGANLHSQAQQQARKARRCWSPELHRLFVAALHQLGGPQVATPKQIREVMKVDGLTNDEVKSHLQKYRLHNRRSPGVVAPVSQSVMLAGGLWAPPHQEQSSSQSGSPQGPLQFSGSGVAATVGGDSSSSDEDDKSEGYSRKYV

SEQ ID NO: 9399 - protein, 77 aa, Arabidopsis thaliana
  misc_feature: Ceres CLONE 2403
  misc_feature: Useful for making plants with modulated cold sensitivity
  misc_feature: Useful for making plants with modulated flowering time
  misc_feature: The plant flowers significantly late compared to wild-type.
MIKVKTLTGKEIEIDIEPTDTIDRIKERVEEKEGIPPVQQRLIYAGKQLADDKTAKDYAIEGGSVLHLVLALRGGLL

SEQ ID NO: 9400 - protein, 229 aa, Zea mays
  misc_feature: Ceres CLONE 241379
  misc_feature: Useful for making plants with modulated biomass
  misc_feature: There is no branching.
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLLGGLAVRRACYGVLRYVMESGAKGCEVIVSGKLRAQRAKSMKFKDGYMISSGQPVNEYIDSAVRHVLLRQGVLGIKVKIMLDWDPKGKVGPITPLPDLVTIHTPKDEDEPRPPVLAPPEV

SEQ ID NO: 9401 - protein, 198 aa, Arabidopsis thaliana
  misc_feature: CLONE 14572
  misc_feature: Useful for making plants with modulated heat sensitivity
MILIPVKIQSLFSYLLLLNLIQSIDKPNPEAMRVHPIPRNINNTLIHHHHHNPTREPGKNLRRLPHIFNRVLELPLRSEADVAVEERHDCFRFVAETVGLCNGDGEMRAYMVEIHPGITKIVVRTNGSSSLGLSLDELELDVWRFRLPESTRPELVTVASVDGDLIVTVPKNAEEEDDDGGGGDFGQGIGSGRLVLVQ

SEQ ID NO: 9402 - protein, 338 aa, Zea mays
  misc_feature: Ceres CLONE 244306
  misc_feature: Useful for making plants with modulated nitrogen use efficiency
MASANAISTASPFRPLSQGRATRSQRFVVRANAKDIAFDQKSRAALQAGVEKLANAVGVTLGPRGRNVVLDEYGNPKVVNDGVTIARAIELYDPMENAGAALIREVASKTNDSAGDGTTTACVLAREIIKLGLLSVTSGANPVSLKKGIDKTVQGLIQELENKSRPIKGGGDIKAVASISAGNDEFIGSMIAEAIDKVGPDGVLSIESSSSFETTVEVEEGMEIDRGYISPQFVTNLEKSIVEFENCKVLITDQKITSIKEILPILEKTTQLRAPLFIIAEDITGEALATLVVNKLRGILNVAAIKAPSFGERRKAVLQDIAIVTGAEFLAKDLGLLG

SEQ ID NO: 9403 - protein, 235 aa, Zea mays
  misc_feature: Ceres CLONE 244916
  misc_feature: Useful for making plants with altered alkaloid content
MVGTGKRERIAIRRIDNLAARQVTFSKRRRGLFKKAEELSILCDAEVGLVVFSATGKLFHFASSSMKQVIDRYDSHSKTLQRSEPQSSQLQSHMDDGTCARLKEELAETSLKLRQMRGEELQRLSVEQLQELEKTLESGLGSVLKTKSQKILDEISGLERKRTRLIEENSRLKEQLQVTRMSRMETQLGADPEFVYEEGQSSESVTNTSYPRPSTDTDDCSDTSLRLGLPLFSSK

SEQ ID NO: 9404 - protein, 395 aa, Arabidopsis thaliana
  misc_feature: SEEDLINE ME18314
  misc_feature: Useful for making plants with modulated low light sensitivity
MAVIIPRSDPPSRIHPEPPQTLEIDHFDHLPDSILLLVFNKIGDVKALGRCCVVSRRFHSLVPQVDNVVVRVDCVISDDDSSSLSSIKSRSGSSAGSFSAIFRLVVGGIVKPLQALGQFLGTKRSSSSCGGSGSSSSSLSISGDDDGGEIEQGGVTHHSPTQVLKNFDEIRYLRIELPSGELGIDDGVLLKWRAEFGSTLDNCVILGASSVIPPNPMRVSQACDTTTVVEAPGSGSDDNGSIPESFYTNGGLKLRVVWTISSLIAASARHYLLQPIIAEHKTLDSLVLTDSDGQGVLCMNRDQLEELRVKPLAASSASKRTLVPALNMRLWYAPTLELPDGTVLKGATLVAIRPSESKKEVSDISWVSSAFEEPYETAAKMLVKRRTYCLEMNSF

SEQ ID NO: 9405 - protein, 264 aa, Arabidopsis thaliana
  misc_feature: Ceres CLONE 24644
  misc_feature: Useful for making plants with modulated biomass
  misc_feature: The plant is abnormally small.
  misc_feature (157)..(157): Xaa is any aa, unknown, or other
  misc_feature (173)..(173): Xaa is any aa, unknown, or other
  misc_feature (174)..(174): Xaa is any aa, unknown, or other
  misc_feature (178)..(178): Xaa is any aa, unknown, or other
  misc_feature (211)..(211): Xaa is any aa, unknown, or other
  misc_feature (212)..(212): Xaa is any aa, unknown, or other
  misc_feature (232)..(232): Xaa is any aa, unknown, or other
  misc_feature (234)..(234): Xaa is any aa, unknown, or other
  misc_feature (260)..(260): Xaa is any aa, unknown, or other
MDPSGMMNEGGPFNLAEIWQFPLNGVSTAGDSSRRSFVGPNQFGDADLTTSANGDPARMSHALSQAVIEGISGAWKRREDESKSAKIVSTIGASEGENKRQKIDEVCDGKAEAESLGTETEQKKQQMEPTKDYIHVRARRGQATDSHSLAERARREXISERMKILQDLVPGCXXVIGXALVLDEIINYIQSLQRQVEFLSMKLEAVNSRMXXGIEVFPPKEFGQQAFENPEXQXGSQSTREYSRGASPEWLHMQIGSGGXERTS

SEQ ID NO: 9406 - protein, 397 aa, Arabidopsis thaliana
  misc_feature: SEEDLINE ME19304
  misc_feature: Useful for making plants with modulated low light sensitivity
MDFNAGVPMSSLSPLMNQDAMWQMNLSSDETMETGSYPERPGEPDCSYYIRTGLCRFGSTCRFNHPRDRELVIATARMRGEYPERIGQPECEYYLKTGTCKFGVTCKFHHPRNKAGIAGRVSLNMLGYPLRSNEVDCAYFLRTGHCKFGGTCKFNHPQPQPTNMMVPTSGQQSYPWSRASFIASPRWQDPSSYASLIMPRGVVPVQGWNPYSGQLGSVSPSGTGNDQNYRNLQQNETIESGSQSQGSFSGYNPGSSVPLGGYYALPRENVFPERPGQPECQFYMKTGDCKFGTVCKFHHPRDRQAPPPDCLLSSIGLSLRPGEPLCVFYTRYGICKFGPSCKFDHPMRVFTYDNTASETDEVVETSTGKSRRLSVSETRQAATTSSGKDTTIDNTQQ

SEQ ID NO: 9407 - protein, 114 aa, Arabidopsis thaliana
  misc_feature: Ceres CLONE 248859
  misc_feature: Useful for making plants with modulated biomass
  misc_feature: The plant is abnormally small.
MEATSQPCFSHNSSLHSTRKQPANPWKKPVTGLPQRMHPKVYRVEPVNFKELVQRLTGAEDVEQEVHQVEAKPVKISDDTTTAKDNPFAFDLSPSSSRFWEAFPLLSPANLSRW

SEQ ID NO: 9408 - protein, 272 aa, Arabidopsis thaliana
  misc_feature: CLONE 23439
  misc_feature: Useful for making plants with altered sterol content
MDSLVESGWKYLVTHFSDFQLACIGSFILHESVFFLSGLPYIFLERTGFLSNYKIQTKSNTPEAQGKCIARLLLYHCCVNLPLMMASYPVFRFMGMESSFPLPSWKVVSAQILFYFIIEDFVFYWGHRILHTKWLYKNVHSVHHEYATPFGLTSEYAHPAEILFLGFATIVGPALTGPHLITLWLWMMLRVIETVEAHCGYHFPWSPSNFLPLYGGSLILMWESFAYSADFHDYHHRLLYTKSGNYSSTFVYMDWIFGTDKGYRKLKALKET

SEQ ID NO: 9409 - protein, 315 aa, Arabidopsis thaliana
  misc_feature: Ceres CLONE 25211
  misc_feature: Useful for making plants with altered Lignin content
  misc_feature: Useful for making plants with modulated nitrogen use efficiency
MTSFQVMRSSNSRNSDLSRRISSASTSSSSIRPQQQFRRDLTSVGYGGRNDGLYSSNSMTVEGILHDTFASDPPAPTESSLLDASINLMDASPAPMEITTTTASDVVDHGGGTETTRGGKSVDEVWREMVSGEGKGMKEETSEEIMTLEDFLAKAAVEDETAVTASAEDLDVKIPVTNYGFDHSAPPHNPFQMIDKVEGSIVAFGNGLDVYGGGARGKRARVMVEPLDKAAAQRQRRMIKNRESAARSRERKQAYQVELEALAAKLEEENELLSKEIEDKRKERYQKLMEFVIPVVEKPKQQPPRFLRRIRSLEW

SEQ ID NO: 9410 - protein, 285 aa, Arabidopsis thaliana
  misc_feature: Ceres CLONE 25220
  misc_feature: Useful for making plants with modulated drought sensitivity
MAKDVEGPEGFQTRDYEDPPPTPFFDADELTKWSLYRAVIAEFVATLLFLYITVLTVIGYKIQSDTKVGGVDCGGVGILGIAWAFGGMIFILVYCTAGISGGHINPAVTFGLFLARKVSLIRAVLYMVAQCLGAICGVGFVKAFQSSYYDRYGGGANSLADGYNTGTGLAAEIIGTFVLVYTVFSATDPKRNARDSHVPVLAPLPIGFAVFMVHLATIPITGTGINPARSFGAAVIYNKSKPWDDHWIFWVGPFIGAAIAAFYHQFVLRASGSKSLGSFRSAANV

SEQ ID NO: 9411 - protein, 286 aa, Arabidopsis thaliana
  misc_feature: Ceres CLONE 252299
  misc_feature: Useful for making plants with modulated oxidative stress sensitivity
MTLARHFRFHLPTNQKMAFAIASALTSTLTLSTSRVQNPTQRRPHVASTSSTGGRLMRERLVVVRAGKEVSSVCEPLPPDRPLWFPGSSPPEWLDGSLPGDFGFDPLGLGSDPDTLKWFAQAELIHSRWAMLAVTGIIIPECLERLGFIENFSWYDAGSREYFADSTTLFVAQMVLMGWAEGRRWADLIKPGSVDIEPKYPHKVNPKPDVGYPGGLWFDFMMWGRGSPEPVMVLRTKEIKNGRLAMLAFLGFCFQATYTSQDPIENLMAHLADPGHCNVFSAFTSH

SEQ ID NO: 9412 - protein, 164 aa, Arabidopsis thaliana
  misc_feature: SEEDLINE ME12596
  misc_feature: Useful for making plants with modulated light quality response
MERSASVGVNDGRFGGNQFYSPSFSSSSSSSSMRHVNYSCGSCGYELNLSSTNRITSTIGSKYGKSMKSGIISFFNIDEGRFSQVDEFQCMPHFSRYSWGLFRHRTKLLCRKCNNYIGNASQEKAPEYALVTQNSDPTSPRIGSVTKYDIRIRSLQPSSAVALL

SEQ ID NO: 9413 - protein, 79 aa, Arabidopsis thaliana
  misc_feature: Ceres CLONE 254065
  misc_feature: Useful for making plants with modulated biomass
  misc_feature: The plant is abnormally small.
MSMVTVKVSNVSLEATERDLKEFFSFSGDIAYLETQSENDGSKLAYVTFKDLQGAETAVLLTGSTIVDSSVTVTMSPDY

SEQ ID NO: 9414 - protein, 117 aa, Arabidopsis thaliana
  misc_feature: Ceres CLONE 2561
  misc_feature: Useful for making plants with modulated biomass
  misc_feature: The plant is abnormally small.
MSSPLSKDLRNKHNVRSMPIRKDDEVQVVRGTFKGREGKVMQVYRRKWVIHIERITREKVNGSTVNVGVNASNVMITKLRLDKDRKSLLERKANGRAAADKEKGTKFSAEDVMENVD

SEQ ID NO: 9415 - protein, 134 aa, Arabidopsis thaliana
  misc_feature: Ceres CLONE 25793
  misc_feature: Useful for making plants with altered Lignin content
MNHGQQSGEAKHEDDAALTEFLASLMDYTPTIPDDLVEHYLAKSGFQCPDVRLIRLVAVATQKFVADVASDALQHCKARPAPVVKDKKQQKDKRLVLTMEDLSKALREYGVNVKHPEYFADSPSTGMDPATRDE

SEQ ID NO: 9416 - protein, 98 aa, Arabidopsis thaliana
  misc_feature: Ceres CLONE 25886
  misc_feature: Useful for biocontainment applications
  misc_feature: Useful for making plants with modulated biomass
  misc_feature: The plant is abnormally small.
  misc_feature: The plant produces a reduced number of seeds.
MCEVEGNHLTHAAIFGQDGSVWAQSSAFPQLKPAEIAGINKDFEEAGHLAPTGLFLGGEKYMVVQGEAGAVIRGKKGPGGVTIKKTTQALVFGIYDER

SEQ ID NO: 9417 - protein, 280 aa, Arabidopsis thaliana
  misc_feature: CLONE 39378
  misc_feature: Useful for making plants with altered sterol content
MSGSSSPSLWLAPNPSKRWGELFFLFYTPFWLTLCLGIVVPYKLYETFTELEYLLLALVSAVPAFVIPMLLVGKADRSLCWKDRYWVKANLWIIVFSYVGNYFWTHYFFKVLGASYTFPSWKMNNVPHTTFFLTHVCFLFYHVASNITLRRLRHSTADLPDSLKWCFEAAWILALSYFIAYLETIAIANFPYYEFVDRSAMYRVGCLFYAIYFIVSFPMFFRMDEKSTDEWDLSRVAVDTLGAAMLVTIILDLWRLFLGPIVPLPEGQNCLQSGLPWFSN

SEQ ID NO: 9418 - protein, 68 aa, Arabidopsis thaliana
  misc_feature: Ceres CLONE 2617
  misc_feature: Useful for making plants with modulated nitrogen use efficiency
MTTSKRLADRKIEKFDKNILKRGFVPETTTKKGKDYPVGPILLGFFVFVVIGSSLFQIIRTATSGGMA

SEQ ID NO: 9419 - protein, 276 aa, Arabidopsis thaliana
  misc_feature: HVG ID no. 262
  misc_feature: Useful for making plants with modulated drought sensitivity
MEILPIPAESFKVGFIGAGKMAESIARGVVASGVLPPNRICTAVHSNLNRRDVFESFGVNVFSTSEEVVKESDVVIFSVKPQVVKKAVTELKSKLSKNKILVSVAAGIKLNDLQEWSGQDRFIRVMPNTPAAVGEAASVMSLGTGATEEDGAIVAMLFGAVGKILKADEKMFDAVTGLSGSGPAYIFLAIEALADGGVAAGLPRELALSLASQTVLGAATMVSKTGKHPGVLKDDVTSPGGTTIAGVHELEKGSFRATLMNAVVAAAKRSRELSQS

SEQ ID NO: 9420 - protein, 346 aa, Zea mays subsp. mays
  misc_feature: Ceres CLONE 263907
  misc_feature: Useful for making plants with modulated cold sensitivity
MAGEEAGRRGVPSLLNPPSASSEGQQEHIASDVTQLIGWTPLVELKRIAAKEGVCARIVGKVEAYQPLCSVKDRSALRMIEDAEERGLISPGTTTLVEPTSGNLGLGLVLVALRKGYRFVAVMPGQYSLDKQILLTYMGAELYVTDPSLGFPGITAKVEELKKELPNVHVLDQFSNRANPEAHVRWTGPEIWKDTAGKVDVFVAGSGSGGTVSGVGKYLKTQNPSVKVICVEPAESPVVSGGEPGSHKIQGIGPGFIPEVLDTSVIDEAVTVTTEEAMAGARRLAREEGLLVGISSGANLAACLKVAAREESKGKMIVTVFPSGGERYMTSDLFAAAREECIAMTF

SEQ ID NO: 9421 - protein, 407 aa, Arabidopsis thaliana
  misc_feature: Ceres CLONE 26542
  misc_feature: Useful for making plants with modulated biomass
  misc_feature: The plant is abnormally small.
MVASAAARPLVTVQGLDGDMSTDQSTTVTLPDVMTAPVRPDIVNFVHAQISNNSRQPYAVSKKAGHQTSAESWGTGRAVSRIPRVPGGGTHRAGQAAFGNMCRGGRMFAPTKIWRRWHRRVNVNMKRHAIVSAIAATAVPALVMARGHKIENVPEMPLVVSDSAEAVEKTSAAIKVLKQIGAYDDAEKAKNSIGIRPGKGKMRNRRYISRKGPLVVFGTEGAKIVKAFRNLPGVELCHVERLNLLKLAPGGHLGRFVIWTKSAFEKLESIYGSFEKPSEKKKGYVLPRAKMVNADLARIINSDEVQSVVNPIKDGSKRAVLKKNPLKNLNVMFKLNPYAKTAKRMSLLAEASRVKAKKEKLEKKRKVVTKEEAQAIKAAGKAWYQTMISDSDYTEFDNFTKWLGASQ

SEQ ID NO: 9422 - protein, 873 aa, Arabidopsis thaliana
  misc_feature: HVG ID no. 266
  misc_feature: Useful for making plants with modulated drought sensitivity
MGTHINFNNLGGGGHPGGEGSSNQMKPTGSVMPLARQSSVYSLTFDELQNTLGGPGKDFGSMNMDELLKSIWTAEEAQAMAMTSAPAATAVAQPGAGIPPPGGNLQRQGSLTLPRTISQKTVDEVWKCLITKDGNMEGSSGGGGESNVPPGRQQTLGEMTLEEFLFRAGVVREDNCVQQMGQVNGNNNNGFYGNSTAAGGLGFGFGQPNQNSITFNGTNDSMILNQPPGLGLKMGGTMQQQQQQQQLLQQQQQQMQQLNQPHPQQRLPQTIFPKQANVAFSAPVNITNKGFAGAANNSINNNNGLASYGGTGVTVAATSPGTSSAENNSLSPVPYVLNRGRRSNTGLEKVIERRQRRMIKNRESAARSRARKQAYTLELEAEIEKLKKTNQELQKKQAEMVEMQKNELKETSKRPWGSKRQCLRRTLTGPWMGTHINFNNLGGGGHPGGEGSSNQMKPTGSVMPLARQSSVYSLTFDELQNTLGGPGKDFGSMNMDELLKSIWTAEEAQAMAMTSAPAATAVAQPGAGIPPPGGNLQRQGSLTLPRTISQKTVDEVWKCLITKDGNMEGSSGGGGESNVPPGRQQTLGEMTLEEFLFRAGVVREDNCVQQMGQVNGNNNNGFYGNSTAAGGLGFGFGQPNQNSITFNGTNDSMILNQPPGLGLKMGGTMQQQQQQQQLLQQQQQQMQQLNQPHPQQRLPQTIFPKQANVAFSAPVNITNKGFAGAANNSINNNNGLASYGGTGVTVAATSPGTSSAENNSLSPVPYVLNRGRRSNTGLEKVIERRQRRMIKNRESAARSRARKQAYTLELEAEIEKLKKTNQELQKKQVSFCLQPLSERNVEATVGQQKAMLEKDINRTMVKDEATRTDEPDS

SEQ ID NO: 9423 - protein, 101 aa, Arabidopsis thaliana
  misc_feature: Ceres CLONE 266712
  misc_feature: Useful for making plants with altered Lignin content
MSEVEYRCFVGGLAWATNDEDLQRTFSQFGDVIDSKIINDRESGRSRGFGFVTFKDEKAMRDAIEEMNGKELDGRVITVNEAQSRGSGGDGESYGGGGGGW

SEQ ID NO: 9424 - protein, 244 aa, Arabidopsis thaliana
  misc_feature: Ceres CLONE 267626
  misc_feature: Useful for making plants with modulated biomass
  misc_feature: The plant is abnormally small.
MSTGLDMSLDDMIAKNRKSRGGAGPARGTGSGSGPGPTRRNNPNRKSTRSAPYQSAKAPESTWGHDMFSDRSEDHRSGRSSAGIETGTKLYISNLDYGVMNEDIKELFAEVGELKRYTVHFDRSGRSKGTAEVVYSRRGDALAAVKKYNDVQLDGKPMKIEIVGTNLQTAAAPSGRPANGNSNGAPWRGGQGRGGQQRGGGRGGGGRGGGGRGRRPGKGPAEKISAEDLDADLDKYHSGDMETN

SEQ ID NO: 9425 - protein, 167 aa, Arabidopsis thaliana
  misc_feature: Ceres CLONE 26838
  misc_feature: Useful for making plants with modulated nitrogen use efficiency
MASVTSATVAIPSFTGLKASTIKSSATVRIQTAAVASPKLTVKSSLKNFGVAAVAAAASIALAGNAMAIEVLLGGGDGSLAFIPNDFSIAKGEKIVFKNNAGYPHNVVFDEDEIPSGVDVAKISMDEQDLLNGAGETYEVALTEPGTYSFYCAPHQGAGMVGKVTVN

SEQ ID NO: 9426 - protein, 416 aa, Arabidopsis thaliana
  misc_feature: HVG ID no. 269
  misc_feature: Useful for making plants with modulated drought sensitivity
MDGSMNLGNEPPGDGGGGGGLTRQGSIYSLTFDEFQSSVGKDFGSMNMDELLKNIWSAEETQAMASGVVPVLGGGQEGLQLQRQGSLTLPRTLSQKTVDQVWKDLSKVGSSGVGGSNLSQVAQAQSQSQSQRQQTLGEVTLEEFLVRAGVVREEAQVAARAQIAENNKGGYFGNDANTGFSVEFQQPSPRVVAAGVMGNLGAETANSLQVQGSSLPLNVNGARTTYQQSQQQQPIMPKQPGFGYGTQMGQLNSPGIRGGGLVGLGDQSLTNNVGFVQGASAAIPGALGVGAVSPVTPLSSEGIGKSNGDSSSLSPSPYMFNGGVRGRKSGTVEKVVERRQRRMIKNRESAARSRARKQAYTVELEAEVAKLKEENDELQRKQARIMEMQKNQETEMRNLLQGGPKKKLRRTESGPW

SEQ ID NO: 9427 - protein, 223 aa, Arabidopsis thaliana
  misc_feature: CLONE 2121
  misc_feature: Useful for making plants with altered sterol content
  misc_feature: Useful for making plants with modulated nitrogen use efficiency
MKELAHPYVPRDLNLPGYVPISMSMSSIVSIYLGSSLLVVSLVWLLFGRKKAKLDKLLMCWWTFTGLTHVILEGYFVFSPEFFKDNTSAYLAEVWKEYSKGDSRYVGRDSAVVSVEGITAVIVGPASLLAIYAIAKEKSYSYVLQLAISVCQLYGCLVYFITAILEGDNFATNSFYYYSYYIGANCWWVLIPSLISFRCWKKICAAAAIANNNVETKTKKKTR

SEQ ID NO: 9428 - protein, 453 aa, Arabidopsis thaliana
  misc_feature: HVG ID no. 271
  misc_feature: Useful for making plants with modulated drought sensitivity
MASGREEFVYMAKLAEQAERYEEMVEFMEKVSAAVDGDELTVEERNLLSVAYKNVIGARRASWRIISSIEQKEESRGNDDHVTAIREYRSKIETELSGICDGILKLLDSRLIPAAASGDSKVFYLKMKGDYHRYLAEFKTGQERKDAAEHTLAAYKSAQDIANAELAPTHPIRLGLALNFSVFYYEILNSPDRACNLAKQAFDEAIAELDTLGEESYKDSTLIMQLLRDNLTLWTSDMQDDAADEIKEAAAPKPTEEQQMASGREEFVYMAKLAEQAERYEEMVEFMEKVSGICDGILKLLDSRLIPAAASGDSKVFYLKMKGDYHRYLAEFKTGQERKDAAEHTLAAYKSAQDIANAELAPTHPIRLGLALNFSVFYYEILNSPDRACNLAKQAFDEAIAELDTLGEESYKDSTLIMQLLRDNLTLWTSDMQDDAADEIKEAAAPKPTEEQQ

SEQ ID NO: 9429 - protein, 289 aa, Arabidopsis thaliana
  misc_feature: Ceres CLONE 27197
  misc_feature: Useful for biocontainment applications
  misc_feature: The plant produces a reduced number of seeds.
MANRYDPNPFAEEEEVNPFANARGVPPASNSRLSPLPPEPVGFDYGRTVDIPLDRAGTQDLKKKEKELQAKEAELKRREQDLKRKEDAAARAGIVIEVKNWPPFFPLIHHDIANEIPVHLQRLQYVTFATYLGLVLCLFWNIIAVTTAWIKGEGVTIWLLALIYFIAGVPGGYVLWYRPLYRAFRTDSALSFGWFFLFYMLHIAFCVFAAVAPPVVFKGKSLAGILPAIDVLSGQAIVGIFYFIGFAFFCLESVVSIWVIQQVYMYFRGSGKQDQMRREAARGALRAAV

SEQ ID NO: 9430 - protein, 538 aa, Arabidopsis thaliana
  misc_feature: HVG ID no. 272
  misc_feature: Useful for making plants with modulated drought sensitivity
MLDSLVSKLPSLSTSDHASVVALNLFVALLCACIVLGHLLEENRWMNESITALLIGLGTGVTILLISKGKSSHLLVFSEDLFFIYLLPPIIFNAGFQVKKKQFFRNFVTIMLFGAVGTIISCTIISLGVTQFFKKLDIGTFDLGDYLAIGAIFAATDSVCTLQVLNQDETPLLYSLVFGEGVVNDATSVVVFNAIQSFDLTHLNHEAAFHLLGNFLYLFLLSTLLGAATGLISAYVIKKLYFGRHSTDREVALMMLMAYLSYMLAELFDLSGILTVFFCGIVMSHYTWHNVTESSRITTKHTFATLSFLAETFIFLYVGMDALDIDKWRSVSDTPGTSIAVSSILMGLVMVGRAAFVFPLSFLSNLAKKNQSEKINFNMQVVIWWSGLMRGAVSMALAYNKFTRAGHTDVRGNAIMITSTITVCLFSTVVFGMLTKPLISYLLPHQNATTSMLSDDNTPKSIHIPLLDQDSFIEPSGNHNVPRPDSIRGFLTRPTRTVHYYWRQFDDSFMRPVFGGRGFVPFVPGSPTERNPPDLSKA

SEQ ID NO: 9431 - protein, 173 aa, Zea mays
  misc_feature: Ceres CLONE 272716
  misc_feature: Useful for making plants with altered terpenoid content
MLAHRLLLLLAVAAASGTAFAKPTAYEALADYDFPPGILPKGVVAYTLDNATGAFTATLDASASGSGSSVCEFSIQGSYSLRYQTKITGKIAPDHLTDLEGVSVKVLFFWLNIVEVTRRGDNLEFSVGIVSADFGIENFLECPTCGCGFDCNNLLMLQKPGAATAKLRLRGAF

SEQ ID NO: 9432 - protein, 156 aa, Arabidopsis thaliana
  misc_feature: HVG ID no. 273
  misc_feature: Useful for making plants with modulated drought sensitivity
MDLEFGRFPIFSILEDMLEAPEEQTEKTRNNPSRAYMRDAKAMAATPADVIEHPDAYVFAVDMPGIKGDEIQVQIENENVLVVSGKRQRDNKENEGVKFVRMERRMGKFMRKFQLPDNADLEKISAACNDGVLKVTIPKLPPPEPKKPKTIQVQVA

SEQ ID NO: 9433 - protein, 153 aa, Zea mays subsp. mays
  misc_feature: Ceres CLONE 273687
  misc_feature: Useful for making plants with modulated nitrogen use efficiency
MQIFVKTLTGKTITLEVESSDTVDNVKAKIQDKEGIPPDQQRLIFAGKQLEDGRTLADYNIQKESTLHLVLRLRGGTMIKVKTLTGKEIEIDIEPTDSIDRIKERVEEKEGIPPVQQRLIYAGKQLADDKTAKDYNIEGGSVLHLVLALRGGY

SEQ ID NO: 9434 - protein, 161 aa, Arabidopsis thaliana
  misc_feature: Ceres CLONE 27375
  misc_feature: Useful for making plants with modulated oxidative stress sensitivity
MSSSGAPSRKTLSKIATNRLQKELVEWQMNPPTGFKHKVTDNLQRWIIEVIGAPGTLYANDTYQLQVDFPEHYPMESPQVIFLHPAPLHPHIYSNGHICLDILYDSWSPAMTVSSICISILSMLSSSTEKQRPTDNDRYVKNCKNGRSPKETRWWFHDDKV

SEQ ID NO: 9435 - protein, 186 aa, Arabidopsis thaliana
  misc_feature: Ceres CLONE 27464
  misc_feature: Useful for making plants with modulated biomass
  misc_feature: The plant is abnormally small.
MARLLFRLLQEANSTSPAEASPPFNSDLVLILAVLLCALTCIIGLIAVSRCAWLRRIASRNRSDQTHPPPVAAANKGLKKKVLRSLPKLTYSPDSPPAEKLVECAICLTEFAAGDELRVLPQCGHGFHVSCIDTWLGSHSSCPSCRQILVVTRCHKCGGLPGSSSSGPEPDTRIKQREDGPDNFLP

SEQ ID NO: 9436 - protein, 122 aa, Arabidopsis thaliana
  misc_feature: Ceres CLONE 27711
  misc_feature: Useful for making plants with modulated nitrogen use efficiency
MEKNSFKLSNPLEMRMAESTRIRAKYPERVPVIVEKAGQSDVPDIDKKKYLVPADLTIGQFVYVVRKRIKLGAEKAIFVFVKNTLPPTAALMSAIYEEHKDEDGFLYMTYSGENTFGGSFYC

SEQ ID NO: 9437 - protein, 311 aa, Arabidopsis thaliana
  misc_feature: Ceres CLONE 27793
  misc_feature: Useful for making plants with altered terpenoid content
MRTGKRNQEEEDYGEEDFNSKREGPSSNTTVHSNRDSKENDKASAIRSKHSVTEQRRRSKINERFQILRELIPNSEQKRDTASFLLEVIDYVQYLQEKVQKYEGSYPGWSQEPTKLTPWRNNHWRVQSLGNHPVAINNGSGPGIPFPGKFEDNTVTSTPAIIAEPQIPIESDKARAITGISIESQPELDDKRLPPLQPILPMVQGEQANECPATSDGLGQSNDLVIEGGTISISSAYSHELLSSLTQALQNAGIDLSQAKLSVQIDLGKRANQGLTHEEPSSKNPLSYDTQGRDSSVEEESEHSHKRMKTL

SEQ ID NO: 9438 - protein, 273 aa, Zea mays
  misc_feature: Ceres CLONE 278992
  misc_feature: Useful for making plants with modulated biomass
  misc_feature: The petioles have very varied liminal angles, giving the plant a very bushy appearance.  The rosette leaves of ten do not appear in the normal fashion
  misc_feature: The plant is abnormally small.
MTNLSAMAASQSYVIRFDGHFDEPSPSSAGAEPPGPQPPFAGRMISLEREHQVIVAALLHVVSGYATPPPQVFTPPPAAARCQVCGMERCLGCEFFAAGEGALGGGAEKAAATGGAAALAAGQRRRRKKKNKYRGVRQRPWGKWAAEIRDPRRAVRKWLGTFDTAEEAARAYDQAAIEFRGPRAKLNFPFPEQPPTGHDEPISSNGDASAAARSSDTTPSPSLCSADAEERGQPEWPSAGQEAGDQLLWEGLQDLMRLDEGEPWLHPASSAWN

SEQ ID NO: 9439 - protein, 86 aa, Zea mays subsp. mays
  misc_feature: Ceres CLONE 280170
  misc_feature: Useful for making plants with modulated nitrogen use efficiency
MSSGRRGRISDDEINELISKLQALLPESSRRRNASRSSASKLLKETCAYIKSLHREVDDLSERLSGLMSTMDNDSPQAEIIRSLLR

SEQ ID NO: 9440 - protein, 336 aa, Zea mays
  misc_feature: Ceres CLONE 280261
  misc_feature: Useful for making plants with altered Lignin content
  misc_feature: Useful for making plants with altered alkaloid content
MPGGSSGPDGEVDAGFAKLQGEDFEYYMQTYSIMLGRNSKKSTVDVDLSSLGGGMNISRHHARIFYDFQRRRFALDVIGKNGCLVEGVLHLPGNPPVKLDSQDLLQIGDKKFYFLLPTRSIFASAAAARHAPIIPQQLPPPPYAHARAGRPRLSEFHDRSFEGDYGREVDEIGNGISETGMRGKLVKRNKKSSGDLDIYGGHRINVEPIGTLGEDSRSEIRSRGDRDIDNQQALQAEEKDVVSSVATVLSDLCGPGEWMPMAKLHNELLEQFGNVWHPSRVRKYLTQDDWSPTETKGRPWFGLLALLRKYPEHFVINTRSKGRMTSEFVSLVSLLS

SEQ ID NO: 9441 - protein, 269 aa, Zea mays
  misc_feature: Ceres CLONE 280814
  misc_feature: Useful for making plants with altered Lignin content
MATAVEVPVEAPVRTVKVTNVSLSATVQDIKEFFSFSGDIDHVEMQSGDEWSQVAYVTFKDAQGAETALLLSGATIVDLSVIIAPAPEHQPPPTASAPPMSGTRVPVGGGDNNVVHKAEDVVSTMLAKGFVLGKDAVGKAKAFDEKHGFTSTAGATVASIDKKIGLTDKITTGTSLVSGKVKEMDQKFQVSDKTKSALAAAEQKVSSAGSAIMKNRYVFTGASWVTSAFNKVAKTATDVGTMTKEKMAAEEHHKGSGPSSGGHSYTPIR

SEQ ID NO: 9442 - protein, 147 aa, Arabidopsis thaliana
  misc_feature: Ceres CLONE 28093
  misc_feature: Useful for making plants with modulated nitrogen use efficiency
MRFLRKRMNTKPSHGPIHFRAPSKIFWRTVRGMIPHKTKRGAAALARLKVFEGVPPPYDKVKRMVIPDALKVLRLQAGHKYCLLGRLSSEVVWNHYDTIKELEVKRKERSQALYERKKQLTKLRAKAEKVAEEKLGSQLDVLASIKY

SEQ ID NO: 9443 - protein, 570 aa, Zea mays subsp. mays
  misc_feature: Ceres CLONE 281642
  misc_feature: Useful for making plants with modulated nitrogen use efficiency
MEEGGEHTSLLVKDDASCHGEETQSLLEANLGPQLKSKCSDWRAPALILGLECLESMAFNGIATNLVVYLRSVLHGGIASSAATVSLWYGTSFFVPILGAAIADTCLGNYKTILISLIMYLFGIVLITVATFMPSTSVLCDVSSCLSSNGTQTMIFFAGLYLTAVGCGGVRSALLPFGANQFNNENSLDIKKRRNFFSLFYICVIFGVITSGTIIVWVQENVSWAIGYGVATTCIGLALIGFLVGTPIFQEDEPCGSPVKSIFQVIVASFRNMSLEVPADSCLLYEVGSNHIQRTKLAHSDDFRFLDKAAVISDPSLVYGGCRSSWSICTVTEVEELKILIRLLPIWVTGIFFGAAISQMHTTFIQQGTVMDTKIGSLSIPPASLYSFEVICVTLWVLAVNKVLVPAIRTYFANGVELTQLQRIGIGRFLMIFAMAMAALLETKRLHIVQEGELLSIVWQLPQYFVIAGAECFGIITQLEFFHGQAPDSMKSILTAFALLTTALGNYLSSAIITLIAGVTRVWHSPGWIPDDLNKGHLDYYYWCLTTLSLVNFVVYLYFASKYKLKKVVC

SEQ ID NO: 9444 - protein, 141 aa, Arabidopsis thaliana
  misc_feature: Ceres CLONE 2831
  misc_feature: Useful for making plants with altered Lignin content
MQTSPESDNDPRYATVTDERKRKRMISNRESARRSRMRKQKQLGDLINEVTLLKNDNAKITEQVDEASKKYIEMESKNNVLRAQASELTDRLRSLNSVLEMVEEISGQALDIPEIPESMQNPWQMPCPMQPIRASADMFDC

SEQ ID NO: 9445 - protein, 173 aa, Arabidopsis thaliana
  misc_feature: Ceres CLONE 28528
  misc_feature: Useful for making plants with modulated biomass
  misc_feature: The plant is abnormally small.
MAPLQRTISDISHQISIDNTLTKEPSPTATATTLLSLSAISEVEDAKCECCGMSEECTPEYIHRVRSKFSGKLICGLCEKAVEGEMEKMNNSEVLMEKRREEAVKVHMSACSRFNRLGRSYPVLYQAEAVKEMLKKRSKKMVVATKPEKGGLARSSSCMPALAKELKDRTLVN

SEQ ID NO: 9446 - protein, 337 aa, Zea mays
  misc_feature: Ceres CLONE 285598
  misc_feature: Useful for making plants with altered Lignin content
MAFFSHHHLQQPHPQQAPPPNQQQPVLPSFRNALPVPVDGQIPAPLTFFNPPPAFPEQPAQTTLVDAVGLTAAAGLGWRQPREQELLGENSQMSSIDFLQTGSAVSTGLALSLEDRRHGGGGAGNSSGDSPLLLLPMLDDDISREVQRLDADMDRFIKAQSERLRQSILEKVQAKQFEALASVEDKIFRKIRDKEAEVETINKRNSELEDQIKHLGVEVGAWQQRAKYNESLINALKYNLEQVCAHQSKDFKEGCGDSEVDDTASCPYGGAVNLQLMPKENRQPKNLTACRVCKSSEACMLLLPCRHLCLCKECESKLSICPLCQSSKILGMEIYYA

SEQ ID NO: 9447 - protein, 287 aa, Zea mays
  misc_feature: Ceres CLONE 286402
  misc_feature: Useful for making plants with altered terpenoid content
MERLQRIFGASGMGQPPTDSPLLDSSEQVYISSLALLKMLKHGRAGVPMEVMGLMLGEFVDDYTVRVVDVFAMPQSGTGVSVEAVDHVFQTNMLDMLKQTGRPEMVVGWYHSHPGFGCWLSGVDINTQQSFEALNPRAVAVVIDPIQSVKGKVVIDAFRLINPQTMMLGQEPRQTTSNVGHLNKPSIQALIHGLNRHYYSIAINYRKNELEEKMLLNLHKKKWTDGLILKRFDTHSKTNEQTVQEMLNLAIKYNKAVQEEDELPPEKLAIANVGRQDAKKHLEEHVL

SEQ ID NO: 9448 - protein, 151 aa, Arabidopsis thaliana
  misc_feature: Ceres CLONE 28832
  misc_feature: Useful for making plants with modulated heat sensitivity
MASSSSRGEMEKMGIDQLKALKEQADLEVNLLQDSLNNIRTATVRLDAAAAALNDLSLRPQGKKMLVPLTASLYVPGTLDEADKVLVDIGTGYFIEKTMDDGKDYCQRKINLLKSNFDQLFEVAAKKKSVADEAGMVLQAKVKQLTAATTS

SEQ ID NO: 9449 - protein, 267 aa, Arabidopsis thaliana
  misc_feature: CLONE 123905
  misc_feature: Useful for biocontainment applications
  misc_feature: Useful for making plants with altered terpenoid content
  misc_feature: Useful for making plants with modulated biomass
  misc_feature: Useful for making plants with modulated flowering time
  misc_feature: No seed is being produced by the plant
  misc_feature: The plant flowers significantly late compared to wild-type.
  misc_feature: The plant is abnormally small.
  misc_feature: The plant produces a reduced number of seeds.
  misc_feature: The rosette leaves do not appear in the normal fashion, i.e., their phyllotaxy may be abnormal or too many leaves may be emerging in comparison to the control.
MHYPNNRTEFVGAPAPTRYQKEQLSPEQELSVIVSALQHVISGENETAPCQGFSSDSTVISAGMPRLDSDTCQVCRIEGCLGCNYFFAPNQRIEKNHQQEEEITSSSNRRRESSPVAKKAEGGGKIRKRKNKKNGYRGVRQRPWGKFAAEIRDPKRATRVWLGTFETAEDAARAYDRAAIGFRGPRAKLNFPFVDYTSSVSSPVAADDIGANASASASVSATDSVEAEQWNGGGGDCNMEWMNMMMMMDFGNGDSSDSGNTIADMFQ

SEQ ID NO: 9450 - protein, 142 aa, Arabidopsis thaliana
  misc_feature: Ceres CLONE 29009
  misc_feature: Useful for making plants with modulated biomass
  misc_feature: The plant is abnormally small.
MTDLQMEVEVDTNSSLQESLPKPQVMYRCKKCRRIVAIEENIVPHEPGKGEECFAWKKRSGNSEQVQCSSIFVEPMKWMQTIHDGVVEEKLLCFGCNGRLGYFNWAGMQCSCGAWVNPAFQLNKSRIDECKSEPNPNLNMET

SEQ ID NO: 9451 - protein, 377 aa, Zea mays
  misc_feature: Ceres CLONE 292789
  misc_feature: Useful for making plants with modulated biomass
  misc_feature: The plant is abnormally small.
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTTAEREIVRDIKEKLAYVALDYDQELENAKSSSSVEKSYELPDGQVITIGAERFRCPEVLFQPSFIGMEAPGIHETTYNSIMKCDVDIRKDLYGNIVLSGGTTMFPGIADRMSKEITALAPSSMKIKVVAPPERKYSVWIGGSILASLSTFQQMWISKAEYDESGPAIVHRKCF

SEQ ID NO: 9452 - protein, 242 aa, Arabidopsis thaliana
  misc_feature: Ceres CLONE 29310
  misc_feature: Useful for making plants with altered terpenoid content
  misc_feature (121)..(121): Xaa is any aa, unknown, or other
MLKRQSLRADNIKMFVLDEADEMLSRGFKDQIYDIFQLLPPKIQVGVFSATMPPEALEITRKFMSKPVRILVKRDELTLEGIKQFYVNVEKEEWKLETLCDLYETLAITQSVIFVNTRRKXDWLTDKMRSRDHTVSATHGDMDQNTRDIIMREFRSGSSRVLITTDLLARGIDVQQVSLVINFDLPTQPENYLHRIGRSGRFGRKGVAINFVTRDDERMLFDIQKFYNVVVEELPSNVADLL

SEQ ID NO: 9453 - protein, 203 aa, Zea mays
  misc_feature: Ceres CLONE 293389
  misc_feature: Useful for making plants with modulated biomass
  misc_feature: The plant is abnormally large.
LPTPLFLSAELRKSPLVSPSPIPPAAADAPRLFKMNVEKLKKMAGAVRTGGKGSMRRKKKAVHKTATTDDKRLQSTLKRIGVNTIPGIEEVNIFKDDIVIQFQNPKVQASIPANTWVVSGVPQTKSLQDLLPTIINQLGPDNLENLKRLAEHFQKQVPGAEASASAAAQDEDDVPELVPGETFEEAAEVKEVPEAEPEEKKDS

SEQ ID NO: 9454 - protein, 1091 aa, Arabidopsis thaliana
  misc_feature: HVG ID no. 296
  misc_feature: Useful for making plants with modulated low light sensitivity
MYKQPRQELEAYYFEPNSVEKLRYLPVNNSRKRFCTLEPFPDSPPYNALSTATYDDTCGSCVTDELNDFKHKIREIETVMMGPDSLDLLVDCTDSFDSTASQEINGWRSTLEAISRRDLRADLVSCAKAMSENDLMMAHSMMEKLRQMVSVSGEPIQRLGAYLLEGLVAQLASSGSSIYKALNRCPEPASTELLSYMHILYEVCPYFKFGYMSANGAIAEAMKEENRVHIIDFQIGQGSQWVTLIQAFAARPGGPPRIRITGIDDMTSAYARGGGLSIVGNRLAKLAKQFNVPFEFNSVSVSVSEVKPKNLGVRPGEALAVNFAFVLHHMPDESVSTENHRDRLLRMVKSLSPKVVTLVEQESNTNTAAFFPRFMETMNYYAAMFESIDVTLPRDHKQRINVEQHCLARDVVNIIACEGADRVERHELLGKWRSRFGMAGFTPYPLSPLVNSTIKSLLRNYSDKYRLEERDGALYLGWMHRDLVASCAWKDDTCGSCVTDELNDFKHKIREIETVMMGPDSLDLLVDCTDSFDSTASQEINGWRSTLEAISRRDLRADLVSCAKAMSENDLMMAHSMMEKLRQMVSVSGEPIQRLGAYLLEGLVAQLASSGSSIYKALNRCPEPASTELLSYMHILYEVCPYFKFGYMSANGAIAEAMKEENRVHIIDFQIGQGSQWVTLIQAFAARPGGPPRIRITGIDDMTSAYARGGGLSIVGNRLAKLAKQFNVPFEFNSVSVSVSEVKPKNLGVRPGEALAVNFAFVLHHMPDESVSTENHRDRLLRMVKSLSPKVVTLVEQESNTNTAAFFPRFMETMNYYAAMFESIDVTLPRDHKQRINVEQHCLARDVVNIIACEGADRVERHELLGKWRSRFGMAGFTPYPLSPLVNSTIKSLLRNYSDKYRLEERDGALYLGWMHRDLVASCAWKYKQPRQELEAYYFEPNSVEKLRYLPVNNSRKRFCTLEPFPDSPPYNALSTATYDDTCGSCVTDELNDFKHKIREIETVMMGPDSLDLLVDCTDSFDSTASQEINGWRSTLEAISRRDLRADLVSCAKAMSENDLMMAHSMMEKLRQMVSVSGEPIQRLGAYLPRW

SEQ ID NO: 9455 - protein, 177 aa, Arabidopsis thaliana
  misc_feature: Ceres CLONE 29637
  misc_feature: Useful for making plants with altered Lignin content
  misc_feature: Useful for making plants with altered terpenoid content
MAAVQQQQAMQKNTLYVGGLADEVNESILHAAFIPFGDIKDVKTPLDQANQKHRSFGFVTFLEREDASAAMDNMDGAELYGRVLTVNYALPEKIKGGEQGWAAHPLWADADTWFERQQQEKEILKMQAENKAAMETAEELHRKKLAEDRQGEMEEDTDTKDDPMARAEADALSHGDA

SEQ ID NO: 9456 - protein, 534 aa, Arabidopsis thaliana
  misc_feature: Ceres CLONE 29661
  misc_feature: Useful for biocontainment applications
  misc_feature: Useful for making plants with modulated flowering time
  misc_feature: Useful for making plants with modulated nitrogen use efficiency
  misc_feature: The plant flowers significantly late compared to wild-type.
  misc_feature: The plant produces a reduced number of seeds.
  misc_feature (497)..(497): Xaa is any aa, unknown, or other
MATKLDTSSLLLALLSKCSLLTQTNLALSLLVASLASLALSLFFWSHPGGPAWGKYFLHRRRQTTVIPGPRGLPFVGSMSLMSNTLAHRCIAATAEKFRAERLMAFSLGETRVIVTCNPDVAKEILNSPVFADRPVKESAYSLMFNRAIGFAPYGVYWRTLRKIASNHLFSPKQIKRSETQRSVIANQIVKCLTKQSNTKGLCFARDLIKTASLNNMMCSVFGKEYELEEEHEEVSELRELVEEGYDLLGTLNWTDHLPWLSEFDPQRIRSRCSNLVPKVNRFVNRIISDHREQTRDSPSDFVDVLLSLDGPDKLSDPDIIAVLWEMIFRGTDTVAVLIEWILARMVLHPDIQSTVHNELDQIVGRSRAVEESDVVSLVYLTAVVKEVLRLHPPGPLLSWARLAITDTIIDGRRVPAGTTAMVNMWAIAHDPHVWENPLEFKPERFVAKEGEVEFSVLGSDLRLAPFGSGRRVCPGKNLGLTTVTFWTATLLHEFEXLTPSDEKTVDLSEKLRLSCEMANPLAAKLRPRRSFSV

SEQ ID NO: 9457 - protein, 195 aa, Zea mays
  misc_feature: Ceres CLONE 303140
  misc_feature: Useful for making plants with altered terpenoid content
MGMEIDMETYPNLNTSPSAATASGDAKACANCHTTKTSLWRGGPEGPKSLCNACGIRYRKRRQAIGLDAGAAAAANSQQDLQQPKKKAAVDPQQQDQHQLRKKTTAVANPQQDRHQPRKRAAAAAAATDPQHTSITKKDTDKKDQQVTVDLHVVGFGKEATFKQRRRMRHNKCMSEEERAAVLLMALSSGVIYAS

SEQ ID NO: 9458 - protein, 187 aa, Zea mays subsp. mays
  misc_feature: Ceres CLONE 303456
  misc_feature: Useful for making plants with modulated nitrogen use efficiency
MGIDLVAGGRNKKTKRTAPKSDDVYLKLLVKLYRFLVRRTKSNFNAVILKRLFMSKTNRPPISMRRLVKFMEGKEKNIAVIVGTVTDDKRIQEVPAMKVTALRFTETARARIVNAGGECLTFDQLALRAPLGENTVLLRGPKNAREAVRHFGKAPGVPHSHTKPYVRSKGRKFEKARGRRNSRGFKV

SEQ ID NO: 9459 - protein, 106 aa, Arabidopsis thaliana
  misc_feature: Ceres CLONE 30457
  misc_feature: Useful for making plants with modulated nitrogen use efficiency
MKHLAVAICCCLAENGYLVLDPNKLEEKKMTAFAYLVFPNTTLSVLPEGSSVAEGEPVEHGIITSVTHGVMSVDDYFLCVENGRAATASLSAFFRKNFQQSSSKAG

SEQ ID NO: 9460 - protein, 251 aa, Arabidopsis thaliana
  misc_feature: HVG ID no. 306
  misc_feature: Useful for making plants with modulated low light sensitivity
MDLSPVKEALAAKSFDKIADICDTLMLQVASEGIEYHDDWPYAIHLLGYFYVDDCDSARFLWKRIPTAIKERKPEVVAAWGIGQKLWTHDYAGVYEAIRGYDWSQEAKDMVAAFSDLYTKRMFQLLLSAYSTITIHDLALFLGMTEDDATTYVVENGWTVDAASQMASVKKQAVKREQKVDSSKLQRLTEYVFHLEHMTEDDATTYVVENGWTVDAASQMASVKKQAVKREQKVDSSKLQRLTEYVFHLEH

SEQ ID NO: 9461 - protein, 334 aa, Zea mays
  misc_feature: Ceres CLONE 306139
  misc_feature: Useful for making plants with altered Lignin content
MEYPATAAGSGSHKYYYPQQHSHSQPQALRRPPRPAARWVKQWIPQDLASSGGKCSLFKWVREDGYRNSKDNPRVLDVEAPKPEPTTEILFLCSYENCGKTFVDVSALRKHASVHNEKQYICNEPNCGKKFVDSSKLKRHYLTHTGQKDFVCPHPGCGKAFSLDFNLRSHLKTHALENYHICPFPACGKRFTSDFKLGAHVKSHEKTGTPIAVQHAPAPPAEKPRVAPKPPTPATTSYADRPYVCPYEGCDKAYIHSYKLNLHLKTQHPEHGQEENGKVGASGGQHAANEHTYQYNYAEVGEIAPNPKKEQDESWAQGPLIQSLQCQGFESNAF

SEQ ID NO: 9462 - protein, 162 aa, Arabidopsis thaliana
  misc_feature: Ceres CLONE 30753
  misc_feature: Useful for making plants with modulated cold sensitivity
MGQVFNKLRGKEWRHKQVQAICDRVFDRFKMQTGRANLTFEELYIAVLLVYNDINKRLPGPHFDPPSKDLVNSIMTDCDINLDGELDREEFVKFIEQITAETFNVVSQGLIIALIVAPTVAIATKKATEGVPGVGKVVQKLPTSIYASLVTLAVMWVNSDSS

SEQ ID NO: 9463 - protein, 441 aa, Arabidopsis thaliana
  misc_feature: HVG ID no. 308
  misc_feature: Useful for making plants with modulated low light sensitivity
MERDEEASGPMMEMCTNGGEETSNRRPIISGEPLDIEAYAALYKGRTKIMRLLFIANHCGGNHALQFDALRMAYDEIKKGENTQLFREVVNKIGNRLGEKYGMDLAWCEAVDRRAEQKKVKLENELSSYRTNLIKESIRMGYNDFGDFYYACGMLGDAFKNYIRTRDYCTTTKHIIHMCMNAILVSIEMGQFTHVTSYVNKAEQNPETLEPMVNAKLRCASGLAHLELKKYKLAARKFLDVNPELGNSYNEVIAPQDIATYGGLCALASFDRSELKQKVIDNINFRNFLELVPDVRELINDFYSSRYASCLEYLASLKSNLLLDIHLHDHVDTLYDQIRKKALIQYTLPFVSVDLSRMADAFKTSVSGLEKELEALITDNQIQARIDSHNKILYARHADQRNATFQKVLQMGNEFDRDVRAMLLRANLLKHEYHARSARKL

SEQ ID NO: 9464 - protein, 485 aa, Arabidopsis thaliana
  misc_feature: HVG ID no. 310
  misc_feature: Useful for making plants with modulated low light sensitivity
MDIEQKQAEIIDQLVKRASTCKSEALGPLIIEATSHPSLFAFSEILALPNVAQLEGTTDSVYLDLLRLFAHGTWGDYKCNATRLPHLSPDQILKLKQLTVLTLAESNKVLPYDTLMVELDVSNVRELEDFLINECMYAGIVRGKLDQLKRCFEVPFAAGRDLRPGQLGNMLHTLSNWLNTSENLLISIQDKIKWADNMSEMDKKHRKEAEEGVEEVKKSLSMKGDVDIRGNKEMFGEPSGVMDYEEDGIRPKRRRHPVTRMDIEQKQAEIIDQLVKRASTCKSEALGPLIIEATSHPSLFAFSEILALPNVAQLEGTTDSVYLDLLRLFAHGTWGDYKCNATRLPHLSPDQILKLKQLTVLTLAESNKVLPYDTLMVELDVSNVRELEDFLINECMYAGIVRGKLDQLKRCFEVPFAAGRDLRPGQLGNMLHTLSNWLNTSENLLISIQDKIKWADNMSEMDKKHRKEAEEGVEEVKKSLSMKRE

SEQ ID NO: 9465 - protein, 207 aa, Arabidopsis thaliana
  misc_feature: Ceres CLONE 31005
  misc_feature: Useful for making plants with modulated nitrogen use efficiency
MNPTHGDFTPLNSNHFVDPKVRFRHHSLMQDYGELHMETEAMRKRLQAVRERKATLMAEVRFLRRRYRHLRQDQPQEIKKVRRSNGGKKIRVEVSPSNKSEAETKHVSLPDLNHSEKAHDETKTSPKRRVPLFDLNQISGEEEQETEAVDNNQENTRVEESNSCKRLMISSIEMQQKDVKPSSCRNGGNGSNKRKISWQDPVAALRV

SEQ ID NO: 9466 - protein, 162 aa, Arabidopsis thaliana
  misc_feature: Ceres CLONE 31044
  misc_feature: Useful for making plants with altered Lignin content
  misc_feature: Useful for making plants with modulated biomass
  misc_feature: The plant is abnormally small.
MAARAHDVAALAIKGTTAYLNFPKLAGELPRPVTNSPKDIQAAASLAAVNWQDSVNDVSNSEVAEIVEAEPSRTVVAQLFSSDTSTTTTTQSQEYSEASCASTSACTDKDSEEEKLFDLPDLFTDENEMMIRNDAFCYYSSTWQLCGADAGFRLEEPFFLSE

SEQ ID NO: 9467 - protein, 216 aa, Arabidopsis thaliana
  misc_feature: Ceres CLONE 3115
  misc_feature: Useful for making plants with modulated oxidative stress sensitivity
MAVAPARARSDYDYLIKLLLIGDSGVGKSCLLLRFSDDTFTTSFITTIGIDFKIRTVELDGKRIKLQIWDTAGQERFRTITTAYYRGAMGILLVYDVTDESSFNNIRNWMKNIEQHASDNFNKILVGNKADMDESKRAVPTAKGQALADEYGIKFFETSAKTNLNVENVFMSIAKDIKQRLTETDTKAEPQGIKITKQDTAASSSTAEKSACCSYV

SEQ ID NO: 9468 - protein, 188 aa, Zea mays
  misc_feature: Ceres CLONE 311714
  misc_feature: Useful for making plants with modulated oxidative stress sensitivity
MSRQRTESFSPSPSLDVCKQILPVLDKFGAAMAIVKSDIGGNITRLENKYTSEPSKYEHLYSMIQEEVQNKTAKGSSSCTNGLLWLTRAMDFLVELFRNLLEHPDWAMSQSCTDSYTKTLKKFHGWLASSSFTVAMKLAPNREKFMEVISGTGDINADIEKFCTTFSPFLKENHNFLASVGLDDLKAS

SEQ ID NO: 9469 - protein, 872 aa, Arabidopsis thaliana
  misc_feature: HVG ID no. 312
  misc_feature: Useful for making plants with modulated low light sensitivity
MASDADMEDYGFEYSDEEQEEQDVDIENQYYNSKGMVETEPEEALSGFAEVVQMEPEKADWGFKALKQTVKIYYRLGKYKEMMEAYTEMLTYIKSAVTRNYSEKCINNIMDFVSGSASQNTGLLQEFYQTTLKALEEAKNERLWFKTNLKLCNIWFDIGEYRRMTKILKELHKSCQKEDGTDDQKKGSQLLEVYAIEIQIYTETKDNKKLKQLYHKALAIKSAIPHPRIMGIIRECGGKMHMAERQWEEAATDFFEAFKNYDEAGNQRRIQCLKYLVLANMLMESEVNPFDGQEAKPYKNDPEILAMTNLIAAYQRNEIIEFERILKSNRRTIMDDPFIRNYMEDLLKKVRTQVLLKLIKPYTKIGIPFISKELNVPETDVTELLVSLILDSRIDGHIDEMNRYLLRGDSGNGRKLHKAVDKWNSQLKSLSSNITSRVCMEDYGFEYSDEEQEEQDVDIENQYYNSKGMVETEPEEALSGFAEVVQMEPEKADWGFKALKQTVKIYYRLGKYKEMMEAYTEMLTYIKSAVTRNYSEKCINNIMDFVSGSASQNTGLLQEFYQTTLKALEEAKNERLWFKTNLKLCNIWFDIGEYRRMTKILKELHKSCQKEDGTDDQKKGSQLLEVYAIEIQIYTETKDNKKLKQLYHKALAIKSAIPHPRIMGIIRECGGKMHMAERQWEEAATDFFEAFKNYDEAGNQRRIQCLKYLVLANMLMESEVNPFDGQEAKPYKNDPEILAMTNLIAAYQRNEIIEFERILKSNRRTIMDDPFIRNYMEDLLKKVRTQVLLKLIKPYTKIGIPFISKELNVPETDVTELLVSLILDSRIDGHIDEMNRYLLRGDSGNGRKLHKAVDKWNSQLKSLSSNITSRVC

SEQ ID NO: 9470 - protein, 223 aa, Zea mays
  misc_feature: Ceres CLONE 312833
  misc_feature: Useful for making plants with altered Lignin content
MARRPASWEQGGDEYDYLFKVVLIGDSGVGKSNLLSRFTKNTFALDSKSTIGVEFATRTLQVENKIIKAQIWDTAGQERYRAITSAYYRGAVGALLVYDVTKVMTFENVKRWLKELRDHADSNIVVMLIGNKTDLRHLRSVAVEDAASFAESEGLFFIETSALDATNVEKAFHTVLAEIYRIISKKPLSSEESGLGSGNLREGQSIQVSATNSGALTSRCCSS

SEQ ID NO: 9471 - protein, 541 aa, Arabidopsis thaliana
  misc_feature: HVG ID no. 313
  misc_feature: Useful for making plants with modulated low light sensitivity
MFTSGNVTARVFERQIRTPPPGASVNRARHFYENLVPSYTLYDVESPDHCFRKFTEDGLFLISFSRNHQELIVYRPSWLTYSTTDDSTTTLPPLPRRASKFDSFFTQLYSVNLASSNELICKDFFLYHQTRRFGLFATSTAQIHDSSSPSNDAVPGVPSIDKITFVLLRLDDGVVLDERVFLHDFVNLAHNMGVFLYDDLLAILSLRYQRIHLLQIRDSGHLVDARAIGYFCREDDELFLNSSSQAMMSQDKSKQQSLSGSKEDDTGENGLRHSLSQPSGSNSFLSGVKQRLLSFIFREIWNEESDNRVQSLKKKFYFHFQDYVDLIIWKVQFLDRQHLLIKFGSVDGGVTRSADHHPAFFAVYNMETTDIVAFYQNSAEDLYQLFEQFSDHFTVSSSTPFMNFVTSHSNNVYALEQLKYTKNKSNSFSQFVKKMLLSLPFSCQSQSPSPYFDQSLFRFDEKLISAADRHRQSSDNPIKFISRRQPQTLKFKIKPGPECGTADGRSKKICSFLFHPHLPLAISIQQTLFMPPSVVNIHFRR

SEQ ID NO: 9472 - protein, 73 aa, Arabidopsis thaliana
  misc_feature: Ceres CLONE 314
  misc_feature: Useful for making plants with modulated flowering time
  misc_feature: The plant flowers significantly late compared to wild-type.
MAKPLGTTGEFFRRRDEWRKHPMLSNQMRHALPGLGIGVAAFCVYLVGEQIYNKALAPSKSSHHHQEQTAPSH

SEQ ID NO: 9473 - protein, 333 aa, Arabidopsis thaliana [sequence omitted]

SEQ ID NO: 9474 - protein, 100 aa, Arabidopsis thaliana
  misc_feature: Ceres CLONE 31762
  misc_feature: Useful for making plants with modulated heat sensitivity
MTTSSSSYGTFSTVFNSSRPNSSATFLVPSLKFSTGISNFANLSNGFSLKSPINPGFLFKSRPFTVQARAAAEKTVHDFTVKDIDGKDVALNKIQGESYV

SEQ ID NO: 9475 - protein, 221 aa, Arabidopsis thaliana
  misc_feature: Ceres CLONE 31969
  misc_feature: Useful for making plants with modulated drought sensitivity
MAGFLSVVRRVYLTLYNWIVFAGWAQVLYLAITTLKETGYENVYDAIEKPLQLAQTAAVLEILHGLVGLVRSPVSATLPQIGSRLFLTWGILYSFPEVRSHFLVTSLVISWSITEIIRYSFFGFKEALGFAPSWHLWLRYSSFLLLYPTGITSEVGLIYLALPHIKTSEMYSVRMPNILNFSFDFFYATILVLAIYVPGSPHMYRYMLGQRKRALSKSKRE

SEQ ID NO: 9476 - protein, 496 aa, Arabidopsis thaliana
  misc_feature: CLONE 15650
  misc_feature: Useful for making plants with modulated nitrogen use efficiency
MTDYNYIDNMQGLITITLTASFPQLHPASCNSQDPLSCGGPNKLQIGVLLLGLCFLSVGSGGIRPCSIPFGVDQFDQRTEEGVKGVASFFNWYYMTFTVVLIITQTVVVYIQDQVSWIIGFSIPTGLMALAVVMFFAGMKRYVYVKPEGSIFSGIAQVIVAARKKRKLKLPAEDDGTVTYYDPAIKSSVLSKLHRSNQFRCLDKAAVVIEGDLTPEGPPADKWRLCSVQEVEEVKCLIRIVPIWSAGIISLAAMTTQGTFTVSQALKMDRNLGPKFEIPAGSLSVISLLTIGIFLPFYDRVFVPFMRRITGHKSGITLLQRIGTGIVFTIFSMIVAGIVERMRRIRSINAGDPTGMTPMSVFWLSPQLILMGLCEAFNIIGQIEFFNSQFPEHMRSIANSLFSLSFAGSSYLSSFLVTVVHKFSGGHDRPDWLNKNLNAGKLDYFYYLIAVLGVVNLVYFWYCARGYRYKVGLPIEDFEEDKSSDDVEMTSKKSME

SEQ ID NO: 9477 - protein, 265 aa, Arabidopsis thaliana
  misc_feature: HVG ID no. 320
  misc_feature: Useful for making plants with modulated light quality response
MAQTMLLTSGVTAGHFLRNKSPLAQPKVHHLFLSGNSPVALPSRRQSFVPLALFKPKTKAAPKKVEKPKSKVEDGIFGTSGGIGFTKANELFVGRVAMIGFAASLLGEALTGKGILAQLNLETGIPIYEAEPLLLFFILFTLLGAIGALGDRGKFVDDPPTGLEKAVIPPGKNVRSALGLKEQGPLFGFTKANELFVGRLAQLGIAFSLIGEIITGKGALAQLNIETGIPIQDIEPLVLLNVAFFFFAAINPGNGKFITDDGEES

SEQ ID NO: 9478 - protein, 348 aa, Arabidopsis thaliana
  misc_feature: Ceres CLONE 32143
  misc_feature: Useful for making plants with modulated nitrogen use efficiency
MKATLAAPSSLTSLPYRTNSSFGSKSSLLFRSPSSSSSVSMTTTRGNVAVAAAATSTEALRKGIAEFYNETSGLWEEIWGDHMHHGFYDPDSSVQLSDSGHKEAQIRMIEESLRFAGVTDEEEEKKIKKVVDVGCGIGGSSRYLASKFGAECIGITLSPVQAKRANDLAAAQSLSHKASFQVADALDKPFEDGKFDLVWSMESGEHMPDKAKFVKELVRVAAPGGRIIIVTWCHRNLSAGEEALQPWEQNILDKICKTFYLPAWCSTDDYVNLLQSHSLQDIKCADWSENVAPFWPAVIRTALTWKGLVSLLRSGMKSIKGALTMPLMIEGYKKGVIKFGIITCQKPL

SEQ ID NO: 9479 - protein, 147 aa, Arabidopsis thaliana
  misc_feature: Ceres CLONE 32348
  misc_feature: Useful for making plants with modulated biomass
  misc_feature: The plant is abnormally small.
  misc_feature (140)..(140): Xaa is any aa, unknown, or other
MDLLLLEKSLIAVFVAVILATVISKLRGKKLKLPPGPIPIPIFGNWLQVGDDLNHRNLVDYAKKFGDLFLLRMGQRNLVVVSSPDLTKEVLHTQGVEFGSRTRNVVFDIFTGKGQDMVFTVYGEHWRKMRRIMDGSFLHXQSCSTES

SEQ ID NO: 9480 - protein, 454 aa, Arabidopsis thaliana
  misc_feature: Ceres CLONE 32361
  misc_feature: Useful for making plants with modulated oxidative stress sensitivity
MASVVLRNPSSKRLVPFSSQIYSRCGASVTSSYSISHSIGGDDLSSSTFGTSSFWRSMATFTRNKPHVNVGTIGHVDHGKTTLTAAITKVLAEEGKAKAIAFDEIDKAPEEKKRGITIATAHVEYETAKRHYAHVDCPGHADYVKNMITGAAQMDGGILVVSGPDGPMPQTKEHILLARQVGVPSLVCFLNKVDVVDDPELLELVEMELRELLSFYKFPGDDIPIIRGSALSALQGTNDEIGRQAILKLMDAVDEYIPDPVRVLDKPFLMPIEDVFSIQGRGTVATGRIEQGVIKVGEEVEILGLREGGVPLKSTVTGVEMFKKILDNGQAGDNVGLLLRGLKREDIQRGMVIAKPGSCKTYKKFEAEIYVLTKDEGGRHTAFFSNYRPQFYLRTADITGKVELPENVKMVMPGDNVTAVFELIMPVPLETGQRFALREGGRTVGAGVVSKVMT

SEQ ID NO: 9481 - protein, 117 aa, Arabidopsis thaliana
  misc_feature: Ceres CLONE 32647
  misc_feature: Useful for making plants with modulated heat sensitivity
MDSSKLSSLSLCLFLICIIYLPQHSLACGSCNPRKGGKHSPKAPKLPVPPVTVPKLPVPPVTVPKLPVPPVTVPKLPVPPVTIPKLPVPPVTVPKLPVPPVTVPKLPVPPVTVPKLP

SEQ ID NO: 9482 - protein, 161 aa, Arabidopsis thaliana
  misc_feature: Ceres CLONE 32868
  misc_feature: Useful for making plants with modulated nitrogen use efficiency
MDSKSLAKSKRAHTLHHSKKSHSVHKPKVPGVSEKNPEKLQGNQTKSPVQSRRVSALPSNWDRYDDELDAAEDSSISLPSDVIVPKSKGADYLHLISEAQAESNSKIENNLDCLSSLDDLLHDEFSRVVGSMISARGEGILSWMEDDNFVVEEDGSGSYQE

SEQ ID NO: 9483 - protein, 240 aa, Zea mays subsp. mays
  misc_feature: Ceres CLONE 329608
  misc_feature: Useful for making plants with modulated nitrogen use efficiency
MQEASSAAAGAEPGRRAAQHQFAGVDLRRPKGYAPPAPAVSEGDPCPRCASRDTKFCYYNNYNTSQPRHFCKGCRRYWTKGGTLRNVPVGGGTRKKPSLSSSSSSSYAAAADADRQPKKKPASKKRRVVAPAPELAAAADPGKTAPTTTTTTTTTSEITTETGALEDSDSLAHLLLQPGTEDAEAVALGLGLSDFPSAGKAVLDDEDSFVWPAASFDMGACWAGAGFADPDPACIFLNLP

SEQ ID NO: 9484 - protein, 93 aa, Zea mays
  misc_feature: Ceres CLONE 331755
  misc_feature: Useful for making plants with altered Lignin content
MASMSLSSSRAQWTAKQNKLFEQALAVYDRDTPDRWHNIARAVGGKSADEVRRYYELLVKDLEHIEAGKVAFPAYRCPGGYDDADSDRLKHLT

SEQ ID NO: 9485 - protein, 953 aa, Arabidopsis thaliana
  misc_feature: HVG ID no. 332
  misc_feature: Useful for making plants with modulated flowering time
MDAFKEEIEIGSSVESLMELLDSQKVLFHSQIDQLQDVVVAQCKLTGVNPLAQEMAAGALSIKIGKRPRDLLNPKAVKYLQAVFAIKDAISKRESREISALFGITVAQVREFFVTQKTRVRKQVRLSREKVVMSNTHALQDDGVPENNNATNHVEPVPLNSIHPEACSISWGEGETVALIPPEDIPPDISDSDKYFVENIFSLLRKEETFSGQVKLMEWIMQIQDASVLIWFLSKGGVLILTTWLSQAASEEQTSVLLLILKVLCHLPLHKASPENMSAILQSVNGLRFYRISDISNRAKGLLSRWTKLFAKIQAMKKQNRNSSQIDSQSQLLLKQSIAEIMGDSSNPEDILSLSNGKSENVRRIESSQGPKLLLTSADDSTKKHMLGSNPSYNKERRKVQMVEQPGQKAAGKSPQTVRIGTSGRSRPMSADDIQKAKMRALYMQSKNSKKDPLPSAIGDSKIVAPEKPLALHSAKDSPPIQNNEAKTEDTPVLSTVQPVNGFSTIQPVNGPSAVQPVNGPLAVQPVNGPSALQPVNGPSAVIVPVQADEIKKPSTPPKSISSKVGVMMKMSSQTILKNCKRKQIDWHVPPGMELDELWRVAAGGNSKEADVQRNRNRRERETTYQSLQTIPLNPKEPWDREMDYDDSLTPEIPSQQPPEESLTEPQDSLDERRIAAGAATTSSSLSSPEPDLELLAALLKNPDLVYALTSGKPSNLAGQDMVKLLDVIKTGAPNSSSSSNKQVEERVEVSLPSPTPSTNPGMSGWGQEGIRNPFSRQNQVGTAVARSGTQLRVGSMQWHQTNEQSIPRHAPSAYSNSITLAHTEREQQQYMQPKLHHNLHFQQQQQQPISTTSYAVREPVGQMGTGTSSSWRSQQSQNSYYSHQENEIASASQVTSYQGNSQYMSSNPGYESWSPDNSPSRNQLNMRGQQQQASRKHDSSTHPYWNQNKRWR

SEQ ID NO: 9486 - protein, 291 aa, Arabidopsis thaliana
  misc_feature: Ceres CLONE 33231
  misc_feature: Useful for making plants with modulated cold sensitivity
MAKDLDVNESGPPAARDYKDPPPAPFFDMEELRKWPLYRAVIAEFVATLLFLYVSILTVIGYKAQTDATAGGVDCGGVGILGIAWAFGGMIFVLVYCTAGISGGHINPAVTVGLFLARKVSLVRTVLYIVAQCLGAICGCGFVKAFQSSYYTRYGGGANELADGYNKGTGLGAEIIGTFVLVYTVFSATDPKRNARDSHVPVLAPLPIGFAVFMVHLATIPITGTGINPARSFGAAVIYNNEKAWDDQWIFWVGPMIGAAAAAFYHQFILRAAAIKALGSFGSFGSFRSFA

SEQ ID NO: 9487 - protein, 1468 aa, Arabidopsis thaliana
  misc_feature: HVG ID no. 333
  misc_feature: Useful for making plants with modulated flowering time
MKESGKKTQQSPSVDEKYSQWKGLVPILYDWLANHNLVWPSLSCRWGPQLEQATYKNRQRLYLSEQTDGSVPNTLVIANCEVVKPRVAAAEHISQFNEEARSPFVKKYKTIIHPGEVNRIRELPQNSKIVATHTDSPDVLIWDVETQPNRHAVLGAANSRPDLILTGHQDNAEFALAMCPTEPFVLSGGKDKSVVLWSIQDHITTIGTDSKSSGSIIKQTGEGTDKNESPTVGPRGVYHGHEDTVEDVAFSPTSAQEFCSVGDDSCLILWDARTGTNPVTKVEKAHDADLHCVDWNPHDDNLILTGSADNTVRLFDRRKLTANGVGSPIYKFEGHKAAVLCVQWSPDKSSVFGSSAEDGLLNIWDYDRVSKKSDRAAKSPAGLFFQHAGHRDKVVDFHWNASDPWTIVSVSDDCETTGGGGTLQIWRMSDLIYRPEEEVVAELEKFKSHVMTCASKPMESDEAAAVSPQATTPSGGTGASGPKKRGRKPKTKEDSQTPSSQQQSDVKMKESGKKTQQSPSVDEKYSQWKGLVPILYDWLANHNLVWPSLSCRWGPQLEQATYKNRQRLYLSEQTDGSVPNTLVIANCEVVKPRVAAAEHISQFNEEARSPFVKKYKTIIHPGEVNRIRELPQNSKIVATHTDSPDVLIWDVETQPNRHAVLGAANSRPDLILTGHQDNAEFALAMCPTEPFVLSGGKDKSVVLWSIQDHITTIGTDSKSSGSIIKQTGEGTDKNESPTVGPRGVYHGHEDTVEDVAFSPTSAQEFCSVGDDSCLILWDARTGTNPVTKVEKAHDADLHCVDWNPHDDNLILTGSADNTVRLFDRRKLTANGVGSPIYKFEGHKAAVLCVQWSPDKSSVFGSSAEDGLLNIWDYDRVSKKSDRAAKSPAGLFFQHAGHRDKVVDFHWNASDPWTIVSVSDDCETTGGGGTLQIWRMSDLIYRPEEEVVAELEKFKSHVMTCASKPDEAAAVSPQATTPSGGTGASGPKKRGRKPKTKEDSQTPSSQQQSDVKMKESGKKTQQSPSVDEKYSQWKGLVPILYDWLANHNLVWPSLSCRWGPQLEQATYKNRQRLYLSEQTDGSVPNTLVIANCEVVKPRVAAAEHISQFNEEARSPFVKKYKTIIHPGEVNRIRELPQNSKIVATHTDSPDVLIWDVETQPNRHAVLGAANSRPDLILTGHQDNAEFALAMCPTEPFVLSGGKDKSVVLWSIQDHITTIGTDSKSSGSIIKQTGEGTDKNESPTVGPRGVYHGHEDTVEDVAFSPTSAQEFCSVGDDSCLILWDARTGTNPVTKVEKAHDADLHCVDWNPHDDNLILTGSADNTVRLFDRRKLTANGVGSPIYKFEGHKAAVLCVQWSPDKSSVFGSSAEDGLLNIWDYDRVSKKSDRAAKSPAGLFFQHAGHRDKVVDFHWNASDPWTIVSVSDDCETTGGGGTLQIWRMSDLIYRPEEEVVAELEKFKSHVMTCASKP

SEQ ID NO: 9488 - protein, 127 aa, Zea mays
  misc_feature: Ceres CLONE 333753
  misc_feature: Useful for making plants with altered Lignin content
  misc_feature: Useful for making plants with altered terpenoid content
MKSRARSGGGDSRLSVRKTKVEKDPNKPKRPPTTFFVFMEEFRKDYKEKHPNVKQVSVIGKAGGDMWKSLSDAEKAPYVSKAEKLKVEYTKKMDAYNNKQSGGGPTLSGDSDKSKSEVNDGDEEGDE

SEQ ID NO: 9489 - protein, 310 aa, Arabidopsis thaliana
  misc_feature: Ceres CLONE 33498
  misc_feature: Useful for making plants with altered alkaloid content
MAAKEGSRIFVGGLSPEVTDRDLERAFSRFGDILDCQIMLERDTGRSRGFAFITFADRRAMDESIREMHGRDFGDRVISVNRAEPKLGRDDGESHGSRGGRDSGYSIAGKGSFGGGGGGGGRVGEDECFKCGRVGHWARDCPSAGGGRGGPVGGFSSRASAYGGSDGRVDRYADRDRYVDRERYIDDRYDGAARYGARDRFDSREAYIPRDRYASDRYAAPADRFAGGDRYSRGSDRYPPGSYDKARSFERDIAPSAGSDRYGGGRAGGPIRGGGEEGRGFRSRAGAPYERPSRSGGGGAYPSSSTFDRY

SEQ ID NO: 9490 - protein, 475 aa, Zea mays
  misc_feature: Ceres CLONE 335011
  misc_feature: Useful for making plants with altered terpenoid content
METSSAPAAATEAGWYVLGPNQEGVGPYALAELREHFANGYFNESTMLWAEGRKEWMPLSSISELHSAVAAKDQSEQDAPDVDDDFEKFQKEVIEAETEVKALKGNDVDQQDDERPATPPDGEEEFTDDDGTIYKWDRTLRAWVPQNDASGSKEDYAVEEMTFAVEEEIFQAPDILGPALEEINNLPESKNKGSDKAEMRGDKKRKSYENPAEKKEANKPPDSWFDLKVNTHVYVTGLPDDVTVEEIVEVFSKCGIIKEDPETKKPRVKIYTDRETGRKKGDALVTYFKEPSVALAVQLLDGTPFRPGGKTHMSVSPAKFEQKGDVFVSKKTDKQKKRKIKKVEDKMLGWGGHDDKKLMIPATVILRHMFTPAELRADEELLPELEADVREECIKFGPVDNVKVCENHPQGVILVRFKDRKDGAKCIEKMNGRWFAGRQIHASEDDGSVNHALIRDYDAEVSRLDRFGQELEEST

SEQ ID NO: 9491 - protein, 145 aa, Arabidopsis thaliana
  misc_feature: Ceres CLONE 3363
  misc_feature: Useful for biocontainment applications
  misc_feature: Useful for making plants with modulated flowering time
  misc_feature: No seed is being produced by the plant
  misc_feature: The plant flowers significantly late compared to wild-type.
MAKADKKPAEKKPAEKTPAAEPAAAAEKKPKAGKKLPKEPAVAGDKKKKRSKKNVETYKIYIFKVLKQVHPDIGISSKAMGIMNSFINDIFEKLAGESSKLARYNKKPTITSREIQTAVRLVLPGELAKHAVSEGTKAVTKFTSS

SEQ ID NO: 9492 - protein, 315 aa, Zea mays
  misc_feature: Ceres CLONE 336323
  misc_feature: Useful for making plants with altered terpenoid content
  misc_feature (109)..(109): Xaa is any aa, unknown, or other
MQGGGGDQAGGSLGMGMGVGYAGGGGAECSSSSVAAAAAAAAAAAEAEERQLLKGEIAVHPLCEQLVAAHVGCLRVATPIDHLPLIDAQLAQSSGLLHSYAAHHSPFLXPHDKHDLDSFLAQYLMLLCSFREQLQQHVRVHAVEAVMACREIEQSLQDLTGVTLEEGTGATMSEEDEDEAPMLEVGLVDMGSDGHDMMGFGPLLPTDSERSLMDRVRQELKIELKQGFKSRIEDVREEILRKRRAGKLPGDTTSILKQWWQQHSKWPYPTEDDKARLVEETGLQLKQINNWFINQRKRNWHNNSQTSTLKSKRKR

SEQ ID NO: 9493 - protein, 282 aa, Arabidopsis thaliana
  misc_feature: Ceres CLONE 33802
  misc_feature: Useful for biocontainment applications
  misc_feature: The plant produces a reduced number of seeds.
  misc_feature (187)..(187): Xaa is any aa, unknown, or other
  misc_feature (193)..(193): Xaa is any aa, unknown, or other
  misc_feature (264)..(264): Xaa is any aa, unknown, or other
MAEKNASAVDGAIRVSGMQFSYDVQDPIFFDFNLDLPAGSRCLLVGANGSGKTTLLKILAGKHMVGGKNVVQVLDRSAFHDTELVCSGDLSYLGGSWSKTAGSAGDIPLQGDFSAEHMIFGVEGIDPFRREKLIDLLDINLQWRMHKVSDGQRRRVQICMGLLHPFKVLLLDEVTVDLDVVARMDLXEFFKEXCEQRGATIVYATHIFDGLETWASHLAYINGGELKLSAKLDEIKDLKTSPNLLSVVEAWLRSETKVEKKTKXKPVVTSPFMSSRQMAYYR

SEQ ID NO: 9494 - protein, 263 aa, Arabidopsis thaliana
  misc_feature: Ceres CLONE 33922
  misc_feature: Useful for making plants with altered Lignin content
  misc_feature: Useful for making plants with modulated nitrogen use efficiency
MAYSACFLHQSALASSAARSSSSSSSQRHVSLSKPVQIICKAQQSHEDDNSAVSRRLALTLLVGAAAVGSKVSPADAAYGEAANVFGKPKTNTDFLPYNGDGFKVQVPAKWNPSKEIEYPGQVLRFEDNFDATSNLNVMVTPTDKKSITDYGSPEEFLSQVNYLLGKQAYFGETASEGGFDNNAVATANILESSSQEVGGKPYYYLSVLTRTADGDEGGKHQLITATVNGGKLYICKAQAGDKRWFKGARKFVESAATSFSVA

SEQ ID NO: 9495 - protein, 415 aa, Zea mays
  misc_feature: Ceres CLONE 339518
  misc_feature: Useful for making plants with altered Lignin content
MMAICSAHTTTISLRSPCTTTVSNAAAGLVQKQVIFLTSINRRSGSRRRGGGVSRTLLQVSCSADGNKPVVIGLAADSGCGKSTFMRRLTSVFGGAAEPPRGGNPDSNTLISDTTTVICLDDYHSLDRTGRKEKGVTALDPRANNFDLMYEQVKAIKQGQAVQKPIYNHVTGLLDPPELITPPKIFVIEGLHPMFDERVRDLLDFSIYLDISDEVKFAWKIQRDMAERGHSLESIKASIEARKPDFDAYIDPQKQYADAVIEVLPTQLIPNDDEGKVLRVKLIMKEGVDNFNPVYLFDEGSTISWVPCGRKLTCSYPGIKFAYGPDIYFGNEVSVLEMDGQFDRLDELIYVESHLSNLSTKFYGEVTQQMLKHADFPGSNNGTGLFQTIVGLKIRDLYEQIVAERAGAPAEAAKV

SEQ ID NO: 9496 - protein, 1173 aa, Arabidopsis thaliana
  misc_feature: HVG ID no. 340
  misc_feature: Useful for making plants with modulated biomass
MASSSSSERWIDGLQFSSLLWPPPRDPQQHKDQVVAYVEYFGQFTSEQFPDDIAELVRHQYPSTEKRLLDDVLAMFVLHHPEHGHAVILPIISCLIDGSLVYSKEAHPFASFISLVCPSSENDYSEQWALACGEILRILTHYNRPIYKTEQQNGDTERNCLSKATTSGSPTSEPKAGSPTQHERKPLRPLSPWISDILLAAPLGIRSDYFRWCSGVMGKYAAGELKPPTIASRGSGKHPQLMPSTPRWAVANGAGVILSVCDDEVARYETATLTAVAVPALLLPPPTTSLDEHLVAGLPALEPYARLFHRYYAIATPSATQRLLLGLLEAPPSWAPDALDAAVQLVELLRAAEDYASGVRLPRNWMHLHFLRAIGIAMSMRAGVAADAAAALLFRILSQPALLFPPLSQVEGVEIQHAPIGGYSSNYRKQIEVPAAEATIEATAQGIASMLCAHGPEVEWRICTIWEAAYGLIPLNSSAVDLPEIIVATPLQPPILSWNLYIPLLKVLEYLPRGSPSEACLMKIFVATVETILSRTFPPESSRELTRKARSSFTTRSATKNLAMSELRAMVHALFLESCAGVELASRLLFVVLTVCVSHEAQSSGSKRPRSEYASTTENIEANQPVSNNQTANRKSRNVKGQGPVAAFDSYVLAAVCALACEVQLYPMISGGGNFSNSAVAGTITKPVKINGSSKEYGAGIDSAISHTRRILAILEALFSLKPSSVGTPWSYSSSEIVAAAMVAAHISELFRRSKALTHALSGLMRCKWDKEIHKRASSLYNLIDVHSKVVASIVDKAEPLEAYLKNTPVQKDSVTCLNWKQENTCASTTCFDTAVTSASRTEMNPRGNHKYARHSDEGSGRPSEKGIKDFLLDASDLANFLTADRLAGFYCGTQKLLRSVLAEKPELSFSVVSLLWHKLIAAPEIQPTAESTSAQQGWRQVVDALCNVVSATPAKAAAAVVLQAERELQPWIAKDDEEGQKMWKINQRIVKVLVELMRNHDRPESLVILASASDLLLRATDGMLVDGEACTLPQLELLEATARAIQPVLAWGPSGLAVVDGLSNLLKCRLPATIRCLSHPSAHVRALSTSVLRDIMNQSSIPIKVTPKLPTTEKNGMNSPSYRFFNAASIDWKADIQNCLNWEAHSLLSTTMPTQFLDTAARELGCTISLSQ

SEQ ID NO: 9497 - protein, 111 aa, Arabidopsis thaliana
  misc_feature: Ceres CLONE 34035
  misc_feature: Useful for biocontainment applications
  misc_feature: Useful for making plants with modulated biomass
  misc_feature: The plant produces a reduced number of seeds.
  misc_feature: The plants are small in stature, dark green, have oval leaves, strong bolts, and are often sterile
MDPRMWHKVAAISGMAALGLGTYGAHVFKPENPSYKQVWQTASLYHLVHTAALVSAPSTKYPNIFGGLLTAGIVAFSGTCYMVALREDRKFSTLAPFGGFAFIAAWATLLF

SEQ ID NO: 9498 - protein, 128 aa, Arabidopsis thaliana
  misc_feature: Ceres CLONE 34060
  misc_feature: Useful for making plants with altered terpenoid content
MADEATRAAFMEIQASMIELTGKLKQVQNQMRNKEGDRKRAFLTLEELRPLPEETNTYKSIGRTFVLEPKTVLEGEQEQKLKDSEAAVASLQTSKEYLEKQVAEVENNLRELLQQEPGIAQQIMSMSM

SEQ ID NO: 9499 - protein, 215 aa, Zea mays
  misc_feature: Ceres CLONE 341857
  misc_feature: Useful for making plants with modulated nitrogen use efficiency
MASSASRFIKCVTVGDGAVGKTCMLICYTSNKFPTDYIPTVFDNFSANVVVDGTTVNLGLWDTAGQEDYNRLRPLSYRGADVFVLAFSLVSRASYENVMKKWLPELQHYAPGVPIVLAGTKLDLREDKHYLVDHPGAVPVTTAQGEELRKHIGATCYIECSSKTQQNVKAVFDAAIKVVIRPPTKQRERKKKKERRGCSIFCSRIMHARRLGCFK

SEQ ID NO: 9500 - protein, 297 aa, Arabidopsis thaliana
  misc_feature: HVG ID no. 342
  misc_feature: Useful for making plants with modulated flowering time
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRLMSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFAWQANSVCTRVAPELQHSRVC

SEQ ID NO: 9501 - protein, 227 aa, Arabidopsis thaliana
  misc_feature: Ceres CLONE 34210
  misc_feature: Useful for biocontainment applications
  misc_feature: The plant produces a reduced number of seeds.
MAKKERPRPEKLSVYLYIPNIVGYMRVLLNCVAFAVCFSNKPLFSVLYFFSFCCDAVDGWVARRFNQVSTFGAVLDMVTDRVSTACLLVILSQIYRPSLVFLSLLALDIASHWLQMYSTFLAGKSSHKDVKDSTSWLFRLYYGNRIFMCYCCVSCEVLYIILLLIAKNQSENLLNVVVATLTQISPLSFLLALTLFGWSMKQTINVIQMKTAADVCVLYDLEKQQKP

SEQ ID NO: 9502 - protein, 154 aa, Arabidopsis thaliana
  misc_feature: Ceres CLONE 34358
  misc_feature: Useful for making plants with modulated cold sensitivity
  misc_feature: Useful for making plants with modulated nitrogen use efficiency
MAGGLGKCSKIRHIVRLRQMLRRWRDQARMSSSFSRCVPSDLPSGHVAVYVGSSCRRFVVRATYLNHPVLRNLLVQAEEEFGFVNQGPLVIPCEESVFEESIRFISRSDSTRSRRFTCPDDFQKNCHVVGIRSKPDLWIESRPLLHGVTEKAVW

SEQ ID NO: 9503 - protein, 223 aa, Arabidopsis thaliana
  misc_feature: Ceres CLONE 34363
  misc_feature: Useful for making plants with altered alkaloid content
MDTTLSPAVEAEQIADSTIDTVSRLIAGVFSGALTGIFAMAGAFTGAVTGAVAGRAAQYGVLRGAALGAVAGAILSVEVLEASRAYWYLELSGSRGPSSMADFVEQLFRGRLVDEQLMSTIINSHHWQLRISDVSYEEREDVYGELEARGLSGDSLRKLPCYIMSSEMVRRQVTHCTICLQDIKTGEITRSLPKCDHTFHLVCVDKWLIRHGSCPICRQAVKD

SEQ ID NO: 9504 - protein, 337 aa, Arabidopsis thaliana
  misc_feature: Ceres CLONE 34385
  misc_feature: Useful for making plants with altered alkaloid content
  misc_feature: Useful for making plants with modulated biomass
  misc_feature: The plant is abnormally small.
MATMARSFLQAISKDEAVAPPLRVVQIEGLAVLKIIKHCKEFSPTLVTGQLLGLDVGSVLEVTNCFPFPVRDDDEEIEADGANYQLEMMRCLREVNVDNNTVGWYQSTVLGSYQTVELIETFMNYQENIKRCVCIIYDPSKADLGVLALKALKLSDSFMELYRGGNFTGEKLREKNFSWMDIFEEIPIKVSNSALVSAFMTELETDTPVSQGDYDRLHSSTTPFLENNMEFLIKCMDDLSMEQQKFQYYYRNLSRQQAQQQAWLQKRRTENMARKSAGEEPLPEEDPSNPIFKAIPEPSRLESFLITNQVSNFCGQINGVAGQNFSRLYLTKALHDN

SEQ ID NO: 9505 - protein, 309 aa, Arabidopsis thaliana
  misc_feature: Ceres CLONE 34480
  misc_feature: Useful for making plants with modulated biomass
  misc_feature: The plant is abnormally small.
MEMSLRLASSSTSNPICLLNPGKNLNFPIRNHRIPKTSKPFCVRSSMSLSKPPRQTLSSNWDVSSFSIDSVAQSPSRLPSFEELDTTNMLLRQRIVFLGSQVDDMTADLVISQLLLLDAEDSERDITLFINSPGGSITAGMGIYDAMKQCKADVSTVCLGLAASMGAFLLASGSKGKRYCMPNSKVMIHQPLGTAGGKATEMSIRIREMMYHKIKLNKIFSRITGKPESEIESDTDRDNFLNPWEAKEYGLIDAVIDDGKPGLIAPIGDGTPPPKTKVWDLWKVEGTKKDNTNLPSERSMTQNGYAAIE

SEQ ID NO: 9506 - protein, 421 aa, Arabidopsis thaliana
  misc_feature: HVG ID no. 347
  misc_feature: Useful for making plants with modulated flowering time
MSNIVVLDNGGGLIKAGQGGERDPTTVIPNCLYKPLSSKKFIHPSPLTTLSDEIDLTSAAVRRPIDRGYLINSDLQREIWSHLFTSLLHIAPSSSSLLLTEAPLSIPSVQRTTDELVFEDFGFSSLYIAHPQSLVHLYEASRQPDSILSKTQCSLVVDCGFSFTHAVPVLHNFTLNHAIKRIDLGGKAFTNYLKELVSYRSINVMDETFLVDDAKEKLCFVSLDLLRDLRLARNGNTLIKSTYVLPDGVTHTKGYVKDPQAAKRFLSLSEKESVVVMDKVGERKKADMNKNEIDLTNERFLVPETLFQPADLGMNQAGLAECIVRAINSCHSYLQPVLYQSIILTGGSTLFPQLKERLEGELRPLVPDHFDVKITTQEDPILGVWRGGSLLASSPDFESMCVTKAEYEELGSARCRRRFFH

SEQ ID NO: 9507 - protein, 175 aa, Arabidopsis thaliana
  misc_feature: HVG ID no. 350
  misc_feature: Useful for making plants with modulated flowering time
MSLSRRDPLVVGSVVGDVLDPFTRLVSLKVTYGHREVTNGLDLRPSQVLNKPIVEIGGDDFRNFYTLVMVDPDVPSPSNPHQREYLHWLVTDIPATTGNAFGNEVVCYESPRPPSGIHRIVLVLFRQLGRQTVYAPGWRQQFNTREFAEIYNLGLPVAASYFNCQRENGCGGRRT

SEQ ID NO: 9508 - protein, 110 aa, Arabidopsis thaliana
  misc_feature: HVG ID no. 351
  misc_feature: Useful for making plants with modulated flowering time
MSGVWVFKNGVIRLVENPNQSGSDTQNRRKVMVYLPTGEVVSSYSTLEQILQSLGWERYFGGGDTDLLQFHKRSSIDLISLPRDFTKFNSVYMYDIVVKNPNYFHVRDSH

SEQ ID NO: 9509 - protein, 46 aa, Arabidopsis thaliana
  misc_feature: Ceres CLONE 3510
  misc_feature: Useful for making plants with modulated biomass
  misc_feature: The plant is abnormally small.
MIYDVNSGLFRSFLSQKGSSSDKRKMEDKPREQKPKASDNKPVMNE

SEQ ID NO: 9510 - protein, 281 aa, Arabidopsis thaliana
  misc_feature: Ceres CLONE 35228
  misc_feature: Useful for making plants with altered alkaloid content
  misc_feature (67)..(67): Xaa is any aa, unknown, or other
MSGALNMTLDEIVKRGKTARSGGRGISRGRGRGRGGGGRGAGPARRGPLAVNARPSSFTINKPVRRXRSLPWQSGLFEDGLRAAGASGVEVGTRLHVTNLDQGVTNEDIRELFSEIGEVERYAIHYDKNGRPSGTAEVVYPRRSDAFQALKKYNNVLLDGRPMRLEILGGNNSSEAPLSGRVNVNVTGLNGRLKRTVVIQQGGGGRGGRGPAPTVSRRLPIHNQQGGGMRGGRGGFRARGRGNGGRGRGGGRGNGKKPVEKSAADLDKDLESYHADAMNTS

SEQ ID NO: 9511 - protein, 300 aa, Arabidopsis thaliana
  misc_feature: Ceres CLONE 35594
  misc_feature: Useful for making plants with altered alkaloid content
  misc_feature (135)..(135): Xaa is any aa, unknown, or other
MGAPKQKWTQEEESALKSGVIKHGPGKWRTILKDPEFSGVLYLRSNVDLKDKWRNMSVMANGWGSREKSRLAVKRTFSLPKQEENSLALTNSLQSDEENVGATSGLQVSSNPPPRRPNVRLDSLIMEAIATLKEXGGCNKTTIGAYIEDQYHAPPDFKRLLSTKLKYLTSCGKLVKVKRKYRIPNSTSLSSHRRKGLGVFGGKQRTSSLPSPKTDIDEVNFQTRSQIDTEIARMKSMNVHEAAAVAAQAVAEAEAAMAEAEEAAKEAEAAEAEAEVAQAFAEEASKTLKGRNICKMMIRA

SEQ ID NO: 9512 - protein, 1224 aa, Arabidopsis thaliana
  misc_feature: HVG ID no. 356
  misc_feature: Useful for making plants with modulated flowering time
MASLSGLYSSSPSLKPAKNHSFKALPAQSRDSFSFPHTSKPTNLPLTLSSARSVARDISHADSKKELLKDPDALWKRYLDWFYQQKELGLYLDISRVGFTDEFVAEMEPRFQAAFKAMEDLEKGSIANPDEGRMVGHYWLRNSKLAPKPTLKTLIENTLDSICAFSDDIISGKPPSSPEGRFTQILSVGIGGSALGPQFVAEALAPDNPPLKIRFIDNTDPAGIDHQIAQLGPELASTLVVVISKSGGTPETRNGLLEVQKAFREAGLNFAKQGVAITQENSLLDNTARIEGWLARFPMYDWVGGRTSIMSAVGLLPAALQGINVREMLTGAALMDEATRTTSIKNNPAALLAMCWYWASNGVGSKDMVVLPYKDSLLLFSRYLQQLVMESLGKEFDLDGNTVNQGLTVYGNKGSTDQHAYIQQLRDGVHNFFATFIEVLRDRPPGHDWELEPGVTCGDYLFGMLQGTRSALYANGRESISVTIQEVTPTSVGAIIALYERAVGLYASIVNINAYHQPGVEAGKKAAAEVLALQKRVLSVLNEATCKDPVEPLTLEEIADRCHAPEEIEMIYKIIAHMSANDRVLIAEGNCGSPRSIKVYLGECNVDDLYAMASLSGLYSSSPSLKPAKNHSFKALPAQSRDSFSFPHTSKPTNLPLTLSSARSVARDISHADSKKELLKDPDALWKRYLDWFYQQKELGLYLDISRVGFTDEFVAEMEPRFQAAFKAMEDLEKGSIANPDEGRMVGHYWLRNSKLAPKPTLKTLIENTLDSICAFSDDIISGKIKPPSSPEGRFTQILSVGIGGSALGPQFVAEALAPDNPPLKIRFIDNTDPAGIDHQIAQLGPELASTLVVVISKSGGTPETRNGLLEVQKAFREAGLNFAKQGVAITQENSLLDNTARIEGWLARFPMYDWVGGRTSIMSAVGLLPAALQGINVREMLTGAALMDEATRTTSIKNNPAALLAMCWYWASNGVGSKDMVVLPYKDSLLLFSRYLQQLVMESLGKEFDLDGNTVNQGLTVYGNKGSTDQHAYIQQLRDGVHNFFATFIEVLRDRPPGHDWELEPGVTCGDYLFGMLQGTRSALYANGRESISVTIQEVTPTSVGAIIALYERAVGLYASIVNINAYHQPGVEAGKKAAAEVLALQKRVLSVLNEATCKDPVEPLTLEEIADRCHAPEEIEMIYKIIAHMSANDRVLIAEGNCGSPRSIKVYLGECNVDDLYA

SEQ ID NO: 9513 - protein, 441 aa, Arabidopsis thaliana
  misc_feature: Ceres CLONE 35786
  misc_feature: Useful for making plants with altered terpenoid content
MDSTKLSELKVFIDQCKSDPSLLTTPSLSFFRDYLESLGAKIPTGVHEEDKDTKPRSFVVEESDDDMDETEEVKPKVEEEEEEDEIVESDVELEGDTVEPDNDPPQKMGDSSVEVTDENREAAQEAKGKAMEALSEGNFDEAIEHLTRAITLNPTSAIMYGNRASVYIKLKKPNAAIRDANAALEINPDSAKGYKSRGMARAMLGEWAEAAKDLHLASTIDYDEEISAVLKKVEPNAHKLEEHRRKYDRLRKEREDKKAERDRLRRRAEAQAAYDKAKKEEQSSSSRPSGGGFPGGMPGGFPGGMPGGFPGGMGGMPGGFPGGMGGMGGMPGGFPGGMGGGMPAGMGGGMPGMGGGMPAGMGGGGMPGAGGGMPGGGGMPGGMDFSKILNDPELMTAFSDPEVMAALQDVMKNPANLAKHQANPKVAPVIAKMMGKFAGPQ

SEQ ID NO: 9514 - protein, 208 aa, Arabidopsis thaliana
  misc_feature: Ceres CLONE 35848
  misc_feature: Useful for making plants with modulated nitrogen use efficiency
MLRTIFLLSLLFALSNASVQDFCVANLKRAETPAGYPCIRPIHVKATDFVFSGLGTPGNTTNIINAAVTPAFAAQFPGLNGLGLSTARLDLAPKGVIPMHTHPGASEVLFVLTGSITAGFVSSANAVYVQTLKPGQVMVFPQGLLHFQINAGKSSASAVVTFNSANPGLQILDFALFANSLPTELVVGTTFLDATTVKKLKGVLGGTG

SEQ ID NO: 9515 - protein, 280 aa, Arabidopsis thaliana
  misc_feature: Ceres CLONE 36094
  misc_feature: Useful for making plants with modulated biomass
  misc_feature: The plant is abnormally small.
MAFGLIGRVVGTKPSRLSTAARLIPARWTSKGSEAQSKASTGGGGASLKTFQIYRWNPDNPGKPELQDYKIDLKDCGPMVLDALIKIKNEMDPSLTFRRSCREGICGSCAMNIDGCNGLACLTKIESGSKETTITPLPHMFVIKDLVVDMTNFYNQYKSIEPWLKRKNPASVPGKEILQSKKDRAKLDGMYECILCACCSTSCPSYWWNPESYLGPAALLHANRWISDSRDEYTKERLEAIDDEFKLYRCHTILNCARACPKGLNPGKQITHIKQLQKSG

SEQ ID NO: 9516 - protein, 171 aa, Zea mays
  misc_feature: Ceres CLONE 362309
  misc_feature: Useful for making plants with altered terpenoid content
  misc_feature (81)..(81): Xaa is any aa, unknown, or other
MEPVRRSGRLANLPDKPVYREKVPDFGMKIRRTYGSVRRDLTNRVYATDDARSYAISKAEDLEQELDSSFPIFIKPMTQSXVTGGFWLGLPIHFCRKYLPKRDEMITLVDEDDDESDTLYLAMKRGLSAGWRGFAVQQKLVDGDCLVFQLIEQTKFKVYITRASSYYESED

SEQ ID NO: 9517 - protein, 462 aa, Zea mays
  misc_feature: Ceres CLONE 362438
  misc_feature: Useful for making plants with altered Lignin content
MFGRAPKKSDNTKYYEILGMPKSASQDDLKKTYRKAAIKNHPDKGGDPEKLLHMHFHHIICDRHEIPRHEIKKALAKALTTDQLFYLREQFTLFGPNKSGHISLQNMKTMLCEDRGIFLEIADFIKGLGLTILRGVMEERSSGRSRGFGYVTFASADDAKNVLDCEHVLGSRTLEVKIATPKEEMKSQGTKKATRIFVARIPQSVDESMFRRHFEAFGEILDLYMPKEHGSKGHRGIGFITFQSAESVDSIMQESHELDGTTVVVDRATPKEEDVRYPPSRPSQGGYGAYNAYISAATRYATLGAPTLYDHPGSAYGRGYYGSSQAVGKKIFVGRLPQEANTDDLRHYFGRFGRIVDAYIPKDPKRSGHRGFGFVTFADEGVAERVSRRSHEILGHEVAIDTAAPLENDSAGGGYIDPMDLYGAYGSMRSFGRFCGGLDYNYGYGPSSGSSRSRSDWRYRPY

SEQ ID NO: 9518 - protein, 254 aa, Zea mays
  misc_feature: Ceres CLONE 362735
  misc_feature: Useful for making plants with modulated nitrogen use efficiency
  misc_feature: Useful for making plants with modulated nitrogen use efficiency
MSGEAAAVGGGEGEANGIPPNVTIYINNLNEKIKLEELKKSLTAVFSQFGKILDVLAFKTLKHKGQAWVVFEDVASATEALKRMQGFPFYDKTMRIQYAKTKSDIIAKADGTFVPRERRKRTDEKSEKKQKREHHHDAGASQIGMGVTAYPGVYGAPQLTQIPIAGGQRVMMPEIIVPNNILFVQNLPHETTPMMLQMLFCQYPGFKEVRMIEAKPGIAFVEYGDETQVTAAMNNLQSFKITKENQMVITYAKK

SEQ ID NO: 9519 - protein, 254 aa, Zea mays subsp. mays; identical to SEQ ID NO: 9518
  misc_feature: Ceres CLONE 362735
  misc_feature: Useful for making plants with modulated nitrogen use efficiency
  misc_feature: Useful for making plants with modulated nitrogen use efficiency

SEQ ID NO: 9520 - protein, 115 aa, Arabidopsis thaliana
  misc_feature: Ceres CLONE 3630
  misc_feature: Useful for making plants with modulated nitrogen use efficiency
MWCACYHQPLPASSVVLNQQAKQEESLRRKQVFFFLSSSSPSSLSTKHQWQISNYPKNGFRLKPKASVLPPSESGDITTFLFVSGAMISMYLVTNFLVPSLLFKSLQGEEEEDSD

SEQ ID NO: 9521 - protein, 368 aa, Arabidopsis thaliana
  misc_feature: Ceres CLONE 36518
  misc_feature: Useful for making plants with modulated biomass
  misc_feature: The plant is abnormally small.
  misc_feature (294)..(294): Xaa is any aa, unknown, or other
MQSLMPALSKTLIAKLLVRHAPRPTWSWFSVRSPPRLRLTTRRLSVTLAVPLDSSLTMLVLMHKCKVLVNIEQQSPDIAQGVHGHFTKRPEDIGAGDQGHMFGYATDETPELMPLSHVLATKIGARLTEVRKNGTCRWLRPDGKTQVTVEYYNDNGAMVPVRVHTVLISTQHDETVTNDEIARDLKEHVIKPIIPEKYLDDKTIFHLNPSGRFVIGGPHGDAGLTGRKIIIDTYGGWGAHGGGAFSGKDPTKVDRSGAYIVRQAAKSVVANGMARRALVQVSYAIGVPEPLSVXVDTYGTGLIPDKEILKIVKETFDFRPGMMTINLDLKRGGNGRFQKTAAYGHFGRDDPDFTWEVVKPLKWDKPQA

SEQ ID NO: 9522 - protein, 54 aa, Arabidopsis thaliana
  misc_feature: Ceres CLONE 36537
  misc_feature: Useful for making plants with modulated nitrogen use efficiency
MSSNCGSCDCADKTQCVKKGTSYTFDIVETQESYKEAMIMDVGAEENNANCKCK

SEQ ID NO: 9523 - protein, 362 aa, Arabidopsis thaliana
  misc_feature: Ceres CLONE 36632
  misc_feature: Useful for making plants with modulated phosphate use efficiency
MARMSLMIMMIMVAVTMINIAKSDPIAPCYFIFGDSLVDNGNNNQLQSLARANYFPYGIDFAAGPTGRFSNGLTTVDVIAQLLGFEDYITPYASARGQDILRGVNYASAAAGIRDETGRQLRGRIAFAGQVANHVNTVSQVVNILGDQNEASNYLSKCIYSIGLGSNDYLNNYFMPTFYSTGNQFSPESYADDLVARYTEQLRVLYTNGARKFALIGVGAIGCSPNELAQNSRDGRTCDERINSANRIFNSKLISIVDAFNQNTPDAKFTYINAYGIFQDIITNPARYGFRVTNAGCCGVGRNNGQITCLPGQAPCLNRNEYVFWDAFHPGEAANIVIGRRSFKREAASDAHPYDIQQLASL

SEQ ID NO: 9524 - protein, 146 aa, Arabidopsis thaliana
  misc_feature: Ceres CLONE 36764
  misc_feature: Useful for making plants with modulated cold sensitivity
MAALARIGGRHLKSVCLINSSASCFFTQRRGVASKLFIGGLSFCTTEQGLSEAFSKCGQVVEAQIVMDRVSDRSKGFGFVTFASADEAQKALMEFNGQQLNGRTIFVDYAKAKQSLGGGGGYPIARGPPDPAVIAATRTTETSKSD

SEQ ID NO: 9525 - protein, 421 aa, Arabidopsis thaliana
  misc_feature: Ceres CLONE 36904
  misc_feature: Useful for making plants with modulated biomass
  misc_feature: The plant is abnormally small.
MRGLVNKLVSRSLSISGKWQNQQLRRLNIHEYQGAELMGKYGVNVPKGVAASSLEEVKKAIQDVFPNESELVVKSQILAGGRGLGTFKSGLKGGVHIVKRDEAEEIAGKMLGQVLVTKQTGPQGKVVSKVYLCEKLSLVNEMYFSIILDRKSAGPLIIACKKGGTSIEDLAEKFPDMIIKVPIDVFAGITDEDAAKVVDGLAPKAADRKDSIEQVKKLYELFRKTDCTMLEINPLAETSTNQLVAADAKLNFDDNAAFRQKEVFAMRDPTQEDPREVAAAKVDLNYIGLDGEIGCMVNGAGLAMATMDIIKLHGGTPANFLDVGGNASEHQVVEAFKILTSDDKVKAILVNIFGGIMKCDVIASGIVNAAKEVALKVPVVVSLEGTNVEQGKRILKESGMKLITADDLDDAAEKAVKALAH

SEQ ID NO: 9526 - protein, 375 aa, Arabidopsis thaliana
  misc_feature: Ceres CLONE 37151
  misc_feature: Useful for making plants with modulated nitrogen use efficiency
MAAAMASHVSTARSPALSFSSSSSSFFPGTTLRRFSAVSLPSPALPRLRVSCQASSVTSPSSPSDVKGKSDLKDFLAIDDFDTATIKTILDKASEVKALLKSGERNYLPFKGKSMSMIFAKPSMRTRVSFETGFFLLGGHALYLGPNDIQMGKREETRDVARVLSRYNDIIMARVFAHQDILDLANYSSVPVVNGLTDHNHPCQIMADALTMIEHIGQVEGTKVVYVGDGNNMVHSWLELASVIPFHFVCACPKGYEPDKERVSKAKQAGLSKIEITNDPKEAVIGADVVYSDVWASMGQKDEAEARRKAFQGFQVDEALMKLAGQKAYFMHCLPAERGVEVTNGVVEAPYSIVFPQAENRMHAQNAIMLHLLGF

SEQ ID NO: 9527 - protein, 277 aa, Arabidopsis thaliana
  misc_feature: Ceres CLONE 37298
  misc_feature: Useful for making plants with modulated biomass
  misc_feature: The rosette leaves do not appear in the normal fashion, i.e., their phyllotaxy may be abnormal or too many leaves may be emerging in comparison to the control.
MGSQQAAVSFLSNLAKAAFGLGTAATVLNTSLFTVDGGERAVIFDRFRGVMDQTVGEGTHFLIPILQRPHIFDIRTKPHTFSSISGTKDLQMVNLTLRVLSRPEVSRLPYIFQTLGLEYDEKVLPSIGNEVLKAVVAQFNADQLLTERPHVSALVRESLITRAKDFNIVLDDVAITHLSYGVEFSRAVEQKQVAQQEAERSKFVVMKADQERRAAVIRAEGESEAAQLISDATAKAGMGLIELRRIEASREIASTLARSPNVAYLPGGQSMLFALNR

SEQ ID NO: 9528 - protein, 455 aa, Arabidopsis thaliana
  misc_feature: Ceres CLONE 37425
  misc_feature: Useful for making plants with modulated flowering time
  misc_feature: The plant flowers significantly late compared to wild-type.
  misc_feature (126)..(126): Xaa is any aa, unknown, or other
  misc_feature (248)..(248): Xaa is any aa, unknown, or other
  misc_feature (271)..(271): Xaa is any aa, unknown, or other
MAAAAMAVHLPKHSSFLPKPKLPLDKKTNFLGGSFNLGRPMSVNREFNSPVMVSASSTSKTVLTDDVDGDQSKRFYINFTGFPFPLGPFLNRRTIRTEAVKGCIWMFEQEQALGFSSVSTNIRMTXIKLKSGGLWVHAPIAPTKECVQLIKELGAPVEYIVLPTFAYEHKIFVGPFSRKFPKAQVWVAPRQWSWPLNLPLEFFGIFRAKIIKDRDLSTPWAEEIEQKVLSSPEVGIGPYVEVAFYHKXSRTLLVTDAVIFVPRKPPSSISXESLLASAKNGLAVKILSKGKDIPNDPVVDNPNTRQKGWERMVLQILFLGPSNLLEPNASFARMSQKLIVSPIVKTLVFSKVPEKVRDWIDEIARDWRFKRIIPAHFEAPINAGRSDFLAAFGFLEDLLGERYVTRPSLSLLFTSLMGKAASYFPPDDMRTLSSLDQFLVSVGAVKKTVSGRKRR

SEQ ID NO: 9529 - protein, 427 aa, Zea mays
  misc_feature: Ceres CLONE 374674
  misc_feature: Useful for making plants with altered terpenoid content
MDIEADGRFGNKRVHNRLGPGSGGAPPSTNGKVCNYWRAGRCNRFPCPFLHSELPEAAPPKRPTGPGGNVWRNPNTGGRGGGHHNRWGKGPGGGSGIASHKPPERPCKYFLAGTECSYGERCRYPHSYCISDSIAMLTLLKGHEQGVTGIALPAGSDKLYSGSKDGTVRMWDCQTGQCAGVITMGREVGCMIIEGPWLFVGIPDAVKVWNMQTAAEMSLTGPTGQVYALAVASELLFAATQAGRILAWRFSAATNCFEPAASLDGHKLAVVSLIVGGMRLYSASMDKTIRVWDLATLQCIQTLSDHTDVVMSVLCWDQFLLSCSLDQTIKVWAATESGNLEVTYTHKEDQGALALSGMPDAQSKPVLLCSLNDNTVRLYDLPSFSDRGRLFSKKEIRAIQMGPGGLFFTGDGTGELKVWQWVDLAQT

SEQ ID NO: 9530 - protein, 321 aa, Arabidopsis thaliana
  misc_feature: Ceres CLONE 37597
  misc_feature: Useful for making plants with modulated nitrogen use efficiency
MAASKRLVVSCLFLVLLFAQANSQGLKVGFYSKTCPQLEGIVKKVVFDAMNKAPTLGAPLLRMFFHDCFVRGCDGSVLLDKPNNQGEKSAVPNLSLRGFGIIDDSKAALEKVCPGIVSCSDILALVARDAMVALEGPSWEVETGRRDGRVSNINEVNLPSPFDNITKLISDFRSKGLNEKDLVILSGGHTIGMGHCPLLTNRLYNFTGKGDSDPSLDSEYAAKLRKKCKPTDTTTALEMDPGSFKTFDLSYFTLVAKRRGLFQSDAALLDNSKTRAYVLQQIRTHGSMFFNDFGVSMVKMGRTGVLTGKAGEIRKTCRSAN

SEQ ID NO: 9531 - protein, 315 aa, Arabidopsis thaliana
  misc_feature: Ceres CLONE 37792
  misc_feature: Useful for making plants with altered terpenoid content
MDLPPGFRFHPTDEELITHYLHKKVLDLGFSAKAIGEVDLNKAEPWELPYKAKIGEKEWYFFCVRDRKYPTGLRTNRATQAGYWKATGKDKEIFRGKSLVGMKKTLVFYRGRAPKGQKTNWVMHEYRLDGKLSAHNLPKTAKNEWVICRVFHKTAGGKKIPISTLIRIGSYGTGSSLPPLTDSSPYNDKTKTEPVYVPCFSNQAETRGTILNCFSNPSLSSIQPDFLQMIPLYQPQSLNISESSNPVLTQEQSVLQAMMENNRRQNFKTLSISQETGVSNTDNSSVFEFGRKRFDHQEVPSPSSGPVDLEPFWNY

SEQ ID NO: 9532 - protein, 374 aa, Arabidopsis thaliana
  misc_feature: Ceres CLONE 37980
  misc_feature: Useful for making plants with altered Lignin content
MQKVFLAMDTCALVIHQSLSRIKLSPPKSSSSSSSSAFSPESLPIRRIELCFRGAICAAVQRNYEETTSSVEEAEEDDESSSSYGEVNKIIGSRTAGEGAMEYLIEWKDGHSPSWVPSSYIAADVVSEYETPWWTAARKADEQALSQLLEDRDVDAVDESGRTALLFVAGLGSDKCVRLLAEAGADLDHRDMRGGLTALHMAAGYVRPEVVEALVELGADIEVEDERGLTALELAREILKTTPKGNPMQFGRRIGLEKVINVLEGQVFEYAEVDEIVEKRGKGKDVEYLVRWKDGGDCEWVKGVHVAEDVAKDYEDGLEYAVAESVIGKRVGDDGKTIEYLVKWTDMSDATWEPQDNVDSTLVLLYQQQQPINE

SEQ ID NO: 9533 - protein, 527 aa, Oryza sativa
  misc_feature: HVG ID no. 381
  misc_feature: Useful for making plants with modulated phosphate use efficiency
MAGGQLNVLSTLDQAKTQWYHFMAIVIAGMGFFTDAYDLFCISLVTKLLGRIYYTDDSKDTPGALPPNVSAAVTGVALCGTLAGQLFFGWLGDKLGRKSVYGFTLILMVVCSVASGLSFGSSAKGVVSTLCFFRFWLGFGIGGDYPLSATIMSEYANKRTRGAFIAAVFAMQGFGILFGAIVALAVSAGFRHAYPAPSYSDNHAASLVPQADYVWRIILMFGTVPAALTYYWRMKMPETARYTALIARNAKQAAADMSKVLHTQIEESADRAETVAVGGESWGLFSRQFLRRHGLHLLATTSTWFLLDIAFYSQNLFQKDIFSKVGWIPPAKTMNALEELYRIARAQALIALCGTIPGYWFTVAFIEIMGRFWIQIMGFAMMTAFMLGLAIPYHHWTTPGHHTGFIVMYGFTFFFANFGPNSTTFIVPAEIYPARLRSTCHGISAAAGKAGAIIGAFGFLYAAQDQHKPEPGYPRGIGIKNALFVLAGTNFLGTIMTLLVPESKGMSLEVISQEVADGDDEEAAYPK

SEQ ID NO: 9534 - protein, 377 aa, Arabidopsis thaliana
  misc_feature: Ceres CLONE 38101
  misc_feature: Useful for making plants with modulated biomass
  misc_feature: Useful for making plants with modulated flowering time
  misc_feature: The plant flowers significantly late compared to wild-type.
  misc_feature: The plant is abnormally small.
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTSAEREIVRDVKEKLAYIALDYEQEMETANTSSSVEKSYELPDGQVITIGGERFRCPEVLFQPSLVGMEAAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 9535 - protein, 304 aa, Arabidopsis thaliana
  misc_feature: Ceres CLONE 38105
  misc_feature: Useful for making plants with modulated biomass
  misc_feature: The plant is abnormally small.
MAIISEVEEESSSSRPMIFPFRATLSSANPLGFLEKVFDFLGEQSDFLKKPSAEDEIVVAVRAAKEKLKKAEKKKAEKESVKPVEKKAEKEIVKLVEKKVEKESVKPTMAASSAEPIEVEKPKDEEEKKESGPIVPNKGNGTDLENYSWIQNLQEVTVNIPVPTGTKARTVVCEIKKNRLKVGLKGQDPIVDGELYRSVKPDDCYWNIEDQKVISILLTKSDQMEWWKCCVKGEPEIDTQKVEPETSKLGDLDPETRSTVEKMMFDQRQKQMGLPTSEELQKQEILKKFMSEHPEMDFSNAKFN

SEQ ID NO: 9536 - protein, 377 aa, Arabidopsis thaliana
  misc_feature: Ceres CLONE 3819
  misc_feature: Useful for making plants with modulated biomass
  misc_feature: The plant is abnormally small.
MAEADDIQPIVCDNGTGMVKAGFAGDDAPRAVFPSVVGRPRHHGVMVGMNQKDAYVGDEAQSKRGILTLKYPIEHGVVSNWDDMEKIWHHTFYNELRIAPEEHPVLLTEAPLNPKANREKMTQIMFETFNSPAMYVAIQAVLSLYASGRTTGIVLDSGDGVSHTVPIYEGFSLPHAILRLDLAGRDLTDYLMKILTERGYMFTTTAEREIVRDIKEKLSFVAVDYEQEMETSKTSSSIEKNYELPDGQVITIGAERFRCPEVLFQPSFVGMEAAGIHETTYNSIMKCDVDIRKDLYGNIVLSGGTTMFSGIADRMSKEITALAPSSMKIKVVAPPERKYSVWIGGSILASLSTFQQMWISKAEYDEAGPGIVHRKCF

SEQ ID NO: 9537 - protein, 528 aa, Oryza sativa
  misc_feature: HVG ID no. 382
  misc_feature: Useful for making plants with modulated phosphate use efficiency
MAGSQLNVLVKLDQAKTQWYHFMAIVIAGMGFFTDAYDLFCIALVTKLLGRLYYTDITKPNPGTLPPNVSSAVTGVALCGTLAGQLFFGWLGDKLGRKSVYGFTLILMVVCSIASGLSFGHTPKSVIATLCFFRFWLGFGIGGDYPLSATIMSEYASKKTRGAFIAAVFAMQGFGILFGAIVALVVSAGFRHAYPAPSYAQNPAASLAPQADYTWRLILMFGTIPAGLTYYWRMKMPETARYTALVARNAKQAAADMSKVLHAEIEERPEVVESQVVAGETWGLFSRQFMKRHGMHLLATTSTWFLLDIAFYSQNLFQKDIFSKVGWIPPAKTMNALEELYRISRAQALIALCGTIPGYWFTVAFIDIVGRFWIQIMGFFMMTVFMLALGVPYDHWTHPAHHTGFVVLYALTFFFANFGPNSTTFIVPAEIFPARLRSTCHGISAASGKAGAIIGAFGFLYAAQDQHNPDAGYSRGIGIRNALFVLAGTNFLGMLMTLLVPESKGLSLEEMSKDNVVDETAQEAIAQA

SEQ ID NO: 9538 - protein, 526 aa, Oryza sativa
  misc_feature: HVG ID no. 383
  misc_feature: Useful for making plants with modulated phosphate use efficiency
  misc_feature (129)..(129): Xaa is any aa, unknown, or other
  misc_feature (262)..(262): Xaa is any aa, unknown, or other
  misc_feature (269)..(269): Xaa is any aa, unknown, or other
  misc_feature (492)..(492): Xaa is any aa, unknown, or other
MADGQLKVLTTLDHARTQWYHFMAIVIAGMGFFTDAYDLFCISLVSKLLGRIYYTDLAGDNPGSLPPNVSAAVNGVALCGTLAGQLFFGWLGDKLGRKSVYGFTLVLMVVCSVASGLSFGRTAKGVVAXLCFFRFWLGFGIGGDYPLSATIMSEYANKRTRGAFIAAVFAMQGFGILFGAIVALVVSAGFRNAYPAPSYADGRAASLVPEADYVWRIILMFGTVPAALTYYWRMKMPETARYTALIARNAKQAAADMSKVLXTEIQEDXERAEAVAAGGAGNEWGLFSRQFVRRHGVHLVATTSTWFLLDIAFYSQNLFQKDIFSKVGWIPPARTMNAVEEVFRIARAQALIALCGTIPGYWFTVAFIDVAGRFAIQLMGFAMMTVFMLGLAAPYHHWTTPGNHTGFVVMYGFTFFFANFGPNATTFIVPAEIYPARLRSTCHGISAAAGKAGAIVGAFGFLYAAQDPHKPEAGYKPGIGIRNALFVLAGTXFLGMLMTLLVPESKGMSLEEVSKENVADDEEATA

SEQ ID NO: 9539 - protein, 538 aa, Oryza sativa
  misc_feature: HVG ID no. 384
  misc_feature: Useful for making plants with modulated phosphate use efficiency
MAGELKVLNALDSAKTQWYHFTAIVIAGMGFFTDAYDLFSISLVTKLLGRIYYFNPASKSPGSLPPNVSAAVNGVAFCGTLAGQLFFGWLGDKMGRKKVYGMTLMLMVICCLASGLSFGSSAKGVMATLCFFRFWLGFGIGGDYPLSATIMSEYANKRTRGAFIAAVFAMQGFGNLTGGIVAIIVSAAFKSRFDAPAYRDDRTGSTVPQADYAWRIVLMFGAIPALLTYYWRMKMPETARYTALVAKNAKQAAADMTQVLNVEIVEEQEKADEVARREQFGLFSRQFLRRHGRHLLGTTVCWFVLDIAFYSSNLFQKDIYTAVQWLPKADTMSALEEMFKISRAQTLVALCGTIPGYWFTVFFIDIIGRFVIQLGGFFFMTAFMLGLAVPYHHWTTPGNHIGFVVMYAFTFFFANFGPNSTTFIVPAEIFPARLRSTCHGISAAAGKAGAIVGSFGFLYAAQSTDASKTDAGYPPGIGVRNSLFFLAGCNVIGFFFTFLVPESKGKSLEELSGENEDDDDVPEAPATADHRTAPAPPA

SEQ ID NO: 9540 - protein, 441 aa, Arabidopsis thaliana
  misc_feature: Ceres CLONE 38419
  misc_feature: Useful for making plants with modulated biomass
  misc_feature: Useful for making plants with modulated flowering time
  misc_feature: The plant flowers significantly late compared to wild-type.
  misc_feature: The rosette leaves do not appear in the normal fashion, i.e., their phyllotaxy may be abnormal or too many leaves may be emerging in comparison to the control.
MYGGDEVSAIVVDLGSHTCKAGYAGEDAPKAVFPSVIGAVDGVEAMDVDVDSTKTNSNSEDSKTESEKEKGKRKLYVGSQAMSYRRDHMEVLSPIKDGIVSDWDLVDNIWEHAFKSCLMIDPTEHPMLLAEPPLNTQQQREKAAELMFEKYKVPALFMAKNPVLTSFATGRATSLVVDCGGGSTTISPVHDGYVLQKAVVSSPLGGEFLTDCLLKSLESKGIKIRPRYSFKRKEVRAGEFQVEDVDIPDTTESYKLFCQRMIVGDIKDSICRVPDTPYDDKSYSNIPTTSYELPDGQTLEIGADRFKVPDVMFNPSIVQTIPGMEKYADMIPSVRGLPHMVMESINKCDVDIRRELYSSILLAGGTSSMQQLKERLEKDLIEESPHSARVKVLASGNTTERRFSVWIGGSILASLGSFQQMWFSKSEYEEHGASYIQRKCP

SEQ ID NO: 9541 - protein, 102 aa, Arabidopsis thaliana
  misc_feature: Ceres CLONE 38470
  misc_feature: Useful for making plants with modulated biomass
  misc_feature: The plant is abnormally small.
MKIVTLVLVVFVILSTSFPAAIKAEDTGDTGNVGVTCDARQLQPCLAAITGGGQPSGACCAKLTEQQSCLCGFAKNPAFAQYISSPNARKVLLACNVAYPTC

SEQ ID NO: 9542 - protein, 549 aa, Arabidopsis thaliana
  misc_feature: Ceres CLONE 38529
  misc_feature: Useful for making plants with altered alkaloid content
MGRGSVTSLAPGFRFHPTDEELVRYYLKRKICNKPFKFDAISVTDVYKSEPWDLPDKSRLKSRDLEWYFFSMLNKKYRNGSKTNRATEMGYWKTTGKDREILNGSKVVGMKKTLVYHKGRAPRGERTNWVMHEYRLVDQDLDKTGVHQDAFVLCRIFQKSGSGPKNGEQYGAPFVEEEWEEEDDMTFVPDQEDLGSEDHVYVHMDDIDQKSENFVVYDAIPIPLNFIHGESSNNVETNYSDSINYIQQTGNYMDSGGYFEQPAESYEKDQKPIIRHRDGSLQNEGIGCGVQDKHSEILQSSDNIFGTDTSCYNDFPVESNYLIGEAFLDPNSNLLENDGLYLETNDLSSTQQDGFDFEDYLTFFDETFDPSQLMGNEDVFFDQEELFQEVETKELEKEETSRSKHVVEEKEKDEASCSKQVDADATEFEPDYKYPLLKKASHMLGAIPAPLANASEFPTKDAAIRLHAAQSSGSVHVTAGMITISDSNMGWSYGKNENLDLILSLGLVQGNTAPEKSGNSSAWAMLIFMCFWVLLLSVSFKVSILVSSR

SEQ ID NO: 9543 - protein, 285 aa, Arabidopsis thaliana
  misc_feature: Ceres CLONE 3853
  misc_feature: Useful for biocontainment applications
  misc_feature: The plant produces a reduced number of seeds.
METLLSPRALSPPLNPKPLSLHQTKPTSHSLSLSKPTTFSGPKHLSTRFTKPESRNWLIDAKQGLAALALSLTLTFSPVGTALASEFNILNDGPPKETYVVDDAGVLSRVTKSDLKKLLSDLEYRKKLRLNFITVRKLTSKADAFEYADQVLEKWYPSIEEGNNKGIVVLITSQKEGAITGGPAFIEAVGENILDATVSENLPVLATDEKYNEAVYSSAKRLVAAIDGQPDPGGPTVKDSKRESNFKTKEETDEKRGQFSLVVGGLLVIAFVVPMAQYFAYVSRK

SEQ ID NO: 9544 - protein, 376 aa, Arabidopsis thaliana
  misc_feature: Ceres CLONE 38584
  misc_feature: Useful for making plants with modulated nitrogen use efficiency
MATLFTVARPSSLLYVSSINPSKTFSPSISLKLNSLSFSFGYRPKPLRFSKIRSSLPSESESESDLDASAVTDEWGEKPGDANEPDSQPDNVTVNVITDEWGEKSGPELEESGTRFMESDPPRNEDEWGGEIGGETEADAGNGSAVSDPTWELKRCLADSVYGTELGFKAGSEVRAEVLELVNQLEALNPTPAPLENPELLDGNWVLLYTAFSELIPLLAAGSTPLLKVKSISQSIDTNNLIIDNSTTLSSPFADFSFSATASFEVRSPSRIEVSFKEGTLKPPVIKSSVDLPESVGVFGQQISLSLLKQSLNPLQDVAANISRALSGQPPLKLPFPGNRGSSWLLTTYLDKDLRISRGDGGLFVLAREGSSLLEL

SEQ ID NO: 9545 - protein, 541 aa, Oryza sativa
  misc_feature: HVG ID no. 388
  misc_feature: Useful for making plants with modulated phosphate use efficiency
MARQEQQQHLQVLSALDAAKTQWYHFTAIVVAGMGFFTDAYDLFCISLVTKLLGRIYYTDLAKENPGSLPPNVAAAVNGVAFCGTLAGQLFFGWLGDKLGRKSVYGMTLLMMVICSIASGLSFSHTPTSVMATLCFFRFWLGFGIGGDYPLSATIMSEYANKKTRGAFIAAVFAMQGFGILAGGIVTLIISSAFRAGFPAPAYQDDRAGSTVRQADYVWRIILMLGAMPALLTYYWRMKMPETARYTALVAKNAKQAAADMSKVLQVEIQEEQDKLEQMVTRNSSSFGLFSRQFARRHGLHLVGTATTWFLLDIAFYSQNLFQKDIFTSINWIPKAKTMSALEEVFRIARAQTLIALCGTVPGYWFTVFLIDIVGRFAIQLLGFFMMTVFMLGLAVPYHHWTTKGNHIGFVVMYAFTFFFANFGPNSTTFIVPAEIFPARLRSTCHGISAAAGKAGAIIGSFGFLYAAQDPHKPDAGYKPGIGVRNSLFVLAGCNLLGFICTFLVPESKGKSLEEMSGEAEDDDDEVAAAGGGAAVRPQTA

SEQ ID NO: 9546 - protein, 177 aa, Arabidopsis thaliana
  misc_feature: Ceres CLONE 38915
  misc_feature: Useful for making plants with altered Lignin content
  misc_feature: Useful for making plants with altered cell wall content and/or composition
MLQGFLFLLSVVLLFSSSAAACDRCLHSSKAAYFSSASALSSGACAYGSMATGFFAGHIAAALPSIYKDGSGCGACFQVRCKNPTLCSSKGTTVIVTDLNKTNQTDLVLSSRAFRAMAKPVVGADRDLLKQGIVDIEYRRVPCDYGNKKMNVRVEESSKNPNYLAIKLLYQGGQTEV

SEQ ID NO: 9547 - protein, 312 aa, Arabidopsis thaliana
  misc_feature: Ceres CLONE 38950
  misc_feature: Useful for making plants with altered terpenoid content
MSDAFCSDCKRHTEVVFDHSAGDTVCSECGLVLESHSIDETSEWRTFANESGDNDPVRVGGPTNPLLADGGLTTVISKPNGSSGDFLSSSLGRWQNRGSNPDRGLIVAFKTIATMADRLGLVATIKDRANEIYKRVEDQKSSRGRNQDALLAACLYIACRQEDKPRTVKEICSVANGATKKEIGRAKEYIVKQLGLETGQLVEMGTIHAGDFMRRFCSNLGMTNQTVKAAQESVQKSEEFDIRRSPISIAAAVIYIITQLSDEKKPLRDISVATGVAEGTIRNSYKDLYPHLSKIIPAWYAKEEDLKNLQSP

SEQ ID NO: 9548 - protein, 149 aa, Arabidopsis thaliana
  misc_feature: Ceres CLONE 3900
  misc_feature: Useful for making plants with altered Lignin content
  misc_feature: Useful for making plants with modulated nitrogen use efficiency
MEFSGDAGMMMENKRNVCSLGESSIKRHKSDLSFNSKERKDKVGERISALQQIVSPYGKTDTASVLLDAMHYIEFLHEQVKVLSAPYLQTIPDATQEELEQYSLRNRGLCLVPMENTVGVAQSNGADIWAPVKTPLSPAFSVTSQSPFR

SEQ ID NO: 9549 - protein, 283 aa, Arabidopsis thaliana
  misc_feature: Ceres CLONE 39107
  misc_feature: Useful for making plants with modulated nitrogen use efficiency
MAEASDLLEWPKKDNRRFLHVVYRVGDLDRTIEFYTEVFGMKLLRKRDIPEEKYSNAFLGFGPETSNFVVELTYNYGVSSYDIGTGFGHFAISTQDVSKLVENVRAKGGNVTREPGPVKGGGSVIAFVKDPDGYTFELIQRGPTPEPFCQVMLRVGDLDRAIKFYEKALGMRLLRKIERPEYKYTIGMMGYAEEYESIVLELTYNYDVTEYTKGNAYAQIAIGTDDVYKSGEVIKIVNQELGGKITREAGPLPGLGTKIVSFLDPDGWKTVLVDNKDFLKELE

SEQ ID NO: 9550 - protein, 152 aa, Arabidopsis thaliana
  misc_feature: Ceres CLONE 39127
  misc_feature: Useful for biocontainment applications
  misc_feature: The plant produces a reduced number of seeds.
MGALDSLSEYISDYFRVTRKRRKRKVMQTVNIKVKMDCDGCERRVKNAVSSMKGVKSVEVNRKIHKVTVSGYVEPKKVLKRIERTGKKAEIWPYVPYNMVAYPYAVGTYDKKAPAGYVRKSEQSQLQLLPGAPENHYISLFSDENPNACTVM

SEQ ID NO: 9551 - protein, 541 aa, Oryza sativa
  misc_feature: HVG ID no. 392
  misc_feature: Useful for making plants with modulated phosphate use efficiency
  misc_feature (63)..(63): Xaa is any aa, unknown, or other
MGRQDQQLQVLNALDAAKTQWYHFTAIIVAGMGFFTDAYDLFCISLVTKLLGRIYYTDPASPXPGSLPPNIAAAVNGVALCGTLSGQLFFGWLGDKLGRKSVYGMTLLLMVICSIASGLSFSHTPTSVMATLCFFRFWLGFGIGGDYPLSATIMSEYANKKTRGAFIAAVFAMQGFGILAGGVVTLAMSAGFQAAFPAPAYEVNAAASTVPQADYVWRIILMLGALPAILTYYWRMKMPETARYTALVAKDAKQASSDMAKVLQVEIEVEEEKLQDITRGRDYGLFSARFAKRHGAHLLGTAATWFLVDVAYYSQNLFQKDIFTSIHWIPKARTMSELEEVFRISRAQTLIALCGTVPGYWFTVFLIDIIGRFKIQLLGFAGMTAFMLGLAIPYHHWTMPGNQVIFVFLYGFTFFFANFGPNATTFIVPAEIFPARLRSTCHGISAASGKAGAIIGAFGFLYAAQPQDKAHVDAGYKPGIGVRNALFVLAGCNLVGFLMTWMLVPESKGKSLEEMSGEADDEEASANGGATAVNSSGVEMV

SEQ ID NO: 9552 - protein, 294 aa, Arabidopsis thaliana
  misc_feature: Ceres CLONE 39231
  misc_feature: Useful for making plants with altered alkaloid content
MTIDSQQKTSKFRWGEMDEDDDFDFLLPPKQVIGPDENGLKTTIEYKFNDEGNKVKITTRTRVRKLASARLNKRAMERRNWPKFGDAANEEAGSHLTMVSTEEILLERPRAPGTKADESKATGDGLSQLGKGGAVLMVCRICHKKGDHWTSKCPYKDLAAPTDVFIDKPPTGESSTMSAAPGTGKAAYVPPSMRAGADRSAVGSDMRRRNDENSVRVTNLSEDTREPDLMELFHPFGAVTRVYVAIDQKTGVSRGFGFVNFVSREDAQRAINKLNGYGYDNLILRVEWATPRPT

SEQ ID NO: 9553 - protein, 214 aa, Arabidopsis thaliana
  misc_feature: Ceres CLONE 39279
  misc_feature: Useful for making plants with altered terpenoid content
MSDDDERGEEYLFKIVIIGDSAVGKSNLLTRYACNEFNPNSKATIGVEFQTQSMLIDGKEVKAQIWDTAGQERFRAVTSAYYRGAVGALVVYDITRSSTFENVGRWLDELNTHSDTTVAKMLIGNKCDLESIRAVSVEEGKSLAESEGLFFMETSALDSTNVKTAFEMVIREIYSNISRKQLNSDSYKEELTLNRVSLVKNENEGTKTFSCCSR

SEQ ID NO: 9554 - protein, 202 aa, Arabidopsis thaliana
  misc_feature: Ceres CLONE 39286
  misc_feature: Useful for biocontainment applications
  misc_feature: The plant produces a reduced number of seeds.
MACKTILRSVFVSESRRTSGARRCFFLPPSPASVPVHGLFPAPKSLCFNGFASVPERATRLNCSHNDQSDQGPPQEAVLKAISEVSKTDGRVGKTTNMIIGGTVADDSAKDWLELDQKVNTYPTERGFTAIGTGGNDFVHAMVVAVESVIDRQIPEDCVKQTLSSKGKYVSVNIGPIQVVSSEQVQAVYNAMRRDERMKYFL

SEQ ID NO: 9555 - protein, 113 aa, Arabidopsis thaliana
  misc_feature: Ceres CLONE 39319
  misc_feature: Useful for making plants with modulated biomass
  misc_feature: Useful for making plants with modulated flowering time
  misc_feature: The plant flowers significantly earllier than wild-type.
  misc_feature: The plant is abnormally small.
MSELDSQVPTAFDPFADANVEDSGAGTKEYVHIRVQQRNGRKSLTTVQGLKKEYSYTKILKDLKKEFCCNGTVVQDSELGQVIQLQGDQRKNVSTFLVQAGLVKKDNIKIHGF

SEQ ID NO: 9556 - protein, 315 aa, Arabidopsis thaliana
  misc_feature: Ceres CLONE 39351
  misc_feature: Useful for making plants with modulated biomass
  misc_feature: The cauline leaves are abnormally small.
MAATSLTAPPSFSGLRRISPKLDAAAVSSHQSFFHRVNSSTRLVSSSSSSHRSPRGVVAMAGSGKFFVGGNWKCNGTKDSIAKLISDLNSATLEADVDVVVSPPFVYIDQVKSSLTDRIDISGQNSWVGKGGAFTGEISVEQLKDLGCKWVILGHSERRHVIGEKDEFIGKKAAYALSEGLGVIACIGEKLEEREAGKTFDVCFAQLKAFADAVPSWDNIVVAYEPVWAIGTGKVASPQQAQEVHVAVRGWLKKNVSEEVASKTRIIYGGSVNGGNSAELAKEEDIDGFLVGGASLKGPEFATIVNSVTSKKVAA

SEQ ID NO: 9557 - protein, 594 aa, Arabidopsis thaliana
  misc_feature: HVG ID no. 395
  misc_feature: Useful for making plants with modulated phosphate use efficiency
MAREQLQVLNALDVAKTQWYHFTAIIIAGMGFFTDAYDLFCISLVTKLLGRIYYHVEGAQKPGTLPPNVAAAVNGVAFCGTLAGQLFFGWLGDKLGRKKVYGMTLMVMVLCSIASGLSFGHEPKAVMATLCFFRFWLGFGIGGDYPLSATIMSEYANKKTRGAFVSAVFAMQGFGIMAGGIFAIIISSAFEAKFPSPAYADDALGSTIPQADLVWRIILMAGAIPAAMTYYSRSKMPETARYTALVAKDAKQAASDMSKVLQVEIEPEQQKLEEISKEKSKAFGLFSKEFMSRHGLHLLGTTSTWFLLDIAFYSQNLFQKDIFSAIGWIPPAQSMNAIQEVFKIARAQTLIALCSTVPGYWFTVAFIDVIGRFAIQMMGFFFMTVFMFALAIPYNHWTHKENRIGFVIMYSLTFFFANFGPNATTFVVPAEIFPARFRSTCHGISAASGKLGAMVGAFGFLYLAQNPDKDKTDAGYPPGIGVRNSLIVLGVVNFLGILFTFLVPESKGKSLEEMSGENEDNENSNNDSRTVPIVMTVLIHFNSVLVHRQLQRSFHFLLPLSQHFPLKIRKLKILPLSFYTLLTILKHFIRSDPT

SEQ ID NO: 9558 - protein, 1377 aa, Arabidopsis thaliana
  misc_feature: HVG ID no. 396
  misc_feature: Useful for making plants with modulated phosphate use efficiency
MTLPYRFSSVRNHSLLLKTSHLCTPRSALGCCFSPKESPFFRKNTAQFLSPQKHTSLPLKLVCPLASFSSYADSEGEEQHHADQPIQNPHESSTVSNESDGKGNAEATGDFSGMAQAFHISSTTARAISIVIAFSALTLPIFMKSLGQGLALKTKLLSYATLLFGFYMAWNIGANDVANAMGTSVGSGALTIRQAVMTAAVLEFSGALLMGTHVTSTMQKGILMANVFQGKDMLLFAGLLSSLAAAGTWLQVASYYGWPVSTTHCIVGSMVGFGLVYGGAGAVFWSSLAKVASSWVISPILGALVSFLVYKCIRRFVYSAPNPGQAAAAAAPVAVFVGVASISSAALPLSKIFPIALSQALACGVAGAIVFDRIIRKQLGHLLAKTKSPETSQNQPKTIGFLSDIAGPTGTQLEIVYGIFGYMQVLSACFMSFAHGGNDVSNAIGPLAAALSILQNGAAAGGAEIVIPMDVLAWGGFGIVAGLTMWGYRVIATIGKKITELTPTRGFAAEFAAASVVLFASKLGLPISATHTLVGAVMGVGFARGLNSVRAETVREIVASWLVTIPVGATLAVIYTWIFTKILSFVLMQIHFHHHQYHHQLHSHHPWPISHLYMTLPYRFSSVRNHSLLLKTSHLCTPRSALGCCFSPKESPFFRKNTAQFLSPQKHTSLPLKLVCPLASFSSYADSEGEEQHHADQPIQNPHESSTVSNESDGKGNAEATGDFSGMAQAFHISSTTARAISIVIAFSALTLPIFMKSLGQGLALKTKLLSYATLLFGFYMAWNIGANDVANAMGTSVGSGALTIRQAVMTAAVLEFSGALLMGTHVTSTMQKGILMANVFQGKDMLLFAGLLSSLAAAGTWLQVASYYGWPVSTTHCIVGSMVGFGLVYGGAGAVFWSSLAKVASSWVISPILGALVSFLVYKCIRRFVYSAPNPGQAAAAAAPVAVFVGVASISSAALPLSKIFPIALSQALACGVAGAIVFDRIIRKQLGHLLAKTKSPETSQNQPKTIGFLSDIAGPTGTQLEIVYGIFGYMQVLSACFMSFAHGGNDVSNAIGPLAAALSILQNGAAAGGAEIVIPMDVLAWGGFGIVAGLTMWGYRVIATIGKKITELTPTRGFAAEFAAASVVLFASKLGLPISATHTLVGAVMGVGFARGLNSVRAETVREIVASWLVTIPVGATLAVIYTWIFTKILSFVLMTLPYRFSSVRNHSLLLKTSHLCTPRSALGCCFSPKESPFFRKNTAQFLSPQKHTSLPLKLVCPLASFSSYADSEGEEQHHADQPIQNPHESSTVSNESDGKGNAEATGDFSGMAQAFHISSTTARAISIVIAFSALTLPIFMKSLGQGLALKTKLLSYATLLFGFYMAWNIGANDV

SEQ ID NO: 9559 - protein, 296 aa, Arabidopsis thaliana
  misc_feature: Ceres CLONE 39757
  misc_feature: Useful for making plants with modulated nitrogen use efficiency
MALRNIENALPISQERPKKLAKLSKQPEIGLNDENNPVAVAESTVEYVASENLKPFSDPESSVQRLLEELASKDWIKVCESLNNTRRFAIHHSSLLLPILEKLIVVMVKAMKNPRSALCKTSIMTCSDIFTAYGEKLLEGPHLKSMDDLLLQLLMKASQDKKFVCEEAEKALNTMVNSVARLPLLRKLQSYVRHSNPRVRAKAAVSTSNCVSKMEVNEMEEFGMVLLAQMAADQLSDKLPEAREAARSMVNSLFEKFTWNEEEDEEGSKQEAWKKFCEKNVTGLNAQAMIKIVASQ

SEQ ID NO: 9560 - protein, 159 aa, Arabidopsis thaliana
  misc_feature: Ceres CLONE 39855
  misc_feature: Useful for making plants with altered Lignin content
MGRCPTRKVKKRRLSHKTARRDKFEVKGDDLVYTELRKPETEIKPLQLDEDLPGMGQFYCLHCDRYFSNASVRDDHFKTKKHKKRVNMMMGQAPHSQLDADLAGGMGMPDNGPKLMSNLVFTELRKPETEDLPGMGQFNCLLCHRELLQCISDGLSFQD

SEQ ID NO: 9561 - protein, 313 aa, Arabidopsis thaliana
  misc_feature: Ceres CLONE 39922
  misc_feature: Useful for making plants with altered alkaloid content
MTMTTVKVSNVSLGATDRDLKEFFSFSGDILYLETQSETERTKLAYVTFKDLQGAETAVLLSGATIVDSSVIVSMAPDYQLSPEALASLEPKDSNKSPKAGDSVLRKAEDVVSSMLAKGFILGKDAIAKAKSVDEKHQLTSTASAKVASFDKKIGFTDKINTGTVVVGEKVREVDQKYQVSEKTKSAIAAAEQTVSNAGSAIMKNRYVLTGATWVTGAFNKVAKAAEEVGQKAKEKVGMAEEEDKRKVVDEFARVHLSESPKAASSTQEAERESKLSESPEAKKDSEHLEPQSKPLQQQSPPPMASAPAPAQP

SEQ ID NO: 9562 - protein, 276 aa, Arabidopsis thaliana
  misc_feature: Ceres CLONE 40102
  misc_feature: Useful for making plants with modulated drought sensitivity
MVKGPGLYTEIGKKARDLLYKDHNSDQKFSITTFSPAGVAITSTGTKKGDLLLGDVAFQSRRKNITTDLKVCTDSTFLITATVDEAAPGLRSIFSFKVPDQNSGKVELQYLHEYAGISTSMGLTQNPTVNFSGVIGSNVLAVGTDVSFDTKSGNFTKINAGLSFTKEDLIASLTVNDKGDLLNASYYHIVNPLFNTAVGAEVSHKLSSKDSTITVGTQHSLDPLTSVKARVNSAGIASALIQHEWKPKSFFTISGEIDTKSIDKSAKVGLALALKP

SEQ ID NO: 9563 - protein, 554 aa, Oryza sativa
  misc_feature: HVG ID no. 402
  misc_feature: Useful for making plants with modulated salt sensitivity
MSSLDATTPRYDEFKRIYHLFLFHAHPFWLQLLYFLFISLLGFLMLKALPMKTSMVPRPMDLDLIFTSVSATTVSSMVAVEMESFSNSQLLLITLLMLLGGEVFTSILGLYFTNAKYSSKMIATLPDDDDHGGSGKPPPATTSPSSTLVELELAPPMDVVVVNPTTTATTHDEVELGLGRRNKHGCTCTTTHTSSSSSASKTTTTRLLMFVVMGYHAVVHVAGYTAIVVYLSAVGGAGAVVAGKGISAHTFAIFTVVSTFANCGFVPTNEGMVSFRSFPGLLLLVMPHVLLGNTLFPVFLRLAIAALERVTGWPELGELLIRRRRGGGEGYDHLLPSSRTRFLALTVAVLVVAQLALFCAMEWGSDGLRGLTAGQKLVGALFMAVNSRHSGEMVVDLSTVSSAVVVLYVVMMYLPPYTTFVPVQDKHQQTGAQSGQEGSSSSSIWQKLLMSPLSCLAIFIVVICITERRQIADDPINYSVLNIVVEVISAYGNVGFSTGYSCARQVRPDGSCRDLWVGFSGKWSKQGKLTLMAVMFYGRLKKFSLHGGQAWKIE

SEQ ID NO: 9564 - protein, 147 aa, Arabidopsis thaliana
  misc_feature: Ceres CLONE 4043
  misc_feature: Useful for making plants with modulated biomass
  misc_feature: The plant is abnormally small.
  misc_feature (102)..(102): Xaa is any aa, unknown, or other
MEINKFLAVVVVVVVLYSVEATAQGGSPQLTACLHKLLPCQPYIHSLNPPPPPSCCGPMKEIVEKDAPCLCTAFNNPEVLKALNLTKENALLLPNACGVNPXVSLCSKIATPSPIASPGSTNGTSSASTISFNRFSFLSAFVAMIFF

SEQ ID NO: 9565 - protein, 286 aa, Arabidopsis thaliana
  misc_feature: Ceres CLONE 40508
  misc_feature: Useful for making plants with altered cell wall content and/or composition
  misc_feature: Useful for making plants with modulated biomass
  misc_feature: The plant is abnormally small.
MASGLSEIGSTKMFDGYNKRYKHFSETLGCSMTFSIYFPPSASASSSHKSPVLYWLSGLTCTDENFIIKSGAQRAASTHGIALVAPDTSPRGLNVEGEADSYDFGVGAGFYLNATQEKWKNWRMYDYVVKELPKLLSENFSQLDTTKASISGHSMGGHGALTIYLRNLDKYKSVSAFAPITNPINCAWGQKAFTNYLGDNKAAWEEYDATCLISKYNNLSATILIDQGENDQFYPDQLLPSKFEEACKKVNAPLLLRLHPGYDHSYYFIATFIEDHISHHAQALEL

SEQ ID NO: 9566 - protein, 316 aa, Arabidopsis thaliana
  misc_feature: Ceres CLONE 40729
  misc_feature: Useful for biocontainment applications
  misc_feature: Useful for making plants with altered Lignin content
  misc_feature: Useful for making plants with altered alkaloid content
  misc_feature: Useful for making plants with modulated biomass
  misc_feature: The plant is abnormally small.
  misc_feature: The plant produces a reduced number of seeds.
MAALIRCCSSFSHTSGGQPPPRDKSRAPEIGKFATSIGYSVVRKPGDHPPFSKIIHSSSQPKERQGKGILQTPFASVGSLDKFSAFEGIGRLKLPVMAVLLTNSLQMATPLEALAAEICEPESSMFSMPILLLVALIGATVGGLLARQRKGELQRLNEQLRQINAALRRQAKIESYAPSLSYAPVGARIPDSEIIVEPKKQELISKLKTGKTFLRNQEPEKAYTEFKIALELAQSLKDPTEEKKAARGLGASLQRQGKYREAIQYHSMVLAISKRESEDSGITEAYGAIADCYTELGDLEKAGKFYDTYIARLETD

SEQ ID NO: 9567 - protein, 932 aa, Arabidopsis thaliana
  misc_feature: HVG ID no. 408
  misc_feature: Useful for making plants with modulated cold sensitivity
  misc_feature: Useful for making plants with modulated heat sensitivity
MADTVEKVPTVVESSSSSTVEASNSAEKTEPTTEKKKWGDVEDDDDEEEAVSELNSLSIKEEEKPDSILEEPEDSNIKAVTSGDTPYTSASRFEDLNLSPELMKGLYVEMKFEKPSKIQAISLPMIMTPPHKHLIAQAHNGSGKTTCFVLGMLSRVDPTLREPQALCICPTRELANQNMEVLQKMGKFTGITAELAVPDSTRGAPAATRGAPVSAHVVIGTPGTLKKWMAFKRLGLNHLKILVFDEADHMLATDGFRDDSLKIMKDIGRVNPNFQVLLFSATFNETVKDFVARTVKDPNQLFVKREDLALDSVKQYKVVCPKEQNKIEVIKDQIMELGDIGQTIIFVKTKASAQKVHKALAEMGYDVTSVHGNLTESDRDKIVKEFKECLTQVLIATDVIARGFDQQRVNLVVNYNLPTKYETGEPDYEVYLHRVGRAGRFGRKGAVFNLLLDDGWDKEVMEKIEKYFEANVKEIKSWNSEEEYKSALKEAGLLDEEEEKPDSILEEPEDSNIKAVTSGDTPYTSASRFEDLNLSPELMKGLYVEMKFEKPSKIQAISLPMIMTPPHKHLIAQAHNGSGKTTCFVLGMLSRVDPTLREPQALCICPTRELANQNMEVLQKMGKFTGITAELAVPDSTRGAPAATRGAPVSAHVVIGTPGTLKKWMAFKRLGLNHLKILVFDEADHMLATDGFRDDSLKIMKDIGRVNPNFQVLLFSATFNETVKDFVARTVKDPNQLFVKREDLALDSVKQYKVVCPKEQNKIEVIKDQIMELGDIGQTIIFVKTKASAQKVHKALAEMGYDVTSVHGNLTESDRDKIVKEFKECLTQVLIATDVIARGFDQQRVNLVVNYNLPTKYETGEPDYEVYLHRVGRAGRFGRKGAVFNLLLDDGWDKEVMEKIEKYFEANVKEIKSWNSEEEYKSALKEAGLLDE

SEQ ID NO: 9568 - protein, 220 aa, Arabidopsis thaliana
  misc_feature: Ceres CLONE 41046
  misc_feature: Useful for making plants with altered Lignin content
MDLLLLEKSLIAVFVAVILATVISKLRGKKLKLPPGPIPIPIFGNWLQVGDDLNHRNLVDYAKKFGDLFLLRMGQRNLVVVSSPDLTKEVLLTQGVEFGSRTRNVVFDIFTGKGQDMVFTVYGEHWRKMRRIMTVPFFTNKVVQQNREGWEFEAASVVEDVKKNPDSATKGIVLRKRLQLMMYNNMFRIMFDRRFESEDDPLFLRLKALNGERILRHHQL

SEQ ID NO: 9569 - protein, 40 aa, Arabidopsis thaliana
  misc_feature: Ceres CLONE 41072
  misc_feature: Useful for making plants with modulated nitrogen use efficiency
MIISETNRREISKYLFKEGVLFAKKDFNLPQHPLIESVPN

SEQ ID NO: 9570 - protein, 252 aa, Arabidopsis thaliana
  misc_feature: Ceres CLONE 41104
  misc_feature: Useful for making plants with altered alkaloid content
MEGIQHPIPRTVEEVFSDFRGRRAGLIKALSTDVQKFYHQCDPEKENLCLYGLPNETWEVNLPVEEVPPELPEPALGINFARDGMQEKDWISLVAVHSDSWLISVAFYFGARFGFGKNERKRLFQMINDLPTIFEVVTGNAKQSKDQSANHNSSRSKSSGGKPRHSESHTKASKMSPPPRKEDESGDEDEDDEQGAVCGACGDNYGGDEFWICCDACEKWFHGKCVKITPAKAEHIKHYKCPSCTTSKKMKA

SEQ ID NO: 9571 - protein, 307 aa, Arabidopsis thaliana
  misc_feature: Ceres CLONE 41320
  misc_feature: Useful for biocontainment applications
  misc_feature: Useful for making plants with modulated biomass
  misc_feature: The plant is abnormally small.
  misc_feature: The plant produces a reduced number of seeds.
MVGGGVIQQILRRKLHSQSLATPVLSWFSSKKAHEDAGSSGVRALALLGAGVSGLLSFSTVASADEAEHGLESPEYPWPHDGILSSYDHASIRRGHQVYQQVCASCHSMSLISYRDLVGVAYTEEEAKAMAAEIEVVDGPNDEGEMFTRPGKLSDRFPQPYANESAARFANGGAYPPDLSLITKARHNGPNYVFALLTGYRDPPAGISIREGLHYNPYFPGGAIAMPKMLNDEAVEYEDGVPATEAQMGKDIVSFLAWAAEPEMEERKLMGFKWIFLLSLALLQAAYYRRLKWSVLKSRKLVLDVVN

SEQ ID NO: 9572 - protein, 273 aa, Arabidopsis thaliana
  misc_feature: Ceres CLONE 41439
  misc_feature: Useful for making plants with altered Lignin content
  misc_feature: Useful for making plants with modulated biomass
  misc_feature: Useful for making plants with modulated flowering time
  misc_feature: The plant flowers significantly late compared to wild-type.
  misc_feature: The plant is abnormally small.
MALEAMNTPTSSFTRIETKEDLMNDAVFIEPWLKRKRSKRQRSHSPSSSSSSPPRSRPKSQNQDLTEEEYLALCLLMLAKDQPSQTRFHQQSQSLTPPPESKNLPYKCNVCEKAFPSYQALGGHKASHRIKPPTVISTTADDSTAPTISIVAGEKHPIAASGKIHECSICHKVFPTGQALGGHKRCHYEGNLGGGGGGGSKSISHSGSVSSTVSEERSHRGFIDLNLPALPELSLHHNPIVDEEILSPLTGKKPLLLTDHDQVIKKEDLSLKI

SEQ ID NO: 9573 - protein, 219 aa, Arabidopsis thaliana
  misc_feature: Ceres CLONE 41543
  misc_feature: Useful for making plants with modulated heat sensitivity
  misc_feature: Useful for making plants with modulated heat sensitivity
MAILYALVARGTVVLSEFTATSTNASTIAKQILEKVPGDNDSNVSYSQDRYVFHVKRTDGLTVLCMAEETAGRRIPFAFLEDIHQRFVRTYGRAVHTALAYAMNEEFSRVLSQQIDYYSNDPNADRINRIKGEMNQVRGVMIENIDKVLDRGERLELLVDKTANMQGNTFRFRKQARRFRSNVWWRNCKLTVLLILLLLVIIYIAVAFLCHGPTLPSCI

SEQ ID NO: 9574 - protein, 365 aa, Arabidopsis thaliana
  misc_feature: Ceres CLONE 41717
  misc_feature: Useful for making plants with modulated drought sensitivity
MKKPVGAEKKRVKRSSGSASTSVRDSGSDSQPRKQAVKKDSFQLFAEKVRDHKGLESRWAVMEQARVEYFRGKDFVSFMKNNPDFKDILEEDKDLDTDDIANVLLGKNLLVRCDRVTKTLRPRKKKLSTWPAHLEIFRDDQSFSENDAFFAWTFEKRHPLWQTLLSFFWPVLTLAICLFPVYPHRCKLIVLYSCAGILLMILSLLFVRAVAFGAMWILLGKRVWFFPNILAEEATLKELFRFWPKKDEEEPPKWTSRLFYTVVAIVVVMLLRRHAPDEAARARYQRRMSNIIDDVLEWSPKLALSGLMENQQPVNITDAANNSSDSAGGPDQTEEVDLDETQGEDLDETQGKEEAEGWTDSDLKT

SEQ ID NO: 9575 - protein, 256 aa, Arabidopsis thaliana
  misc_feature: Ceres CLONE 41745
  misc_feature: Useful for making plants with modulated nitrogen use efficiency
  misc_feature (245)..(245): Xaa is any aa, unknown, or other
MAVVLRGGITGGFLHHRRDASSVITRRISSVKAAGGGINPTVAVERATWLPGLNPPPYLDGNLAGDYGFDPLGLGEDPESLKWYVQAELVHSRFAMLGVAGILFTDLLRTTGIRNLPVWYEAGAVKFDFASTKTLIVVQFLLMGFAETKRYMDFVSPGSQAKEGSFFFGIEAALEGLEPGYPGGPLLNPLGLAKDVKNAHDWKLKEIKNGRLAMMAMLGFFVQASVTHTGPIDNLVEHLSNPWHXTIIQTLFTSTS

SEQ ID NO: 9576 - protein, 405 aa, Zea mays
  misc_feature: HVG ID no. 420
  misc_feature: Useful for making plants with modulated endosperm cell number
  misc_feature: Useful for making plants with modulated endosperm size
MERVFSVEEIPNPYWVPPHPQSAAAGAVAAPAGEAAGLMNRCPSEWYFQKFLEEAVLDSPVPVAGVSRGSVGAGVEAAERKTPGTAAAAAASSSVVDPVEYNAIVKQKLEKDLAAVALWRASGAAPPDNSPAGSSLPSVDVPHAGPLKPMGGTGSLVQNKLAGAPGGGSSPHVVQNADIPVKQTTSSSSREQSDDDDMEGDAETTGNGNPVQQRLQRRKQSNRESARRSRSRKAAHLNELEAQVAQLRVENSSLLRRLADVNQKFNEAAVDNRVLKADVETLRAKVKMAEDSVKRVTGMNTLFPAVSDMSSLSMPFNGSPSDSASDAAVPIQDDLNSYFANPSEIGGSNGYMPDIASSAQEDDDFVNGAQVAGKMGSTDSLQRVASLEHLQKRMCGGPASSGSTS

SEQ ID NO: 9577 - protein, 414 aa, Arabidopsis thaliana
  misc_feature: Ceres CLONE 42530
  misc_feature: Useful for making plants with altered Lignin content
  misc_feature: Useful for making plants with altered alkaloid content
MAGMASDGTQYDPRQFDTKMNAILGEEGEETFYTNYDEVCDSFDAMELQPDLLRGIYAYGFEKPSAIQQRGIIPFCKGLDVIQQAQSGTGKTATFCSGVLQQLDISLVQCQALVLAPTRELAQQIEKVMRALGDYLGVKAQACVGGTSVREDQRVLQSGVHVVVGTPGRVFDLLRRQSLRADAIKMFVLDEADEMLSRGFKDQIYDIFQLLPSKVQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFMTSEDERMMADIQRFYNVVVEELPSNVADLL

SEQ ID NO: 9578 - protein, 357 aa, Arabidopsis thaliana
  misc_feature: Ceres CLONE 42713
  misc_feature: Useful for making plants with altered terpenoid content
  misc_feature: Useful for making plants with modulated low light sensitivity
MEGSSSAIARKTWELENNILPVEPTDSASDSIFHYDDASQAKIQQEKPWASDPNYFKRVHISALALLKMVVHARSGGTIEIMGLMQGKTEGDTIIVMDAFALPVEGTETRVNAQSDAYEYMVEYSQTSKLAGRLENVVGWYHSHPGYGCWLSGIDVSTQMLNQQYQEPFLAVVIDPTRTVSAGKVEIGAFRTYPEGHKISDDHVSEYQTIPLNKIEDFGVHCKQYYSLDITYFKSSLDSHLLDLLRNKYWVNTLSSSPLLGNGDYVAGQISDLAEKLEQAESQLANSRYGGIAPAGHQRRKEDEPQLAKITRDSAKITVEQVHGLMSQVIKDILFNSARQSKKSADDSSDPEPMITS

SEQ ID NO: 9579 - protein, 156 aa, Arabidopsis thaliana
  misc_feature: Ceres CLONE 42925
  misc_feature: Useful for making plants with modulated biomass
  misc_feature: The plant is abnormally small.
  misc_feature: The rosette leaves do not appear in the normal fashion, i.e., their phyllotaxy may be abnormal or too many leaves may be emerging in comparison to the control.
MDSASSNTKAIDPPLHMLGFEFDELSPTRITGRLPVSPVCCQPFKVLHGGVSALIAESLASMGAHMASGFKRVAGIQLSINHLKSADLGDLVFAEATPVSTGKTIQVWEVKLWKTTQKDKANKILISSSRVTLICNLPIPDNAKDAANMLKMVAKL

SEQ ID NO: 9580 - protein, 358 aa, Arabidopsis thaliana
  misc_feature: Ceres CLONE 42960
  misc_feature: Useful for making plants with altered terpenoid content
MCGGAIISDFIPPPRSRRVTSEFIWPDLKKNLKGSKKSSKNRSNFFDFDAEFEADFQGFKDDSSIDCDDDFDVGDVFADVKPFVFTSTPKPAVSAAAEGSVFGKKVTGLDGEAEKSANRKRKNQYRGIRQRPWGKWAAEIRDPREGARIWLGTFKTAEEAARAYDAAARRIRGSKAKVNFPEENLKANSQKRSVKANLQKPVAKPNPNPSPALVQNSNISFENMCFMEEKHQVSNNNNNQFGMTNSVDAGCNGYQYFSSDQGSNSFDCSEFGWSDQAPITPDISSAVINNNNSALFFEEANPAKKLKSMDFETPYNNTEWDASLDFLNEDAVTTQDNGANPMDLWSIDEIHSMIGGVF

SEQ ID NO: 9581 - protein, 325 aa, Arabidopsis thaliana
  misc_feature: Ceres CLONE 42965
  misc_feature: Useful for biocontainment applications
  misc_feature: Useful for making plants with modulated flowering time
  misc_feature: The plant flowers significantly late compared to wild-type.
  misc_feature: The plant produces a reduced number of seeds.
MASSSCFLRSILFSSPTNLRSNHHLPTFFPKNHLICSHSTSSRFESLSVSSIGTGSTKKSSDTRRKVKSMATTNIGKEEKKRVEIYDLEENLAIDLAKFTADLSDKFCKERGAFTVVVSGGSLIKSLRKLVESPYVDSIDWARWHFFWVDERVVPKNHDDSNYKLAYDSFLSKVPIPPGNVYAINEALSAEAAADDYETCLKHLVNTNILRVSESTGFPKFDLMLLGMGPDGHVASLFPGHGLCNESKKWVVSISDSPKPPSERITFTFPVINSSAHVALVVCGSGKAEAVEAALKKTGNVPPAGSVSAEDELVWFLDKPASSKL

SEQ ID NO: 9582 - protein, 140 aa, Arabidopsis thaliana [sequence omitted]

SEQ ID NO: 9583 - protein, 142 aa, Glycine max
  misc_feature: Ceres CLONE 474636
  misc_feature: Useful for making plants with altered Lignin content
MSGVGPLSQDWEPVVLRKKAPTAAAKKDEKAVNAARRSGAEIETLKKYNAGTNKAASSSTSLNTKRLDDDTENLAHEKVPTELKKAIMQARMDKKLTQAQLAQLINEKPQVIQEYESGKAIPNQQIIGKLERALGAKLRGKK

SEQ ID NO: 9584 - protein, 335 aa, Glycine max
  misc_feature: Ceres CLONE 475689
  misc_feature: Useful for making plants with altered Lignin content
  misc_feature: Useful for making plants with altered terpenoid content
MENSTQESHLRSENSVSYESPYPIYGMSFSPSHPHRLALGSFIEEYTNRVDILSFHPDTLSLTPNPSLSFDHPYPPTKLMFHPRKPPSSSSDLLATSGDYLRLWEVRDNSVEAVSLFNNSKTSEFCAPLTSFDWNDIDPNRIATSSIDTTCTIWDIERTLVETQLIAHDKEVYDIAWGEARVFASVSADGSVRIFDLRDKEHSTIIYESPHPDTPLLRLAWNKQDLRYMATILMDSNKVVILDIRSPTTPVAELERHRGSVNAIAWAPHSSTHICSAGDDTQALIWDLPTLASPTGIDPVCMYSAGCEINQLQWSAVQPEWIAIAFANKMQLLKV

SEQ ID NO: 9585 - protein, 259 aa, Glycine max
  misc_feature: Ceres CLONE 478453
  misc_feature: Useful for making plants with altered Lignin content
  misc_feature (204)..(204): Xaa is any aa, unknown, or other
MHKLGRGHRDKLQQFITITGASEKLALQALKASDWHLEGAFDFFYSQPQLKTFTDSRHLEELYNRYKDAYVDMILADGITLLCNDIQVDPQDIVMLVLSWHMKAGTMCEFSKKEFIEGLQSLGIDSLEKFREKIPYMRSELKDEQKFREIYNFAFGWAKEKGQKSLALDTAIGMWQLLFAEKQWPLVDHWCQFLQARHNKAISXDTWSQLLEFAKTVGSNLSDYDAEGAWPYLIDEFVEYLNENGIIQNDLINDSSLKR

SEQ ID NO: 9586 - protein, 480 aa, Glycine max
  misc_feature: Ceres CLONE 479006
  misc_feature: Useful for making plants with altered Lignin content
MEEEAPPVPPAPPIVAMLPSPGMGHLIPMIEFAKRAVRYHNLAVTFVIPTDGPPSKAQKAVFQALPDSISHTFLPPVNLSDFPPGTKIETLISHTVLLSLPSLRQAFHSLSSTYTLAAVVVDLFATDAFDVAAEFNASPYVFYPSTATVLSIALHLPTLDKQVQCEFRDLPEPVTIPGCIPLPVKDFLDPVLERTNEAYKWVLHHSKRYREAEGIIENSFAELEPGAWNELQREQPGRPPVYAVGPLVRMEPGPADSECLRWLDEQPRGSVLFVSFGSGGTLSSAQINELALGLENSQQRFLWVVKSPNDAIANATYFNAESHEDPLQFLPEGFVERTKGRGFLVKSWAPQPQVLAHQSTGGFLSHCGWNSILESVVNGVPLIAWPLFAEQRTNAFMLMHEVKVALRPKVAEDTGLVQSQEIASVVKCLMEGHEGKKLRYRIKDLKEAAAKALSPNGSSTDHISNLVLKWTNKTTISTSG

SEQ ID NO: 9587 - protein, 275 aa, Glycine max
  misc_feature: Ceres CLONE 479015
  misc_feature: Useful for making plants with altered Lignin content
MENAEEMMQQNDEVLSVELPAPSGWNKLFFPKKLGTPRKSEIVFIAPTGEEISTKKQLEQYLKAHPGNPVISEFDWGTGETPRRSARISEKVKSTPPADSDTPKKRARKSSGSKKDNKETESASEEGKAKSDTEDPKAAEEEKNEGNDNSNSGGKQLENGDKTEQIDEQAKKPDVDMEENDLNDTNNKLENDSDEIKNSHVNGENVIAERPEGEEAQKQEVEPAEKVAEEAANTAETEKSLLTELEKEKNEEKTDTATLEANGGGEKENPNAAQM

SEQ ID NO: 9588 - protein, 197 aa, Glycine max
  misc_feature: Ceres CLONE 480900
  misc_feature: Useful for making plants with altered alkaloid content
MASVHSSFLLPYNLLSLTTPSSSSTQILFTARPSATHLRPLLLTTRRRSGRRPFAAVAEQAATATEAAARRLYVGNIPRTVTNDELAKIVQEHGAVEKAEVMYDKYSGRSRRFAFVTMKTVEDATAVIEKLNGTELGGREIKVNVTEKPLSTLDLPLLQAEESEFIDSPHKVYVGNLAKTVTTDTLKNFFSEKGKVS

SEQ ID NO: 9589 - protein, 234 aa, Glycine max
  misc_feature: Ceres CLONE 481710
  misc_feature: Useful for making plants with altered terpenoid content
  misc_feature: Useful for making plants with modulated flowering time
  misc_feature: The plant flowers significantly late compared to wild-type.
  misc_feature (44)..(44): Xaa is any aa, unknown, or other
MFTLNHSSDLYHVSPELSSSLDTSSPASEGSRGVAFSDEEVRLXVRHPKKRAGRKKFRETRHPVYRGVRRRNSDKWVCEVREPNKKTRIWLGTFPTPEMAARAHDVAAMALRGRYACLNFADSAWRLPVPATAEAKDIQKAAAEAAQAFRPDQTLKNANTRQECVEAVAVAVAETTTATAQGVFYMEEEEQVLDMPELLRNMVLMSPTHCLGYEYEDADLDAQDAEVSLWNFSI

SEQ ID NO: 9590 - protein, 433 aa, Zea mays
  misc_feature: HVG ID no. 484
  misc_feature: Useful for making plants with modulated biomass
MVLDLNVASPADSGTSSSSVLNSADGGFRFGLLGSPVDDDDCSGEMAPGASTGFMTRQLFPSPTPPAEPEPEPVAAPVPVWQPQRAEDLGMAQKPVAPAKNTRRGPRSRSSQYRGVTFYRRTGRWESHIWDCGKQVYLGGFDTAHAAARAYDRAAIKFRGLDADINFSLSDYEDDLKQMRNWTKEEFVHILRRQSTGFARGSSKYRGVTLHKCGRWEARMGQLLGKKYIYLGLFDSEVEAARAYDRAALRFNGREAVTNFEPSSYNAGDNNLRDTETEAIDDGDAIDLDLRISQPNVQDPKRDNTLAGLQPTCDSPESSNTMASQPMSSSSPWPGYHQNPAVSFHHQRLYSSACHGFFPNHQVQERPVERRPELGAQPFPSWAWQAQGSPHVPLHHSAASSGFSTAAGANGGMPLPSHPPAQFPTTTNPFFFP

SEQ ID NO: 9591 - protein, 380 aa, Arabidopsis thaliana
  misc_feature: CDNA 4282552
  misc_feature: Useful for making plants with modulated biomass
MADDKEMPAAVVDGHDQVTGHIISTTIGGKNGEPKQTISYMAERVVGTGSFGIVFQAKCLETGETVAIKKVLQDRRYKNRELQLMRVMDHPNVVCLKHCFFSTTSKDELFLNLVMEYVPESLYRVLKHYSSANQRMPLVYVKLYMYQIFRGLAYIHNVAGVCHRDLKPQNLLVDPLTHQVKICDFGSAKQLVKGEANISYICSRFYRAPELIFGATEYTTSIDIWSAGCVLAELLLGQPLFPGENAVDQLVEIIKVLGTPTREEIRCMNPHYTDFRFPQIKAHPWHKIFHKRMPPEAIDFASRLLQYSPSLRCTALEACAHPFFDELREPNARLPNGRPFPPLFNFKQEVAGSSPELVNKLIPDHIKRQLGLSFLNQSGT

SEQ ID NO: 9592 - protein, 342 aa, Arabidopsis thaliana
  misc_feature: Ceres GEMINI 5001F11
  misc_feature: Useful for making plants with modulated salt sensitivity
MADLKSTFLDVYSVLKSDLLQDPSFEFTHESRQWLERMLDYNVRGGKLNRGLSVVDSYKLLKQGQDLTEKETFLSCALGWCIEWLQAYFLVLDDIMDNSVTRRGQPCWFRKPKVGMIAINDGILLRNHIHRILKKHFREMPYYVDLVDLFNEVEFQTACGQMIDLITTFDGEKDLSKYSLQIHRRIVEYKTAYYSFYLPVACALLMAGENLENHTDVKTVLVDMGIYFQVQDDYLDCFADPETLGKIGTDIEDFKCSWLVVKALERCSEEQTKILYENYGKAEPSNVAKVKALYKELDLEGAFMEYEKESYEKLTKLIEAHQSKAIQAVLKSFLAKIYKRQK

SEQ ID NO: 9593 - protein, 176 aa, Arabidopsis thaliana
  misc_feature: Ceres GEMINI 5031G10
  misc_feature: Useful for making plants with modulated cold sensitivity
  misc_feature: Useful for making plants with modulated salt sensitivity
  misc_feature: Useful for making plants with modulated cold sensitivity
MEKLLNPYDKQCMKMAMLKHEETFKQQVYELHRLYQVQKILMKNMEINKFTTKNNHVNSGLGTFIRRVDNEIDRPANFSGGNNNIEIMDESEIELTLGPSCYGGDEMMRMNKKKKKNSLPEMMDGSLNSGRRSFSSSSTGSSNNNNNNLEEQVRQERMMKHQKQQPWLQALTLNVI

SEQ ID NO: 9594 - protein, 559 aa, Arabidopsis thaliana
  misc_feature: Ceres GEMINI 5065F4
  misc_feature: Useful for making plants with altered Lignin content
MSLRVVSSVFSGINRIPNLHETHTLLRSHVFSFFFKPANIGSIRRLVLSPSYGDRSRDSVGSAADVSSSILDDELLSSVSAVRDADEALAMISDRFGSNRGGIVELEDCRSIISAAVSRGNVDLALSIFYTMRASFDLGGSDNDRWSWSRPDVEVYTMLVNGLAASLRVSDSLRIIRDICRVGISPAEEVPFGKIVRCPSCLIAIAVAQPQHGVQIVSCANCRYQYELFSGDITSIDSEELGKDIPLWEKGLRLIQIKKNKITSSVHSIVVQTPSGTARTHRFATETAELPAQEGERVTIASAAPSNVYRQVGPFKFISKAPNFYPGEPMSLTKHKDGRESILLRPPSKDGDKILQPSFLIPLLAILATGDAASGVIDPSLPQLLSVATVTSLAIGATVNSFVLPKLNQLPERTVDVVGIKQQLLSQYDVLQRRIRDLKEAVEKEVWMLARMCQLENKILAVGEPAYRTRRTRVKKVRESLENSIKGKIDLIDSYARISSMIEIEVEMDSDVLAAEAVNNTENIAQQIEQIMELENLEEKWKIQAEANDEAERLLSSQP

SEQ ID NO: 9595 - protein, 97 aa, Arabidopsis thaliana
  misc_feature: Ceres GEMINI 5090C3
  misc_feature: Useful for making plants with modulated nitrogen use efficiency
MSPIVITQLATGISVLAGAVFIKSVMDQKPMAGQFPRCPTCNGTGRVTCFCSRWSDGDVGCRRCSGSGRAACSNCGGSGTGRPLPAQITVQPPNRPY

SEQ ID NO: 9596 - protein, 136 aa, Arabidopsis thaliana
  misc_feature: Ceres GEMINI 5101F6
  misc_feature: Useful for making plants with modulated oxidative stress sensitivity
  misc_feature: Useful for making plants with modulated oxidative stress sensitivity
MVNKQGQTRLAQYYEWLTLEERRALEGEIVRKCLARNDQQCSFVEHRNYKIVYRRYASLFFMVGVDDDENELAILEFIHLLVETMDKHFGNVCELDIMFHLEKAHFMLEEMVMNGCIVETSKANILSPIQLMDKAH

SEQ ID NO: 9597 - protein, 57 aa, Arabidopsis thaliana
  misc_feature: Ceres GEMINI 5109A2
  misc_feature: Useful for making plants with altered alkaloid content
  misc_feature: Useful for making plants with altered terpenoid content
MAFDGCCPDCKLPGDDCPLIWGACNHAFHLHCILKWVNSQTSQAHCPMCRREWQFKE

SEQ ID NO: 9598 - protein, 307 aa, Arabidopsis thaliana
  misc_feature: Ceres GEMINI 5109A5
  misc_feature: Useful for making plants with altered alkaloid content
MSRPAPLPPRCPIPKKLSLSPVADTFYSSSSPIESYIGQYKSSTQDSRLEDQPAWLDELLCDKTDGLLTRGGPLRRSASDSVVLLGDISATFSGFDQSEDEESLSSEACGDLESACVYGPNSPRAKNNSSFSNNPIASAFSDYGSQTPPQNLDDTVKGINRSPVAENACGSMGIPNAKRNPGQRSRVRKLQYIAELERTVGMLQTVEADLSVRVASLLQTRATLSLENSQLKQQMAILKQDKLIREGEYQLLKKEAQRLKSGLGYLGSTNNSNRLVRSYSAGSNVAPRTASSHLDWNLLDLTKLNLN

SEQ ID NO: 9599 - protein, 557 aa, Arabidopsis thaliana
  misc_feature: Ceres GEMINI 5109A6
  misc_feature: Useful for making plants with altered alkaloid content
MSARISFLKNPDPCNHLSDYKLRYGTDGYKSFNNLFRCFNDARIKIKLQGIDIPRCSYCSVYQKRLYICLICRSISCSSHILLHTQLNKGHDIAIDVERSELYCCACIDQVYDSEFDEVVVSKQLFGLGMSVKSGADVVAVRSNKKRRLDSQLIIGSNFLVSPRDRREKWTFPLGLRGLNNLGSTCFMNAVLQALVHAPPLRNFWLSGQHNRDLCPRRTMGLLCLPCDLDVIFSAMFSGDRTPYSPAHLLYSWWQHSTNLATYEQQDSHEFFISLLDRIHENEGKSKCLYQDNEECQCITHKAFSGLLRSDVTCTTCGSTSTTYDPFIDISLTLDSMNGFSPADCRKNRYSGGPSVNAIMPTLSGCLDFFTRSEKLGPDQKLNCQSCGEKRESSKQMSIRRLPLLLCLHVKRFEHSLTRKTSRKIDSYLQYPFRLNMSPYLSSSIIGKRFGNRIFAFDGEGEYDSSSSSSPSAEFEIFAVVTHKGMLESGHYVTYLRLKGLWYRCDDAWINEVEEEVVRGCECYMLFYAQETVIQKAHKELSYQVISMADAFPFADC

SEQ ID NO: 9600 - protein, 261 aa, Arabidopsis thaliana
  misc_feature: Ceres GEMINI 5109B4
  misc_feature: Useful for making plants with altered Lignin content
MEDIHNLDIEKSDRSIWLMKCPVVVDKAWHKIAASSSSSFASSDSPPDMAKIVREVDPLRDDSPPEFKMYMVGAEYGNMPKCYALNMFTDFVPMGGFSDVNQGCAAAEGKVDHKFDMKPYGETIEEYARLCRERTSKAMVKNRQIQVIDNDRGVHMRPMPGMLGLVSSNSKEKRKPPPVKQTEVKRTRRDRGELEAIMFKLFEGQPNWTLKQLVQETDQPAQFLKEILNELCVYNKRGSNQGTYELKPEYKKSAEDDTGGQ

SEQ ID NO: 9601 - protein, 99 aa, Arabidopsis thaliana
  misc_feature: Ceres GEMINI 5109C2
  misc_feature: Useful for making plants with altered terpenoid content
MAIFRSTLVLLLILFCLTTFELHVHAAEDSQVGEGVVKIDCGGRCKGRCSKSSRPNLCLRACNSCCYRCNCVPPGTAGNHHLCPCYASITTRGGRLKCP

SEQ ID NO: 9602 - protein, 496 aa, Arabidopsis thaliana
  misc_feature: Ceres GEMINI 5109C6
  misc_feature: Useful for making plants with altered Lignin content
  misc_feature: Useful for making plants with altered alkaloid content
  misc_feature: Useful for making plants with altered terpenoid content
MAGFSLYCFKNPRILFTLPSESPLFVLGSDKCSPATRRPSRKTRGFVVTYAHSNPKIINPKKKSRYGQTLSPYDSDEDDDDDDDDDDDDWLLNDDFAEVTEYEKKKPKSHKQTIAKKSVKKGIVKPEESETDEDDLDLGISPNATSEKKKESWRLDGRGKMSSRKYVEKLYPRLAEEIDIDPKCVPLLDYLSTFGLKESHFVQMYERHMPSLQINVFSAQERLDYLLSVGVKHRDIKRMLLRQPQILQYTVENNLKAHISFLMGLGIPNSKIGQIVAATPSLFSYSVENSLRPTIRYLIEEVGIKETDVGKVVQLSPQILVQRLDITWNTRYMFLSKELGAPRDSVVKMVKKHPQLLHYSIDDGFLPRINFLRSIGMCNSDILKVLTSLTQVLSLSLEDNLKPKYMYLVNELNNEVHILTKYPMYLSLSLDQRIRPRHRFLVELKKVRKGPFPLSSLVPNDESFCQQWAGTSVDTYLAFRQRLLLKEFANKYDKRG

SEQ ID NO: 9603 - protein, 249 aa, Arabidopsis thaliana
  misc_feature: Ceres GEMINI 5109E11
  misc_feature: Useful for making plants with altered alkaloid content
MALDQSFEDAALLGELYGEGAFCFKSKKPEPITVSVPSDDTDDSNFDCNICLDSVQEPVVTLCGHLFCWPCIHKWLDVQSFSTSDEYQRHRQCPVCKSKVSHSTLVPLYGRGRCTTQEEGKNSVPKRPVGPVYRLEMPNSPYASTDLRLSQRVHFNSPQEGYYPVSGVMSSNSLSYSAVLDPVMVMVGEMVATRLFGTRVMDRFAYPDTYNLAGTSGPRMRRRIMQADKSLGRIFFFFMCCVVLCLLLF

SEQ ID NO: 9604 - protein, 710 aa, Arabidopsis thaliana
  misc_feature: Ceres GEMINI 5109F1
  misc_feature: Useful for making plants with altered terpenoid content
MDEGDGRDQMDQFHQNEAISAVADDGFMAEEEDDDYEDLYNDVNVGEGFLQSMKKNDEAGSRNEEKEKVNMEEEDRVEPVLGEAEVSISIPGLVGESVEKEAEAESGGGGSGSGTDVVVASSGYGAQEVKVSDVSQEIPGGIGTGTGGGLRVELGQASNRANDLEAPRGNNISQGLLPPPPVLGNNENLMRPVMGNVNGGIPPGPGSNMVGNGANIAMPGVVGGGTGGGGGGGAFLFVGDLHWWTTDAELEAELCKYGAVKEVKFFDEKASGKSKGYCQVEFYDPVAASACKDALNGYPFNGRPCVVEYASPYSVKRMGEAQVNRTQQAQSVIAQAKRGGPADPPSKPLVANNNNNNNNNAIGGNFQGGENRGFGRGNWGRGNAQGMGGRGPGGPMRNRPNGMGGRGLMGNGGFGQGMGTGPPMNMMHQPMMGQGFEQAFGGPMARMGGYGGFPGAPGPQFPGLLSSFPPVGGVGLPGVAPHVNPAFFGRGMPMNGMGMMPNAGVDGGHNMGMWDPNSGGWGAGEDLGSGRAAESSYGEEAASDHQYGEVNHERGARPNPVKEKERASEREWSGSSDRRNREDKDAGYERDIPREKDVGHGYDMPERRHRDDRDTGREREREHHHKDRERSREHVRDRERERERDRHREERERYGGDHRTRHRDEPEHDEEWNRGRSSRGHNKSRLSREDNHRSKSRDTDYGKRRRLTTE

SEQ ID NO: 9605 - protein, 293 aa, Arabidopsis thaliana
  misc_feature: Ceres GEMINI 5109G4
  misc_feature: Useful for making plants with altered alkaloid content
  misc_feature: Useful for making plants with altered terpenoid content
MAATSEHTILQFVSPSSTASATTSVLTARIHPLVIFNVCDCFVRRPDSAERVIGTLLGSILPDGTVDIRNSYAVPHNESSDQVAVDIDYHHNMLASHLKVNSKETIVGWYSTGAGVNGGSSLIHDFYAREVPNPIHLTVDTGFTNGEGTIKAFVSSNLSLGDRQLVAHFQEIPVDLRMVDAERVGFDVLKATSVDKLPNDLEGMELTMERLLTLINDVYKYVDSVVGGQIAPDNNIGRFIADAVASLPKLPPQVFDNLVNDSLQDQLLLLYLSSITRTQLSLAEKLNTAAQML

SEQ ID NO: 9606 - protein, 536 aa, Arabidopsis thaliana
  misc_feature: Ceres GEMINI 5109G6
  misc_feature: Useful for making plants with altered Lignin content
MNNVLQFGLQSSAIYVAKFLVVPLRSLRVGSSFVGVGVGTRSFNKRLMSNATAFSINNSKRKELKIPGAAIDQNCHQMGSDTDRDEMGTLQDDRKEIEAMTVQELRSTLRKLGVPVKGRKQELISTLRLHMDSNLPDQKETSSSTRSDSVTIKRKISNREEPTEDECTNSEAYDIEHGEKRVKQSTEKNLKAKVSAKAIAKEQKSLMRTGKQQIQSKEETSSTISSELLKTEEIISSPSQSEPWTVLAHKKPQKDWKAYNPKTMRPPPLPEGTKCVKVMTWNVNGLRGLLKFESFSALQLAQRENFDILCLQETKLQVKDVEEIKKTLIDGYDHSFWSCSVSKLGYSGTAIISRIKPLSVRYGTGLSGHDTEGRIVTAEFDSFYLINTYVPNSGDGLKRLSYRIEEWDRTLSNHIKELEKSKPVVLTGDLNCAHEEIDIFNPAGNKRSAGFTIEERQSFGANLLDKGFVDTFRKQHPGVVGYTYWGYRHGGRKTNKGWRLDYFLVSQSIAANVHDSYILPDINGSDHCPIGLILKL

SEQ ID NO: 9607 - protein, 122 aa, Arabidopsis thaliana
  misc_feature: Ceres GEMINI 5109H7
  misc_feature: Useful for making plants with altered Lignin content
MIQLKENVNYLKEKKRTLLQGELGNLYEGSFLLPKLSIRSRDSTIEMNLIMDLNMKRVMLHELVSIFEEEGAQVMSANLQNLNDRTTYTIIAQAIISRIGIDPSRIEERVRKIIYGYIYFEA

SEQ ID NO: 9608 - protein, 379 aa, Arabidopsis thaliana
  misc_feature: Ceres GEMINI 5110B11
  misc_feature: Useful for making plants with altered Lignin content
MLPSRKTKRVFSCDFTPGRKRRRCVVVPSSVSPVPENTTGADLLDSIPDDLVISILCKLGSTSRCPADFINVLLTCKRLKGLAMNPIVLSRLSPKAIAVKAHNWSEYSHRFLKRCVDAGSLEACYTLGMIRFYCLQNRGNGASLMAKAAISSHAPALYSLAVIQFNGSGGSKNDKDLRAGVALCARAAFLGHVDALRELGHCLQDGYGVPQNVSEGRRFLVQANARELAAVLSSGIQARSTWLSLSQPPPPVVPNHGQQTCPLLSDFGCNVPAPETHPANRFLADWFAVRGGDCPGDGLRLCSHAGCGRPETRKHEFRRCSVCGVVNYCSRACQALDWKLRHKMDCAPVQRWLEEGDGGEGNVQIDGNGNGDNVLLPMS

SEQ ID NO: 9609 - protein, 198 aa, Arabidopsis thaliana
  misc_feature: Ceres GEMINI 5110B2
  misc_feature: Useful for making plants with altered alkaloid content
MEDQETKRITKKPSRSIIISLKDIPPLDPSSIPSMKPMAQDHHNVGMQRFQEKTDFKFEEEDNAISSFSNIQIDPNSTRSISLEKKLAPKPDEEHTTTTKPISKDDESKTRRGSAKSVLHEMCASKRWRPPVYECCNVDGPCHLRLFTYKVMVEIRDSSGKTVLECFGDPRRKKKAAAEHAAEGALWYLEHVKTKPHQ

SEQ ID NO: 9610 - protein, 667 aa, Arabidopsis thaliana
  misc_feature: Ceres GEMINI 5110B8
  misc_feature: Useful for making plants with altered alkaloid content
MGSTPFCYSINPSPSKLDFTRTHVFSPVSKQFYLDLSSFSGKPGGVSGFRSRRALLGVKAATALVEKEEKREAVTEKKKKSRVLVAGGGIGGLVFALAAKKKGFDVLVFEKDLSAIRGEGKYRGPIQIQSNALAALEAIDIEVAEQVMEAGCITGDRINGLVDGISGTWYVKFDTFTPAASRGLPVTRVISRMTLQQILARAVGEDVIRNESNVVDFEDSGDKVTVVLENGQRYEGDLLVGADGIWSKVRNNLFGRSEATYSGYTCYTGIADFIPADIESVGYRVFLGHKQYFVSSDVGGGKMQWYAFHEEPAGGADAPNGMKKRLFEIFDGWCDNVLDLLHATEEEAILRRDIYDRSPGFTWGKGRVTLLGDSIHAMQPNMGQGGCMAIEDSFQLALELDEAWKQSVETTTPVDVVSSLKRYEESRRLRVAIIHAMARMAAIMASTYKAYLGVGLGPLSFLTKFRVPHPGRVGGRFFVDIAMPSMLDWVLGGNSEKLQGRPPSCRLTDKADDRLREWFEDDDALERTIKGEWYLIPHGDDCCVSETLCLTKDEDQPCIVGSEPDQDFPGMRIVIPSSQVSKMHARVIYKDGAFFLMDLRSEHGTYVTDNEGRRYRATPNFPARFRSSDIIEFGSDKKAAFRVKVIRKTPKSTRKNESNNDKLLQTA

SEQ ID NO: 9611 - protein, 217 aa, Arabidopsis thaliana
  misc_feature: Ceres GEMINI 5110C3
  misc_feature: Useful for making plants with altered alkaloid content
  misc_feature: Useful for making plants with altered terpenoid content
MANSMATLSRRLYRSLLSNPRISQASMSFCTNNITSPEDSDFDELESPIEPKASDPVSRFSGEERVMEERPLENGLDSGIFKAILVGQVGQLPLQKKLKSGRTVTLFSVGTGGIRNNRRPLINEDPREYASRSAVQWHRVSVYPERLADLVLKNVEPGTVIYLEGNLETKIFTDPVTGLVRRIREVAIRRNGRVVFLGKAGDMQQPSSAELRGVGYY

SEQ ID NO: 9612 - protein, 558 aa, Arabidopsis thaliana
  misc_feature: Ceres GEMINI 5110C6
  misc_feature: Useful for making plants with altered alkaloid content
MEDTRSVASLMDSTSSKIQQLQKAFAELESQRAVTLNLKWKELEEHFHGLERSLKRRFHELEDQEKEYETKTRKAQELLEKKKAAVEAKEKAALERLQKKRDAAMFTINSALDKYNNAPVSKPSVGERWPQNAVEDSSNVFAADSITDDNPDGIVQDVQISPVMGNYEVKAYPQLLKLCGDMDSTGLHKFVSDNRKNLASLKEEIPMAFRAAANPASLVLDSLEGFYPMEAPTADGKKDANLLGMRRTCIMLMECLSILLSGLDRNCLAVVLSQNVKHRAKTIAEGWNPLLESLDMDACNGNSLEAHAFLQLLATFAIVADFKEDELLKLIPMVSRRRQAAELCRSLGLAEKMPGVIEVLVNSGKQIDAVNLAFAFELTEQFSPVSLLKSYLIEARRSSPQGRPGNASPAVQDEFNERELIGLKTVIKCIEEHSLEEQYPVEPLHKRILQLEKAKADKKRATEPMKPQPKRPRGAQPRVTDNNNNINNNKTGYGRVIPERYPQYVYDNRPFLSGPIMAAQPPPPPPPQTYTFNPAPAHGNFYANCYQYQAPPPPPYFH

SEQ ID NO: 9613 - protein, 222 aa, Arabidopsis thaliana
  misc_feature: Ceres GEMINI 5110E1
  misc_feature: Useful for making plants with altered alkaloid content
MDSEPGQPENGTDAEKSVVGKCSETISDSEPGQPENGTEAEKSVVQKCSEKIDESEAGQPENSTEAEKFVVRKCSEKIDGSENVPAAGCVIRTDLNSCPEFEKKPLFLTKNWRNILCRCEKCLEMYKQRKVSYLLDAEDTIVEYEKKAKEKRTEKLEKQEGEALDLLNNLDHVSKVELLHGIKDFQDGLQGLMESAGPSKAITSADIEQMFSKLKNKRKRME

SEQ ID NO: 9614 - protein, 383 aa, Arabidopsis thaliana
  misc_feature: Ceres GEMINI 5110E11
  misc_feature: Useful for making plants with altered alkaloid content
MSSPERALLNLLTDIALSFDGAILGLTLAVSAVGSALKYASTNAALKKIKDAPEVSISDLRSLLPASEDKSETNDNRKSNDQRIVVVRGVVKPKISGDEGYKNNNVLISPETGDKALIIQRTQTYVYSGWKRLFQSTGHRFMLERSLRKHGADFTRTVPFVIVGKDQQSNSSFVAVNMDGSRQPLPLTTVYNRLQPINSSFLQAFLYPDYPVGLLDIEKILPPGKDITAVGIYSFNNGVPEIKSCQDLPYFLSEMTKDKMIEDLMEQTNFIFLGSVILGIVSVGILSYAAVRTWNKWKQWNHQRELPQRPNDSVVDDEPEDADEIPDGELCVICVSRRRVPAFIPCGHVVCCRRCASTVERELNPKCPVCLQSIRGSMRVYYS

SEQ ID NO: 9615 - protein, 320 aa, Arabidopsis thaliana
  misc_feature: Ceres GEMINI 5110E4
  misc_feature: Useful for making plants with altered alkaloid content
MATAVGGGSDVEVGFAKLQGEDFEYYMQSYSIILGRNSKKATVDVDLSSLGGGMNISRNHARIFYDFTRRRFSLEVLGKNGCLVEGVLHLPGNPNVKLDSQDLLQIGDKEFYFLLPVRSILGGPLGPRHHVSGQTSVVPYHNYQSGPGSGSGKKGVRSRELYEYDDEDDDDDDDEEDDMRGSGKKTRRDGHEVVYASGEKKREGRSKVDREADDQQFLQLEEKDVVSSVATVLSDLCGPGEWMPMEKLHSVILKEYGNVWHHSRVRRYLSQEDWAIPEAKGKPWYGLLMLLRKYPEHFVINTRSKGRVTLEFVSLVTLLS

SEQ ID NO: 9616 - protein, 597 aa, Arabidopsis thaliana
  misc_feature: Ceres GEMINI 5110E5
  misc_feature: Useful for making plants with altered Lignin content
MVLSNKKLKQRIRQDLAESLSVSVSETNPQSQSLKLLLDSSSHKPRLSKREKRRNCETFAREDDEIRENEVGNGGSSEKTDTKIKKKRKRDDAVEVDELEGDEGTKEEQKPQKKKNKKKKKKRKVNKTPKKAEEGNVEEKVKVEEIEVNTDNKEEDGVVPNKLYVGGIPYQSTEDEIRSYFRSCGVIIKVDCKMRPEDGAFSGIAFITFDTEDGAKRALAFDRAAMGDRYLTIQQYVKTTTPSIPRRKTSSGFAPEMVDGYNRVYIGNLAWDTTERDIRKLFSDCVINSVRLGKNKETGEFKGYAHVDFKDSVSVAIALKLDQQVICGRPVKICCALKDRPATDHTPGETNNAGSYNMEDTYAAADPVPALAGRSEVDDGNYFATTVSSSKVKRRVCYECGEKGHLSTACPIKLQKADDQANSKLGQETVDGRPAMQSYGLPKNSGDSYYMNETYASTNETYNGGYSASAVGTGKVKRRNCYECGEKGHLSTACPIKLQNTSHTNSTLDHQTVEAGPTQVTSYSLQKKTRDTENNGGSFMDESYATVPISIDVTNGANDASLTSAVSTGKIKKRNCYECGEKGHLSSACPNKLQKQG

SEQ ID NO: 9617 - protein, 717 aa, Arabidopsis thaliana
  misc_feature: Ceres GEMINI 5110E8
  misc_feature: Useful for making plants with altered alkaloid content
MEDADGLSFDFEGGLDSGPVQNTASVPVAPPENSSSAAVNVAPTYDHSSATVAGAGRGRSFRQTVCRHWLRGLCMKGDACGFLHQFDKARMPICRFFRLYGECREQDCVYKHTNEDIKECNMYKLGFCPNGPDCRYRHAKLPGPPPPVEEVLQKIQQLTTYNYGTNRLYQARNVAPQLQDRPQGQVPMQGQPQESGNLQQQQQQQPQQSQHQVSQTLIPNPADQTNRTSHPLPQGLVKFLRFYLTSTVTKTINRPALGWLYPLVLLLSIISLLFSISAVLNGLIASGFQQDSCDPKSHVFFISDWSPRVDCLFLCSSVAILPITYFVVKSNNRENFELSVQQGVWATQRSNEAKLNEAFDSVENVILIFSVNRTRHFQGCAKMTSRIGGYIGGGNWKHEHGTAQYGRNFSVKWLKLCELSFHKTRNLRNPYNENLPVKISRDCQELEPSVGEQLASLLYLEPDSELMAISIAAEAKREEEKAKGVNPESRAENPDIVPFEDNEEEEEEEDESEEEEESMAGGPQGRGRGRGIMWPPQMPLGRGIRPMPGMGGFPLGVMGPGDAFPYGPGGYNGMPDPFGMGPRPFGPYGPRFGGDFRGPVPGMMFPGRPPQQFPHGGYGMMGGGRGPHMGGMGNAPRGGRPMYYPPATSSARPGPSNRKTPERSDERGVSGDQQNQDASHDMEQFEVGNSLRNEESESEDEDEAPRRSRHGEGKKRR

SEQ ID NO: 9618 - protein, 192 aa, Arabidopsis thaliana
  misc_feature: Ceres GEMINI 5110F11
  misc_feature: Useful for making plants with altered terpenoid content
METATGEITIVCNHCDRDIPSLNIDLHRVHCARNLEKCKICGDMVPKKHAEEHYLNTHAPIACSMCKETIEREIFDSHKGEICPKRIVTCEFCEFPLPAVDLAEHQEVCGNRTELCYQCNSYVRLRERYNHETKCPGTVESSRRIPRAAEGDGNGRRRRDGNGVSNKRLFFTIAITGIAVIIGSLFFQRKPE

SEQ ID NO: 9619 - protein, 322 aa, Arabidopsis thaliana
  misc_feature: Ceres GEMINI 5110G12
  misc_feature: Useful for making plants with altered Lignin content
MVMRKLQLPLSQTQKVRFERAIERLQSLSSSANSDASVIVTDSIPVNHDDAFLKGHGTSEVDGELLATVCGVVERVDKLVYVRTLRARYKPEVGDIVVGRVIEVAQKRWRVELNFNQDGVLMLSSMNMPDGIQRRRTSVDELNMRNIFVEHDVVCAEVRNFQHDGSLQLQARSQKYGKLEKGQLLKVDPYLVKRSKHHFHYVESLGIDLIIGCNGFIWVGEHVEVRDPMAIDDQKDEEMISSSSTGKEQSHIPLETRQTICRIGNAIRVLSNLGFTVTLEVIMETVNLSNSKNIDIHDMLGSEFHVVVAENEAERRRTKRKK

SEQ ID NO: 9620 - protein, 493 aa, Arabidopsis thaliana
  misc_feature: Ceres GEMINI 5110G4
  misc_feature: Useful for making plants with altered Lignin content
MESQGPSNGHPMDISSNSIPSSACNLCGRVVQSASDDLEIFSLCVDCKFLLLEDFGTPAPPLARRQTIRRRRMRRRRRTTRHDSSESVGVGDLSSQQFTHLISIARQSLSTVQASEDLRDDLRTSSHTTPSGSTRWRLFSESESDDFDNFGETESNASFSLYRFPHADNDTISFSAYGGESDASTDRHADIFVQPDDRSDIDFDTDIDPMRAGLNQWNSDEEDREWEEGAGPSGVAGTRYRNYLASPSESYSSMTRFDSPELERSFRQRIIERRHSLSRNIFTGLEDLDFSPYAANVGDYLDERGFDELLEQLAESDNSRRGAPPASVSCVRNLPRVIIAEEHVMKGLVCAICKELFSLRNETTQLPCLHLYHAHCIVPWLSARNSCPLCRYELPTDDKDYEEGKRNVLDVSEDSSSSDDGTESGEEEYVERGESESGVSRVSRGRWLFLAAAPVVSLVGVVLAMWLSSPHRRGIAISHSQRENRTRRWLPFF

SEQ ID NO: 9621 - protein, 387 aa, Arabidopsis thaliana
  misc_feature: Ceres GEMINI 5110H5
  misc_feature: Useful for biocontainment applications
  misc_feature: Useful for making plants with altered Lignin content
  misc_feature: Useful for making plants with altered alkaloid content
  misc_feature: Useful for making plants with altered terpenoid content
  misc_feature: The leaves start out wild- type green and gradually turn yellow-green in color, while the cotyledons stay wild-type green.
MGSSEMEKSGKEKEPKTTPPSTSSSAPATVVSQEPSSAVSAGVAVTQDWSGFQAYSPMPPHGYVASSPQPHPYMWGVQHMMPPYGTPPHPYVTMYPPGGMYAHPSLPPGSYPYSPYAMPSPNGMAEASGNTGSVIEGDGKPSDGKEKLPIKRSKGSLGSLNMIIGKNNEAGKNSGASANGACSKSAESGSDGSSDGSDANSQNDSGSRHNGKDGETASESGGSAHGPPRNGSNLPVNQTVAIMPVSATGVPGPPTNLNIGMDYWSGHGNVSGAVPGVVVDGSQSQPWLQDEREIKRQRRKQSNRESARRSRLRKQAECDELAQRAEVLNGENSSLRAEINKLKSQYEELLAENSSLKNKFSSAPSLEGGDLDKNEQEPQRSTRQDVA

SEQ ID NO: 9622 - protein, 409 aa, Arabidopsis thaliana
  misc_feature: Ceres GEMINI 5111B1
  misc_feature: Useful for making plants with altered terpenoid content
MASSKGSQSVRNLMYPGKHALLPPKIPFPSVSASYSEYIPTGLIGSRHGQKLSNEKTHHQRTSSESHLVEELPFWLDDLLNEQPESPARKCGHRRSSSDSYAYLDVANATNISLTLQNDFSYRNTVLSTQRGVQELDRNKNAQDAAFYSGASFLKQKSRQRDSLVATGACPSWLPFARENGGGKNLGALYMSQDATVISSERKNYAEPFSHDPKMLSSEENNSNPSPVTYEADNTKRAKQQFAQRSRVRKLQYISELERNVQTLQAEGSKVSAELDFLNQRNLILSMENKALKKRLESIAQEKLIKQSSYQDSTVLKIVYLMSSVYYPVEQEVLEKEIGRLRALYQQQQQTQKPSASRGRATSKDLDSQFSSLSLNTKDSNCRRDSVSVMGPGDSTRSDPYLPPHHRRF

SEQ ID NO: 9623 - protein, 350 aa, Arabidopsis thaliana
  misc_feature: Ceres GEMINI 5111D1
  misc_feature: Useful for making plants with altered alkaloid content
MALSSAGVVSHLHPPSFSSSSGLSVNRVLFRNRNASPCGLSLPILNPSRSVLVFARGKNRKGFVSSSSSSPKKNKKKSLDGADNGGGEEEEDPFEALFNLLEEDLKNDNSDDEEISEEELEALADELARALGVGDDVDDIDLFGSVTGDVDVDVDNDDDDNDDDDNDDDDDDSEEDERPTKLKNWQLKRLAYALKAGRRKTSIKNLAAEVCLDRAYVLELLRDPPPKLLMLSATLPDEKPPVAAPENSSPDPSPVESLSAEDVVVEPKEKVKDEAVHVMQQRWSAQKRVKKAHIETLEKVYRRSKRPTNAVVSSIVQVTNLPRKRVLKWFEDKRAEDGVPDKRAPYQAPV

SEQ ID NO: 9624 - protein, 86 aa, Arabidopsis thaliana
  misc_feature: Ceres GEMINI 5118E5
  misc_feature: Useful for making plants with modulated biomass
  misc_feature: Useful for making plants with modulated low light sensitivity
  misc_feature: The plants are small.
MEESKKYKSMVKQTMNKKKKNNNKKGHGSGSRSGLLQMKVRRLQILIPGGQTCNHPDLLLSKTVDYIVHLKLKLRFLKAISEMYSL

SEQ ID NO: 9625 - protein, 340 aa, Arabidopsis thaliana
  misc_feature: Ceres GEMINI 5130B2
  misc_feature: Useful for making plants with modulated nitrogen use efficiency
MESLGKLQLHHQPFHLSFTHTSSSTFPKNLFKSSIQPISSLKSASIKASSSKFQNSITPLPKSTPFRLFKSTCITLTTAAALLLANLHLKSPAIAAPIAPPPSVESKENVTLEEEERALDEHLITHPSDVDALRSLMEVKIKSRKLTEAVEVIDRLIKLEPEEKEWPVLKANIFTYSGDLDLAKTGFEEILAKDPLRVEAYHGLLMAYSDAGLDLKEVESRIEEAMLKCKKENNQNDFRDFKLLVAQIRVIEGKHSEALKLYQELVKEEPRDFRPYLCQGIIYTLLKKKDKAEEQFDNFRKLVPKNHPYREYFMDNMIATKLFSEKAQREMAEEMAGSTS

SEQ ID NO: 9626 - protein, 108 aa, Arabidopsis thaliana
  misc_feature: Ceres CLONE 5132
  misc_feature: Useful for making plants with modulated flowering time
  misc_feature: The plant flowers significantly late compared to wild-type.
MATSKLQAIWNHPAGPKTIHFWAPTFKWGISIANIADFAKPPEKLSYPQQIAVTCTGVIWSRYSMVINPKNWNLFSVNVAMAGTGIYQLARKIKHDYATEAEPAVASE

SEQ ID NO: 9627 - protein, 216 aa, Arabidopsis thaliana
  misc_feature: Ceres GEMINI 5149G2
  misc_feature: Useful for making plants with modulated nitrogen use efficiency
MNGEEVKTSQPQKKLQNPTPRLNERILSSLSKRSVAAHPWHDLEIGPGAPVIFNVVIEISKGSKVKYELDKKTGLIKVDRILYSSVVYPHNYGFVPRTLCEDNDPIDVLVIMQEPVLPGCFLRARAIGLMPMIDQGEKDDKIIAVCVDDPEYKHITNINELPPHRLSEIRRFFEDYKKNENKEVAVNDFLQPGPAIEAIQYSMDLYAEYILHTLRR

SEQ ID NO: 9628 - protein, 321 aa, Arabidopsis thaliana
  misc_feature: Ceres GEMINI 5154A4
  misc_feature: Useful for making plants with altered Lignin content
  misc_feature: Useful for making plants with altered cell wall content and/or composition
MADVHKGKVCVTGAGGFLGSWVVDLLLSKDYFVHGTVRDPDNEKYAHLKKLEKAGDKLKLFKADLLDYGSLQSAIAGCSGVFHVACPVPPASVPNPEVELIAPAVDGTLNVLKACIEANVKRVVYVSSVAAAFMNPMWSKNQVLDEACWSDQEYCKKTENWYCLAKTRAESEAFEFAKRTGLHLVSVCPTLVLGPILQQNTVNASSLVLLKLLKEGFETRDNQERHLVDVRDVAQALLLVYEKAEAEGRYICTSHTVKEEIVVEKLKSFYPHYNYPKKYIDAEDRVKVSSEKLQKLGWTYRPLEETLVDSVESYRKAKLVD

SEQ ID NO: 9629 - protein, 393 aa, Arabidopsis thaliana
  misc_feature: Ceres GEMINI 5156A11
  misc_feature: Useful for making plants with modulated biomass
  misc_feature: Useful for making plants with modulated low light sensitivity
  misc_feature: The rosette leaves do not appear in the normal fashion, i.e., their phyllotaxy may be abnormal or too many leaves may be emerging in comparison to the control.
MFSWLARMALFCLRPMRRYGRMNRDDDDDDDHDGDSSSSGDSLLWSRELERHSFGDFSIAVVQANEVIEDHSQVETGNGAVFVGVYDGHGGPEASRYISDHLFSHLMRVSRERSCISEEALRAAFSATEEGFLTLVRRTCGLKPLIAAVGSCCLVGVIWKGTLLIANVGDSRAVLGSMGSNNNRSNKIVAEQLTSDHNAALEEVRQELRSLHPDDSHIVVLKHGVWRIKGIIQVSRSIGDAYLKRPEFSLDPSFPRFHLAEELQRPVLSAEPCVYTRVLQTSDKFVIFASDGLWEQMTNQQAVEIVNKHPRPGIARRLVRRAITIAAKKREMNYDDLKKVERGVRRFFHDDITVVVIFIDNELLMVEKATVPELSIKGFSHTVGPSKFSIFLS

SEQ ID NO: 9630 - protein, 385 aa, Arabidopsis thaliana
  misc_feature: Ceres GEMINI 5163C11
  misc_feature: Useful for making plants with modulated drought sensitivity
  misc_feature: Useful for making plants with modulated flowering time
  misc_feature: The plant flowers significantly late compared to wild-type.
MDMKSGHSSPVMTDSPPISNSRLTIRQNRLPYSSAAATAISQNNNLLLTVPRKKTGILDDVKSNGWLDAMKSSSPPPTILNKDNLSNDATDMTYREWMQLKYPSALTSFEKIMSFAKGKRIALFLDYDGTLSPIVEEPDCAYMSSAMRSAVQNVAKYFPTAIISGRSRDKVYEFVNLSELYYAGSHGMDIMSPAGESLNHEHSRTVSVYEQGKDVNLFQPASEFLPMIDKVLCSLIESTKDIKGVKVEDNKFCISVHYRNVEEKNWTLVAQCVDDVIRTYPKLRLTHGRKVLEIRPVIDWDKGKAVTFLLESLGLNNCEDVLPIYVGDDRTDEDAFKVLRDGPNHGYGILVSAVPKDSNAFYSLRDPSEVMEFLKSLVTWKRSMG

SEQ ID NO: 9631 - protein, 452 aa, Arabidopsis thaliana
  misc_feature: Ceres GEMINI 5166B2
  misc_feature: Useful for making plants with altered Lignin content
  misc_feature: Useful for making plants with altered cell wall content and/or composition
MGFFLCSSSSIFFKFGISIIFLVSFSGLTPSEAYDPLDPSGNITVKWDIITWTGDGYVATVTVYNFQQYRHIQAPGWTLGWSWAKREVIWGMNGGQTTEQGDCSKFKGTIPHCCKKTPSVVDLLPGSPYNQQIANCCRGGVLNSWAQDPATAVSAFQLTVGQAGTTNKTVRVPKNFTLKAPGPGYTCSPAKIVKPTRFIGTDKRRVTQALMTWNVTCTYSQFLAQKTPTCCVSLSSFYNKTIVSCPTCSCGCRNTSQPGNCVDPKGPRIASVIPNPGKNAYIPPLVQCTKHMCPVRIHWHVKVNYKQYWRVKVTITNFNYNMNYSQWNLVVQHPNFDNLTQTFSFNYKPLTPYASINDTGILWGIKFYNDLLMQAGPFGNVQSELLFQKEASAFTFEKGWAFPRRIYFNGDNCVMPPPDSYPWLPNTGSHKSVGSLFAAMALLLIVFLHGNL

SEQ ID NO: 9632 - protein, 389 aa, Arabidopsis thaliana
  misc_feature: Ceres GEMINI 5170H8
  misc_feature: Useful for making plants with altered Lignin content
  misc_feature: Useful for making plants with altered cell wall content and/or composition
MANGADRLDLDGKPIKPMTICMIGAGGFIGSHLCEKLMTETPHKVLALDVYNDKIKHLLEPDTVQWAGRIQFHRINIKHDSRLEGLIKMADLTINLAAICTPADYNTRPLDTIYSNFIDALPVVKYCSENNKRLIHFSTCEVYGKTIGSFLPKDHPLRQDPEFYVLKEDISPCIFGSIEKQRWSYACAKQLIERLVYAEGAENGLEFTIVRPFNWIGPRMDFIPGIDGPSEGVPRVLACFSNNLLRREPLKLVDGGESQRTFIYIKDAIEAVLLMIENPERANGHIFNVGNPNNEVTVRQLAEMMTEVYAKVSGETAIESPTIDVSSKEFYGEGYDDSDKRIPDMTIINRQLGWNPKTSLWDLLESTLTYQHTTYAEAIKKATSKPVAS

SEQ ID NO: 9633 - protein, 525 aa, Arabidopsis thaliana
  misc_feature: Ceres GEMINI 5173B9
  misc_feature: Useful for making plants with altered Lignin content
  misc_feature: Useful for making plants with altered cell wall content and/or composition
MTVMNHRHKQCHFLLLLLITVFSAALDGVSSETDVGGFDYGEALSKSLLYFEAQRSGRLPYNQRVTWRDHSGLTDGLEQGVDLVGGYHDAGDHVKFGLPMAFTVTMLSWSVIEYGDSLASTGELSHALEAIKWGTDYFIKAHTSPNVLWAEVGDGDTDHYCWQRPEDMTTSRRAFKIDENNPGSDIAGETAAAMAAASIVFRSTNPHYSHLLLHHAQQLFEFGDKYRGKYDESLKVVKSYYASVSGYMDELLWGATWLYRATDNEHYMSYVVDMAHQLGGLSWAMSEFSWDVKFAGVQLLASMLLKEEKHKQHSKVLQQYKSKADHYLCSILNKNINGTNVQRTPAGLLYVRQWNNMQYVSTASFLLTVYSDHLRKSNTDLECHEGTVTPDEMLGFAKSQIDYILGSNPMETSYLVGYGPKYPIRVHHRGASIASFKEHKGFIGCTQGYDNWYGRSEPNPSVLVGALVGGPDHQDDFDDRRGNYVQTEACTYNTAPLVGVFARLIELEEQKLEEEDVSLVATYKR

SEQ ID NO: 9634 - protein, 125 aa, Arabidopsis thaliana
  misc_feature: Ceres CLONE 5198
  misc_feature: Useful for making plants with modulated biomass
  misc_feature: The plant is abnormally small.
MAAKLRISSSSFSHRTNDSKTSSSSSYSSLLALPQFLCPPSPLGFPQFKLHAKLGGRDGEVKPKDKKKFITKEEEPEQYWQSVGEREGENPMKTPLPYIIIFGMSTPFVILAIAFANGWIKVPIR

SEQ ID NO: 9635 - protein, 461 aa, Arabidopsis thaliana [sequence omitted]

SEQ ID NO: 9636 - protein, 279 aa, Arabidopsis thaliana
  misc_feature: Ceres CLONE 5220
  misc_feature: Useful for biocontainment applications
  misc_feature: The leaves start out wild- type green and gradually turn yellow-green in color, while the cotyledons stay wild-type green.
MAVSFNTTLHQPSLSPSCSIKLYSGLKPQSASFLASGYQNLNKEFYGRVHKSLQSGTGKASRSRVKMMPIGTPRVPYRNREEGTWQWVDIWNALYRERVIFIGQNIDEEFSNQILATMLYLDTLDDSRRIYMYLNGPGGDLTPSLAIYDTMKSLKSPVGTHCVGLAYNLAGFLLAAGEKGHRFAMPLSRIALQSPAGAARGQADDIQNEAKELSRIRDYLFNELAKNTGQPAERVFKDLSRVKRFNAEEAIEYGLIDKIVRPPRIKEDAPRQDESAGLG

SEQ ID NO: 9637 - protein, 497 aa, Glycine max
  misc_feature: Ceres CLONE 534281
  misc_feature: Useful for making plants with altered Lignin content
  misc_feature (99)..(99): Xaa is any aa, unknown, or other
MNHNNSNNSNNNRARYPPGMGLGRGGFNPNLSQNPNQNQNHHAFQARPPYHQQQQAQYVQRHLLQQQQQQQWLRRDANAVDEVEKTVQSEAVDSSSQDXKARLKIPPADTRYKTEDVTATKGNEFEDYFLKRELLMGIYEKGFERPSPIQEESIPIALTGSDILARAKNGTGKTAAFCIPALEKIDQDNNVIQVVILVPTRELALQTSQVCKELGKHLKIQVMVTTGGTSLKDDILRLYQPVHLLVGTPGRILDLTKKGVCILKDCAMLVMDEADKLLSPEFQPSIEQLIHFLPTTRQILMFSATFPVTVKDFKDRYLQKPYVINLMDELTLKGITQFYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKNAETYLHRVGRSGRFGHLGLAVNLITYEDRFNLYRIEQELGTEIKQIPPQIDQAIYCR

SEQ ID NO: 9638 - protein, 134 aa, Arabidopsis thaliana
  misc_feature: Ceres CLONE 5392
  misc_feature: Useful for biocontainment applications
  misc_feature: The plant produces a reduced number of seeds.
MAKEGTTVIGVPYYAGQNPYQAGIVPPNAIYGDPLGAPIQQTIYRDTPAPFNCLYCGNTGLTNLRSKPGVAAVVACMMPFMLGFCFLCPSMDCLWNKQHHCPQCGNKVADFEKSDPCLVMDPPQWKQPSFALPA

SEQ ID NO: 9639 - protein, 375 aa, Glycine max
  misc_feature: Ceres CLONE 541719
  misc_feature: Useful for making plants with altered Lignin content
MEGSSCSNDTSYLLAFGENSGGLCPMTMMPLVTSHHATNPSNPSNNTNNNENTNCLFIPNCSNSSGTPSIMLHNNNNTDDDNNKTSTNTGLGYYFMESDHHHRNNNNNGSSSSSSSSAVKAKIMAHPHYHRLLAAYVNCQKVGAPPEVVARLEEACASAATMAGDAAAAAGSSCIGEDPALDQFMEAYCEMLTKYEQELSKPLKEAMLFLQRIECQFKNLTISSTDFACNEGAERNGSSEEDVDLHNMIDPQAEDRELKGQLLRKYSGYLGSLKQEFMKKRKKGKLPKEARQQLLEWWSRHYKWPYPSESQKLALAESTGLDQKQINNWFINQRKRHWKPSEDMQFVVMDPSHPHYYMDNVLGNPFPMDLSHPML

SEQ ID NO: 9640 - protein, 216 aa, Glycine max
  misc_feature: Ceres CLONE 543118
  misc_feature: Useful for making plants with altered Lignin content
  misc_feature (123)..(123): Xaa is any aa, unknown, or other
MAAAPARARADYDYLIKLLLIGDSGVGKSCLLLRFSDGSFTTSFITTIGIDFKIRTIELDSKRIKLQIWDTAGQERFRTITTAYYRGAMGILLVYDVTDEASFNNIRNWIRNIEQHASDNVNXILVGNKADMDESKRAVPTSKGQALADEYGIKFFETSAKTNMNVEEVFFSIARDIKQRLADTDSRAEPQTIKINQPDQATSGGQPAQKSACCGS

SEQ ID NO: 9641 - protein, 359 aa, Glycine max
  misc_feature: Ceres CLONE 543325
  misc_feature: Useful for making plants with modulated nitrogen use efficiency
MNNPNGGICFLLFLFLFPFAAAQPATNQNQSYYNKFSPSMAIIIVILIAALFLMGFFSIYIRHCSDSPSASIRNLAAATGRSRRGTRGLEQAVIDTFPTLEYSAVKIHKLGKGTLECAVCLNEFEDTETLRLIPKCDHVFHPECIDEWLASHTTCPVCRANLVPQPGESVHGIPILNAPEDIEAQHEAQNDLVEPEQQQQDPKPPVPTEPQVLSLNQTLNRNRTRGSRSGRPRRFPRSHSTGHSLVLPGEDTERFTLRLPEEVRKQILQNPQLHRARSLVILPREGSSRRGYRTGEGSSRGRSSRRLDRGFKSDRWVFTMAPPFLVRASSIRSPRVANNGGEGTSAAASLPPPPAVESV

SEQ ID NO: 9642 - protein, 280 aa, Glycine max
  misc_feature: Ceres CLONE 557012
  misc_feature: Useful for making plants with modulated salt sensitivity
  misc_feature: Useful for making plants with modulated salt sensitivity
MSTTGTVLASTPTQRLLGKVALVTGGASGIGESIVRLFHIHGAKICIADVQDNLGKQVCQSLGDEANVVFVHCDVTVEDDVSHAVDFTVGKFGTLHIIVNNAGISGSPCSDIRNADLSEFDKVFSVNTKGVFHGMKHAARIMIPKKKGSIISLCSVASAIGGLGPHAYTGSKYAVLGLTKNVAAELGKHAIRVNCVSPYGVATGLALAHLPEDERTDDALVSFRDFTGRMANLQGVELTTHDVANAVLFLASDDAKYISGENLMVDGGFTSANHSLQVFR

SEQ ID NO: 9643 - protein, 460 aa, Glycine max
  misc_feature: Ceres CLONE 560066
  misc_feature: Useful for biocontainment applications
  misc_feature: Useful for making plants with modulated salt sensitivity
  misc_feature: The plant produces a reduced number of seeds.
MAKKKSWFSLVKRLFIWDTHSTQDKKEKRRKWIFGRLKSKRLPSIKAPLPSKGTTLSEAEQEQSKHALTVAIASAAAAEAAVTAAHAAAEVVRLTGQRNENSEESQPVKTRNGAPQSTYQCQREIKESAAAIKIQTAFRGYLARKALRALKGIVKLQAIIRGRAVRRQAMSSLKCLQSIVSIQSQVCARRLQMVEGRCDYSENEEMQDFKDKIIRMDSNSERKWDESTVLKEEVDTSCTSKRERTKEYSFNHRRSAESERSKVNGRWRYWLEQWVDTQLSKSKELEDLDSVFSSHSRAGEEYGGRQLKLRSNIQRQNPVEGLDSPILGSRRSFPHRRQCSVGEDHSFLSSPATPAYMAATESAKAKARSTSSPKIRTGGNVDMNSDSYSPCKKKLSIASSINSEMLSNGRVGKLSVNQQQRSPSFKGLSVPIKSSRTTIKDLSINSDCSLPNWDRQAFFK

SEQ ID NO: 9644 - protein, 91 aa, Glycine max
  misc_feature: Ceres CLONE 560681
  misc_feature: Useful for making plants with altered terpenoid content
  misc_feature: Useful for making plants with modulated nitrogen use efficiency
MSSRRSRQQSASTRISDDQIIDLVSKLRQLVPEIRDRRSDKVSASKVLQETCNYIRSLHREVDDLSERLSQLLATIDADSPEAAIIRSLIN

SEQ ID NO: 9645 - protein, 114 aa, Glycine max
  misc_feature: Ceres CLONE 560692
  misc_feature: Useful for making plants with modulated salt sensitivity
MKQKCLVVLVFVVLLACAFGWDEGIPGGWNPIKNINDPHVTEIANFAVTEYDKQSGEKLKLVKVIKGDLQVVAGLNYRLSLTASDSNNYQAIVYEKAWAREHYRNLTSFTPLHA

SEQ ID NO: 9646 - protein, 272 aa, Glycine max
  misc_feature: Ceres CLONE 566317
  misc_feature: Useful for biocontainment applications
  misc_feature: The plant produces a reduced number of seeds.
MKTLVMDTTSSTPQDSSSSKRHFHWTNKVGNEDPQLATSETMSKIIEEEDTNTKEKEQEEDDKAVPLPGPATKRKIQAVAISRLRSVLTVFSKNHRSNLPFGLGSRVVGTLFGYRRGHVHFAFQRDPTSQPAFLIELATPISGLVREMASGLVRIALECDKDKDSEEKKTTKKNKTLRLLQESVWRTYCNGKKCGFATRRECGAKDWDILKAVEPISMGAGVLPNSDGSDGEVMYMRARFERIVGSRDSEAFYMMNPDSNGAPELSIYLLRV

SEQ ID NO: 9647 - protein, 205 aa, Arabidopsis thaliana
  misc_feature: HVG ID no. 58
  misc_feature: Useful for making plants with modulated drought sensitivity
MLTEEELKRLYRIQKTLMQMLRDRGYFIADSELTMTKQQFIRKHGDNMKREDLVTLKAKRNDNSDQLYIFFPDEAKVGVKTMKMYTNRMKSENVFRAILVVQQNLTPFARTCISEISSKFHLEVFQEAEMLVNIKEHVLVPEHQVLTTEEKKTLLERYTVKETQLPRIQVTDPIARYFGLKRGQVVKIIRPSETAGRYVTYRYVV

SEQ ID NO: 9648 - protein, 138 aa, Arabidopsis thaliana
  misc_feature: Ceres CLONE 5864
  misc_feature: Useful for making plants with modulated nitrogen use efficiency
MAKKKELLSKAPWRGDDEDDSDKFSNAKLKVTKDSDGMSKMHVPSRGTKKGSLADDDDDSLEIDPQLRYSFNRNYQFLQSVFTIDTLVKPLPPSMAFNVSRNLSFFTRIFTQFFDPEGIANAQKSLGLGQEEKARRVR

SEQ ID NO: 9649 - protein, 298 aa, Oryza sativa
  misc_feature: HVG ID no. 588
  misc_feature: Useful for making plants with modulated silicon content
MASNNSRTNSRANYSNEIHDLSTVQNGTMPTMYYGEKAIADFFPPHLLKKVVSEVVATFLLVFMTCGAAGISGSDLSRISQLGQSIAGGLIVTVMIYAVGHISGAHMNPAVTLAFAVFRHFPWIQVPFYWAAQFTGAICASFVLKAVIHPVDVIGTTTPVGPHWHSLVVEVIVTFNMMFVTLAVATDTRAVGELAGLAVGSAVCITSIFAGAISGGSMNPARTLGPALASNKFDGLWIYFLGPVMGTLSGAWTYTFIRFEDTPKEGSSQKLSSFKLRRLRSQQSIAADDVDEMENIQV

SEQ ID NO: 9650 - protein, 72 aa, Arabidopsis thaliana
  misc_feature: HVG ID no. 59
  misc_feature: Useful for making plants with modulated drought sensitivity
MSGLQAQDSACSLDKPSKDVVATATKPKKRICCACPDTKKLRDECIVEHGESACTKWIEAHILCLRSESFKV

SEQ ID NO: 9651 - protein, 483 aa, Glycine max
  misc_feature: Ceres CLONE 590462
  misc_feature: Useful for making plants with modulated biomass
  misc_feature: The plant is abnormally small.
MDSNGYLVVGVVAFALLCSFRVSLTDSVPLFSPVHDAASLTRNSFPAGFIFGAGSSAYQFEGAAKEGGRGPSIWDTFTHNHPEKIRDGANGDVAVDQYHRYKEDVKIMKDMNLDSYRFSISWPRILPKGKLSGGVNQEGINYYNNLINELLANGVLPYVTLFHWDLPQALEDEYGGFLSSHIVQGGYATGATAPGRCTGPQCLGGDAGTEPYIVTHNQILAHAAAVHVYKTKYQAHQKGKIGITLVSNWFIPLAENSTSDIKAARRAIDFQYGWYMEPLTKGEYPKNMRALVGSRLPKFTKWQAKLVNGSFDFIGLNYYSSGYINGVPPSNDKPNFLTDSRTNTSFERNGRPLGLRAASVWIYFYPRGLLDLLLYTKEKYNNPLIYITENGMNEFNDPTLSVEEALMDIYRIDYYYRHFFYLRSAIKAGANVKGFFAWSFLDCNEWFAGFTVRFGLNFVDYKDGLKRYPKLSAQWYKNFLKRN

SEQ ID NO: 9652 - protein, 116 aa, Arabidopsis thaliana
  misc_feature: Ceres CLONE 5915
  misc_feature: Useful for making plants with modulated nitrogen use efficiency
MALDTYASSNPNDVHEDVLLKARDACYKARDAFYACLEKESGKKPTEIATVGLLYPKECSNSRTQFVNNCRSSWVKHFDREYCRNKRVQRLLDDGDERKGPMSLPQPYTFKPSPST

SEQ ID NO: 9653 - protein, 361 aa, Zea mays
  misc_feature: HVG ID no. 592
  misc_feature: Useful for making plants with modulated drought sensitivity
MTKHAAYSSEDVVAAVAAPAPAGRHFTSFQALKGAPLDCKKHAAVDLSASGAAVVGGGPWFESMKASSPRRAADAEHGDWMEKHPSALAQFEPLLAAAKGKQIVMFLDYDGTLSPIVEDPDRAVMSEEMREAVRRVAEHFPTAIVSGRCRDKVLNFVKLTELYYAGSHGMDIQGPAACRQPNHVQQAEAAAVHYQAASEFLPVIEEVFRTLTAKMESIAGARVEHNKYCLSVHFRCVREEEWNAVNEEVRSVLREYPNLKLTHGRKVLEIRPSIKWDKGKALEFLLKSLGYAGRNDVFPIYIGDDRTDEDAFKVLRNMGQGIGILVSKLPKETAASYSLSDPAEVKEFLRKLANKKGARQP

SEQ ID NO: 9654 - protein, 384 aa, Glycine max
  misc_feature: Ceres CLONE 597624
  misc_feature: Useful for making plants with altered Lignin content
  misc_feature: Useful for making plants with altered alkaloid content
MDAISCLDESTTTESLSISQAKPSSTIMSSEKASPSPPPPNRLCRVGSGASAVVDSDGGGGGGSTEVESRKLPSSKYKGVVPQPNGRWGSQIYEKHQRVWLGTFNEEDEAARAYDVAVQRFRGKDAVTNFKPLSGTDDDDGESEFLNSHSKSEIVDMLRKHTYNDELEQSKRSRGFVRRRGSAAGAGNGNSISGACVMKAREQLFQKAVTPSDVGKLNRLVIPKQHAEKHFPLQSAANGVSATAAAAKGVLLNFEDVGGKVWRFRYSYWNSSQSYVLTKGWSRFVKEKNLKAGDTVCFQRSTGPDRQLYIDWKTRNVVNEVALFGPVVEPIQMVRLFGVNILKLPGSDSIANNNNASGCCNGKRREMELFSLECSKKPKIIGAL

SEQ ID NO: 9655 - protein, 341 aa, Arabidopsis thaliana
  misc_feature: HVG ID no. 598
  misc_feature: Useful for making plants with modulated flowering time
MPRPFFHKLIFSSTIQEKRLRVPDKFVSKFKDELSVAVALTVPDGHVWRVGLRKADNKIWFQDGWQEFVDRYSIRIGYLLIFRYEGNSAFSVYIFNLSHSEINYHSTGLMDSAHNHFKRARLFEDLEDEDAEVIFPSSVYPSPLPESTVPANKGYASSAIQTLFTGPVKAEEPTPTPKIPKKRGRKKKNADPEEINSSAPRDDDPENRSKFYESASARKRTVTAEERERAINAAKTFEPTNPFFRVVLRPSYLYRGCIMYLPSGFAEKYLSGISGFIKVQLAEKQWPVRCLYKAGRAKFSQGWYEFTLENNLGEGDVCVFELLRTRDFVLKVTAFRVNEYV

SEQ ID NO: 9656 - protein, 150 aa, Glycine max
  misc_feature: Ceres CLONE 599633
  misc_feature: Useful for making plants with altered alkaloid content
MAKKAKGSHSASSASASSSSDKLVLRIKSNEGTKRSVRQTNSRKKLKAKQKKNKQKFDAMKPRKPPTAFFYFLEDFRKEFQEQNPDVKSMRDIGKACGEKWKTMTYEEKVQYYDIATKKREEFDSAMAEFNKKMENGEFDETDDESEFDE

SEQ ID NO: 9657 - protein, 268 aa, Arabidopsis thaliana
  misc_feature: Ceres CLONE 6042
  misc_feature: Useful for making plants with altered Lignin content
  misc_feature: Useful for making plants with altered cell wall content and/or composition
MSMTADSQSDYAFLESIRRHLLGESEPILSESTASSVTQSCVTGQSIKPVYGRNPSFSKLYPCFTESWGDLPLKENDSEDMLVYGILNDAFHGGWEPSSSSSDEDRSSFPSVKIETPESFAAVDSVPVKKEKTSPVSAAVTAAKGKHYRGVRQRPWGKFAAEIRDPAKNGARVWLGTFETAEDAALAYDRAAFRMRGSRALLNFPLRVNSGEPDPVRIKSKRSSFSSSNENGAPKKRRTVAAGGGMDKGLTVKCEVVEVARGDCLLVL

SEQ ID NO: 9658 - protein, 452 aa, Glycine max
  misc_feature: Ceres CLONE 609573
  misc_feature: Useful for making plants with modulated biomass
  misc_feature: The plant is abnormally small.
METGGGRDSGMSSETINSSTQRTSMSNESVCSTSFSRLSFDLPPPSSSPETLFVKPHRSSDFAYSAILRRKSALTFRDFHLLRRIGAGDIGTVYLCRLRHDAGDEDDDEDPCFYAMKVVDKEAVALKKKAQRAEMERKILKMVDHPFLPTLYAEFEASNFSCIVMEYCSGGDLHSLQHNHPNNRFSLSSARFYAAEVLVALEYLHMLGIIYRDLKPENVLVRSDGHIMLSDFDLSLCSDAIPAVESPDCSLDPAFAPALRYTRQYSTPFSCLSNRVFRSRKVQTLQPNRLFVAEPVGARSCSFVGTHEYVSPEVASGNSHGNAVDWWSFGIFIYEMVYGRTPFAGSSNEATLRSIIKKPLAFPTSTPSSTLEMHARDLISGLLNKDPNRRLGSKRGSADVKKHPFFAGLNLALIRTVTPPEVPSLRRHKTTPFYYPANVNNSRQQLTAFDYF

SEQ ID NO: 9659 - protein, 365 aa, Arabidopsis thaliana
  misc_feature: Ceres CLONE 641
  misc_feature: Useful for biocontainment applications
  misc_feature: The plant produces a reduced number of seeds.
MSSPATTITFFFFFTLSSFFYITSSLQNNNNNNNKHTATVNSLNIPSAAAEITLVNPKLPPRSLSLTSSKKFEGSSNLVHLRYHMGPVLSSSPINIYVIWYGQWSRPHKSLIRDFLNSISDAKAPSPSVSEWWRTASLYTDQTGSNVSRSVLIAGEYSDSKYSHGQHLTRLTIQEVIASAARSASFPVDHKNGMYLVLTSHDVTMQDFCRAVCGFHYFTFPSMVGYTMPYAWVGQSGKQCPEVCAYPFALPGYMGHGGPGELRPPNGETGVDGMVSVIGHELAEVVSNPLINAWYAGEDPTAPTEIGDLCEGLYGSGGGGGYIGQVMRDREGKTFNMNGKGGRKFLVQWIWNPNLKACSGPNSVD

SEQ ID NO: 9660 - protein, 146 aa, Arabidopsis thaliana
  misc_feature: HVG ID no. 66
  misc_feature: Useful for making plants with high aluminum sensitivity
  misc_feature: Useful for making plants with modulated high pH sensitivity
  misc_feature: Useful for making plants with modulated low iron sensitivity
  misc_feature: Useful for making plants with modulated phosphate use efficiency
MNLQAVSCSFGFLSSPLGVTPRTSFRRFVIRAKTEPSEKSVEIMRKFSEQYARRSGTYFCVDKGVTSVVIKGLAEHKDSYGAPLCPCRHYDDKAAEVGQGFWNCPCVPMRERKECHCMLFLTPDNDFAGKDQTITSDEIKETTANM

SEQ ID NO: 9661 - protein, 271 aa, Glycine max
  misc_feature: Ceres CLONE 664026
  misc_feature: Useful for making plants with modulated cold sensitivity
MASLIESGWQYLITHFSDFQLACLGSFFLHEGVFFLSGLPFIWLERAGWMSKYKIQAKNNTPAAQEKCIVRLLLYHFGVNLPVMIFSYPVFTYMGMRSSLPLPSWKVVLIQIIFYFILEDFIFYWGHRILHTKWLYKHVHSVHHEYATPFGLTSEYAHPAEILFLGFATIFGPAITGPHLITLWLWMVLRVLETVEAHCGYHFPWSLSNFLPLYGGADFHDYHHRLLYTKSGNYSSTFTYMDRIFGTDIGYRKLKALKSIGVEDSGEQKKQ

SEQ ID NO: 9662 - protein, 358 aa, Arabidopsis thaliana
  misc_feature: Ceres CLONE 6674
  misc_feature: Useful for making plants with modulated drought sensitivity
MGKASGLLLFLLGFGFFVVTYNLLTLIVHNRSGVSNSDGSPLLDPVVQMPLNIRKAKSSPAPFHVALTATDAPYNKWQCRIMYYWYKQKKALPGSDMGGFTRILHSGNSDNLMDEIPTFVVDPLPPGLDRGYVVLNRPWAFVQWLERATIKEDYVLMAEPDHVFVNPLPNLAVGGFPAAFPFFYITPEKYENIVRKYYPAEMGPVTNIDPIGNSPVIISKESLEKIAPTWMNVSLTMKNDPETDKAFGWVLEMYGYAIASAIHGVRHILRKDFMLQPPWDLSTKGKFIIHYTYGCDYNMKGELTYGKIGEWRFDKRSHLRGPPPRNMSLPPPGVPESVVTLVKMVNEATATIPNWDTL

SEQ ID NO: 9663 - protein, 172 aa, Arabidopsis thaliana
  misc_feature: Ceres CLONE 6685
  misc_feature: Useful for making plants with modulated biomass
  misc_feature: The plant is abnormally small.
  misc_feature (8)..(8): Xaa is any aa, unknown, or other
MLHSYLGXAEMVPEFAKLGAYFSFSGFLMSMSEKKAKKMLKAVPSDRILLETDSPDALPKAESGCLYFVDGDPSLPEEGNSAQDLDSASYDKPNVSSDSMKLTKETLNHPANIHIVLGYVAQLLDMKNEELAELSYQNAVRLFSYEGSKILLDRGTGDVSGHTQNQSTTHVS

SEQ ID NO: 9664 - protein, 417 aa, Glycine max
  misc_feature: Ceres CLONE 674157
  misc_feature: Useful for making plants with altered alkaloid content
  misc_feature: Useful for making plants with altered terpenoid content
MDRVFSVDNISDHFWPPPPIPVSGANTSSQMSRSASEWAFQRFIQEASASAPSPPSSSSPADVVFVEIDDQPKPTPPPPSHGGVLPSDPGPVALDSEEYQAFLKSKLNLACAAVAMTRGSLAKSQDPSPFSDGGSQPTNPSLVGSQTTSKGSIPSGNDQSKLQDKDINAPVGIPSIPAIQKKPAVAIRPSTSGSSREQSDDEDIEGETSMNDNTDPADVKRVRRMLSNRESARRSRRRKQAHLTDLETQVSQLRGENSTLLKRLTDVSQKYSDSAVDNRVLKADVETLRAKVKMAEETVKRITGLNPMPHAMSDISSLGLPSFDGRSPSDTSADASVPVQDDPHHHFYQPTLNNPIPSHDPIVNNGLGGISSIENVQQQNAAAVVGGNKIGQTASLQRVASLEHLQKRIRGGPPSEQ

SEQ ID NO: 9665 - protein, 162 aa, Triticum aestivum
  misc_feature: Ceres CLONE 684584
  misc_feature: Useful for making plants with modulated biomass
  misc_feature: The plant is abnormally small.
MAAQAPPPPPPEQKMMVAIDESECSHYALEWALRNLAPRRLILFTVQPFSPLSYLPVGSPLGPSVASPELIRSVTEHQRQLAQALVDKAKAICAEHGVDAETVIEVGDPKETICEAAEKLNVDLLILGSHSRGPVQRFFLGSVSNYCSHHAKCPVLVVKKKE

SEQ ID NO: 9666 - protein, 97 aa, Arabidopsis thaliana
  misc_feature: CLONE 16209
  misc_feature: Useful for making plants with modulated drought sensitivity
MENTDELVSIELPAPASWKKLFYPKRAGTPRKTEIVFVAPTGEEISSRKQLEQYLKAHPGNPVISEFEWTTGETPRRSSRISQKVRLQRLLLTKSPS

SEQ ID NO: 9667 - protein, 120 aa, Arabidopsis thaliana
  misc_feature: Ceres CLONE 7182
  misc_feature: Useful for making plants with modulated nitrogen use efficiency
MVQRLVYRSRHSYATKSNQHRIVKTPGGKLVYQTTKKKASGPKCPVTGKRIQGIPHLRPSEYKRSRLSRNRRTVNRAYGGVLSGSAVRERIIRAFLVEEQKIVKKVLKLQKAKEKVAPKA

SEQ ID NO: 9668 - protein, 150 aa, Arabidopsis thaliana
  misc_feature: Ceres CLONE 7191
  misc_feature: Useful for making plants with modulated biomass
  misc_feature: The plant is abnormally small.
MAFCNKLGGLLRQNISSNGNVPVTSMLGSLRLMSTKLFIGGLSWGTDDASLRDAFAHFGDVVDAKVIVDKETGRSRGFGFVNFNDEGAATAAISEMDGKELNGRHIRVNPANDRPSAPRAYGGGGGYSGGGGGGYGGGGGSYGGGDGGGY

SEQ ID NO: 9669 - protein, 130 aa, Arabidopsis thaliana
  misc_feature: CLONE 17584
  misc_feature: Useful for making plants with altered glycerol content
MASPKSPTRPTQQNPQPNFHDFLPTMAGNLGGEGLIGELCNGFELLMDREKGVITFESLRRNAAAVLGLGDLTDEDVRCMIKEGDFDCDGALNQMEFCVLMFRLSPDLMEASRCLVTEVIEEEFGFTRRH

SEQ ID NO: 9670 - protein, 142 aa, Arabidopsis thaliana
  misc_feature: Ceres CLONE 727
  misc_feature: Useful for making plants with modulated nitrogen use efficiency
MEKFCCVVAYKITKEEDKRDALLHLEVREKQYDQKEYLDFFTDYNASEPAVAGVMVYIASPDKKSNNNYLGPAPLEDIAKQIVKAKGPSGPNRDYLFNLEEALAQLGFKDKHVTDLANQVRHILSESEELDIDATAATANNV

SEQ ID NO: 9671 - protein, 587 aa, Arabidopsis thaliana
  misc_feature: SEEDLINE SR05001
  misc_feature: Useful for making plants with altered carbon content
  misc_feature: Useful for making plants with altered nitrogen content
MEEKDVYTQDGTVDIHNNPANKEKTGNWKACRFILGNECCERLAYYGMGTNLVNYLESRLNQGNATAANNVTNWSGTCYITPLIGAFIADAYLGRYWTIATFVFIYVSGMTLLTLSASVPGLKPGNCNADTCHPNSSQTAVFFVALYMIALGTGGIKPCVSSFGADQFDENDENEKIKKSSFFNWFYFSINVGALIAATVLVWIQMNVGWGWGFGVPTVAMVIAVCFFFFGSRFYRLQRPGGSPLTRIFQVIVAAFRKISVKVPEDKSLLFETADDESNIKGSRKLVHTDNLKFFDKAAVKSQSDSIKDGEVNPWRLCSVTQVEELKSIITLLPVWATGIVFATVYSQMSTMFVLQGNTMDQHMGKNFEIPSASLSLFDTVSVLFWTPVYDQFIIPLARKFTRNERGFTQLQRMGIGLVVSIFAMITAGVLEVVRLDYVKTHNAYDQKQIHMSIFWQIPQYLLIGCAEVFTFIGQLEFFYDQAPDAMRSLCSALSLTTVALGNYLSTVLVTVVMKITKKNGKPGWIPDNLNRGHLDYFFYLLATLSFLNFLVYLWISKRYKYKKAVGRAHKCCSLEPIVQTFGNKVS

SEQ ID NO: 9672 - protein, 273 aa, Arabidopsis thaliana
  misc_feature: Ceres CLONE 732
  misc_feature: Useful for making plants with modulated nitrogen use efficiency
MSLRKTLTAVNQSSLPPDSLISAGNLTVSEVSGSSSRIRFRPRKIRKVSSDPSPRIIITASPPLSTKSTVDIALRHLQSSDELLGALITTHNDPPVFDSSNTPFLSLARSILYQQLATKAAKCIYDRFISLFNGGEAGVFPESVISLSAVDLRKIGVSGRKASYLHDLADKYNNGVLSDELILKMSDEELIDRLTLVKGIGVWTVHMFMIFSLHRPDVLPVGDLGVRKGVKDLYGLKNLPGPLQMEQLCEKWRPYRSVGSWYMWRLIESRKTK

SEQ ID NO: 9673 - protein, 105 aa, Arabidopsis thaliana
  misc_feature: Ceres CLONE 74
  misc_feature: Useful for biocontainment applications
  misc_feature: The plant produces a reduced number of seeds.
MAGVMQKFLIASMFMWILPIAILYGFNNDLLPGSTTLSPHSLTLLSGFLAVVSVNVVIVFYICLALKEPADKHKPDASFVAEAKDSVKKLTSGVTNTDPALKKQE

SEQ ID NO: 9674 - protein, 235 aa, Arabidopsis thaliana
  misc_feature: HVG ID no. 74
  misc_feature: Useful for making plants with modulated nitrogen use efficiency
MPKSKRDRPVTLSKTKKKGREHKECIVNGIREAVEKYSSVYVFSFENMRNIKFKEFRQQFRHNGKFFLGSNKVMQVALGRSAEDELRSGIYKVSKLLRGDTGLLVTDMPKEEVESLFNAYEDSDFSRTGSIAVETVELKEGPLEQFTHEMEPLLRKLEMPVRLNKGTVELVADFVVCEEGKQLSPKSAHILRLLRMKMATFKLNLLCRWSPSDFELYREDLSELYREDLSDVETS

SEQ ID NO: 9675 - protein, 557 aa, Arabidopsis thaliana
  misc_feature: SEEDLINE SR05003
  misc_feature: Useful for making plants with altered carbon content
MSGSVSRDAEALKSADSSTRRSGGRITFPFMIVTLFGLTLATLGWLQNLIVYLIEEYNMKSIAAAKILNIFSGFTFMFPAIGAIAADSFFGTIPVILVSSFISLVGVVLLALTTLFDSLRPQACETASSLCQAPTNIQLGVLYTAITLGCVGAGGLRFTLATAGANQYEKAKDQGSFFNWFFFTWYLAASISATAIVYAEENISWSFGFGLCVAANLFGLIVFILGKRFYKHDKPLGSPFTSLLRVIFVAIRKRKAVVSTNEKDYHSESKKAPTKSFRFFNRAALKQNDEVNADGTIHNQWRLCSVQQVEDFKAVIRIIPLVLAILFLSTPIAMQLGLTVLQGLVMDRRLGPHFKIPAGSLQVITLLSTCLFIIVNDRFLYPFYQKLTGKFPTPIQRVGIGHVFNILSMAVTAIVEAKRLKIVQKGHFLGSSSVADMSVLWLFPPLVIVGIGEAFHFPGNVALCYQEFPESMRSTATSITSVLIGICFYTSTALIDLIQKTTAWLPDDINHGRVDNVYWILVIGGVLNLGYFLVCSWFYKYRNLENADHEQDANVSH

SEQ ID NO: 9676 - protein, 338 aa, Arabidopsis thaliana
  misc_feature: CLONE 19143
  misc_feature: Useful for making plants with altered tocopherol content
MASLMLNGAITFPKGLGSPGSNLHARSIPRPTLLSVTRTSTPRLSVATRCSSSSVSSSRPSAQPRFIQHKKEAYWFYRFLSIVYDHVINPGHWTEDMRDDALEPADLSHPDMRVVDVGGGTGFTTLGIVKTVKAKNVTILDQSPHQLAKAKQKEPLKECKIVEGDAEDLPFPTDYADRYVSAGSIEYWPDPQRGIREAYRVLKIGGKACLIGPVYPTFWLSRFFSDVWMLFPKEEEYIEWFKNAGFKDVQLKRIGPKWYRGVRRHGLIMGYSVTGVKPASGDSPLQLGPKEEDVEKPVNNPFSFLGRFLLGTLAAAWFVLIPIYMWIKDQIVPKDQPI

SEQ ID NO: 9677 - protein, 573 aa, Nicotiana tabacum
  misc_feature: HVG ID no. 795
  misc_feature: Useful for making plants with modulated drought sensitivity
  misc_feature: Useful for making plants with modulated heat sensitivity
DPSVQSDMKHWPFKVVPGPGDKPMIVVQYKGEEKQFAPEEISSMVLTKMKEVAEAFLGQTVKNAVVTVPAYFNDSQRQATKDAGAISGLNVMRIINEPTAAAIAYGLDKKASRSGEKNVLIFDLGGGTFDVSLLTIEEGIFEVKATAGDTHLGGEDFDNRLVNHFVQDFKRKHKKDISGNARALRRLRTACERAKRTLSSTAQTTIEIDSLYEGIDFYATITRARFEEMNMDLFRKCMEPVEKCLRDAKIDKSHVHDVVLVGGSTRIPKVQQLLQDFFNGKELCKSINPDEAVAYGAAVQAAILSGEGDQKVQDLLLLDVTPLSLGLETAGGVMTVLIPRNTTIPTKKEQIFSTYSDNQPGVLIQVYEGERPMTKDNNLLGKFELKGIPPAPRGVPQINVCFDIDANGILNVSAEDKTAGVKNKITITNDKGRLSKEEIERLVQEAERYKAEDESMKKKVEAKNSLENYAYNMRNTVRDEKFSGKLDPSDKQKIEKAVDETIDWLDGNQLVEVDEFEDKLKDLENLCNPIIAKMYQGGADGDVPMGGSADTGAGYGKAGSTNNGAGPKIEEVD

SEQ ID NO: 9678 - protein, 92 aa, Triticum aestivum
  misc_feature: CLONE 733804
  misc_feature: Useful for making plants with modulated nitrogen use efficiency
  misc_feature: Useful for making plants with modulated seedling growth
MSSRRSRSRQSGSSRITDEQISDLVSKLQDLLPEARLRGNDRVPSSRVLQETCTYIRSLHREVDDLSERLSELLATSDMSSAQAAIIRSLLM

SEQ ID NO: 9679 - protein, 259 aa, Arabidopsis thaliana
  misc_feature: Ceres CLONE 8049
  misc_feature: Useful for making plants with altered Lignin content
  misc_feature: Useful for making plants with altered cell wall content and/or composition
MATTTTEATKTSSTNGEDQKQSQNLRHQEVGHKSLLQSDDLYQYILETSVYPREPESMKELREVTAKHPWNIMTTSADEGQFLNMLIKLVNAKNTMEIGVYTGYSLLATALALPEDGKILAMDVNRENYELGLPIIEKAGVAHKIDFREGPALPVLDEIVADEKNHGTYDFIFVDADKDNYINYHKRLIDLVKIGGVIGYDNTLWNGSVVAPPDAPMRKYVRYYRDFVLELNKALAADPRIEICMLPVGDGITICRRIS

SEQ ID NO: 9680 - protein, 606 aa, Arabidopsis thaliana
  misc_feature: HVG ID no. 816
  misc_feature: Useful for making plants with modulated heat sensitivity
MAAYYRWKSFEENEDRPEKPRRYGVTEMRGPHYSVLSQNLLQEIFESMGQFVDGLKFSGGSNSLIPKSFIKQAIEMAHEHGVYVSTGDWAEHMLRSGPSAFKDYVEECKQLGFDTIELNANLLEVPEETLLRYVRLIKNGGLRAKPMFAVKFNKSDIPGRNRAFGSYVVPEPRSSEFVEDIDLLIRKAERCLEAGADTIMIDADDVCKYADSLRADIIAKVIGRLGIEKTMFEASDAKLVEWFIKRYGPNVFADTLVLSIIFNLLFEWSPSQDSYLFVLVFQVNLYVDHSQIMDLECLRGRHLECKCFENNVICDFSVITMAAYYRWKSFEENEDRPEKPRRYGVTEMRGPHYSVLSQNLLQEIFESMGQFVDGLKFSGGSNSLIPKSFIKQAIEMAHEHGVYVSTGDWAEHMLRSGPSAFKDYVEECKQLGFDTIELNANLLEVPEETLLRYVRLIKNGGLRAKPMFAVKFNKSDIPGRNRAFGSYVVPEPRSSEFVEDIDLLIRKAERCLEAGADTIMIDADDVCKYADSLRADIIAKVIGRLGIEKTMFEASDAKLVEWFIKRYGPNVNLYVDHSQIMDLECLRGRHLGKDHQSVLSSSYFLF

SEQ ID NO: 9681 - protein, 268 aa, Arabidopsis thaliana
  misc_feature: HVG ID no. 817
  misc_feature: Useful for making plants with modulated time to senescence
MCSLSAIMLLPTKLKPAYSDKRSNSSSSSSLFFNNRRSKKKNQSIVPVARLFGPAIFESSKLKVLFLGVDEKKHPSTLPRTYTLTHSDITAKLTLAISQSINNSQLQGWANRLYRDEVVAEWKKVKGKMSLHVHCHISGGHFLLDLFAKFRYFIFCKELPVVLKAFVHGDGNLLNNYPELQEALVWVYFHSNVNEFNKVECWGPLWEAVSPDGHKTETLPEARCADECSCCFPTVSSIPWSHSLSNEGVNGYSGTQTEGIATPNPEKL

SEQ ID NO: 9682 - protein, 266 aa, Arabidopsis thaliana
  misc_feature: CLONE 154343
  misc_feature: Useful for making plants with altered alkaloid content
  misc_feature: Useful for making plants with modulated nitrogen use efficiency
MGRQPCCDKLGVKKGPWTVEEDKKLINFILTNGHCCWRALPKLAGLRRCGKSCRLRWTNYLRPDLKRGLLSHDEEQLVIDLHANLGNKWSKIASRLPGRTDNEIKNHWNTHIKKKLLKMGIDPMTHQPLNQEPSNIDNSKTIPSNPDDVSVEPKTTNTKYVEISVTTTEEESSSTVTDQNSSMDNENHLIDNIYDDDELFSYLWSDETTKDEASWSDSNFGVGGTLYDHNISGADADFPIWSPERINDEKMFLDYCQDFGVHDFGF

SEQ ID NO: 9683 - protein, 164 aa, Arabidopsis thaliana
  misc_feature: Ceres CLONE 8265
  misc_feature: Useful for biocontainment applications
  misc_feature: Useful for making plants with modulated biomass
  misc_feature: The plant is abnormally small.
  misc_feature: The plant produces a reduced number of seeds.
MSRPGDWNCRSCSHLNFQRRDSCQRCGDSRSGPGGVGGLDFGNFGGRAMSVFGFTTGSDVRPGDWYCTVGNCGTHNFASRSTCFKCGTFKDETGAGGGGGGIGGPAMFDADIMRSRVPGNGGRSSWKSGDWICTRIGCNEHNFASRMECFRCNAPRDFSNRTSF

SEQ ID NO: 9684 - protein, 347 aa, Arabidopsis thaliana
  misc_feature: Ceres CLONE 8327
  misc_feature: Useful for making plants with modulated salt sensitivity
MGNKIISMMKKDSKDGGGGSKSKRMNRSQRKLLADEEMLHRRALSMAIHQAQLSQRFDGSMSRRVGSTSTRKRTLSDPFSNGKQVPDFSESLIVKKFVLVHGEGFGAWCWYKMVASLEESGLSPVTVDLTGCGFNMTDTNTVSTLEEYSKPLIDLLENLPEEEKVILVGHSTGGASISYALERFPEKISKAIFVCATMVSDGQRPFDVFSEELGSAERFMKESQFLIYGNGKDKPPTGFMFEKPHMKGLYFNQSPNKDIALAMISMRPVPLGPMMEKVSLTAERYGKGRRFYVQTLDDRALSPDVQEKLVRENSPEGVFKIKGSDHCPFFSKPQSLHKILLEIAQIP

SEQ ID NO: 9685 - protein, 78 aa, Arabidopsis thaliana
  misc_feature: CLONE 30469
  misc_feature: Useful for making plants with modulated cold sensitivity
  misc_feature: Useful for making plants with modulated salt sensitivity
MESEGKIVFTEEQEALVVKSWSVMKKNSAELGLKLFIKIFEIAPTTKKMFSFLRDSPIPAEQNPKLKPHAMSVFVMYN

SEQ ID NO: 9686 - protein, 85 aa, Arabidopsis thaliana
  misc_feature: Ceres CLONE 8500
  misc_feature: Useful for making plants with modulated nitrogen use efficiency
MSSRGKRKDEDVRASDDESETHAPAKKVAKPADDSDQSDDIVVCNISKNRRVSVRNWNGKIWIDIREFYVKDGKTLPGKKGNFIL

SEQ ID NO: 9687 - protein, 92 aa, Arabidopsis thaliana [sequence omitted]

SEQ ID NO: 9688 - protein, 33 aa, Arabidopsis thaliana
  misc_feature: CLONE 2403
  misc_feature: Useful for making plants with modulated cold sensitivity
MQIFVKTLTGKTITLEVESSDTIDNVKAKIQDK

SEQ ID NO: 9689 - protein, 220 aa, Arabidopsis thaliana
  misc_feature: Ceres CLONE 8788
  misc_feature: Useful for making plants with altered alkaloid content
  misc_feature: Useful for making plants with altered terpenoid content
  misc_feature (178)..(178): Xaa is any aa, unknown, or other
MAATSSSPPCNISASSLLLRQPSRSILKVFGLLPPVSRNNRKLGRLTVTRSNLAQDFLGDFGARDPYPEEIASQFGDKVLGCQSTEHKILIPNASVLSLSQLQCSPVSSSQPPLSGDDARTLLHKVLGWSIVDNEAGGLKIRCMWKVKDFGCGVELINRIHKVAEASGHYPSLHLESXTQVRAELFTSSIGGLSMNDFIMAAKIDDIKTSDLSPRKRAWA

SEQ ID NO: 9690 - protein, 329 aa, Arabidopsis thaliana
  misc_feature: CLONE 34553
  misc_feature: Useful for making plants with altered carotene content
MAQLPPKIPTMTTPNWPDFSSQKLPSIAATAAAAATAGPQQQNPSWMDEFLDFSATRRGTHRRSISDSIAFLEPPSSGVGNHHFDRFDDEQFMSMFNDDVHNNNHNHHHHHSINGNVGPTRSSSNTSTPSDHNSLSDDDNNKEAPPSDHDHHMDNNVANQNNAAGNNYNESDEVQSQCKTEPQDGPSANQNSGGSSGNRIHDPKRVKRILANRQSAQRSRVRKLQYISELERSVTSLQTEVSVLSPRVAFLDHQRLLLNVDNSAIKQRIAALAQDKIFKDAHQEALKREIERLRQVYHQQSLKKMENNVSDQSPADIKPSVEKEQLLNV

SEQ ID NO: 9691 - protein, 187 aa, Arabidopsis thaliana
  misc_feature: Ceres CLONE 8916
  misc_feature: Useful for biocontainment applications
  misc_feature: Useful for making plants with modulated biomass
  misc_feature: The plant produces a reduced number of seeds.
  misc_feature: The plants are small.
MRPLDETETTVVFEKLFKFVGNNLKKIVENPSDEGPESTPGSYCFRLQKNRVYYVSEALVKRATNISRKNLVSFGTCIGKYTHAGSFHLTIMSLNILAANAKHKVWLKPTSEMSFLYGNHVLKGGLGRITDSIVPGDGVVVFSMSDVPLGFGIAAKSTQDCRKLDPNGIVVLHQADIGEYLRGEDDL

SEQ ID NO: 9692 - protein, 85 aa, Zea mays
  misc_feature: Ceres CLONE 896483
  misc_feature: Useful for making plants with modulated nitrogen use efficiency
  misc_feature: Useful for making plants with modulated nitrogen use efficiency
MSASRSSSPNSISQWSQKENKMFEEALAYYGEGTSNRWDKVSRAMGGIKSAEEVRCHYEDLDYDVKMIESGHVPYPKYKTHGFWT

SEQ ID NO: 9693 - protein, 85 aa, Zea mays subsp. mays; identical to SEQ ID NO: 9692
  misc_feature: Ceres CLONE 896483
  misc_feature: Useful for making plants with modulated nitrogen use efficiency
  misc_feature: Useful for making plants with modulated nitrogen use efficiency

SEQ ID NO: 9694 - protein, 251 aa, Zea mays
  misc_feature: CLONE 246416
  misc_feature: Useful for making plants with altered alkaloid content
  misc_feature: Useful for making plants with modulated flowering time
MGRGPVQLRRIENKINRQVTFSKRRNGLLKKAHEISVLCDAEVALIVFSTKGKLYEYSSHSSMEGILERYQRYSFEERAVLNPSIEDQANWGDEYVRLKSKLDALQKSQRQLLGEQLSSLTIKELQQLEQQLDSSLKHIRSRKNQLMFDSISALQKKEKALTDQNGVLQKFMEAEKEKNKALMNAQLREQQNGASTSSPSLSPPIVPDSMPTLNIGPCQHRGAAESESEPSPAPAQANRGNLPPWMLRTVK

SEQ ID NO: 9695 - protein, 119 aa, Arabidopsis thalia
  misc_feature: Ceres CLONE 9221
  misc_feature: Useful for making plants with modulated biomass
  misc_feature: The plant is abnormally small.
MTNTRAIYAVIAILAIVISAVESTGDFGDSLDFVRAGSSSLFSGCTGSIAECIAEEEEMEFDSDISRRILAQKKYISYGAMRRNSVPCSRRGASYYNCQRGAQANPYSRGCSTITRCRR

SEQ ID NO: 9696 - protein, 139 aa, Arabidopsis thaliana
  misc_feature: Ceres CLONE 92670
  misc_feature: Useful for making plants with modulated biomass
  misc_feature: Useful for making plants with modulated flowering time
  misc_feature: The plant flowers significantly late compared to wild-type.
  misc_feature: The plant is abnormally small.
MPLYDCMLLFKPIIRKEGLIDLVARIGKHVYSRNGVLTEIKSFGKVELGYGIRKLDGRHYQGQLMQITMMTTPNMNKELHYLNKEDKLLRWLLVKHRDIKIGQSEKEDSLTVPNRLTSGSLYDGSSSDEDDNNILGLSR

SEQ ID NO: 9697 - protein, 143 aa, Arabidopsis thaliana
  misc_feature: SEEDLINE ME10822
  misc_feature: Useful for making plants with modulated nitrogen use efficiency
MRKKREAKDENEEEEEEKKKRLELMKAAAQAWLSHSQTSKHTVLEFDAQRKHAFVKGKASRFKTEALSAKHHPSFLDWEFGQSLWDPYEILSVSKKLERELTLEEQTFSSSDNDGLKKMKKKKTRDSRNSLRSLFTRSSSKRF

SEQ ID NO: 9698 - protein, 259 aa, Brassica napus
  misc_feature: Ceres CLONE 942964
  misc_feature: Useful for making plants with altered alkaloid content
  misc_feature (154)..(154): Xaa is any aa, unknown, or other
  misc_feature (210)..(210): Xaa is any aa, unknown, or other
MAMGMAELGFPYWNPLRRRFPPDSPFFASGNVERELLAKQVALDFTEDEINNLQIIVETESRRISCPIVGCPERLKSLDNFEDHYKARHTASCSVCSRVYPTSRLLSIHISEAHDSFFQAKVARGYDMYECLVEGCGLKFKNYKARHRHLVDKXKFPTTFEFFKRTQLSKKRREKLQKQRVPKLKHEEDKEEASSDAMEVEDKASLDGLXSALSTLTTSDTTPSNVSFGRRHGRGLTFVPRSVHREKPTNSSSTPGPKT

SEQ ID NO: 9699 - protein, 168 aa, Brassica napus
  misc_feature: Ceres CLONE 942980
  misc_feature: Useful for making plants with modulated nitrogen use efficiency
MGFPVGYSELLLPRIFLHLLSFLGLLRKLISTIFWLIGLPDFLEPEPVSSSWPEPPPTSSHQDSHLFSAALLAGDILPVVRFSDLNLPESECCAVCLYDFENHDEIRRLTNCRHIFHKGCLDRWMMDYNQITCPLCRTQFIPDDLQVAFNHKLWAESSEVSELLVESF

SEQ ID NO: 9700 - protein, 158 aa, Arabidopsis thaliana
  misc_feature: Ceres CLONE 94503
  misc_feature: Useful for making plants with modulated nitrogen use efficiency
MELASFLGRALFVSVFLLSAWQEFNDFGEDGGRSAKSLKPKFNAFVNHVTTHTGQQLPPVDMKILVAAAIALKGIGGLLFVFGSSLGAYLLLLHQAVATPILYDFYNYDVDRKEFGQLFSKFTQSLALLGGLLFFIGMKNSRKHGRQLRKKAPKAKAN

SEQ ID NO: 9701 - protein, 307 aa, Arabidopsis thaliana
  misc_feature: Ceres CLONE 94688
  misc_feature: Useful for making plants with altered alkaloid content
  misc_feature: Useful for making plants with modulated nitrogen use efficiency
MHDPAVPIVTGFLGKGWKTGAVTTLGRGGSDLTATTIGKALGLKEIQVWKDVDGVLTCDPTIYKRATPVPYLTFDEAAELAYFGAQVLHPQSMRPAREGEIPVRVKNSYNPKAPGTIITKTRDMTKSILTSIVLKRNVTMLDIASTRMLGQVGFLAKVFSIFEELGISVDVVATSEVSISLTLDPSKLWSRELIQQELDHVVEELEKIAVVNLLKGRAIISLIGNVQHSSLILERAFHVLYTKGVNVQMISQGASKVNISFIVNEAEAEGCVQALHKSFFESGDLSELLIQPRLGNGSPVRTLQVEN

SEQ ID NO: 9702 - protein, 446 aa, Arabidopsis thaliana
  misc_feature: HVG ID no. 95
  misc_feature: Useful for making plants with modulated salt sensitivity
MTKKMRRVGKYEVGRTIGEGTFAKVKFARNTDTGDNVAIKIMAKSTILKNRMVDQIKREISIMKIVRHPNIVRLYEVLASPSKIYIVLEFVTGGELFDRIVHKGRLEESESRKYFQQLVDAVAHCHCKGVYHRDLKPENLLLDTNGNLKVSDFGLSALPQEGVELLRTTCGTPNYVAPEVLSGQGYDGSAADIWSCGVILFVILAGYLPFSETDLPGLYRKINAAEFSCPPWFSAEVKFLIHRILDPNPKTRIQIQGIKKDPWFRLNYVPIRAREEEEVNLDDIRAVFDGIEGSYVAENVERNDEGPLMMNAFEMITLSQGLNLSALFDRRQDFVKRQTRFVSRREPSEIIANIEAVANSMGFKSHTRNFKTRLEGLSSIKAGQLAVVIEIYEVAPSLFMVDVRKAAGETLEYHKFYKKLCSKLENIIWRATEGIPKSEILRTITF

SEQ ID NO: 9703 - protein, 169 aa, Arabidopsis thaliana
  misc_feature: Ceres CLONE 95453
  misc_feature: Useful for making plants with altered alkaloid content
MASGDVEYRCFVGGLAWATDDRALETAFAQYGDVIDSKIINDRETGRSRGFGFVTFKDEKAMKDAIEGMNGQDLDGRSITVNEAQSRGSGGGGGHRGGGGGGGGYSGGGGSYGGGGGRREGGGGYSGGGGYSSRGGGGGSYGGGRREGGGGYGGGEGGGYGGSGGGGGW

SEQ ID NO: 9704 - protein, 301 aa, Brassica napus
  misc_feature: Ceres CLONE 955048
  misc_feature: Useful for making plants with altered terpenoid content
  misc_feature (32)..(32): Xaa is any aa, unknown, or other
  misc_feature (188)..(188): Xaa is any aa, unknown, or other
  misc_feature (202)..(202): Xaa is any aa, unknown, or other
  misc_feature (244)..(244): Xaa is any aa, unknown, or other
  misc_feature (266)..(266): Xaa is any aa, unknown, or other
  misc_feature (282)..(282): Xaa is any aa, unknown, or other
  misc_feature (296)..(296): Xaa is any aa, unknown, or other
MSAALSSSLYISPKKPSSPQLSQSTKPTTIKXTLHTHPLFSVADQAVTLQMKEKILCLELMGIDSGKALSLNPFLRSASLDSVEAVLNFLQSKGIYPNDLPRILGMCPKILTSDIRTELNPVFTFLSSDLHVPDNAFRRVVKKCPRLLISTVEDQLKPALFYLQRLGFKDLDALAYQDPVLLVSSVEXTLIPKLRFLESIGXSRSEAIGMILRCPALFTFSIENNFKPKLDYFMCEIKGKLENXKEFPQYFAFSLEKRIKPRHLKXMERGLELPLALMLKSXDEEFEQLLLQTEPXPVVNV

SEQ ID NO: 9705 - protein, 307 aa, Arabidopsis thaliana
  misc_feature: Ceres CLONE 95679
  misc_feature: Useful for making plants with modulated nitrogen use efficiency
MEDEEGIGLILARATELRLKISDCIDNSSTTVSDNGDGNEDLSPGEGRKSEIIGNQDKDFDSISSEDVDEAEAERLLRIRDALEALESQLASLQNLRQRQQYEKQLALSEIDYSRKMLLEKLKEYKGKDFEVLRETTTFAGERVDYENDLLLPPYPVHPPLSLGLDNNNGYLSHLPSKKKSDANGFGSGHVRNEAEAKSPNGGSGGSSHGVIRFLGSVAKIVLPIIGVISLLSASGYGPEMRKRGASLNLFGLLPHRATRGKRTPNQCPPGKVLVIEDGEARCLVKERVEIPFDSVVAKRDVTYGYG

SEQ ID NO: 9706 - protein, 131 aa, Brassica napus
  misc_feature: Ceres CLONE 957981
  misc_feature: Useful for making plants with altered alkaloid content
MLDHSEEEYSETMKRRAGDAIEQNKKTCADCGTSKTPLWRGGPAGPKSLCNACGIRNRKKRRGAEDKKQKKTNSGGGDLKRSPKFGESMKQRIMDLGMTKRSTVEKQLRKLGEEEQAAVLLMALSYGSVYA

SEQ ID NO: 9707 - protein, 246 aa, Arabidopsis thaliana
  misc_feature: Ceres CLONE 96
  misc_feature: Useful for making plants with modulated biomass
  misc_feature: Useful for making plants with modulated flowering time
  misc_feature: Useful for making plants with modulated drought sensitivity
  misc_feature: The plant flowers significantly late compared to wild-type.
  misc_feature: The plant is abnormally large.
MVGDYRGRFSSRRFSDDSDDSSDDASSVEGETTSSMYSAGKEYMETEWTNEKHSLYLKSMEASFVDQLYNSLGALGKNENVSESTRFGSGRKPSQEQFKVLHDGFWQKINVKQPEHRINGRHGGNSHEFLRSPWIKHYKPLVKTQIPVTDEPENQVVSSSNGKKGICSSGSASSLKQLSSHSRDHDQISVGEAEVSDQNFVNEGIKGENGSSKKMKTVMMSESSSTDQVVPLNKLLQHDVNLKSVS

SEQ ID NO: 9708 - protein, 1520 aa, Arabidopsis thaliana
  misc_feature: HVG ID no. 96
  misc_feature: Useful for making plants with modulated salt sensitivity
MADKDVPFGVEDIVQTPLPGYVAPTAVSFSPDDSLITYLFSPEKNLKRRVYAFDVNKGESNLVFSPPDGGVDESNISPEEKLRRERLRERGLGVTRYEWVKTNSKMRFIVVPLPAGVYMKDLSSSPNPELIVPSSPTSPIIDPRLSPNGLFLAYVRESELHVLNLLKNQTQQLTSGANGSTLSHGLAEYIAQEEMDRRNGYWWSLDSKFIAYTEVDSSQIPLFRIMHQGKRSVGSEAQEDHAYPFAGALNSTLRLGVVSSAGGGKTTWMNLVCGGRGNTEDEYLGRVNWLPGNVLIVQVLNRSQSKLKIISFDINTGQGNVLLTEESDTWVTLHDCFTPLEKVPSSRGSGGFIWASERTGFRHLYLYESDGTCLGAITSGEWMVEQIAGVNEPMSLVYFTGTLDGPLETNLYCAKLEAGNTSRCQPMRLTHGKGKHIVVLDHQMKNFVDIHDSVDSPPRVSLCSLSDGTVLKILYEQTSPIQILKSLKLEPPEFVQIQANDGKTTLYGAVYKPDSSKFGPPPYKTMINVYGGPSVQLVYDSWINTVDMRTQYLRSRGILVWKLDNRGTARRGLKFESWMKHNCGYVDAEDQVTGAKWLIEQGLAKPDHIGVYGWSYGGYLSATLLTRYPEIFNCAVSGAPVTSWDGYDSFYTEKYMGLPTEEERYLKSSVMHHVGNLTDKQKLMLVHGMIDENVHFRHTARLVNALVEAGKRYELLIFPDERHMPRKKKDRIYMEQRIWEFIEKNLMDRRNGYWWSLDSKFIAYTEVDSSQIPLFRIMHQGKRSVGSEAQEDHAYPFAGALNSTLRLGVVSSAGGGKTTWMNLVCGGRGNTEDEYLGRVNWLPGNVLIVQVLNRSQSKLKIISFDINTGQGNVLLTEESDTWVTLHDCFTPLEKVPSSRGSGGFIWASERTGFRHLYLYESDGTCLGAITSGEWMVEQIAGVNEPMSLVYFTGTLDGPLETNLYCAKLEAGNTSRCQPMRLTHGKGKHIVVLDHQMKNFVDIHDSVDSPPRVSLCSLSDGTVLKILYEQTSPIQILKSLKLEPPEFVQIQANDGKTTLYGAVYKPDSSKFGPPPYKTMINVYGGPSVQLVYDSWINTVDMRTQYLRSRGILVWKLDNRGTARRGLKFESWMKHNCGYVDAEDQVTGAKWLIEQGLAKPDHIGVYGWSYGGYLSATLLTRYPEIFNCAVSGAPVTSWDGYDSFYTEKYMGLPTEEERYLKSSVMHHVGNLTDKQKLMLVHGMIDENVHFRHTARLVNALVEAGKRYELLIFPDERHMPRKKKDRIYMEQRIWEFIEKNLMGCSVSKKKKKNAMRPPGYEDPELLASVTPFTVEEVEALYELFKKLSSSIIDDGLIHKEEFQLALFRNRNRRNLFADRIFDVFDVKRNGVIEFGEFVRSLGVFHPSAPVHEKVKFAFKLYDLRQTGFIEREELKEMVVALLHESELVLSEDMIEVMVDKAFVQADRKNDGKIDIDEWKDFVSLNPSLIKNMTLPYLKDINRTFPSFVSSCEEEEMELQNVSS

SEQ ID NO: 9709 - protein, 446 aa, Arabidopsis thaliana
  misc_feature: Ceres CLONE 96020
  misc_feature: Useful for making plants with modulated biomass
  misc_feature: The plant is abnormally small.
MAAVTQFLSQPSSIRGTLNQYQLNQTSLSRIPFLSLKSTLKPLKRLSVKAAVSQNSTKTLTKESASSFDHCFKKSSDGFLYCEGTKVQDIMETVEKRPFYLYSKPQITRNLEAYKEALEGVRSVIGYAIKANNNLKILEYLRSLGCGAVLVSGNELRLALLAGFDPTKCIFNGNGKSLEDLVLAAQEGVFVNVDSEFDLNNIVEASRISGKQVNVLLRINPDVDPQVHPYVATGNKNSKFGIRNEKLQWFLDEVKAHPKELKLVGAHCHLGSTITKVDIFRDAAVLMIEYIDEIRRQGFEVSYLNIGGGLGIDYYHAGAVLPTPMDLINTVRELVLSRDLNLIIEPGRSLIANTCCFVNYVTGVKTNGTKNFIVIDGSMAELIRPSLYDAYQHIELVSPTPPEAEVTKFDVVGPVCESADFLGKDRELPTPPQGAGLWFMTLVHTV

SEQ ID NO: 9710 - protein, 209 aa, Brassica napus
  misc_feature: Ceres CLONE 965405
  misc_feature: Useful for making plants with modulated salt sensitivity
  misc_feature (156)..(156): Xaa is any aa, unknown, or other
  misc_feature (158)..(158): Xaa is any aa, unknown, or other
  misc_feature (168)..(168): Xaa is any aa, unknown, or other
  misc_feature (183)..(183): Xaa is any aa, unknown, or other
  misc_feature (187)..(187): Xaa is any aa, unknown, or other
  misc_feature (196)..(196): Xaa is any aa, unknown, or other
  misc_feature (197)..(197): Xaa is any aa, unknown, or other
MSADDSSNATDVDGKLGSDLNVNSDGEDAADNDSSKTLTIPAPAVCLVRFAGDAAGGAVMGSIFGYGSGLFKKKGFKGSFADAGQSAKTFAVLSGVHSLVVCLLKQLRGKDDAINVGVAGCCTGLALSFPGAPQALLQSCLTFGAFSFILEGLNKXQXALAHSVSLRXQTGNFGDHQQRPLQXSLAXPIHEEIKGXXSFCKSLTKPKKI

SEQ ID NO: 9711 - protein, 230 aa, Arabidopsis thaliana
  misc_feature: Ceres CLONE 96705
  misc_feature: Useful for making plants with modulated nitrogen use efficiency
MQCGSMLFKQEELQEMSGVNVGGDYVEVMCGCTSHRYGDAVARLRVFPTGDLEITCECTPGCDEDKLTPAAFEKHSGRETARKWKNNVWVIIGGENVPLSKTVLLKYYNESSKKCSRSNRSQGAKVCHRDEFVGCNDCGKERRFRLRSRDECRLHHNAMGDPNWKCSDFPYDKITCEEEEERGSRKVYRGCTRSPSCKGCTSCVCFGCELCRFSECTCQTCVDFTSNVKA

SEQ ID NO: 9712 - protein, 150 aa, Arabidopsis thaliana
  misc_feature: Ceres CLONE 9716
  misc_feature: Useful for making plants with modulated biomass
  misc_feature: The plant is abnormally large.
MSKRKTKEPKVENVTLGPAVREGEQVFGVVHVFASFNDTFIHVTDLSGRETLVRITGGMKVKADRDESSPYAAMLAAQDVAQRCKELGITAIHVKLRATGGNKTKTPGPGAQSALRALARSGMKIGRIEDVTPIPTDSTRRKGGRRGRRL

SEQ ID NO: 9713 - protein, 155 aa, Arabidopsis thaliana
  misc_feature: Ceres CLONE 97415
  misc_feature: Useful for biocontainment applications
  misc_feature: The plant produces a reduced number of seeds.
MSAVAINHFFGLPETIEKLILPISRSGESNNESRGRGSSNNIPIDILESPKKYIFYLDIPGISKSDIQVTVEEERTLVIKSNGKRKRDDDESEEGSKYIRLERRLAQNLVKKFRLPEDADMASVTAKYQEGILTVVIKKLPPQPPKPKTVQIAVS

SEQ ID NO: 9714 - protein, 177 aa, Brassica napus
  misc_feature: Ceres CLONE 975540
  misc_feature: Useful for making plants with altered alkaloid content
  misc_feature (120)..(120): Xaa is any aa, unknown, or other
MALPMPQASRNMQGPGGGGGGRFSGRGGESGPGHVSSFGASATAKISVDASLAGAIIGKGGVSSKQICRQTGAKLSIQDHERDPNLKNIELEGTFEQINEASVMVRELIGRLNSAASRRXPGGGGGIGGGVGSEGKPHPGSNFKTKMCERFAKGNCTFGDRCHFAHGEAELRRSGIA

SEQ ID NO: 9715 - protein, 102 aa, Zea mays subsp. mays
  misc_feature: Ceres CLONE 987311
  misc_feature: Useful for making plants with modulated nitrogen use efficiency
MERVASSCCVSLLAQSRRAYTMAAAMAKKGAAARRVDEKKAAAALTKRVMGKKEVNTAAAAAAEEKAWVPDPVTGYYRPAGSAKEVDAAELRSKLLTEAAAN

SEQ ID NO: 9716 - protein, 141 aa, Arabidopsis thaliana
  misc_feature: Ceres CLONE 98855
  misc_feature: Useful for making plants with modulated flowering time
  misc_feature: The plant flowers significantly late compared to wild-type.
MASGDVEYRCFVGGLAWATDDRALETAFAQYGDVIDSKIINDRETGRSRGFGFVTFKDEKAMKDAIEGMNGQDLDGRSITVNEAQSRGSGGGGGHRGGGGGGYSSRGGGGGSYGGGRREGGGGYGGGEGGGYGGNGGGGGW

SEQ ID NO: 9717 - protein, 285 aa, Arabidopsis thaliana
  misc_feature: HVG ID no. 99
  misc_feature: Useful for making plants with modulated drought sensitivity
MSTNTESSSYSSLPSQRLLGKVALITGGATGIGESIVRLFHKHGAKVCIVDLQDDLGGEVCKSLLRGESKETAFFIHGDVRVEDDISNAVDFAVKNFGTLDILINNAGLCGAPCPDIRNYSLSEFEMTFDVNVKGAFLSMKHAARVMIPEKKGSIVSLCSVGGVVGGVGPHSYVGSKHAVLGLTRSVAAELGQHGIRVNCVSPYAVATKLALAHLPEEERTEDAFVGFRNFAAANANLKGVELTVDDVANAVLFLASDDSRYISGDNLMIDGGFTCTNHSFKVFR

SEQ ID NO: 9718 - protein, 442 aa, Arabidopsis thaliana
  misc_feature: SEEDLINE ME06182
  misc_feature: Useful for making plants with altered carbon content
  misc_feature: Useful for making plants with altered nitrogen content
  misc_feature: Useful for making plants with modulated nitrogen use efficiency
MTATEAKNRKINVGDGDDVVDIEIPDTAHQISSDSWFQVAFVLTTGINSAYVLGYSGTIMVPLGWIGGVVGLLIATAISLYANTLIAKLHEFGGRRHIRYRDLAGFIYGRKAYHLTWGLQYVNLFMINCGFIILAGSALKAVYVLFRDDHTMKLPHFIAIAGLICAIFAIGIPHLSALGVWLGVSTFLSLIYIVVAIVLSVRDGVKTPSRDYEIQGSSLSKLFTITGAAANLVFAFNTGMLPEIQATVRQPVVKNMMKALYFQFTAGVLPMYAVTFIGYWAYGSSTSTYLLNSVNGPLWVKALANVSAILQSVISLHIFASPTYEYMDTKYGIKGNPFAIKNLLFRIMARGGYIAVSTLISALLPFLGDFMSLTGAVSTFPLTFILANHMYYKAKNNKLNAMQKLWHWLNVVFFSLMSVAAAIAAVRLIAVDSKNFHVFADL

SEQ ID NO: 9719 - protein, 242 aa, Arabidopsis thaliana
  misc_feature: Ceres CLONE 99033
  misc_feature: Useful for making plants with altered Lignin content
MAKLSFKDSLKALEADIQHANTLALDYPREKDGARVQMRLSYSPTAQFFLFLVQWTDCKLAGFLGLLRVLIYMTYADGKTTMSVYERKASIREFQAVILPSLSQLQRGVTDIDDSKQKEVCKMRYRKKDESEMSEIEIEREEECGICMEMNSKVVLPNCTHSLCIKCYRDWRGRSQSCPFCRDSLKRVDSGDLWMFLDQNDTVNLTAIARENQKRLFMYIEKLPLVVPDQVYASSPYDFHVR

SEQ ID NO: 9720 - protein, 194 aa, Arabidopsis thaliana
  misc_feature: Ceres CLONE 99075
  misc_feature: Useful for making plants with altered terpenoid content
  misc_feature (192)..(192): Xaa is any aa, unknown, or other
MDRIDHLFNQYANKSSSLIDPEGIEELCSNLEVSHTDIRILMLAWKMKAEKQGYFTHEEWRRGLKALRADTINKLKKALPELEKEVRRPSNFADFYAYAFCYCLTEEKQKSIDIETICQLLEIVMGSTFRAQVDYFVEYLKIQNDYKVINMDQWMGLYRFCNEISFPDMGNYNPELAWPLILDNFVEWIQEXQA

SEQ ID NO: 9721 - protein, 483 aa, Arabidopsis thaliana
  misc_feature: Ceres CLONE 99519
  misc_feature: Useful for making plants with altered terpenoid content
  misc_feature: Useful for making plants with modulated nitrogen use efficiency
MNEKANVSKELNARHRKILEGLLKHPENRECADCKTKGPRWASVNLGIFICMQCSGIHRSLGVHISKVRSATLDTWLPEQVAFIQSMGNDKANSYWEAELPPNYDRVGIENFIRAKYEEKRWVSRGEKARSPPRVEQERRKSVETSGPGYEHGHSSSPVNLFEERKTIPASRTRNNVAATRINLPVPPQGPSQVIKPQQKMESAATPVEREKQAVNVAPASDPPKVDFATDLFNMLSMDDSTTNTSEATPGDTPADDNSWAGFQSAGSGQTAEKIVTAKPAESSSPPASSSDFEDLFKDTPNLTTQQAPKDVKGDIMSLFEKTNIVSPFAMHQQQVAMLAQQQALYMAAAKAAGGTPNGVNQQAIANALNVASANWSNPGGYQIPGMTNPVGGQADLQKLMQNMNMNANMNTRPAQPQENTLQYPSSSFYTMGQANQVNGMTPNSTGKPQSSSATQPTSTTPSSQSGKDFDFSSLMDGMFTKH

SEQ ID NO: 9722 - protein, 93 aa, Arabidopsis thaliana
  misc_feature: Ceres CLONE 99657
  misc_feature: Useful for making plants with modulated time to senescence
  misc_feature: The plant senesces significantly late compared to wild-type.
MANAASGMAVHDDCKLKFMELKAKRTFRTIVYKIEDKQVIVEKLGEPEQSYDDFAASLPADDCRYCIYDFDFVTAENCQKSKIFLHGLRTLPK

SEQ ID NO: 9723 - protein, 505 aa, Arabidopsis thaliana
  misc_feature: Ceres SEEDLINE ME04616
  misc_feature: Useful for biocontainment applications
  misc_feature: Useful for making plants with altered cell wall content and/or composition
  misc_feature: Useful for making plants with modulated biomass
  misc_feature: Useful for making plants with modulated flowering time
  misc_feature: The plant flowers significantly earllier than wild-type.
  misc_feature: The plant flowers significantly late compared to wild-type.
  misc_feature: The plant is abnormally small.
  misc_feature: The plant produces a reduced number of seeds.
  misc_feature: The plants are small.
MDLLLLEKSLIAVFVAVILATVISKLRGKKLKLPPGPIPIPIFGNWLQVGDDLNHRNLVDYAKKFGDLFLLRMGQRNLVVVSSPDLTKEVLLTQGVEFGSRTRNVVFDIFTGKGQDMVFTVYGEHWRKMRRIMTVPFFTNKVVQQNREGWEFEAASVVEDVKKNPDSATKGIVLRKRLQLMMYNNMFRIMFDRRFESEDDPLFLRLKALNGERSRLAQSFEYNYGDFIPILRPFLRGYLKICQDVKDRRIALFKKYFVDERKQIASSKPTGSEGLKCAIDHILEAEQKGEINEDNVLYIVENINVAAIETTLWSIEWGIAELVNHPEIQSKLRNELDTVLGPGVQVTEPDLHKLPYLQAVVKETLRLRMAIPLLVPHMNLHDAKLAGYDIPAESKILVNAWWLANNPNSWKKPEEFRPERFFEEESHVEANGNDFRYVPFGVGRRSCPGIILALPILGITIGRMVQNFELLPPPGQSKVDTSEKGGQFSLHILNHSIIVMKPRNC

SEQ ID NO: 9724 - protein, 532 aa, Arabidopsis thaliana
  misc_feature: Ceres SEEDLINE ME04665
  misc_feature: Useful for making plants with modulated biomass
  misc_feature: Useful for making plants with modulated flowering time
  misc_feature: The plant flowers significantly late compared to wild-type.
  misc_feature: The plant is abnormally small.
MENFMVEMAKTISWIVVIGVLGLGIRVYGKVMAEQWRMRRKLTMQGVKGPPPSLFRGNVPEMQKIQSQIMSNSKHYSGDNIIAHDYTSSLFPYLDHWRKQYGRVYTYSTGVKQHLYMNHPELVKELNQANTLNLGKVSYVTKRLKSILGRGVITSNGPHWAHQRRIIAPEFFLDKVKGMVGLVVESAMPMLSKWEEMMKREGEMVCDIIVDEDLRAASADVISRACFGSSFSKGKEIFSKLRCLQKAITHNNILFSLNGFTDVVFGTKKHGNGKIDELERHIESLIWETVKERERECVGDHKKDLMQLILEGARSSCDGNLEDKTQSYKSFVVDNCKSIYFAGHETSAVAVSWCLMLLALNPSWQTRIRDEVFLHCKNGIPDADSISNLKTVTMVIQETLRLYPPAAFVSREALEDTKLGNLVVPKGVCIWTLIPTLHRDPEIWGADANEFNPERFSEGVSKACKHPQSFVPFGLGTRLCLGKNFGMMELKVLVSLIVSRFSFTLSPTYQHSPVFRMLVEPQHGVVIRVLRQ

SEQ ID NO: 9725 - protein, 368 aa, Arabidopsis thaliana
  misc_feature: Ceres SEEDLINE ME09881
  misc_feature: Useful for making plants with modulated biomass
  misc_feature: The plant is abnormally small.
MCAKKEEEEEEEEDSSEAMNNIQNYQNDLFFHQLISHHHHHHHDPSQSETLGASGNVGSGFTIFSQDSVSPIWSLPPPTSIQPPFDQFPPPSSSPASFYGSFFNRSRAHHQGLQFGYEGFGGATSAAHHHHEQLRILSEALGPVVQAGSGPFGLQAELGKMTAQEIMDAKALAASKSHSEAERRRRERINNHLAKLRSILPNTTKTDKASLLAEVIQHVKELKRETSVISETNLVPTESDELTVAFTEEEETGDGRFVIKASLCCEDRSDLLPDMIKTLKAMRLKTLKAEITTVGGRVKNVLFVTGEESSGEEVEEEYCIGTIEEALKAVMEKSNVEESSSSGNAKRQRMSSHNTITIVEQQQQYNQR

SEQ ID NO: 9726 - protein, 280 aa, Arabidopsis thaliana
  misc_feature: Ceres SEEDLINE ME10335
  misc_feature: Useful for biocontainment applications
  misc_feature: Useful for making plants with modulated time to senescence
  misc_feature: The plant produces a reduced number of seeds.
  misc_feature: The plant senesces significantly earlier than wild-type.
MEKKKAMQIEGYPIEGLSIGGHETCIIFPSLRIAFDIGRCPHRAISQDFLFISHSHMDHIGGLPMYVATRGLYKMKPPTIIVPASIKETVESLFEVHRKLDSSELKHNLVGLDIGEEFIIRKDLKVKAFKTFHVIQSQGYVVYSTKYKLKKEYIGLSGNEIKNLKVSGVEITDSIITPEVAFTGDTTSDFVVDETNADALKAKVLVMESTFLDDSVSVEHARDYGHIHISEIVNHAEKFENKAILLIHFSARYTVKEIEDAVSALPPPLEGRVFALTQGF

SEQ ID NO: 9727 - protein, 265 aa, Arabidopsis thaliana
  misc_feature: Ceres SEEDLINE ME11039
  misc_feature: Useful for biocontainment applications
  misc_feature: The leaves start out wild- type green and gradually turn yellow-green in color, while the cotyledons stay wild-type green.
MATTNSLHHHHHSSPSYTHHRNNLHCQSHFGPTSLSLKQPTSAATFSLICSASSTSSSTTAVSAVSTTNASATTAETATIFDVLENHLVNQNFRQADEETRRLLIQISGEAAVKRGYVFFSEVKTISPEDLQAIDNLWIKHSDGRFGYSVQRKIWLKVKKDFTRFFVKVEWMKLLDTEVVQYNYRAFPDEFKWELNDETPLGHLPLTNALRGTQLLKCVLSHPAFATADDNSGETEDELNRGVAVAKEQAGVGADKRVFKTNYSF

SEQ ID NO: 9728 - protein, 313 aa, Arabidopsis thaliana
  misc_feature: Ceres SEEDLINE ME11094
  misc_feature: Useful for making plants with modulated flowering time
  misc_feature: The plant flowers significantly late compared to wild-type.
MRCKRHTVDFSSSIGVCASCLRERLFTLAVSTAASENDDNDHRHSRISPPPLLFPRSVSPYVAPRKSDAGTGTGAGGRDSVASSNNRFFATPQVVVQSSSSEKVFESDRSFKKKKSGLSRFSSFFRTRSDDYDSRRDSCDASTVFSQPSSATTSRSWFSKVISVRSKKQSTTNTCYIEDLIASESDHHHHNQNRPRQRYCRGMSPAGDSTTNDESVEESPGRLRRTPVMGTPGRKKTATIGIGRSVSGMAFCLSPLVRAKPNCSSNWKAKFPPDFGYSGELKSPAKPHLSTAASFCGNRSKKLVDLGRVDHRR

SEQ ID NO: 9729 - protein, 518 aa, Arabidopsis thaliana
  misc_feature: Ceres SEEDLINE ME11543
  misc_feature: Useful for making plants with modulated biomass
  misc_feature: The plant is abnormally small.
MEEEDPTASNVITNSNSSSMRNLSPAMNTPVVSLESRINRLINANQSQSPSPSSLSRSIYSDRFIPSRSGSNFALFDLSPSPSKDGKEDGAGSYATLLRAAMFGPETPEKRDITGFSSSRNIFRFKTETHRSLNSFSPFGVDDDSPGVSHSGPVKAPRKVPRSPYKILDLVDFRSLVSIMHETICDLCDVLVSEGLEFESEVLDAPALQDDFYLNLVDWSAQNVLAVGLGNCVYLWNACSSKVTKLCDLGAEDSVCSVGWALRGTHLAVGTSTGKVQIWDASRCKRTRTMEGHRLRVGALAWGSSVLSSGSRDKSILQRDIRCQEDHVSKLAGHKSEVCGLKWSYDNRELASGGNDNRLFVWNQHSTQPVLKYSEHTAAVKAIAWSPHVHGLLASGGGTADRCIRFWNTTTNTHLSSIDTCSQVCNLAWSKNVNELVSTHGYSQNQIIVWKYPTMSKIATLTGHTYRVLYLAVSPDGQTIVTGAGDETLRFWNVFPSPKSQNTDSEIGSSFFGRTTIR

SEQ ID NO: 9730 - protein, 149 aa, Arabidopsis thaliana
  misc_feature: Ceres SEEDLINE ME11748
  misc_feature: Useful for biocontainment applications
  misc_feature: The plant produces a reduced number of seeds.
MQAVSVDETKNTVVLRAEHKNEEGRKSVDKFEVKTRNPETIKSVERKLMEKGVQRMDRHPSDGIPLRRPPSKSGHGGKYTWEGPDRMEDYEMQPDPPAMDEGDPNYDEEQVKKSGDDVAVELVKGEVEVAKEAPAGVARVEVDPRLVGR

SEQ ID NO: 9731 - protein, 209 aa, Arabidopsis thaliana
  misc_feature: Ceres SEEDLINE ME11780
  misc_feature: Useful for making plants with modulated flowering time
  misc_feature: The plant flowers significantly late compared to wild-type.
MENGKRDRQDMEVNTTPRKPRVLLAASGSVAAIKFGNLCHCFTEWAEVRAVVTKSSLHFLDKLSLPQEVTLYTDEDEWSSWNKIGDPVLHIELRRWADVLVIAPLSANTLGKIAGGLCDNLLTCIIRAWDYTKPLFVAPAMNTLMWNNPFTERHLLSLDELGITLIPPIKKRLACGDYGNGAMAEPSLIYSTVRLFWESQAHQQTGGTS

SEQ ID NO: 9732 - protein, 361 aa, Arabidopsis thaliana
  misc_feature: Ceres SEEDLINE ME12040
  misc_feature: Useful for biocontainment applications
  misc_feature: The plant produces a reduced number of seeds.
MLQLVVVAWLLIFTAETVVPHQESGEWSCESDSEIQVLADFRPGIITLDGHNDDWKDIDGSEFPLRPALDPDSDHEYDAGKMTVKALHDGRDIYFLLEIDGNYAYDKGENNKCPSVALMFQIGDQATYHNMGGCKEGTDSCTSKACRGFEVDIMHFSIGNAIPGRLYGGNPIDNGEGNGGDRFGHLVDIYAWNPHCRYLDGLGPSGNDSSAQNDWHGAWWHSSFTTLSGYVEEDSPYTPDGKKGTYYFEFSRPLRTMDRLQQDVQFTLGSPAKMSVAFWYPVDSKPWHGSGHYTINCDWTPLDISSGSSSGLTASTVKGSSDGASITAILLSMISLVFSGFIAYRLFSPRNVPFTPMENNL

SEQ ID NO: 9733 - protein, 77 aa, Arabidopsis thaliana
  misc_feature: Ceres SEEDLINE ME12463
  misc_feature: Useful for making plants with modulated flowering time
  misc_feature: The plant flowers significantly late compared to wild-type.
MAAKSTLKIKGKAKPSKGSSSSSSSSASSKYKVFKDWTNWSLQKAKVATHYGFIPLIIIIGMNSDPKPHLFHLLSPV

SEQ ID NO: 9734 - protein, 72 aa, Arabidopsis thaliana
  misc_feature: Ceres SEEDLINE ME13441
  misc_feature: Useful for making plants with modulated time to senescence
  misc_feature: The plant senesces significantly earlier than wild-type.
MAKPLGTTGEFFRRRDEWRKHPMLSNQMRHALPGIGIGVGAFCVYLVGEQIYSKLMAPSSQSSHQKQPAPSH

SEQ ID NO: 9735 - protein, 115 aa, Arabidopsis thaliana
  misc_feature: Ceres SEEDLINE ME14011
  misc_feature: Useful for making plants with modulated biomass
  misc_feature: The rosette leaves do not appear in the normal fashion, i.e., their phyllotaxy may be abnormal or too many leaves may be emerging in comparison to the control.
MEEKWKLSKKDTTASSSSSKSKFSRSFSTSASSTKSPIFVRSSSTKCSVPSSSSSSSSSSSISRSFSRKERRSSSSSSSSITQKYSSLAKEQKARFYIMRRCVAMLVCWHKHGDS

SEQ ID NO: 9736 - protein, 148 aa, Arabidopsis thaliana
  misc_feature: Ceres SEEDLINE ME14666
  misc_feature: Useful for making plants with modulated biomass
  misc_feature: The plant is abnormally small.
MSKDGLSNDQVSSMKEAFMLFDTDGDGKIAPSELGILMRSLGGNPTESQLKSIITTENLSSPFDFNRFLDLMAKHLKTEPFDRQLRDAFKVLDKEGTGFVAVADLRHILTSIGEKLQPSEFDEWIKEVDVGSDGKIRYEDFIARMVAK

SEQ ID NO: 9737 - protein, 252 aa, Arabidopsis thaliana
  misc_feature: Ceres SEEDLINE ME17016
  misc_feature: Useful for biocontainment applications
  misc_feature: The plant produces a reduced number of seeds.
MDSFDFDNVKAEKAKALRRFNRFCRIGRFFRAAEVCVALLFIFWTFSQLPFVVQISGAFLRRIAAVISTPLFVFLLGNSIVVVLLTKSSDQTTTAVASAETEIYQAFVRSVENRSKPSDEDLTEGIVYDDKQVIVTDLDSNPNLTVDENMPHVEIDSDSSPHSKVYGRSKSDVSGKQSSNMVMMMMKRSLQRSETEKFCKETENDDDSEEEKNYPEDDLSNEEFQKTIEAFIAKQRMFRRQESLAVVVHNIA

SEQ ID NO: 9738 - protein, 206 aa, Arabidopsis thaliana
  misc_feature: Ceres SEEDLINE ME17281
  misc_feature: Useful for making plants with modulated biomass
  misc_feature: The rosette leaves do not appear in the normal fashion, i.e., their phyllotaxy may be abnormal or too many leaves may be emerging in comparison to the control.
MDMYKDDSSPYCYFHPKEEYVGVCPLCLNERLLVLASKQRSSRTKHSSSSPIISLPKIFALSSLLSRLDLRHRKFHPSSDLDVSTSQEDSFISIKFENDGNASWEKKAVVTKVCVDNNNNNTTNSTCKKQQSPITSNTSIVEHNSAKSSLRWRKRIGHLFHVIKLKSGSSTSSCHVAPSKVEGTKVRKQGWMVRTLTRKKSRKSKS

SEQ ID NO: 9739 - protein, 315 aa, Arabidopsis thaliana
  misc_feature: Ceres SEEDLINE ME17461
  misc_feature: Useful for making plants with modulated biomass
  misc_feature: The rosette leaves do not appear in the normal fashion, i.e., their phyllotaxy may be abnormal or too many leaves may be emerging in comparison to the control.
MEIEVAEAAAAELNFDSTTSSPYITAPSSPTRFGNNFFSAPTSPSPSTSSNIPFDWDDQPRTPKKRSAIGFEDDFEFNFSGQLEKTSFSAADELFDGGKIRPLRTPLTPTVSSPRSRGLEIEDSDDQKDRGRDRSPGSSSSRYDRKGSRSMSPLRVSDIMVDEEEEVQSTKMVASNTSNQKSSVFLSAILFPGRAYKKWKLKDLLLFRSASDGRPIPTKESLNRYDILTKKDAEEVRNSSIRSRESCESSVSRSRRRNGAVVSAHEMHYTENRAVSEELKRKTFLPYKQGWLGCLGFNPAVNEIARVGSLSRASS

SEQ ID NO: 9740 - protein, 158 aa, Arabidopsis thaliana
  misc_feature: Ceres SEEDLINE ME18235
  misc_feature: Useful for making plants with modulated biomass
  misc_feature: The plant is abnormally small.
MVSREQKRGSLQEKFQLLRSITNSHAENDTSIIMDASKYIQKLKQKVERFNQDPTAEQSSSEPTDPKTPMVTVETLDKGFMINVFSGKNQPGMLVSVLEAFEDIGLNVLEARASCTDSFSLHAMGLENEDGENMDAEAVKQAVTDAIRSWGEINDPQN

SEQ ID NO: 9741 - protein, 217 aa, Arabidopsis thaliana
  misc_feature: Ceres SEEDLINE ME18955
  misc_feature: Useful for biocontainment applications
  misc_feature: Useful for making plants with modulated flowering time
  misc_feature: The plant flowers significantly late compared to wild-type.
  misc_feature: The plant produces a reduced number of seeds.
MASISNEPERENRDEEETGANEDEDTGAQVAPIVRLEEVAVTTGEEDEDTILDLKSKLYRFDKDGSQWKERGAGTVKFLKHRVSGKIRLVMRQSKTLKICANHLVGSGMSVQEHAGNDKSCVWHARDFSDGELKDELFCIRFASVENCKAFMQKFKEVAESEEEKEESKDASDTAGLLEKLTVEEKESEKKPVEKAEENKKSEAVEEKKTEESVPSA

SEQ ID NO: 9742 - protein, 572 aa, Arabidopsis thaliana
  misc_feature: Ceres SEEDLINE ME19267
  misc_feature: Useful for making plants with modulated biomass
  misc_feature: The rosette leaves do not appear in the normal fashion, i.e., their phyllotaxy may be abnormal or too many leaves may be emerging in comparison to the control.
MADEIVPPATQLAAVSLENDGSTVQRAQFSNRVLIRTILDRPDGGAGLAGQTVRIGGWVKSGRDQGKRTFSFLAVNDGSCPANLQVMVDPSLYDVSNLVATGTCVTVDGVLKVPPKGKGTQQQIELNVVKVIDVGTVDASKYPLPKTKLTLETLRDVLHLRSRTNSISAVARIRNALAFATHSFFQEHSFLYIHTPIITTSDCEGAGEMFQATTLINYTERLEQDLIDNPPPTEADVEAARLIVIERGNVVAELKAAKASKEAITAAVAELKIAKETFAHIDERSRLRPGLPKKDGNIDYSKDFFGRQAFLTVSGQLQVETYACALSNVYTFGPTFRAENSHTSRHLAEFWMVEPEIAFADLEDDMNCAEAYVKYMCNWLLEKCYADMELMAKNFDSGCIDRLKLVASTPFGRITYTKAIELLEEAVAKGKEFDNNVEWGIDLASEHERYLTEVLFQKPLIVYNYPKGIKAFYMRLNDDEKTVAAMDVLVPKVGELIGGSQREERYDVIKKRIEEMGLPIEPYEWYLDLRRYGTVKHCGFGLGFERMILFATGLDNIRDVIPFPRYPGKADL

SEQ ID NO: 9743 - protein, 613 aa, Arabidopsis thaliana
  misc_feature: Ceres SEEDLINE ME19303
  misc_feature: Useful for making plants with modulated biomass
  misc_feature: Useful for making plants with modulated flowering time
  misc_feature: The plant flowers significantly late compared to wild-type.
  misc_feature: The rosette leaves do not appear in the normal fashion, i.e., their phyllotaxy may be abnormal or too many leaves may be emerging in comparison to the control.
MKSLNDLPAPKSTTTTYYDHSNDAWFKNRVTESETVKSSSIKFKVVPAYLNRQGLRPKNPEDFGDGGAFPEIHLPQYPLLMGKNKSNKPGAKTLPVTVDAQGNVVFDAIVRQNENSRKIVYSQHKDIIPKFLKNEGDLGTVVDEEEELQKEIQETAEETKAAIEKIVNVRLSAAQPSNIARQSGDSQYIKYKPSQQSSAFNSGAKERIIRMVEMPVDPLDPPKFKHKRVPRASGSPPVPVMHSPPRPVTVKDQQDWKIPPCISNWKNPKGYTIPLDKRLAADGRGLQDVQINDNFAKLSEALYVAEQKAREAVSMRSKVQKEMVMKDKERKEQELRALAQKARSERTGAAMSMPVSSDRGRSESVDPRGDYDNYDQDRGREREREEPQETREEREKRIQREKIREERRRERERERRLDAKDAAMGKKSKITRDRDRDISEKVALGMASTGGKGGGEVMYDQRLFNQDKGMDSGFAADDQYNLYDKGLFTAQPTLSTLYKPKKDNDEEMYGNADEQLDKIKNTERFKPDKAFTGASERVGSKRDRPVEFEKEEEQDPFGLEKWVSDLKKGKKPLDKIGSGGTMRASGGGGSSSRDDDHGGSGRTKINFERSDRR

SEQ ID NO: 9744 - protein, 541 aa, Arabidopsis thaliana
  misc_feature: Ceres SEEDLINE ME19541
  misc_feature: Useful for making plants with modulated biomass
  misc_feature: The rosette leaves do not appear in the normal fashion, i.e., their phyllotaxy may be abnormal or too many leaves may be emerging in comparison to the control.
MLCFRSQRVFILVSLCLLSSFLVVVTGTTSITGVGNEEERGVEEEWRTSVIERVIAEESGENSSLILAAKRTRRKDPADNFKLYTGGWNISNSHYLTSVGYTAAPFIIIALVWFVFFGLSLSLICLCYCCCARQSYGYSRVAYALSLILLISFTIAAIIGCVFLYTGQGKFHASTTDTLDYVVSQANLTSENLRNVSDYLNAAKKVDVQSSILPQDVLSSIDNIQGKINSSATTLSVKTMENQDKIQNVLDIMRLALVIIAAVMLFLAFIGFLLSIFGLQCLVYTLVILGWILVTVTFVLCGGFLLLHNVVGDTCVAMDQWVQNPTAHTALDDILPCVDNATARETLTRTKLVTYQLVNLLDNAISNMTNRNFPPQFRPLYYNQSGPLMPLLCNPFNADLSDRQCQPGQVHLNNATEVWKNFTCQIVTPGTCSTPGRLTPKLYSQMAAAVNVSYGLYKYGPFLADLQGCDFVRSTFTDIERDHCPGLKRYTQWIYVGLVVVSASVMSSLVFWVIYARERRHRVYTKDYNAMHSEDPRSKGH

SEQ ID NO: 9745 - protein, 160 aa, Arabidopsis thaliana
  misc_feature: Ceres SEEDLINE ME19619
  misc_feature: Useful for biocontainment applications
  misc_feature: The plant produces a reduced number of seeds.
MATSASALLSPTTFSTAISHKNPNSISFHGLRPLRLGGSSSALPKLSTTGRKSSSAVVRAELSPSIVISLSTGLSLFLGRFVFFNFQRENVAKQGLPEQNGKTHFEAGDDRAKEYVSLLKSNDPIGFNIVDVLAWGSIGHIVAYYILATSSNGYDPSFFG

SEQ ID NO: 9746 - protein, 253 aa, Arabidopsis thaliana
  misc_feature: Ceres SEEDLINE ME19621
  misc_feature: Useful for biocontainment applications
  misc_feature: Useful for making plants with modulated biomass
  misc_feature: The plant is abnormally small.
  misc_feature: The plant produces a reduced number of seeds.
MPTSDSGEPRRIAMKPNGVTVPISDQQEQLPCPRCDSSNTKFCYYNNYNFSQPRHFCKACRRYWTHGGTLRDVPVGGGTRKSAKRSRTCSNSSSSSVSGVVSNSNGVPLQTTPVLFPQSSISNGVTHTVTESDGKGSALSLCGSFTSTLLNHNAAATATHGSGSVIGIGGFGIGLGSGFDDVSFGLGRAMWPFSTVGTATTTNVGSNGGHHAVPMPATWQFEGLESNAGGGFVSGEYFAWPDLSITTPGNSLK

SEQ ID NO: 9747 - protein, 364 aa, Arabidopsis thaliana
  misc_feature: Ceres SEEDLINE ME20342
  misc_feature: Useful for making plants with modulated biomass
  misc_feature: Useful for making plants with modulated flowering time
  misc_feature: The plant flowers significantly late compared to wild-type.
  misc_feature: The plant is abnormally small.
MNTTSTHFVPPRRFEVYEPLNQIGMWEESFKNNGDMYTPGSIIIPTNEKPDSLSEDTSHGTEGTPHKFDQEASTSRHPDKIQRRLAQNREAARKSRLRKKAYVQQLETSRLKLIHLEQELDRARQQGFYVGNGVDTNALSFSDNMSSGIVAFEMEYGHWVEEQNRQICELRTVLHGQVSDIELRSLVENAMKHYFQLFRMKSAAAKIDVFYVMSGMWKTSAERFFLWIGGFRPSELLKVLLPHFDPLTDQQLLDVCNLRQSCQQAEDALSQGMEKLQHTLAESVAAGKLGEGSYIPQMTCAMERLEALVSFVNQADHLRHETLQQMHRILTTRQAARGLLALGEYFQRLRALSSSWAARQREPT

SEQ ID NO: 9748 - protein, 106 aa, Arabidopsis thaliana
  misc_feature: Ceres SEEDLINE ME21076
  misc_feature: Useful for making plants with modulated biomass
  misc_feature: The plant is abnormally small.
MDNTDRRRRRKQHKIALHDSEEVSSIEWEFINMTEQEEDLIFRMYRLVGDRWDLIAGRVPGRQPEEIERYWIMRNSEGFADKRRQLHSSSHKHTKPHRPRFSIYPS

SEQ ID NO: 9749 - protein, 115 aa, Arabidopsis thaliana
  misc_feature: Ceres SEEDLINE ME21325
  misc_feature: Useful for making plants with modulated flowering time
  misc_feature: The plant flowers significantly late compared to wild-type.
MVKSTSKDAQDLFRSLRSAYSATPTNLKIIDLYVVFAVFTALIQVVYMALVGSFPFNSFLSGVLSCIGTAVLAVCLRIQVNKENKEFKDLAPERAFADFVLCNLVLHLVIINFLG

SEQ ID NO: 9750 - protein, 479 aa, Arabidopsis thaliana
  misc_feature: Ceres SEEDLINE ME21331
  misc_feature: Useful for making plants with modulated biomass
  misc_feature: The rosette leaves do not appear in the normal fashion, i.e., their phyllotaxy may be abnormal or too many leaves may be emerging in comparison to the control.
MASGQREAERSAKAERAEAAASLAAEDLKDINKGDVTYKLTERTTTTEPERPGLIGSVMKAVQGTKDAVIGKSHDTAESTREGADIASEKAAGMRDTTGEVRDSTAQKTKETADYTADKAREAKDKTADKTKETADYAAEKAREAKDRTADKTKETAEYTAEKAREAKDKTADKLGEYKDYTAEKAKEAKDTTAEKLGEYKDYTVDKAKEAKDKTAEKAKETAEYTSDKARETKDKTAEKVGEYKDYTAEKAKETADKAREAKDKTAEKVGEYRDYTAEKATETKDAGVSKIGELKDSAVDTAKRAMGFLSGKTEETKQKAVETKDTAKEKMDEAGEEARRKMEEMRLEGKKLDEDASRKTQQSTESAADKAHETKDSVAQRGEEGKGSIMGALGNMTGAIKSKLTGATTPSDEETRASAHGDESTGKTVVAVDVKDTRPGYVATVLKEADQMTGQTFNDVGEIDDEEKVRIVVGEKKL

SEQ ID NO: 9751 - protein, 361 aa, Arabidopsis thaliana
  misc_feature: Ceres SEEDLINE ME21615
  misc_feature: Useful for making plants with modulated biomass
  misc_feature: The plant is abnormally small.
MDKYELVKDIGAGNFGVARLMRVKNSKELVAMKYIERGPKIDENVAREIINHRSLRHPNIIRFKEVVLTPTHIAIAMEYAAGGELFERICSAGRFSEDEARYFFQQLISGVSYCHAMQICHRDLKLENTLLDGSPAPRLKICDFGYSKSSLLHSMPKSTVGTPAYIAPEVLSRGEYDGKMADVWSCGVTLYVMLVGAYPFEDQEDPKNFKKTIQRIMAVKYKIPDYVHISQDCKHLLSRIFVTNSNKRITIGDIKKHPWFLKNLPRELTEIAQAAYFRKENPTFSLQSVEEIMKIVEEAKTPARVSRSIGAFGWGGGEDAEGKEEDAEEEVEEVEEEEDEEDEYDKTVKQVHASMGEVRVS

SEQ ID NO: 9752 - protein, 638 aa, Arabidopsis thaliana
  misc_feature: Ceres SEEDLINE ME24000
  misc_feature: Useful for making plants with modulated biomass
  misc_feature: The plant is abnormally small.
MGITKTSPNTTILLKTFHNNSMSQDYHHHHHHNQHQGGIFNFSNGFDRSDSPNLTTQQKQEHQRVEMDEESSVAGGRIPVYESAGMLSEMFNFPGSSGGGRDLDLGQSFRSNRQLLEEQHQNIPAMNATDSATATAAAMQLFLMNPPPPQQPPSPSSTTSPRSHHNSSTLHMLLPSPSTNTTHHQNYTNHMSMHQLPHQHHQQISTWQSSPDHHHHHHNSQTEIGTVHVENSGGHGGQGLSLSLSSSLEAAAKAEEYRNIYYGANSSNASPHHQYNQFKTLLANSSQHHHQVLNQFRSSPAASSSSMAAVNILRNSRYTTAAQELLEEFCSVGRGFLKKNKLGNSSNPNTCGGDGGGSSPSSAGANKEHPPLSASDRIEHQRRKVKLLTMLEEVDRRYNHYCEQMQMVVNSFDIVMGHGAALPYTALAQKAMSRHFRCLKDAVAAQLKQSCELLGDKDAAGISSSGLTKGETPRLRLLEQSLRQNRAFHQMGMEQEAWRPQRGLPERSVNILRAWLFEHFLHPYPSDADKHLLARQTGLSRNQVSNWFINARVRLWKPMVEEMYQQESKEREREEELEENEEDQETKNSNDDKSTKSNNNESNFTAVRTTSQTPTTTAPDASDADAAVATGHPSKIQH

SEQ ID NO: 9753 - protein, 626 aa, Arabidopsis thaliana
  misc_feature: Ceres SEEDLINE ME24015
  misc_feature: Useful for making plants with modulated biomass
  misc_feature: The plant is abnormally small.
MGKSSGRNGNGSFNGNKFHGVRPYVRSPVPRLRWTPDLHRCFVHAVEILGGQHRATPKLVLKMMDVKGLTISHVKSHLQMYRGGSKLTLEKPEESSSSSIRRRQDSEEDYYLHDNLSLHTRNDCLLGFHSFPLSSHSSFRGGGGGRTKEQQTSESGGYDDDADFLHIKKMNDTTTFLSHHFPKGTEEWREQEHEEEEEDLSLSLSLNHHHWRSNGSSVMNLSNRFGSNSKTAILNDSYSDENHSSSAAAAVTSVVIPPCSGNVLRAVLLLFFICFCFSLYRTSGYLRIVSDSSSTLSRIFPSVNDSSSSPSPSPSLSPEEIEEPKLEEVLRRAATKDGTVILTTLNEAWAAPGSVIDLFFESFRIGKGTRRLLKHLVIIALDAKAYSRCQELHKHCFRLETEGVDFSGGEAYFMTPSYLTMMWRRISFLRSVLEKGYNFVFTDADVMWFRNPFRRFYEDGDFQIACDHYIGRPNDFRNRPNGGFTFVRANNRSIGFYKFWYDSRTKYPKNHDQDVLNFIKTDPFLWKLRIRIRFLNTVYFGGFCEPSKDLNLVCTMHANCCFGLDSKLHDLRIMLQDWRDFKSLPLHSNQSSGFTWSVPQNCSLDSLRPVDSKDEEESEPPGESTQ

SEQ ID NO: 9754 - protein, 251 aa, Arabidopsis thaliana
  misc_feature: Ceres SEEDLINE ME24044
  misc_feature: Useful for making plants with modulated biomass
  misc_feature: Useful for making plants with modulated flowering time
  misc_feature: The plant flowers significantly earllier than wild-type.
  misc_feature: The plant is abnormally small.
MGRGRVELKRIENKINRQVTFAKRRNGLLKKAYELSVLCDAEVALIIFSNRGKLYEFCSSSNMLKTLDRYQKCSYGSIEVNNKPAKELENSYREYLKLKGRYENLQRQQRNLLGEDLGPLNSKELEQLERQLDGSLKQVRSIKTQYMLDQLSDLQNKEQMLLETNRALAMKLDDMIGVRSHHMGGGGGWEGGEQNVTYAHHQAQSQGLYQPLECNPTLQMGYDNPVCSEQITATTQAQAQQGNGYIPGWML

SEQ ID NO: 9755 - protein, 398 aa, Arabidopsis thaliana
  misc_feature: Ceres SEEDLINE ME24390
  misc_feature: Useful for making plants with modulated biomass
  misc_feature: The plant is abnormally small.
  misc_feature: There is no branching.
MEEYQHDNSTTPQRVSFLYSPISSSNKNDNTSDTNNNNNNNNSSNYGPGYNNTNNNNHHHQHMLFPHMSSLLPQTTENCFRSDHDQPNNNNNPSVKSEASSSRINHYSMLMRAIHNTQEANNNNNDNVSDVEAMKAKIIAHPHYSTLLQAYLDCQKIGAPPDVVDRITAARQDFEARQQRSTPSVSASSRDPELDQFMEAYCDMLVKYREELTRPIQEAMEFIRRIESQLSMLCQSPIHILNNPDGKSDNMGSSDEEQENNSGGETELPEIDPRAEDRELKNHLLKKYSGYLSSLKQELSKKKKKGKLPKEARQKLLTWWELHYKWPYPSESEKVALAESTGLDQKQINNWFINQRKRHWKPSEDMQFMVMDGLQHPHHAALYMDGHYMGDGPYRLGP

SEQ ID NO: 9756 - protein, 488 aa, Arabidopsis thaliana
  misc_feature: Ceres SEEDLINE ME24874
  misc_feature: Useful for biocontainment applications
  misc_feature: The plant produces a reduced number of seeds.
MSFRDDNTEEGRNDLRRPFLHTGSWYRMGSRQSSMLESSQVIRDSSISVLACVLIVALGPIQFGFTCGYSSPTQAAITKDLGLTVSEYSVFGSLSNVGAMVGAIASGQIAEYVGRKGSLMIAAIPNIIGWLSISFAKDTSFLYMGRLLEGFGVGIISYTVPVYIAEIAPQTMRGALGSVNQLSVTIGIMLAYLLGLFVPWRILAVLGVLPCTLLIPGLFFIPESPRWLAKMGLTDDFETSLQVLRGFETDITVEVNEIKRSVASSSKRSAVRFVDLKRRRYYFPLMVGIGLLALQQLGGINGVLFYSSTIFESAGVTSSNVATFGVGVVQVVATGIATWLVDKAGRRLLLMISSIGMTISLVIVAVAFYLKEFVSPDSNMYNILSMVSVVGVVAMVISCSLGMGPIPWLIMSEILPVNIKGLAGSIATLLNWFVSWLVTMTANMLLAWSSGGTFTLYALVCGFTVVFVSLWVPETKGKTLEEIQALFR

SEQ ID NO: 9757 - protein, 558 aa, Arabidopsis thaliana
  misc_feature: Ceres SEEDLINE ME25045
  misc_feature: Useful for making plants with modulated biomass
  misc_feature: Useful for making plants with modulated flowering time
  misc_feature: The plant flowers significantly late compared to wild-type.
  misc_feature: The plant is abnormally small.
MASSVVFAATGSLSVPPLKSRRFYVNSSLDSDVSDMSVNAPKGLFPPEPVPYKGPKLKVAIIGAGLAGMSTAVELLDQGHEVDIYDSRTFIGGKVGSFVDRRGNHIEMGLHVFFGCYNNLFRLMKKVGAEKNLLVKDHTHTFINKDGTIGELDFRFPVGAPIHGIRAFLVTNQLKPYDKLRNSLALALSPVVKALVDPDGAMRDIRNLDSISFSDWFLSKGGTRASIQRMWDPVAYALGFIDCDNMSARCMLTIFSLFATKTEASLLRMLKGSPDVYLSGPIKQYITDRGGRIHLRWGCREILYDKSADGETYVTGLAISKATNKKIVKADVYVAACDVPGIKRLLPKEWRESRFFNDIYELEGVPVVTVQLRYNGWVTELQDIELARQLKRAVGLDNLLYTPDADFSCFADLALASPADYYIEGQGTLLQCVLTPGDPYMRMPNDKIIEKVAMQVTELFPSSRGLEVTWSSVVKIAQSLYREAPGKDPFRPDQKTPIKNFFLAGSYTKQDYIDSMEGATLSGRQASSYICDAGEELAELNKKLSSSATAVPDELSLV

SEQ ID NO: 9758 - protein, 523 aa, Arabidopsis thaliana
  misc_feature: Ceres SEEDLINE ME25225
  misc_feature: Useful for making plants with modulated biomass
  misc_feature: Useful for making plants with modulated flowering time
  misc_feature: The plant flowers significantly late compared to wild-type.
  misc_feature: The plant is abnormally small.
MSMSEFGIVYAIHIITVQFGSVVSKVCECLLRKGPLSSRDISRLAESDINHNKVKDILYLLIQHNCVQAFSIEPPDGSESKAIVQYIVLFNNILHRVRYNKFSRIVNEELDSKCGAVLDGLLSNGRLTLGQFIERDRDSGNTIGSEAIRDSLQKLVAARFVERIPSPEPVLGNKEKEPAKRRGAKAAKILKEPETLEEQVVEAATPVDAIRFPLIFEEDSNSSLADDNSNITEGKRKQRDVDTSDSSSGVIWRPNFEEFIHRLRHKACVEIVKERRDEGCAIVLRAMLEVGRSQEKKVKTDNSAPMSVGSIYEEVIKTEAGRTMLQERVEACLDQLSATSSYLPAFVNEVNDSYIVDYKSIISVAQKDEIEAVVMRRYGKEAFRMFRYLSQEGRFVETDKIADAALTEKKDTPQFLLKMWKDGYLHMQKLAVTAPGMYTPFLLWKVNKLIVTTQMLDEMYHASLNLSLRLAHELEAEKELLLLPLDKLEGPLKERLKKVKAKRLLLSSTMFKLDDAIMLFHDF

SEQ ID NO: 9759 - protein, 198 aa, Oryza sativa
  misc_feature: Ceres SEEDLINE ME25699
  misc_feature: Useful for making plants with modulated biomass
  misc_feature: The plant is abnormally small.
MKRFAFEDSDMARVLMLMSSHGQQEQALALPVPVQLPLAAARGDRAPERAFVCKTCNRVFPSFQALGGHRASHKKPRLDGDGDLSLSKPKLHGCSICGLEFAIGQALGGHMRRHRAMTGGMPRAIVVDKKPDVVDVHVHGHDDDGGIKRGGLWLDLNHPPCDDAGDDDAECGHNAAGAGITFHQFLDTGAMAVDCVGY

SEQ ID NO: 9760 - protein, 147 aa, Oryza sativa
  misc_feature: Ceres SEEDLINE ME27002
  misc_feature: Useful for biocontainment applications
  misc_feature: Useful for making plants with modulated biomass
  misc_feature: The plant is abnormally small.
  misc_feature: The plant produces a reduced number of seeds.
MAVNSREEEAEMNLELTLCYTPPPPPPFVGFFFCMYCDRKFHSSQALGGHQNAHKLERSQAKLRREAIAAEILAHRAVVLQAGAAANHDGGYGAGSDPLPAAQKVRAEEVQRGAAASAPEFGGFARGESSPEYGVQQAHGQDLSLRL

SEQ ID NO: 9761 - protein, 236 aa, Oryza sativa
  misc_feature: Ceres SEEDLINE ME27008
  misc_feature: Useful for biocontainment applications
MDFDLFNSYPESQLDLMSTMLQLEQLTALSDQSLFMAAPTSPPVSPMGTPSPQFSPPPQMSVTTTTAGGGYQDQYNSMPATYGAGAGVHQLDFAMSSPGSDSGAPQGSSSSSSSEAMREMIFHIAALQPVEIDPEAVRPPKRRNVRISKDPQSVAARLRRERISERIRILQRLVPGGTKMDTASMLDEAIHYVKFLKSQVQSLERAAAATGAAAHRAAAFGAAYPAALPMQHHAPW

SEQ ID NO: 9762 - protein, 570 aa, Arabidopsis thaliana
  misc_feature: Ceres SEEDLINE SR05003
  misc_feature: Useful for making plants with altered carbon content
  misc_feature: Useful for making plants with altered nitrogen content
MSGSVSRDAEALKSADSSTRRSGGRITFPFMIVTLFGLTLATLGWLQNLIVYLIEEYNMKSIAAAKILNIFSGFTFMFPAIGAIAADSFFGTIPVILVSSFISLVGVVLLALTTLFDSLRPQACETASKLCQAPTNIQLGVLYTAITLGCVGAGGLRFTLATAGANQYEKTKDQGSFFNWFFFTWYLAASISATAIVYAEENISWSFGFGLCVAANLLGLIVFISGKKFYKHDKPLGSPFTSLLRVIFAAIRKRKAVVSTNEKDYHSESKKTPTKSFRFFNRAALKQDDEVNSDGTIHNQWRLCSVQQVEDFKAVIRIIPLVLAILFLSTPIAMQLGLTVLQGLVMDRRLGPHFKIPAGSLQVITLLSTCLFIIVNDRFLYPFYQKLTGKFPTPIQRVGIGHVFNILSMAVTAIVEAKRLKIVQKGHFLGSSSVADMSVLWLFPPLVIVGIGKELDPDHFIRLRREAFHFPGNVALCYQEFPESMRSTATSITSVLIGICFYTSTALIDLIQKTTAWLPDDINHGRVDNVYWILVIGGVLNLGYFLVCSWFYKYRNLENADHEQDANVSH

SEQ ID NO: 9763 - DNA, 390 bp, Panicum virgatum
  misc_feature: Ceres CLONE 1716328
  misc_feature: Encodes the peptide sequence at SEQ ID NO. 9764
actcccmactccaaccaccgcagcagctagcgaccggtctcactctcagcaatcgcctygccatgttctccatgttcggattcttcrtccaggccatcgtcaccggcaagggcccgctcgagaacctcgccgaccacctcgccgacccggtcaacaacaacgcctgggcctacgccaccaacttcgtccccggcaactaagctccgatccattggcaatgcaacttcattgtcttccggagggggcgtacgtggatccattgatgctgcaagctgccgcgtgtgcgtctcttgtttcacgttgcatttcaggggcaagtcgagatgatgagttgccgttgtacactaagatgaacgatgatgcttgtgcaatagtagtggttttgttcct

SEQ ID NO: 9764 - protein, 65 aa, Panicum virgatum
  misc_feature: Ceres CLONE 1716328
  misc_feature: Functional homolog of the protein sequence given in SEQ ID NO 50109
  misc_feature: Useful for making plants with modulated nitrogen use efficiency
  misc_feature (2)..(2): Xaa is any aa, unknown, or other
  misc_feature (29)..(29): Xaa is any aa, unknown, or other
SXLQPPQQLATGLTLSNRLAMFSMFGFFXQAIVTGKGPLENLADHLADPVNNNAWAYATNFVPGN

SEQ ID NO: 9765 - DNA, 532 bp, Panicum virgatum
  misc_feature: Ceres CLONE 1716359
  misc_feature: Encodes the peptide sequence at SEQ ID NO. 9766
ttctgcctccactctccacacgactcctttccgccgccgccgacgccgccgccgtcgcagcagtcaccgtgaccagcaaccggacaaagtatggatacccaggttaagcttgctgttgtggtgaaggtgatgggccgcactggctccaggggtcaggtgacccaggtcagggtgaagttcctggacgaccagaaccgtctcatcatgaggaacgtcaagggccctgtccgtgagggtgacatcctcaccctcctcgagtctgagagggaggccaggaggctgcgctgaacggctgaagcagctggtggttgcgccagttgttggccattcctgttttaaacaagttaaatgatgaattgaatccccccttgcctagtgtactgctttcgtatcaagttattgaacaatgctactttgtcctttgagtaggctatggagaatgggcttaagcaatggaattgtaatttgagtactcgtcttgttgcaagttttggtctgttattgcctgaatgaatttaagtgcacaaaaggg

SEQ ID NO: 9766 - protein, 65 aa, Panicum virgatum
  misc_feature: Ceres CLONE 1716359
  misc_feature (1)..(65): Pfam Name: Ribosomal_S28e Pfam Description: Ribosomal protein S28e
MDTQVKLAVVVKVMGRTGSRGQVTQVRVKFLDDQNRLIMRNVKGPVREGDILTLLESEREARRLR

SEQ ID NO: 9767 - DNA, 824 bp, Panicum virgatum
  misc_feature: Ceres CLONE 1716363
  misc_feature: Encodes the peptide sequence at SEQ ID NO. 9768
gttcccccatccgcgcaggccaaccaacagtgccctccctcctctccttccgcgtcgcgtgccctcgccgcagcccatccccatggcagaccagctcaccgacgagcagatcgcggagttcaaggaggcgttcagcctcttcgacaaggacggcgacggttgcatcactaccaaggagctgggaactgttatgcgctcccttggccagaaccctactgaagcagagctgcaggacatgatcaacgaggttgatgctgatggcaatggtaccatcgacttcccagagttcctgaacctgatggcaaggaagatgaaggacactgactccgaggaggagctcaaggaggctttccgcgtctttgacaaggaccagaacggtttcatctcggctgctgagctccgccatgtcatgaccaaccttggtgagaagctgaccgacgaggaagtcgacgagatgatccgtgaggctgatgtggacggtgatggccagatcaactatgaggagtttgtcaaggtcatgatggccaagtgaggagcggtccccccaaaataagtttgtccaaagcaaactgaattatcaggctcacaagctgtactttgtcatgtcccgttgatgagcacgtatcagtatcatgcaggtggtaatgttgagtagtggtcgggttaggtggtgtagtcatgggaacgcgacatcagatacctgtttcttttgattgttatgttgttatcttgcattattgcgcctgttggagctttaggatttgttgaagttcatattttcgtgggtattgtctttctttttttgcgcaagtcttatctttctt

SEQ ID NO: 9768 - protein, 149 aa, Panicum virgatum
  misc_feature: Ceres CLONE 1716363
  misc_feature (121)..(149): Pfam Name: efhand Pfam Description: EF hand
  misc_feature (85)..(113): Pfam Name: efhand Pfam Description: EF hand
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
  misc_feature: Functional homolog of the protein sequence given in SEQ ID NO 50110
  misc_feature: Useful for making plants with modulated salt sensitivity
MADQLTDEQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMAK

SEQ ID NO: 9769 - DNA, 409 bp, Panicum virgatum
  misc_feature: Ceres CLONE 1716365
  misc_feature: Encodes the peptide sequence at SEQ ID NO. 9770
atattgtactgtgaggaagtgaagaatcaggctgcttctgaaatagatgccctgtatgatgagataaggccagcgattgaagagcatgagagggatagccaagacagcgtctccacaagccttgcggagaagtggatcgaggccagctgctgcaagtacaaagctgatttcgatctgtatgccgcaatcatcaagaacattgcctccatgccgctaagatctaaggatgatatggccccgagagaacagaatggattgaaatacttggaaaatggctcgtgatttagttagaaatgtgaattctttactattgcattcttgaattgatcttaattaccttatcaaaaaaacgatcttaattaggtagagaaacattgtgaggtcacaaattaacaatgttgaattacac

SEQ ID NO: 9770 - protein, 93 aa, Panicum virgatum
  misc_feature: Ceres CLONE 1716365
  misc_feature: SWISSPROT Homolog: EC 2.1.1.43 Histone-lysine N-methyltransferase
ILYCEEVKNQAASEIDALYDEIRPAIEEHERDSQDSVSTSLAEKWIEASCCKYKADFDLYAAIIKNIASMPLRSKDDMAPREQNGLKYLENGS

SEQ ID NO: 9771 - DNA, 533 bp, Panicum virgatum
  misc_feature: Ceres CLONE 1716386
  misc_feature: Encodes the peptide sequence at SEQ ID NO. 9772
acggaagtccccctctctcctctctctctctcggccgccttctttcttctcctttccaagcggcgacgacaggggagtggcgccgcccttgccagtttcgtcgggcgcttcgccggccaagtctccttttctaaactcgtagtcgctgatggggaaagcaaagcgtgcctcaatcttcatcaggctggtttctgcagccggtactgggttcttctatgtgaagcgcaagaatcctcggcggatcactgagaagcttgaatttaggaagtatgatccccgtgtgaacaagcatgttctgttcacagaagcaaagatgaagtgagatcttctaccttcacacaatgcagaacaggaataggttgtcagcattttgcaatcagaaatctctagtaccattaaggatgtcatgttctggtttccagtgttccatttggataactgtaatgggcatatgattaaggatttgatgtgctcttccagtcgattttttgcaacaataaacattttgttgctcgagtgagctgcagacctgc

SEQ ID NO: 9772 - protein, 57 aa, Panicum virgatum
  misc_feature: Ceres CLONE 1716386
  misc_feature (8)..(55): Pfam Name: Ribosomal_L33 Pfam Description: Ribosomal protein L33
MGKAKRASIFIRLVSAAGTGFFYVKRKNPRRITEKLEFRKYDPRVNKHVLFTEAKMK

SEQ ID NO: 9773 - DNA, 766 bp, Panicum virgatum
  misc_feature: Ceres CLONE 1716428
  misc_feature: Encodes the peptide sequence at SEQ ID NO. 9774
aatagccggttcttaatctcaggtttgggggaaaaaaagcctcgcaaaccacaactctccgctgatttgggaggcgctcgaggtaaaccagaccattgggacacatggctcgtactaagcaaaccgctcgcaagtccactggaggcaaggctcctaggaagcaactagccaccaaggctgcccgtaagtctgcgcccacaactgggggagtgaagaagcctcaccgttaccgccctgggactgttgctcttcgtgaaatccgcaagtaccagaagagcactgacctgctcataaggaagcttccattccagaggcttgttagggagattgcccaggatttcaagactgatctgcgtttccagagccatgcggtgcttgccctgcaggaggctgcggaagcatacctggtgggtctgttcgaggacaccaacctgtgcgccatccacgccaagcgtgtgacgatcatgcctaaggacattcagctggctaggaggattcgcggcgagagggcttagtttcactgctctggtgtgcatctgttcgatgcaactgcttttgcgatgttggtgctttaacttctgtcagtgttttgaactctgaatagttatagtgttcgtttgtggtgctaggttaggtgctgctgcaatcttattatgttttagagtttaatcgcttggtaccgaatacatcttgtaagtgctggtttcatccatccacctgatgggtgtggtttctatctgaattctgaaccttgaactggtatgtt

SEQ ID NO: 9774 - protein, 136 aa, Panicum virgatum
  misc_feature: Ceres CLONE 1716428
  misc_feature (58)..(132): Pfam Name: Histone Pfam Description: Core histone H2A/H2B/H3/H4
MARTKQTARKSTGGKAPRKQLATKAARKSAPTTGGVKKPHRYRPGTVALREIRKYQKSTDLLIRKLPFQRLVREIAQDFKTDLRFQSHAVLALQEAAEAYLVGLFEDTNLCAIHAKRVTIMPKDIQLARRIRGERA

SEQ ID NO: 9775 - DNA, 334 bp, Panicum virgatum
  misc_feature: Ceres CLONE 1716442
  misc_feature: Encodes the peptide sequence at SEQ ID NO. 9776
agagactagccggagcttctttgttggtgtttgcaaacaagcaggacattcagggcgctctgaaacctgcagaaatcgccaaggtcctggatctggcagccatggagaagagccggcactggcagatcgtcggctgcagcgcccacaccggcgacgggctgcttcggggtttcgactggctcgttcaagacgccgcctcgcgcatctacgtcctcgactgaatacctgaagagagtccctatcttatgccgatgatggagtatcgagttcaggattgttgtgctagacttgactcgatgcaagtgactgaaaaaatcaaatcttttcactcggt

SEQ ID NO: 9776 - protein, 72 aa, Panicum virgatum
  misc_feature: Ceres CLONE 1716442
  misc_feature (1)..(64): Pfam Name: Arf Pfam Description: ADP-ribosylation factor family
RLAGASLLVFANKQDIQGALKPAEIAKVLDLAAMEKSRHWQIVGCSAHTGDGLLRGFDWLVQDAASRIYVLD

SEQ ID NO: 9777 - DNA, 738 bp, Panicum virgatum
  misc_feature: Ceres CLONE 1716482
  misc_feature: Encodes the peptide sequence at SEQ ID NO. 9778
ctctcagcgccgccaaggtgccgtcagagacccaccatgggtatctcccgtgactcgctgcacaagcgccgggcgactggtggaaggaagaagcactggcgcaagaagaagaaatatgagctgggccgccagccagccatgaccaagctgtccagcaacgtggcagtgcgcaaggtccgcgtgcgcggtggcaacaccaagttccgcgccctgcgcctggacgctggcaacttctcctggggcactgaggctgtcacccgcaaggctcgtattctggatgtgtgctacaacgcctccaacaacgagcttgtgcgcactcagaccctggtgaagaacgccatcatccaggttgatgccacccccttcaagcagtggtaccagacgcactacggtgtggagctgggcaacaagggcaaggaggaggccaaggttgaggacaagaaggcttccaaccacgtcaagaggaagctgaagcagcgcactgccacccgcaagctggaccagaacgtggctgaccagttcaccactggtcgcctgtacgcctgcatctcctcccgccccggccagtgcggacgctgcgacggctacatcctggagggcaaggagctggagttctacgtcaagaagatgcagaagaagaagtccaaggctgcgtaggcctagaggggggctgtagcgcgctttgcttgttgcttctctcttcttgcctgctcactgggtgtaaacagtaaaaaacgc

SEQ ID NO: 9778 - protein, 206 aa, Panicum virgatum
  misc_feature: Ceres CLONE 1716482
  misc_feature (1)..(186): Pfam Name: Ribosomal_S8e Pfam Description: Ribosomal protein S8e
MGISRDSLHKRRATGGRKKHWRKKKKYELGRQPAMTKLSSNVAVRKVRVRGGNTKFRALRLDAGNFSWGTEAVTRKARILDVCYNASNNELVRTQTLVKNAIIQVDATPFKQWYQTHYGVELGNKGKEEAKVEDKKASNHVKRKLKQRTATRKLDQNVADQFTTGRLYACISSRPGQCGRCDGYILEGKELEFYVKKMQKKKSKAA

SEQ ID NO: 9779 - DNA, 479 bp, Panicum virgatum
  misc_feature: Ceres CLONE 1716552
  misc_feature: Encodes the peptide sequence at SEQ ID NO. 9780
gcccagaatccaaagctatggggggggcccaggaccaagaaatcctcacctccactcccgtcctcgtcttcaacaagtcttactgtcctttctgcgtccctgtgaaacacctgttctagaacctggtagcaagcttcaaggccattcacattgatgtggaaagtgatggacctaagatccccgatcctctcaacgaatgcactggccacacgaccgtcccaaatgtcttcatccatcctaaacatattgatggctgccatgataccatggcactgaacaatgatgggaagctggtggctctgctaactgaggctcgagcaatctcgggttctacctccaataaaaccgccactgcttagctaaacctgagagttgtcccggttgacatgtttatactgttcccatagtatgaaataaaggggctatgcttcgcaagtcctgaactttgtgctgtcgaagtgtcaagtactatcatgact

SEQ ID NO: 9780 - protein, 33 aa, Panicum virgatum
  misc_feature: Ceres CLONE 1716552
  misc_feature: Functional homolog of the protein sequence given in SEQ ID NO 50111
  misc_feature: Useful for biocontainment applications
MGGAQDQEILTSTPVLVFNKSYCPFCVPVKHLF

SEQ ID NO: 9781 - DNA, 340 bp, Panicum virgatum
  misc_feature: Ceres CLONE 1716648
  misc_feature: Encodes the peptide sequence at SEQ ID NO. 9782
cttctgttttctctctacggggactcgctggggccgccgcctccgccgtcgtcgcagcagtcaccgtgacctgcaaccggacatagcatggatactcaggttaagcttgctgttgtggtcaaggtgatgggccgcactggctccaggggtcaggtgacccaggtcagagtgaagttcctggacgaccagaaccgtctcatcatgaggaacgtcaagggccctgtccgtgagggtgacatcctcaccctgctcgagtctgagagggaggccaggaggctgcgctgaagcagctggttgttgtgccagttgttcgccgttcctgtcttaaacaagttgatga

SEQ ID NO: 9782 - protein, 65 aa, Panicum virgatum; identical to SEQ ID NO: 9766
  misc_feature: Ceres CLONE 1716648
  misc_feature (1)..(65): Pfam Name: Ribosomal_S28e Pfam Description: Ribosomal protein S28e

SEQ ID NO: 9783 - DNA, 404 bp, Panicum virgatum
  misc_feature: Ceres CLONE 1716648-R
actccccgggacccacagcccgggaaacccaggtcagtgaggagttgctggacgtccagatccgtgtgatgggccgcaccgtttaggggcctctccttcagggggtcagcctcaccttcctggagtaccagaacggggtcagcaggaggaacgtcaacagccgggggtggcaccgttacatgcccacccgcgtcttaatccaagatgaatgccggatggaatcccccatgcactagggtgttgtttcagtattcaagctgttgaactcattaatacaagttcctgagagaaggattacccgaaccctcttaaacagtgaaagcatcaagtgcttgatggtcgtgacgcagtctttggtatgttatggcccgaatgagttaaaggcaatggaatgatatttggcg

SEQ ID NO: 9784 - DNA, 346 bp, Panicum virgatum
  misc_feature: Ceres CLONE 1716657
  misc_feature: Encodes the peptide sequence at SEQ ID NO. 9785
ctctgcaagcggcagaattacttccagaacttgacgaagcacacctacctgaaagggcgctatgatgtgatcacctccgttgccatcccccttgcacttggtgcctccagcatgttcatgattggccgaggagtttacaacatgtctcatgagattgggaaaaaggagtgaacttccacgggctatctagtgggcatggaagtaataccatcctttttgttaagtctttgattgcaaaataatactgtcaaagaacgatccaactgcatttccgcttcttttttgtttgtacatgtggatatccactgccagctacttgaagatcagcgtaatcattgtttcagtt

SEQ ID NO: 9785 - protein, 56 aa, Panicum virgatum
  misc_feature: Ceres CLONE 1716657
  misc_feature (1)..(51): Pfam Name: COX7a Pfam Description: Cytochrome c oxidase subunit VIIa
LCKRQNYFQNLTKHTYLKGRYDVITSVAIPLALGASSMFMIGRGVYNMSHEIGKKE

SEQ ID NO: 9786 - DNA, 770 bp, Panicum virgatum
  misc_feature: Ceres CLONE 1716688
  misc_feature: Encodes the peptide sequence at SEQ ID NO. 9787
gtcggccgccatctccccactcttaggttttaggtcccctcgccgccgccgccggcctcgcgaggttgcagaaatggtcgcccacaggttccatcagtaccaggtggtgggtcgcgcgctgccgacccccggcgatgagcaccccaagatctaccgcatgaagctctgggccaccaacgaggtccgcgccaagtccaagttctggtacttcctgaggaagctcaagaaggtgaagaagagcaacggccagattctcgccatcaacgagatctttgagcgcaaccctacaacaatcaagaattacggcatctggctgcgttaccagagcaggacaggttaccacaacatgtacaaggagtaccgtgacaccaccttgaatggttctgtggagcagatgtacaatgagatggcctcccgtcaccgtgtgaggtccccctgcatccaaatcattaaaacagcaacagtccaattcaagctctgcaagagggacaacaccaagcagttccacaattccaagattaagttccctcttgtgtcccgcatggtcagaccaccaaccaggaagctgaagacgaccttcaaggcttcaaggcccaacttgttcatgtgatccaactcaccctgactcccttcctaatctgtaagcgcagacagtttggaggcttgctagttgagattaatcatatctgctgcaacttattgtttctatattttagttttaggtccttatgctggcctttattagcttaatgaatgtcctcttttcttcc

SEQ ID NO: 9787 - protein, 178 aa, Panicum virgatum
  misc_feature: Ceres CLONE 1716688
  misc_feature (5)..(178): Pfam Name: Ribosomal_L18ae Pfam Description: Ribosomal L18ae protein family
MVAHRFHQYQVVGRALPTPGDEHPKIYRMKLWATNEVRAKSKFWYFLRKLKKVKKSNGQILAINEIFERNPTTIKNYGIWLRYQSRTGYHNMYKEYRDTTLNGSVEQMYNEMASRHRVRSPCIQIIKTATVQFKLCKRDNTKQFHNSKIKFPLVSRMVRPPTRKLKTTFKASRPNLFM

SEQ ID NO: 9788 - DNA, 461 bp, Panicum virgatum
  misc_feature: Ceres CLONE 1716728
  misc_feature: Encodes the peptide sequence at SEQ ID NO. 9789
ctctcggccggaggagctcatgatgctgatcgactacgtgattaggagcaactgggtcccttgcctcgagtgcagcaagctcggcttcgtcttccgtgagaacgccacttcccccgggtactacgatggccgctactggaccatgtggaagctgcccatgttcggctgcaccgacgccactcaggtgtacgccgagctcgaggagtgtaagaaggcctaccccgacaactacatccgcattctcggattcgacaacgccaggcaggtgcagtgcgtcatgttcatcgcctacaagcccgagtagaccggcggcgcctaagcttaccgatcgcgcgcgcggacaggaggcccggcagctcgctcgtgagcggccgtgaagtgtctactcggttttggcgaacttgaagctctatgtctcgtcgtcctcctttgtttgtttcctttcttgatactcatcagtg

SEQ ID NO: 9789 - protein, 100 aa, Panicum virgatum
  misc_feature: Ceres CLONE 1716728
  misc_feature (3)..(99): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
SRPEELMMLIDYVIRSNWVPCLECSKLGFVFRENATSPGYYDGRYWTMWKLPMFGCTDATQVYAELEECKKAYPDNYIRILGFDNARQVQCVMFIAYKPE

SEQ ID NO: 9790 - DNA, 591 bp, Panicum virgatum
  misc_feature: Ceres CLONE 1716780
  misc_feature: Encodes the peptide sequence at SEQ ID NO. 9791
acccccaaaatcctctcccggcacgctcctccctccctctcttatcccctccctcccccctcgcgcggcgccaccatggcctcctccgtcggaaacagaggggcaaagagtatgatagtgggggcagggacagtggtatccggagggagaggtctagcgatcgtgactatgaccgtgatcgtcagtatgagcgaagccgtggaagagataggccctatgatcacagagatagaggatcagaatatcgaaataattccttcagaaatgggagggattccgaaagaggcgggcatagatacaggagtggtgatatgacaaacgaccgagggagaatgcggagcaggtcacgttctccaaacaggcatggctatggaaggtctagaagtccagatcattagctgaacatttagatagttttattcacatttgggactcatgaggtagaccgttcaattttgctatttattactgtacaatggattttattgaagtgtcgcactcgtttaagtctctgctctgctgtaacagctctgttggaaccctacagtcttcctttttacatggcaaaaaaaaaaaaaaaaaaaaactcga

SEQ ID NO: 9791 - protein, 131 aa, Panicum virgatum
  misc_feature: Ceres CLONE 1716780
  misc_feature: SWISSPROT Homolog: EC 5.2.1.8 Peptidylprolyl isomerase
PQNPLPARSSLPLLSPPSPLARRHHGLLRRKQRGKEYDSGGRDSGIRRERSSDRDYDRDRQYERSRGRDRPYDHRDRGSEYRNNSFRNGRDSERGGHRYRSGDMTNDRGRMRSRSRSPNRHGYGRSRSPDH

SEQ ID NO: 9792 - DNA, 194 bp, Panicum virgatum
  misc_feature: Ceres CLONE 1716782
  misc_feature: Encodes the peptide sequence at SEQ ID NO. 9793
agtggtttgaatgcaacaatgagcatcctcctggtcatggcaaatatcatatatttatcaggggacggaggtgttcttaagacggtggtccggaaagcacatgatgatgctatagcgccatatgatagtctgcccttggttgatgttcattacgaaagcacacttgctgagaataggtgaagttttggacacca

SEQ ID NO: 9793 - protein, 47 aa, Panicum virgatum
  misc_feature: Ceres CLONE 1716782
  misc_feature: Functional homolog of the protein sequence given in SEQ ID NO 50112
  misc_feature: Useful for making plants with modulated biomass
MANIIYLSGDGGVLKTVVRKAHDDAIAPYDSLPLVDVHYESTLAENR

SEQ ID NO: 9794 - DNA, 452 bp, Panicum virgatum
  misc_feature: Ceres CLONE 1716793
  misc_feature: Encodes the peptide sequence at SEQ ID NO. 9795
tcaaggagctcaagctcaaggagatcaagaacggcaggctcgccatgctcgccatcctcggctacttcatccaggggctcgtcaccggcgtcggcccctaccagaacctgctcgaccacctcgccgaccccgtcaacaacaacgtgctcaccagcctcaagttccactagagatgccgccggccgccgcctgttgttgtagtgggagcgagagaggtgatcgtcgatgtgtgttcgtcatgtgctggctgatgggaaggattattccgaggcgctgcatgatccgtccattgcccggcctgctcgctgctcgtaacgaattagtaatccatccatcctgttaattcagacccaggaaccgtactactgcacatggtaaatcaatgtacaattccgatcgactccagtgtcattatatatgttgagcgacgacggcgtccatttcatcttacc

SEQ ID NO: 9795 - protein, 55 aa, Panicum virgatum
  misc_feature: Ceres CLONE 1716793
  misc_feature: Functional homolog of the protein sequence given in SEQ ID NO 50109
  misc_feature: Useful for making plants with modulated nitrogen use efficiency
  misc_feature: Functional homolog of the protein sequence given in SEQ ID NO 50113
  misc_feature: Useful for making plants with modulated oxidative stress sensitivity
  misc_feature: Functional homolog of the protein sequence given in SEQ ID NO 50114
  misc_feature: Useful for making plants with modulated water use efficiency
  misc_feature: Functional homolog of the protein sequence given in SEQ ID NO 50115
  misc_feature: Useful for making plants with modulated biomass
  misc_feature: Useful for making plants with modulated drought sensitivity
  misc_feature: Useful for making plants with modulated phosphate use efficiency
KELKLKEIKNGRLAMLAILGYFIQGLVTGVGPYQNLLDHLADPVNNNVLTSLKFH

SEQ ID NO: 9796 - DNA, 487 bp, Panicum virgatum
  misc_feature: Ceres CLONE 1716803
  misc_feature: Encodes the peptide sequence at SEQ ID NO. 9797
gcttctgcctcctctctccacacgacttgctcccgccgccgccgccgccgccgccgccgtcgcagcagtcaccgtgaccagcaaccggacaaagtatggatacccaggttaagcttgctgttgtggtgaaggtgatgggccgcactggctccaggggtcaggtgacccaggtcagggtgaagttcctggacgaccagaaccgtctcatcatgaggaacgtgaagggccctgtccgtgagggtgacatcctcaccctcctcgagtctgagagggaggccaggaggctgcgctgaagcagctggtggttgcgccagttgttggccattcctgtactgctttcgtatcaagttattgaacaatgctaccttgtcctttgagtaggctatggagaatgggcttaagcaatcgaattgtaatttaagcactcgtcttattgcaagttttggtctgttattgcctgaatgaatttaagtgcacttgatgcgtg

SEQ ID NO: 9797 - protein, 65 aa, Panicum virgatum; identical to SEQ ID NO: 9766
  misc_feature: Ceres CLONE 1716803
  misc_feature (1)..(65): Pfam Name: Ribosomal_S28e Pfam Description: Ribosomal protein S28e

SEQ ID NO: 9798 - DNA, 383 bp, Panicum virgatum
  misc_feature: Ceres CLONE 1716858
  misc_feature: Encodes the peptide sequence at SEQ ID NO. 9799
atcccgttcccgtggcgtgccttctagggtttccttcctccccccgcctccccgcgccgctccctcccgcccgccagatttggatctgcgctccagccccaggttgttccgatggctcctgctgtagaagctgtgaacgaggcaggctcattccaaaaggttcctgctctgaatgaaagaatactgtcatccatgtccaggagatctgttgctgcgcatccttggcatgatctggagattggacctggtgcaccaaccatattcaactgtgtaaggacatcatgtgatacttcactgatcaattgatcttttgttacttaacattgatggatacttttgcaacatgttaatttcaatatcacaatattttgtcttttcttcgg

SEQ ID NO: 9799 - protein, 64 aa, Panicum virgatum
  misc_feature: Ceres CLONE 1716858
  misc_feature: SWISSPROT Homolog: EC 3.6.1.1 Inorganic diphosphatase
  misc_feature: Functional homolog of the protein sequence given in SEQ ID NO 50116
  misc_feature: Useful for making plants with modulated nitrogen use efficiency
MAPAVEAVNEAGSFQKVPALNERILSSMSRRSVAAHPWHDLEIGPGAPTIFNCVRTSCDTSLIN

SEQ ID NO: 9800 - DNA, 418 bp, Panicum virgatum
  misc_feature: Ceres CLONE 1716873
  misc_feature: Encodes the peptide sequence at SEQ ID NO. 9801
atcacgcatggcwacyctmtacagaswgacctcygaatcattttysaarctrtcrawstgggaagtgtracracatmtgatsmtttgggtacagcaaaggmcagawrcttrmaatcmgasgagatatagcttatggmtcttctatttcwgtacyrccatcgayagatcwgtayaaaatcgttctgtmaaacatgttcgagaggttgtgcgctctctgtgacgcttatttgtagggctcttatttctatgggatattcaatgtgaaagagaagaaaatttttggattgatgtcacctgactgccacgtcctgatgacacggattctttctgttattcaaaaaggtgttccccctgaaaatgtgagattgacaaatatgaaggtgtgcgcggtcatcaatgaaatttctcagaaagcaat

SEQ ID NO: 9801 - protein, 43 aa, Panicum virgatum
  misc_feature: Ceres CLONE 1716873
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
MSPDCHVLMTRILSVIQKGVPPENVRLTNMKVCAVINEISQKA

SEQ ID NO: 9802 - DNA, 452 bp, Panicum virgatum
  misc_feature: Ceres CLONE 1716970
  misc_feature: Encodes the peptide sequence at SEQ ID NO. 9803
aatgtcgtttcagttcaagatttctcttttaagaagacaagagaggggagaagatgcaggactgggcgccggtgttcatctcgctggtgctcttcatcctgctgtcgccgggcctgctgttccagatccccggcaagtgccggatcatcgacttcggcaacttccacaccagcgctctctccatcctcgtccactccatcctcttcttcgctctcatcgccatcttcctcatcgccatcggcgtgcacatgtacctcgggtcctagctggtagctttttttagcctgatgcctacctgcctgccgatggtgttcgtcgatcagcttgcatctcgatcgtgttcttctctgctagtcgcccatctctaattaaggggttctattttctatacacatgtattgaataacaatgtatgtaccatccatgcatgttcaaaaatcaaaaaaaaaacc

SEQ ID NO: 9803 - protein, 70 aa, Panicum virgatum
  misc_feature: Ceres CLONE 1716970
  misc_feature: Functional homolog of the protein sequence given in SEQ ID NO 50117
  misc_feature: Useful for making plants with altered cell wall content and/or composition
MQDWAPVFISLVLFILLSPGLLFQIPGKCRIIDFGNFHTSALSILVHSILFFALIAIFLIAIGVHMYLGS

SEQ ID NO: 9804 - DNA, 744 bp, Panicum virgatum
  misc_feature: Ceres CLONE 1717015
  misc_feature: Encodes the peptide sequence at SEQ ID NO. 9805
agcacaagcacacgcacaagcccaagcaggatggcgacctcgacggcgaggacggtgaaggatgtcaacccgcacgagttcgtcaaggcctactccgcgcacctcaagcgctccggcaagatggagctccctgagtgggttgacattgtgaagactgcgaggttcaaggagctccctccttatgaccctgactggtactacaccagggctgcctctattgcaaggaagatctacctgaggcaaggcattggtgtgggtggattccagaaaatctacggtggccgccagaggaatggttcctgtccgccacacttctgcaagagcagtggcgccatttcacgcaacatcctgcagcagttgcagaaaatgggcatcattgatgttgatcccaagggtggacggctgattacttcccagggaaggcgtgatctggaccaagtggctggaagggttgctgttgaagcttgagcagtatcatcttctgtttgaatggtgtcgtgtttgatggttgagatggctactatatttgcagttttgaattaggacttgtaccaccttttttgtttagagaatttaatgttaatgcatctagctatgaagcagcacactatatcttcgctgaggatctaatgcaatgtctgaactcctgaaccagagaaatttgtttgcgactgagctgatatccataatgtgttttgcttctcgtacagatctggtgccctaaaagtgggtttcatcagtttc

SEQ ID NO: 9805 - protein, 145 aa, Panicum virgatum
  misc_feature: Ceres CLONE 1717015
  misc_feature (7)..(145): Pfam Name: Ribosomal_S19e Pfam Description: Ribosomal protein S19e
MATSTARTVKDVNPHEFVKAYSAHLKRSGKMELPEWVDIVKTARFKELPPYDPDWYYTRAASIARKIYLRQGIGVGGFQKIYGGRQRNGSCPPHFCKSSGAISRNILQQLQKMGIIDVDPKGGRLITSQGRRDLDQVAGRVAVEA

SEQ ID NO: 9806 - DNA, 391 bp, Panicum virgatum
  misc_feature: Ceres CLONE 1717016
  misc_feature: Encodes the peptide sequence at SEQ ID NO. 9807
aaaaaaaaagaacaagcacctccccgagcttgatggcgacctcgacggtgaggacggtgaatgatttctactctctcgagttcgtcaaggcctactgcgcgcgcctcaagcgctccggcgagatggagctccctgagtgggttgacattgtgaagactgccaggttcaaggagctccctccttatgaccctgagtggtactacaccagggctgcctctatcgcaaggaagatctacctgacgctaggcattggtgtgggtggattccagaaaatctaccgtggccgccagacgaatggttcctgtccgccacacttctgcaagagcagtggcgccatttcacccaacatcctgcagcagttgcacaaaatgggcatcattgatgttgatcc

SEQ ID NO: 9807 - protein, 119 aa, Panicum virgatum
  misc_feature: Ceres CLONE 1717016
  misc_feature (7)..(119): Pfam Name: Ribosomal_S19e Pfam Description: Ribosomal protein S19e
MATSTVRTVNDFYSLEFVKAYCARLKRSGEMELPEWVDIVKTARFKELPPYDPEWYYTRAASIARKIYLTLGIGVGGFQKIYRGRQTNGSCPPHFCKSSGAISPNILQQLHKMGIIDVD

SEQ ID NO: 9808 - DNA, 779 bp, Panicum virgatum
  misc_feature: Ceres CLONE 1717050
  misc_feature: Encodes the peptide sequence at SEQ ID NO. 9809
gagtcctccatttagccctcggttctcgagtcttccagactcgcgctcgctgctcgctgctcgccttcgcttccgacttctccactcgcgtcgcacgcaggggtcgcctgagatcacatagacaatggtgaaggctgtcgctgtcctcgctggcagtgatgtcaagggtaccattttcttttctcaagagggagatggtccaaccaccgtgaccggaagtatctctgggctcaagccggggctccatgggttccatgtgcatgcgcttggtgacaccaccaatggctgcatgtccactgggccacacttcaatcctgctgctaaggagcatggtgcaccagaagatgagaatcgccatgccggtgatcttgggaatgtgacagctggagaagatggtgttgctaatgtcaatattactgactgccagattcccctcactgggccacactcaatcattggccgagctgtagttgtccatgccgatccagatgaccttggcaagggtggacatgagcttagcaagagcacgggaaatgctggtggccgtgttgcttgtggtatcattgggctccagggctagatgctgtggcttcattggtgaacattcacatctgagcacctccggtcttgctgcttcatttcccttatattggatacataattggctactcttaataatcgcctgatcaatagtcagagcgctattcctatcattccgtgtatgaacattgcacaaccatcatttttctttagtgcgatgcgaagtggctgttttggcg

SEQ ID NO: 9809 - protein, 151 aa, Panicum virgatum
  misc_feature: Ceres CLONE 1717050
  misc_feature (1)..(151): Pfam Name: Sod_Cu Pfam Description: Copper/zinc superoxide dismutase (SODC)
  misc_feature: SWISSPROT Homolog: EC 1.15.1.1 Superoxide dismutase
MVKAVAVLAGSDVKGTIFFSQEGDGPTTVTGSISGLKPGLHGFHVHALGDTTNGCMSTGPHFNPAAKEHGAPEDENRHAGDLGNVTAGEDGVANVNITDCQIPLTGPHSIIGRAVVVHADPDDLGKGGHELSKSTGNAGGRVACGIIGLQG

SEQ ID NO: 9810 - DNA, 631 bp, Panicum virgatum
  misc_feature: Ceres CLONE 1717063
  misc_feature: Encodes the peptide sequence at SEQ ID NO. 9811
atgtaatgtaagaggtactgatatgacaagtccacatggtataccagttgaccttctagataggctggtaattgttcgaacagaaacatatggccctactgagatgatccagatactagctatccgagcacaagtggaagagattgatattgatgaagagagtcttgcttatttaggagagatcggacaacagacttctttgagacatgctattcagctgctatcacctgccagtgtggttgcaaagactaatggaagagagaagatctgcaaggctgatcttgaggaagttagcggactctatttggatgccaaatcgtcagctcgtctgctccaggagcaacaagaaagatacatcacttagatttctcatgttgtgcaagtccccgagaaaaacgtagttgtcgactctagccatgtatactgcatctgtcttgttcacaggtgcagagtctccgagagcacatttgaggggtaatgatttttgtaccggctgctttggactttgtagtctccagcgaagactctattctggcatattgcttgttcacatactgttggcagattagattggtgcaagaattgtcgtgtatttttacccttgctaatcaatgcccagattccgtgtgct

SEQ ID NO: 9811 - protein, 120 aa, Panicum virgatum
  misc_feature: Ceres CLONE 1717063
  misc_feature (1)..(104): Pfam Name: TIP49 Pfam Description: TIP49 C-terminus
CNVRGTDMTSPHGIPVDLLDRLVIVRTETYGPTEMIQILAIRAQVEEIDIDEESLAYLGEIGQQTSLRHAIQLLSPASVVAKTNGREKICKADLEEVSGLYLDAKSSARLLQEQQERYIT

SEQ ID NO: 9812 - DNA, 613 bp, Panicum virgatum
  misc_feature: Ceres CLONE 1717154
  misc_feature: Encodes the peptide sequence at SEQ ID NO. 9813
gttgtctcgtcctctgcgcatagctagggttggcgactgcagggctcgtggcctctcccaagcgcagccatcatgccgaagcaaatccatgagatcaaggacttccttctcacagcgaggaggaaggatgcccgctccgtgaggatcaagaggagcaaggatgctgtcaagttcaaggttcgctgctccaagtacctctacacactgtgtgtctacgacactgagaaggccatcaagctgaagcagtctctacctcctggcttgaccgtgcaggaggtttaagctttggaaatagtgactacagcacctgtgctggttgcttcgaagatttgccaatctaccttcaatttagtttttgtaggggacatctgagtgttttaaatgaattgctgtgattgagacaaaatgttatgtggaagtaatatgatgactggcgaccctccatttgatgttcaaatggactcgttcttttcttttctcttttcaaaacagcgcatttgttagttttgttgtcaaattaaattaggtttgccgaatggggatattgcgaatacccaacagcaagctagagatggttttaatacctactcgtatctcaaaattcttataggcg

SEQ ID NO: 9813 - protein, 69 aa, Panicum virgatum
  misc_feature: Ceres CLONE 1717154
  misc_feature (2)..(69): Pfam Name: Ribosomal_L38e Pfam Description: Ribosomal L38e protein family
MPKQIHEIKDFLLTARRKDARSVRIKRSKDAVKFKVRCSKYLYTLCVYDTEKAIKLKQSLPPGLTVQEV

SEQ ID NO: 9814 - DNA, 550 bp, Panicum virgatum
  misc_feature: Ceres CLONE 1717178
  misc_feature: Encodes the peptide sequence at SEQ ID NO. 9815
aaggcggaaaccatggtaaatggacgcgcggggcagcgcgtcaggctctccgttcggggcactatcctcggatacaagaggtctaagtcgacccagtacgagaactcgtcactggtgcagatccagggggtgaacactaaggaggacctcccgcggtactccccgcagcgcttggcgtacatctacaaggccaagaccaagagcaccgagacccgctacaggtgcatctggggcaaggtcacccgcccgcacggcaactccggcgtcgtccgcgccaagttcaagtccaccctcccgccggagtccatgggacgcaaggtcagagtgttcatgtacccgagcagcatcttaggttttattggagtagggatggccatgattatttcttacttatcttgagctgaaaattccaggttttggtgaaccactgctggttggcaacttagtttgttcaagtaatgagaacatgtgtaagttttgccaaaattggtgtataaaggatgaaccataatagtaatgaaaagccagcaccagagcttattttcagcat

SEQ ID NO: 9815 - protein, 128 aa, Panicum virgatum
  misc_feature: Ceres CLONE 1717178
  misc_feature (12)..(106): Pfam Name: Ribosomal_L35Ae Pfam Description: Ribosomal protein L35Ae
MVNGRAGQRVRLSVRGTILGYKRSKSTQYENSSLVQIQGVNTKEDLPRYSPQRLAYIYKAKTKSTETRYRCIWGKVTRPHGNSGVVRAKFKSTLPPESMGRKVRVFMYPSSILGFIGVGMAMIISYLS

SEQ ID NO: 9816 - DNA, 794 bp, Panicum virgatum
  misc_feature: Ceres CLONE 1717208
  misc_feature: Encodes the peptide sequence at SEQ ID NO. 9817
tcattgccgcaattcttcttcttcccctctccagctagatcgaccggagcagcagagaggctgatccgaccaagcttcaccccaagatatggcaagcaaaaggattcagaaggaactcatggatttgcaaaaggatccaccaacatcatgcagtgctgggcctgctggagaggatctattccactggcaggccacaatcatgggtcctagtgacagcccctatgcaggaggggtgttctttgttaacatccactttcctcctgactacccctttaagcccccaaaagtgaacttccaaactaaggtgcatcacccaaacatcaactctaacgggggcatttgccttgatatcctcaaggagcaatggagcccagccctgaccatatcaaaggtcctgctctccatcagctctctcctcaccgaccccaacccagacgacccccttgtcccagagattgctcacatgtacaagaaccagaggcaacgctacgaggaaactgcaagggcctggacccagaagtacgcgatgggctgatgccccatcacattgagcaatgttaccacttgccactgcaatgaccatcgtgaatgttgtaaagattaagttgaaccggttccatgttttgtgatggtatcccaggactccagacggctgtgtcagttgtactggcttctgaagacaaagtttatctgtgtacagcagctttaaagcatgacaatctgagttctgcacccaaactttggtttatatgaaaagcacttgcagtcactgcattcgcatgtgtagctgccag

SEQ ID NO: 9817 - protein, 148 aa, Panicum virgatum
  misc_feature: Ceres CLONE 1717208
  misc_feature (5)..(142): Pfam Name: UQ_con Pfam Description: Ubiquitin-conjugating enzyme
  misc_feature: SWISSPROT Homolog: EC 6.3.2.19 Ubiquitin--protein ligase
  misc_feature: Functional homolog of the protein sequence given in SEQ ID NO 50118
  misc_feature: Useful for biocontainment applications
  misc_feature: Functional homolog of the protein sequence given in SEQ ID NO 50119
  misc_feature: Useful for making plants with modulated low light sensitivity
  misc_feature: Functional homolog of the protein sequence given in SEQ ID NO 50120
  misc_feature: Useful for making plants with modulated light quality sensitivity
MASKRIQKELMDLQKDPPTSCSAGPAGEDLFHWQATIMGPSDSPYAGGVFFVNIHFPPDYPFKPPKVNFQTKVHHPNINSNGGICLDILKEQWSPALTISKVLLSISSLLTDPNPDDPLVPEIAHMYKNQRQRYEETARAWTQKYAMG

SEQ ID NO: 9818 - DNA, 411 bp, Panicum virgatum
  misc_feature: Ceres CLONE 1717246
  misc_feature: Encodes the peptide sequence at SEQ ID NO. 9819
gagatcgaccccgagctgcgctactccttccagcggaacaccaagtttttgaagagagtttttagtggggatacacttgtcaagcctcttccccctgtaatggcatacagtgtatctcgtgatgtaaactttttcttccggatcttcgcaaaactctgggatgaagaaagaattgccaatggacagaaatcccttggactggggaatgatgatggttcccgccgaatgcgctgattgtagtcaaacaaagtttctgtactgagctcagaactctttgtcgtacggactggagatcttttatatatgcttcgaaagacagatgtggcgtttcttaagtttggattgtaattctgtttatcttagtgtttctttcatgtatttttgcttgtaccatatattcaaattcaatct

SEQ ID NO: 9819 - protein, 77 aa, Panicum virgatum
  misc_feature: Ceres CLONE 1717246
  misc_feature: Functional homolog of the protein sequence given in SEQ ID NO 50121
  misc_feature: Useful for making plants with modulated nitrogen use efficiency
EIDPELRYSFQRNTKFLKRVFSGDTLVKPLPPVMAYSVSRDVNFFFRIFAKLWDEERIANGQKSLGLGNDDGSRRMR

SEQ ID NO: 9820 - DNA, 288 bp, Panicum virgatum
  misc_feature: Ceres CLONE 1717293
  misc_feature: Encodes the peptide sequence at SEQ ID NO. 9821
gcaacgcctcgtacagttcatcaagtaaatccacatcagatcacacacaagctagctgcaaaaatggcgtcgacggtggcgagccacgcccgggacaagctcaaggacagcagcgacccgctcgagaactactgcaaggagaaccccgagaccgacgagtgccgcatctacgacaactagagcaagcctgctgtatatatcgatctgtgtatcagcaatcaaaagaagttaaatttgttatagatatagataattaataaacgaataaaggatatttgaccgcgggtc

SEQ ID NO: 9821 - protein, 38 aa, Panicum virgatum
  misc_feature: Ceres CLONE 1717293
  misc_feature (2)..(38): Pfam Name: CP12 Pfam Description: CP12 domain
  misc_feature: SWISSPROT Homolog: EC 1.2.1.13 Glyceraldehyde-3-phosphate dehydrogenase (NADP(+)) (phosphorylating)
MASTVASHARDKLKDSSDPLENYCKENPETDECRIYDN

SEQ ID NO: 9822 - DNA, 362 bp, Panicum virgatum
  misc_feature: Ceres CLONE 1717348
  misc_feature: Encodes the peptide sequence at SEQ ID NO. 9823
cttttcgcgcgaacgccgccgccgccgccgttagctccagcgccccgtgagccgcccttatccgactacaggctgggcgtcaccttcacctatccaacatggataagacacgtgttatgatacctgggcgcaagctcaagacccgcagaaagaaccagaggttggctgacaaaggcttcaagaagagccatctcaggcctgactggaacaaaccttttgctggctcatctcaggcaaagggaatcatccttaaaaagagaggcattgaggctaagcagccaaactctgctatccagaagtgtgcccgtgtacaccttgtgaaaaattggaagaagattgctgcctttgtgcctaacgacggt

SEQ ID NO: 9823 - protein, 87 aa, Panicum virgatum
  misc_feature: Ceres CLONE 1717348
  misc_feature (8)..(87): Pfam Name: Ribosomal_S12 Pfam Description: Ribosomal protein S12
MDKTRVMIPGRKLKTRRKNQRLADKGFKKSHLRPDWNKPFAGSSQAKGIILKKRGIEAKQPNSAIQKCARVHLVKNWKKIAAFVPND

SEQ ID NO: 9824 - DNA, 594 bp, Panicum virgatum
  misc_feature: Ceres CLONE 1717348-R
tagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagc

SEQ ID NO: 9825 - DNA, 598 bp, Panicum virgatum
  misc_feature: Ceres CLONE 1717415
  misc_feature: Encodes the peptide sequence at SEQ ID NO. 9826
ttttgggttattggtggcacctctgcccatctcttcgccgtgttccagggtctgctgaaagtgttggctgggatcgataccaacttcacagttacctcaaaggcatctgatgaagatggcgactttgctgagctttatgtgttcaagtggaccagtttgctcatcccgccaaccactgtccttgtcattaacctggttggaatggtggcagggatttcatatgccattaacagcggctaccaatcctggggtccgctttttgggaagctgttcttctcaatctgggtgatcctccatctctaccccttcctcaagggtctcatgggcaggcagaaccgcacaccaaccattgtcattgtctggtccattctccttgcgtccatcttctctctgttgtgggtgaagatcgaccctttcatctccccaacacagagagctgttgctttggggcaatgcggcgtgaactgctgatcaggactagacccctccctgaagaggctcaatcaggatctacccccttcgtgttgatagctgaggaggctagatgggattttttgtgtagatgaggatgggatgcatctaaattatgcccctgttt

SEQ ID NO: 9826 - protein, 156 aa, Panicum virgatum
  misc_feature: Ceres CLONE 1717415
  misc_feature: SWISSPROT Homolog: EC 2.4.1.12 Cellulose synthase (UDP-forming)
  misc_feature: Functional homolog of the protein sequence given in SEQ ID NO 50122
  misc_feature: Useful for making plants with modulated biomass
  misc_feature: Functional homolog of the protein sequence given in SEQ ID NO 50123
  misc_feature: Useful for making plants with altered cell wall content and/or composition
  misc_feature: The sequence is a functional homolog of SEQ ID NO 6 in US patent 7285702
  misc_feature: Functional homolog of the protein sequence given in SEQ ID NO 50124
  misc_feature: Useful for making plants with altered carbohydrate content
  misc_feature: The sequence is a functional homolog of SEQ ID NO 26 in US patent 7312377
  misc_feature: The sequence is a functional homolog of SEQ ID NO 2 in US patent 7049481
  misc_feature: Functional homolog of the protein sequence given in SEQ ID NO 50125
  misc_feature: Useful for making plants with modulated plant growth and development
FWVIGGTSAHLFAVFQGLLKVLAGIDTNFTVTSKASDEDGDFAELYVFKWTSLLIPPTTVLVINLVGMVAGISYAINSGYQSWGPLFGKLFFSIWVILHLYPFLKGLMGRQNRTPTIVIVWSILLASIFSLLWVKIDPFISPTQRAVALGQCGVNC

SEQ ID NO: 9827 - DNA, 460 bp, Panicum virgatum
  misc_feature: Ceres CLONE 1717534
  misc_feature: Encodes the peptide sequence at SEQ ID NO. 9828
attgtccaccatatcggaaggaaatacaccagtgaccaacaacgggtttaaggaggaagcagctccacctaaggaaacactagatgttacatccttcaggcagcgagctgaggctcttgaaggactcttagagctttctgcggagcttctagaacacagcaggctggaggagcttgcgattgttctcaagccattcgggaaggccaaggtgtcccctcgagaaacggcaatatggttagctaaaagtttcaaaggcttgatgaatgatgaagcaagccgcagttcagcgtgaatacacatagactttgccccttttttttctcggttactttctgtgtgcgctctgaatcagcaatagttgtcttgttcatatccctcttctgacaatgtgtgagtcccacgtttcagtcttgatagctcgccattctttacagcacatgttgtaaatagccaaacttgt

SEQ ID NO: 9828 - protein, 96 aa, Panicum virgatum
  misc_feature: Ceres CLONE 1717534
  misc_feature: SWISSPROT Homolog: EC 2.7.11.1 Non-specific serine/threonine protein kinase
LSTISEGNTPVTNNGFKEEAAPPKETLDVTSFRQRAEALEGLLELSAELLEHSRLEELAIVLKPFGKAKVSPRETAIWLAKSFKGLMNDEASRSSA

SEQ ID NO: 9829 - DNA, 445 bp, Panicum virgatum
  misc_feature: Ceres CLONE 1717537
  misc_feature: Encodes the peptide sequence at SEQ ID NO. 9830
atttttctctagggttttctcgccaccgccgcttccgccttcgccgccgcagccgcagccatgccgtcccacaagaccttccggatcaagaagaagctggccaagaagcagcgccagaaccgccccatcccctactggatccgcatgcgcaccgacaacaccatcaggtacaacgcgaagcgcaggcactggcgccgcaccaagctcggattctgagcgggggaagagatgccgggcaccgatgcttggggaaactcgtgattacgagccggcctcgggacgcttccatgattccgcatgctaggaagctgcttgtttagattttgcttgtgttaaattgatcttatcagttgtttctgtagcgaactgagaataccatgttttgctgatggttggagaacatcatttataattatgccgaagctatcttgatctgccgtgcgtt

SEQ ID NO: 9830 - protein, 51 aa, Panicum virgatum
  misc_feature: Ceres CLONE 1717537
  misc_feature (9)..(51): Pfam Name: Ribosomal_L39 Pfam Description: Ribosomal L39 protein
MPSHKTFRIKKKLAKKQRQNRPIPYWIRMRTDNTIRYNAKRRHWRRTKLGF

SEQ ID NO: 9831 - DNA, 267 bp, Panicum virgatum
  misc_feature: Ceres CLONE 1717589
  misc_feature: Encodes the peptide sequence at SEQ ID NO. 9832
gccgtccttggaggtggagactctgttgcagctgttgagaaggtgggagttgctgatgttctgagccacatttcaacggcaggtggtgccagcttggaattgttggaaggaaaggagcttcctgcagttgctgctttagatgaagccttccctgttgactgatataagtttctcatttgtttctccttcatcctcgtgtcctgtgtacaattcccacacttcttggtcgctccttgtcggtccctcgaaatgcgagatccaatgcta

SEQ ID NO: 9832 - protein, 53 aa, Panicum virgatum
  misc_feature: Ceres CLONE 1717589
  misc_feature: SWISSPROT Homolog: EC 2.7.2.3 Phosphoglycerate kinase
AVLGGGDSVAAVEKVGVADVLSHISTAGGASLELLEGKELPAVAALDEAFPVD

SEQ ID NO: 9833 - DNA, 447 bp, Panicum virgatum
  misc_feature: Ceres CLONE 1717635
  misc_feature: Encodes the peptide sequence at SEQ ID NO. 9834
tctgctgccaagcatggaaaggtctatgtaaccatcgcaaagaagatcctagagaaaggcaatgactatactaagaaggaaactgacaggcttcagcgcatgttggcgaagtccatcagccccacgaaggcagatgaatttaccatcaagaagaacgttctttcgacattctcttcctaaggcaacggctggcccaactttcatgtttcagatataggcgaagagaactgcaagtttaggggatgtgataatgagagttgattgttggtagaactaattttgggggtttccctcgagcatacgtgatacttttatcattttgtggttcacagttcttttcttcgcgacgtagcactatagtctacttttggatggagagaagcgatagaaaacattgtgactacagaacaggatttttttattccaataaggctcactttatgggat

SEQ ID NO: 9834 - protein, 59 aa, Panicum virgatum
  misc_feature: Ceres CLONE 1717635
  misc_feature (1)..(58): Pfam Name: ERp29 Pfam Description: Endoplasmic reticulum protein ERp29, C-terminal domain
  misc_feature: SWISSPROT Homolog: EC 5.3.4.1 Protein disulfide-isomerase
SAAKHGKVYVTIAKKILEKGNDYTKKETDRLQRMLAKSISPTKADEFTIKKNVLSTFSS

SEQ ID NO: 9835 - DNA, 483 bp, Panicum virgatum
  misc_feature: Ceres CLONE 1717652
  misc_feature: Encodes the peptide sequence at SEQ ID NO. 9836
agactattcatattccattcgcccgcagcggaagtggcgcccgccgccgccgtctcgtcctcgactccctcctcgtcctcgctcgtccaccgcttggagtgcgttcctccgttcccagaagcgcagcatggcaaagctcaagccaaaggcgttgctggcacaaagcaaagtgaagaaggcccctagccaaatcagtgtgatcacaatcttcacctacttggtcctcggtgtcatagttgtatcctctgtttatgctgcttacaaatatttggtaggcaaaggaccagcagtgacagcagcaggcgtcgaggggaattaaacctcaaactatgtaactgattttgttgttgtatcatccagttggataattttggttgctgcagccagtaaaaggagcatgtatagattgtatctttctacagttttattgtaaaccgtgggtacattatattgatatgtgtatgctaaattcctttcctcgat

SEQ ID NO: 9836 - protein, 63 aa, Panicum virgatum
  misc_feature: Ceres CLONE 1717652
  misc_feature: SWISSPROT Homolog: EC 5.2.1.8 Peptidylprolyl isomerase
MAKLKPKALLAQSKVKKAPSQISVITIFTYLVLGVIVVSSVYAAYKYLVGKGPAVTAAGVEGN

SEQ ID NO: 9837 - DNA, 872 bp, Panicum virgatum
  misc_feature: Ceres CLONE 1717659
  misc_feature: Encodes the peptide sequence at SEQ ID NO. 9838
ctctttctcgccagccccgcgccgaaccctaaccaaagggtgttgagttgagtcaccggttgcagccatgagtaagttgcaatctgaggctctcaaggatgccatctcccagatagttggggatgccaaggagaagaataggaagttcaccgagaccgttgagcttcagattggtctgaagaactacgacccacagaaggacaagcgtttcagcggctctgttaagctgcctcacatccctcgcccaaagatgaaggtgtgcatgcttggtgatgcccagcatgttgaggaggctgagaagattggacttgactacatggatgtcgaggcgctcaagaaaatgaacaagaacaagaagcttgtcaagaagcttgccaagaagtaccatgctttcttggcatcagaggccatcatcaagcagattccccgtctccttggtcctggtctcaacaaggcaggcaagttccctacactggttacccaccaggagtctcttgaatccaaagtgaacgagacaaaagctacagtcaagttccagttgaagaaagttctttgcatgggtgttgctgtgggtaacctgtccatggaggagaagcagatccagcagaacatccagatgagcgtcaacttccttgtgtcccttctgaagaagaactggcagaatgtgaggtgcctgtacatcaagagcaccatgggaaagccatacagggtgttctaattcttggcgtgatccttgtgatgttgatttactatgcctctccagctgggcttgtcttaaaacttagatatgtacccatcagttttgtgcctgtcaaagagaatgttgaagtatttggtctttaatctagtgtttcctgtggaggaattctttt

SEQ ID NO: 9838 - protein, 216 aa, Panicum virgatum
  misc_feature: Ceres CLONE 1717659
  misc_feature (10)..(212): Pfam Name: Ribosomal_L1 Pfam Description: Ribosomal protein L1p/L10e family
MSKLQSEALKDAISQIVGDAKEKNRKFTETVELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYIKSTMGKPYRVF

SEQ ID NO: 9839 - DNA, 481 bp, Panicum virgatum
  misc_feature: Ceres CLONE 1717672
  misc_feature: Encodes the peptide sequence at SEQ ID NO. 9840
ctcactccatacctgtccgcgcgggaagattcctgagagatatacggaaagcccctaagcttcctcctttggttaaagtgcccaaggtgtatccgatcctgagccagccactcttggggatgctccaaactgactaaaaaaggaagagcatgggctgtctgaagggcctcgtcggccccttcctcttggagccggtacttaaccttgcgattcttgctctcactgaggtgcaggtggagaaaagacatgctcaagatcttttaggtgcacgagcgggttacatcgaagtggatctcaaccgcggtaagatccttgatagttttcgcccccaagaaagttttccgatgatgagcgcttttaaagtactgctatgtggcgcggtattatcccgtattgacgcccggcaagagcacctcagtccccccatacactattctcagaaagacttgggtgagtactccccagtcacagaaaagcatct

SEQ ID NO: 9840 - protein, 110 aa, Panicum virgatum
  misc_feature: Ceres CLONE 1717672
  misc_feature: SWISSPROT Homolog: EC 3.5.2.6 Beta-lactamase
MGCLKGLVGPFLLEPVLNLAILALTEVQVEKRHAQDLLGARAGYIEVDLNRGKILDSFRPQESFPMMSAFKVLLCGAVLSRIDARQEHLSPPIHYSQKDLGEYSPVTEKH

SEQ ID NO: 9841 - DNA, 546 bp, Panicum virgatum
  misc_feature: Ceres CLONE 1717730
  misc_feature: Encodes the peptide sequence at SEQ ID NO. 9842
aggaactcccaaggttgtcaagccttrtggarmgaaagaatgatggytgctattaaagtgctccactccgcctttgstggcaccagagagaaatagatgttgkatgcagcaagatcagtctatccaattgagagggttactgtcaacaacactatgtatcacaagagctgcttcaagtgctgccatggaggatgcaccatcagcccttcgaactacatcgcgcacgaggggaagctctactgcaagcatcaccacatccaactgatcaaggagaaggggaacttcagccaactcgagaatgatcacgwgaaaacatcacaggctggatcgctggaggacgaagamscagagtattaatctttgagcatttccacagatgaataatgaatctccttgcatttgctcgagagcaatatatctttctggggcacggtttggtttcagttttaccaatggaggtcatgtgcactgagaacaattatacatcgtcttgtatctgcatgtaaaccttgttaaatctgagtcaaattctctaccggtttcacc

SEQ ID NO: 9842 - protein, 86 aa, Panicum virgatum
  misc_feature: Ceres CLONE 1717730
  misc_feature (5)..(57): Pfam Name: LIM Pfam Description: LIM domain
  misc_feature: Functional homolog of the protein sequence given in SEQ ID NO 50126
  misc_feature: Useful for making plants with altered carbohydrate content
  misc_feature: Functional homolog of the protein sequence given in SEQ ID NO 50127
  misc_feature: Useful for making plants with modulated heat sensitivity
  misc_feature: The sequence is a functional homolog of SEQ ID NO 428 in the 10/412,699 US patent application
  misc_feature: The sequence is a functional homolog of SEQ ID NO 616 in the 11/435,388 US patent application
  misc_feature: The sequence is a functional homolog of SEQ ID NO 992 in the 11/479,226 US patent application
  misc_feature (3)..(3): Xaa is any aa, unknown, or other
  misc_feature (71)..(71): Xaa is any aa, unknown, or other
  misc_feature (83)..(83): Xaa is any aa, unknown, or other
  misc_feature (84)..(84): Xaa is any aa, unknown, or other
MLXAARSVYPIERVTVNNTMYHKSCFKCCHGGCTISPSNYIAHEGKLYCKHHHIQLIKEKGNFSQLENDHXKTSQAGSLEDEXXEY

SEQ ID NO: 9843 - DNA, 527 bp, Panicum virgatum
  misc_feature: Ceres CLONE 1717762
  misc_feature: Encodes the peptide sequence at SEQ ID NO. 9844
atggatccatgggaagggtcggctcctctcggacagcggtggcggatccctctgctccatctccggcaaggcatttggcatctgacctcaacagcaagcaaatggcaggtggcagggttgcacatgccaccctcaagggcccgagcgtggtgaaggagatcttcattggagtcaccctcgggctgattgccggtggcatgtggaagatgcaccactggaacgagcagaggaagactagatccttctacgacatgctggacaagggccagatcagcgttgttgtcgaggagtagctttcacgcgccaagtctgaagttattttctcacagttgtttctgaaactctggagagcatgatgaagtgaatgctgtggagatttgtcttgaaaaataagcataaccatttgaggacaccagattttgttgaatttccttccgtttcatgaatattagaacatgtccaggtcataccgatcaactgaatatctgatctagttttacataagttaatgtgattgtgaaatttgc

SEQ ID NO: 9844 - protein, 63 aa, Panicum virgatum
  misc_feature: Ceres CLONE 1717762
  misc_feature (2)..(63): Pfam Name: COX5C Pfam Description: Cytochrome c oxidase subunit Vc (COX5C)
  misc_feature: SWISSPROT Homolog: EC 1.9.3.1 Cytochrome-c oxidase
MAGGRVAHATLKGPSVVKEIFIGVTLGLIAGGMWKMHHWNEQRKTRSFYDMLDKGQISVVVEE

SEQ ID NO: 9845 - DNA, 122 bp, Panicum virgatum
  misc_feature: Ceres CLONE 1717833
  misc_feature: Encodes the peptide sequence at SEQ ID NO. 9846
tttattggcatcctttcagctgctaaccatttttctgagcgtatggcagttcggaagtcatggatgatttctaccaggagatcatctaatgttgttgctcgcttctttgtggctctgaatgg

SEQ ID NO: 9846 - protein, 40 aa, Panicum virgatum
  misc_feature: Ceres CLONE 1717833
  misc_feature: Functional homolog of the protein sequence given in SEQ ID NO 50128
  misc_feature: Useful for making plants with altered carbohydrate content
FIGILSAANHFSERMAVRKSWMISTRRSSNVVARFFVALN

SEQ ID NO: 9847 - DNA, 641 bp, Panicum virgatum
  misc_feature: Ceres CLONE 1718317
  misc_feature: Encodes the peptide sequence at SEQ ID NO. 9848
ttcaaacaatcgccattgaaataataaaagaaatctcaaaaaaaaaaaaaaaaaaaaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgt

SEQ ID NO: 9848 - protein, 181 aa, Panicum virgatum
  misc_feature: Ceres CLONE 1718317
  misc_feature (31)..(181): Pfam Name: Beta-lactamase Pfam Description: Beta-lactamase
  misc_feature: SWISSPROT Homolog: EC 3.5.2.6 Beta-lactamase
MSIQHFRVALIPFFAAFCLPVFAHPETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMP

SEQ ID NO: 9849 - DNA, 867 bp, Panicum virgatum
  misc_feature: Ceres CLONE 1719347
  misc_feature: Encodes the peptide sequence at SEQ ID NO. 9850
agagagagagagagagagagagagatgtgctaacccatgaactgctcttatgcatgcgacagccataagcattgctattagggcaaagcagccagtttccgacgcctgatagccgccggaatctgcgagatctccacgagcagcgtcgtcggataaggcagccggcacggcaatgccggttccccttgccccgtatccaactcctccggtgccattcacaccccccaatggggcccaaagccagcttgtatgcaccgggtgccggaatcttctcatgtatccagctgatgcaacgtccgtctgctgtgcagtttgcagcaccgtcaccgccgtgccggctccgggaactgagatggcacagttagtttgcggaggatgccacactctcctgatgtacatacgtggcgcgacaagtgtacaatgttcttgctgccacactgttaacctggctatggaagcgaatcaggtcgcccatgtaaattgcgggaactgccgtatgctgcttatgtaccagtatggcgctaggtctgtgaaatgtgcagtctgcaattttgtgacatcagttggggcctcacctggtgcagagcagaagcccagcagctgatgttcctgaaaatactgagatcacctatgaaggcagcttctgaaaaggatgctttgagtgcaaatgtatagagttcttccctgaagcaattttttctcctcctttatctccattcttcccatccattctgcgttccttcgatggacctggcgagcccgcggaataatgagagttttgggaaatatctagtgctaaacttcgtcgacttgtctgtaaaactgaatgagacatatacataaacctatggtgttttctgtgtttct

SEQ ID NO: 9850 - protein, 143 aa, Panicum virgatum
  misc_feature: Ceres CLONE 1719347
  misc_feature (104)..(128): Pfam Name: zf-LSD1 Pfam Description: LSD1 zinc finger
  misc_feature (66)..(90): Pfam Name: zf-LSD1 Pfam Description: LSD1 zinc finger
  misc_feature (27)..(51): Pfam Name: zf-LSD1 Pfam Description: LSD1 zinc finger
  misc_feature: Functional homolog of the protein sequence given in SEQ ID NO 50129
  misc_feature: Useful for making plants with modulated oxidative stress sensitivity
MPVPLAPYPTPPVPFTPPNGAQSQLVCTGCRNLLMYPADATSVCCAVCSTVTAVPAPGTEMAQLVCGGCHTLLMYIRGATSVQCSCCHTVNLAMEANQVAHVNCGNCRMLLMYQYGARSVKCAVCNFVTSVGASPGAEQKPSS

SEQ ID NO: 9851 - DNA, 865 bp, Panicum virgatum
  misc_feature: Ceres CLONE 1719373
  misc_feature: Encodes the peptide sequence at SEQ ID NO. 9852
attttttccggcctcctcttcctcgcgcggcgcctgcccccctgccggttcgaagcgtgcgaagagagcgaagaagcagcgcggagaggtggcccgtaccaagcaaaccgctcgcaagtccacgggagggaaggctcccaggaagcagcttgcaactaaggctgcccgcaagtcagccccgaccactggaggagtgaagaagccccaccgctaccgccctgggactgttgccctccgtgagatccgcaagtaccagaagagcactgagctgttgatcaggaagctgcccttccagaggcttgttagggaaattgcacaggacttcaagactgatctgcgtttccagagccatgctgtgcttgccctccaggaggctgccgaggcgtaccttgttggtctgtttgaggacaccaacctgtgcgccatccatgctaagcgtgtgaccatcatgcccaaggacattcagctggccaggaggatccgtggcgagagggcttaatcatgatcatgacaatcaaaatctcgtgtcgtagtcgtggtttaatgtggtgccatgttcggacatcagtagggcttgttttgtggatcataagtttctcttctgcagcactatatgttgcgactaccgttgttggtgttattactagggtcgtcgaatacttaaattgtctcgtctagtgttgttaccgcgttgacagtttgacatttgtgtgctttgttgctgctgactagcagtgctgtttgtgcgctgctggattgtaagcttcattgctgttgctgatccgttcgttaatgtcaagtatcgtgtaatagttcgtgtacattttatccgttcgttcagttacattttgttgttggtcctgtc

SEQ ID NO: 9852 - protein, 165 aa, Panicum virgatum
  misc_feature: Ceres CLONE 1719373
  misc_feature (87)..(161): Pfam Name: Histone Pfam Description: Core histone H2A/H2B/H3/H4
FFPASSSSRGACPPAGSKRAKRAKKQRGEVARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 9853 - DNA, 1115 bp, Panicum virgatum
  misc_feature: Ceres CLONE 1719377
  misc_feature: Encodes the peptide sequence at SEQ ID NO. 9854
aagactcgccgctcgccgctcgccgccagcatctcgcgtcccgacaatctgccgcagaagaatcggccccagtccccgtctcttctcctcctcctccccctccttccccattctaccagccgcggccatggccaccgacagcgccgcccccgccgggtccaagagtaagctgctcgtcttcgattccgtggaagatctcgcggtgtctctggcgaagtacaccgctgagctgtctcagaagttcgccaccgagaggggcgccttcaccgtcgtgctctccggcggatccctcatcgactcgctcagcaagctgacggagccgccgtacctggaatcggtggactggagcaagtggcacgtcttctgggtggatgagagagtcgtgcccaaggatcatgaggatagcaactacaagctcgccttcgatgggtttctctccaaggtgccgattcctcctgggcaagtttatgctataaatgatgccttgtcagctgagggagcagcggatgactacgaagcttgcttgaagcagcttgttaagaatggtgtgattgccatgtcaacagcaactgggtttcccaggtttgatctccagcttcttggaatgggacctgatggccacattgcctctctcttccctggtcaccctcttgttaatgagaaagagaggtgggtcacctacatcaaggattctccaaagccgccaccagagaggatcacatttacatttccagtaatcaactcatctgcatatatcgcgatggtggtcactggagctgggaaagctggtccagtgcagaaagcgctttcagacaagcaaacttcttccgatctgctgcctgttgagatggctgtgcttcaagatggagaattcacttggttcactgacaagccagcagtgtccctgttgcagaacaagtgaaggccaaccatggtgatcttagttcgaagccgtttatcttaaataaaagatccaagggcctgcatagtgcatagttgcattcatcctccttggatttcatgtaagggagacttgagccctttatgtagtatgttttctagagtaatgtgtttcagatactccgttgattctagttcagtgaataacagtctct

SEQ ID NO: 9854 - protein, 306 aa, Panicum virgatum
  misc_feature: Ceres CLONE 1719377
  misc_feature (70)..(306): Pfam Name: Glucosamine_iso Pfam Description: Glucosamine-6-phosphate isomerases/6-phosphogluconolactonase
  misc_feature: SWISSPROT Homolog: EC 3.1.1.31 6-phosphogluconolactonase
  misc_feature: Functional homolog of the protein sequence given in SEQ ID NO 50130
  misc_feature: Useful for biocontainment applications
  misc_feature: Useful for making plants with modulated flowering time
RLAARRSPPASRVPTICRRRIGPSPRLFSSSSPSFPILPAAAMATDSAAPAGSKSKLLVFDSVEDLAVSLAKYTAELSQKFATERGAFTVVLSGGSLIDSLSKLTEPPYLESVDWSKWHVFWVDERVVPKDHEDSNYKLAFDGFLSKVPIPPGQVYAINDALSAEGAADDYEACLKQLVKNGVIAMSTATGFPRFDLQLLGMGPDGHIASLFPGHPLVNEKERWVTYIKDSPKPPPERITFTFPVINSSAYIAMVVTGAGKAGPVQKALSDKQTSSDLLPVEMAVLQDGEFTWFTDKPAVSLLQNK

SEQ ID NO: 9855 - DNA, 692 bp, Panicum virgatum
  misc_feature: Ceres CLONE 1719392
  misc_feature: Encodes the peptide sequence at SEQ ID NO. 9856
gatccgcgatcgagctacctttcttttttttttttgaaagcaaggagagatgtatgcatgtatataagcacagtgcttttcctcttttctagtgatttctatttgtttttttgtcttatgacttgttgcactactttctttttcatcaacttattgaatatacaacagcggaatcccggccttctcagcaggaaagcaaaagatggaagcaccatcgtcgacgacgaagatcaccgtgaagtccgtcgccgatgggcaggagctcaaggaatcatgagcaatgctgagaatggcaacaagttgctggtgctggagttcacggcgccgtggtcggagccgtgcaagtacatgagcaaggtgctagatggaaacccccccgggagaggacttgcatacgagttgcaagactatgctgacttttgctcgcttgacatcaccaaattcaggcaattcgcgcagcgcatgacagtggaggccctgccgacgtttctgctgctcaagcagggctacacggtgctgggccgcgtcgtaggcgttgacaaggaatgtaacaccccgggtgtttgcacagtaatttaattaggtgtctgcacagtaattatgtatgtttactatgcatcatgtgcttgaaatgcttaaaaatgatctttttgtaattatgaaaggttatatgtgtaattatgattttatgc

SEQ ID NO: 9856 - protein, 101 aa, Panicum virgatum
  misc_feature: Ceres CLONE 1719392
  misc_feature: SWISSPROT Homolog: EC 1.8.1.9 Thioredoxin-disulfide reductase
MSNAENGNKLLVLEFTAPWSEPCKYMSKVLDGNPPGRGLAYELQDYADFCSLDITKFRQFAQRMTVEALPTFLLLKQGYTVLGRVVGVDKECNTPGVCTVI

SEQ ID NO: 9857 - DNA, 694 bp, Panicum virgatum
  misc_feature: Ceres CLONE 1719420
  misc_feature: Encodes the peptide sequence at SEQ ID NO. 9858
gtcgtcgccgtcctcgtcctcgtccagccgtcgtcctcaagatggcggcggtggatctgtccaagctggtgaaggagaagcgcttctgggtggcctccttcctcgtcgcatgggcagccgcgctgcagggccgcatgatgtggatgcagcgccaggaagccttcaagcacaagttcggcgcagacgcctccgacgcctcttcccccttggactcctcctctacctagcatttttaccaccggatgcgccagattactggtctgttggcagtctgtccgttgatttgttcgtactttgggtctgggaaatgaacctctgctaccttccctcccctatccagcattctactgtagctctcacaagtcacagcagcagctgtttctctgagttagtacatgcactgggaaaatcagtggctgtgaatgacttgctacctgctagtgctgcttatgattcccaattatgaatgaattgttagtgtcaagaacttaatgttgagtcatgagcagttacttctagttatctgcatggagctcttgtggtaccgttttgctttacaggcatctctgaattgttgagggcctgagaagataggctgttgctccatgcatgatctgcatacatccagtccaatgagcaccttaagccttcattctccttattgtaatatgatgaataaatggtttggttgagc

SEQ ID NO: 9858 - protein, 61 aa, Panicum virgatum
  misc_feature: Ceres CLONE 1719420
  misc_feature: Functional homolog of the protein sequence given in SEQ ID NO 50131
  misc_feature: Useful for making plants with modulated heat sensitivity
MAAVDLSKLVKEKRFWVASFLVAWAAALQGRMMWMQRQEAFKHKFGADASDASSPLDSSST

SEQ ID NO: 9859 - DNA, 807 bp, Panicum virgatum
  misc_feature: Ceres CLONE 1719424
  misc_feature: Encodes the peptide sequence at SEQ ID NO. 9860
aaaccttgtttccccgacccgatctccatttccaagagcaagaacccgaggaagcagccatggcggtgtcgatcgagctcaccaaggagtacgggtacgtcgtgctggtgctggtggcctacgccttcctcaacttctggatgggcttccaggtcggcaaggcccgcagaaagtacaaggtgttctaccccaccatgtacgccgtcgagtcggagaacaaggacgccaagctcttcaactgcgtgcagagggggcatcagaactcgctggagatgatgcccatgttcttcgtcatgctgctgctcggcggtctgcagcacccgaccatcgccgccggactgggcgccttctacacggtcgcgaggttcttctacttcaagggatatgccaccggtgtcccggacaaccgtctcaagattggggggctcaacttcctcgctgtgtttgggctgatcatctgcacggcatctttcggcatcaacctggtcatcagggagacgctctgaagttcaggtttacacgtgatctgcagactggattaacgggacaaattacttcttgtggcctgggtagtgaaactttgtgacatgacagttatctaggtttgtgtagtcgtatactcgcatctttcttttcatcttgatatgcaaagtagcagatgtgcgcgtttgtgtcacttttgttaatgccggaataagagatggagatggcttgaagcgtgaatcttacagttcatgctgcttgctagttgttactctgttttcgccgtaaaggattgtcaatggattgtgcctcattgtttgcagt

SEQ ID NO: 9860 - protein, 148 aa, Panicum virgatum
  misc_feature: Ceres CLONE 1719424
  misc_feature (9)..(140): Pfam Name: MAPEG Pfam Description: MAPEG family
  misc_feature: SWISSPROT Homolog: EC 2.5.1.18 Glutathione transferase
MAVSIELTKEYGYVVLVLVAYAFLNFWMGFQVGKARRKYKVFYPTMYAVESENKDAKLFNCVQRGHQNSLEMMPMFFVMLLLGGLQHPTIAAGLGAFYTVARFFYFKGYATGVPDNRLKIGGLNFLAVFGLIICTASFGINLVIRETL

SEQ ID NO: 9861 - DNA, 361 bp, Panicum virgatum
  misc_feature: Ceres CLONE 1719445
  misc_feature: Encodes the peptide sequence at SEQ ID NO. 9862
aaggagatcctgagagccggcaccggtccccatccgacaaggggccgaaaggtcaccttgctctgctccgtctacaggaaggatcgtgatctatccttcaaattgtggagcaccacggaccctgttcagcagccgttcagtttcaactttgatctgggttcagtgatcaaaggatgagatgagggatttatgatgttgtcagtgggagaagttgttcttgtcccctcgctgctggactatgcttatggactcagcgtgatttccagctttgggaattctctcctgctgcggtgctggtattcgagattgaggtcctcaatgcacactgattcgagtagctattctggatggagtcctcttt

SEQ ID NO: 9862 - protein, 58 aa, Panicum virgatum
  misc_feature: Ceres CLONE 1719445
  misc_feature: SWISSPROT Homolog: EC 5.2.1.8 Peptidylprolyl isomerase
KEILRAGTGPHPTRGRKVTLLCSVYRKDRDLSFKLWSTTDPVQQPFSFNFDLGSVIKG

SEQ ID NO: 9863 - DNA, 505 bp, Panicum virgatum
  misc_feature: Ceres CLONE 1719445-R
  misc_feature: Encodes the peptide sequence at SEQ ID NO. 9864
gcaccgacctcaagcggccagatggccagaaggtcaccgtccactgcaccggctacgggaaggatcgtgatctatccaagaaattttggagcaccaaggaccctggtcagcaaccattcagtttcaacattggtgtgggttcagtgatcaaaggaggggatgagggagttatgaccatgcaagtgattgaagtggatcgtatccagtgcaccccggaataggattatggatccagggaatttccagcaacgggaattcaaccaaatttggcgttggtattggagattgaggtcctcagtgcccagtaataaatgtagcaattcaggacggagccatcggtgaaaacaaaatctggagggagcttttccctcttgagtaacgaaataaatccattgtcaccccatccaacaagcagcagagtgttgtttttagtaaatcacctcacactttaacactgagcggccgtgaaacatagggttgatgaaatttcctgtggtaggactct

SEQ ID NO: 9864 - protein, 72 aa, Panicum virgatum
  misc_feature: Ceres CLONE 1719445-R
  misc_feature: SWISSPROT Homolog: EC 5.2.1.8 Peptidylprolyl isomerase
TDLKRPDGQKVTVHCTGYGKDRDLSKKFWSTKDPGQQPFSFNIGVGSVIKGGDEGVMTMQVIEVDRIQCTPE

SEQ ID NO: 9865 - DNA, 269 bp, Panicum virgatum
  misc_feature: Ceres CLONE 1719502
  misc_feature: Encodes the peptide sequence at SEQ ID NO. 9866
tccgctccttcctcagccagaatggtggcgcctccgaccagaggaaaatggaagagcagaatcctaaagagcacaaccccaaggccaactacaacaagcctgtcatgaatgaataatttgtagcaccataatcatgctacataaatcgagttgtatgaaccttttgtcgtgcattgcacttgatattgaagtacctttgtcaaaccaccttatgctcatgctgacttcctgacgtgatccgccacgctcatcggttttccccttaaagc

SEQ ID NO: 9866 - protein, 37 aa, Panicum virgatum
  misc_feature: Ceres CLONE 1719502
  misc_feature (1)..(37): Pfam Name: Wound_ind Pfam Description: Wound-inducible basic protein family
  misc_feature: Functional homolog of the protein sequence given in SEQ ID NO 50132
  misc_feature: Useful for making plants with modulated biomass
RSFLSQNGGASDQRKMEEQNPKEHNPKANYNKPVMNE

SEQ ID NO: 9867 - DNA, 345 bp, Panicum virgatum
  misc_feature: Ceres CLONE 1719502-R
agcccgggttcttcacaaacaaagtcggcgggggcggtggcggagaagcaagatgatctgggacgagagctttcccgtcttgcgctcgttcttcagccggaagggaggtgcttcgcgttagctggaaaatgtaaagagcagaagcctaaggggcagaaccccagggctcaatgggaacaagcatttctggaaggattaatttgtcacagcagaatcatgtatcataaatagagtggcaagaaccttttgtacccccttgaactggatcttaaagtgcctttctaacccgggttatcctctctcgaactcgtggatcccccgctctgcaggaatttgagtgaactt

SEQ ID NO: 9868 - DNA, 1021 bp, Panicum virgatum
  misc_feature: Ceres CLONE 1719517
  misc_feature: Encodes the peptide sequence at SEQ ID NO. 9869
gaagtttccacacaactaactagataaccgcttcagaggaaggcggaaatttcccctccctcgatcgatttcagcgtccccttcctagcatcgaccccaattccgcgtcgcccagcaatcgcaatcccgcgaactcccccttctttcgactcgccccgcgccccctttggatttcgccggattcgatgaagaagatcttcggcgccaagaagaacaaggaacccccgcccaccatccaggacgcaaccgaccgaatcaccaagcgcggcgacaccgtcgatgagaagatcaagaagctcgatgccgagctcgcgcgctacaaggagcagatcaagaagacgcgcccaggccccgcgcaggaggccgtcaaggcacgggccatgagggtcctcaagcagcggaggatgtatgaaggacagcgtgacatgctatacaaccaaacatataaccttgaccaagttgctttttcagcggagggacttaaagatgctcaacaaactatgactgcaatgaagactgccaacaaagagctgaaaggaatgatgaaaactgtcaagctcgaagatatagatagcatgcaagatgagatgatggatcttatggacgtgagcaatgagatacaagaaactcttggtagaagctacaacgtccctgatgacattgatgaggaagaactcatgggcgaacttgatgctctggaagctgatatggattttgaatcagagtcagtcccgtcataccttcaaccagatcaagaatctgaactcaacttacctgctgcaccaactggccatgcagcagccccaccacaccagcagcaggaggatgaactgggattgcctacagtgccccaagcatccattcgtacgtaggcacggatcttggtcaggatggaatgatattcacagttgaatgtaaccttttttgtgttatgtaccactatgatttgtggatggtgtaaatttgattgaattggattgatcgggacataataagcaatatcatcctcgtgtactcggtg

SEQ ID NO: 9869 - protein, 228 aa, Panicum virgatum
  misc_feature: Ceres CLONE 1719517
  misc_feature (12)..(204): Pfam Name: Snf7 Pfam Description: Snf7
MKKIFGAKKNKEPPPTIQDATDRITKRGDTVDEKIKKLDAELARYKEQIKKTRPGPAQEAVKARAMRVLKQRRMYEGQRDMLYNQTYNLDQVAFSAEGLKDAQQTMTAMKTANKELKGMMKTVKLEDIDSMQDEMMDLMDVSNEIQETLGRSYNVPDDIDEEELMGELDALEADMDFESESVPSYLQPDQESELNLPAAPTGHAAAPPHQQQEDELGLPTVPQASIRT

SEQ ID NO: 9870 - DNA, 733 bp, Panicum virgatum
  misc_feature: Ceres CLONE 1719539
  misc_feature: Encodes the peptide sequence at SEQ ID NO. 9871
cttttcttattgcagatggcccgtaccaagcaaaccgctcgcaagtccacgggagggaaggctcccaggaagcagcttgcaactaaggctgcccgcaagtcagccccgaccactggaggagtgaagaagccccaccgctaccgccctgggactgttgccctccgtgagatccgcaagtaccagaagagcactgagctgttaatcaggaagctgcccttccagaggcttgttagggaaattgcacaggacttcaagactgatctacgtttccagagccatgctgtgcttgccctccaggaggctgccgaggcgtaccttgttggtctgtttgaggacaccaacctgtgcgccatccatgctaagcgtgtgaccatcatgcccaaggacattcagctggccaggaggatccgaggcgagagggcttaatcatgatcatgacaatcaaaatctcgtgtcgtagtagtggtttaatgtggtgccatgttcggacatcagtagggcttgttttgtggatcataagtttctcttctgcagcactatgtgttgcgactaccgttgttggtgttattactagggtcgtcgaatacttaaattgtctcgtctagtgttgttaccgcgttgacagtttgacatttgtgtgctttgttgctgctgactagcagtgctgtttgtgcgctgctggattgtaagcttcattgctgttgctgatccgttcgttaatgtcaagtttcgg

SEQ ID NO: 9871 - protein, 136 aa, Panicum virgatum
  misc_feature: Ceres CLONE 1719539
  misc_feature (58)..(132): Pfam Name: Histone Pfam Description: Core histone H2A/H2B/H3/H4
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 9872 - DNA, 738 bp, Panicum virgatum
  misc_feature: Ceres CLONE 1719563
  misc_feature: Encodes the peptide sequence at SEQ ID NO. 9873
atccagtccccaatccgtcgagaaattcctcccgagccatcgaaatcgaagcgaagcgaagcggcctcccccgatcctctcaagatgcagatctttgttaagaccctcaccggcaagaccatcactttggaggttgagtcgtctgacaccattgacaatgtgaaggccaagatccaggacaaggagggcatccctccggaccagcagcgtctgatcttcgcwggcaagcagcttgaggatggccgcaccctrgcagactacaacatccagaaggagtccaccctccacctggtgctccgcctgcgtggtggtatgcagatctttgtsaagaccctcacyggcaagaccatcaccttggaggtggagtcttcmgataccatygacaatgtgaaggcgaagatccaggacaaggagggcatccccccggaccagcagcgtctgatcttcgccggcaagcagctggaggatggccgcaccctggcggactacaacattcagaaggagtcgaccctycaccttggtmctgcgyctccgtggtggttgcagagcctagtgccctcacctgagttgccttttgtcgttatggtcaacccctggtttaagtcgtgtgaactctctgcattgcgttgctagtgtctggttgtggttgtaataagaacatgttgctgtggatcacatgactttcatggctgctttaaagttcctgaaatctgaactcggaacccctttttaagcttt

SEQ ID NO: 9873 - protein, 182 aa, Panicum virgatum
  misc_feature: Ceres CLONE 1719563
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
  misc_feature (147)..(147): Xaa is any aa, unknown, or other
  misc_feature (149)..(149): Xaa is any aa, unknown, or other
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLGXAXPWWLQSLVPSPELPFVVMVNPWFKSCELSALRC

SEQ ID NO: 9874 - DNA, 609 bp, Panicum virgatum
  misc_feature: Ceres CLONE 1719583
  misc_feature: Encodes the peptide sequence at SEQ ID NO. 9875
cctccgttgcagcgccgccaccatctagggcgcattccccactcctgtccgcagccgccgagcctgcgccagccctgcaagatggtgctccagaacgacatcgacctgctcaaccccccggcggagctcgagaagctcaagcacaagaagaagcgcctcgtccagtcccccaactctttcttcatggacgtcaagtgccagggatgcttcagcataaccactgttttcagccactcccagactgttgtggtgtgcccgggctgccaaactgtcctctgccagcccactggaggaaaggctaggctcacggagggttgctccttccgccggaagggagactagaatgtaatctggaagacgatgtttgttctgagccaagtttttcactttgagtatgtagccgtcaaattttgtgctatactgctatgtgaaatgttagggccctgaactgctgcttactataaggctttcaatatctattcctatgttatgtactggatactactactcaatgttctgtttggcacctgctttatctaattagctggggttgttttggattatgatgaaccaagtggtgaaattgttgaatactctcggttggcttgc

SEQ ID NO: 9875 - protein, 86 aa, Panicum virgatum
  misc_feature: Ceres CLONE 1719583
  misc_feature (30)..(84): Pfam Name: Ribosomal_S27e Pfam Description: Ribosomal protein S27
MVLQNDIDLLNPPAELEKLKHKKKRLVQSPNSFFMDVKCQGCFSITTVFSHSQTVVVCPGCQTVLCQPTGGKARLTEGCSFRRKGD

SEQ ID NO: 9876 - DNA, 530 bp, Panicum virgatum
  misc_feature: Ceres CLONE 1719588
  misc_feature: Encodes the peptide sequence at SEQ ID NO. 9877
aggaagaggctcatggacaccaaccccaactcattcaggaagctggtccggaccttcctagaagccagcggcagaggctactgggagacatcggaggagaacttggagaggctccgggagctctactcggaggttgaagacaagatcgagggaattgaccggtaaattgattgatcggctccagcattattccagcaaggagaagctcggagctcttctgcctcactgagctgagacacttgaacaatgtgtgattttatataaagttgtaacatgtaataatacaggaggatatacaatgtttaacaaagaggatggccgtgattgggaaaaaaagaagcatgagttgaagaaatgaagttgttttgtgtagagttttttttaaaaaaaaattctcgctttctcaaatttgttatggagaacgagtaacaaaagatggaggcatggagcatattttcagcctcaacttcacttggctttgaaatgtcccctgttctttcagttcacagaatgtcatcaggaagtgcgag

SEQ ID NO: 9877 - protein, 54 aa, Panicum virgatum
  misc_feature: Ceres CLONE 1719588
  misc_feature: SWISSPROT Homolog: EC 6.6.1.1 Magnesium chelatase
RKRLMDTNPNSFRKLVRTFLEASGRGYWETSEENLERLRELYSEVEDKIEGIDR

SEQ ID NO: 9878 - DNA, 378 bp, Panicum virgatum
  misc_feature: Ceres CLONE 1719589
  misc_feature: Encodes the peptide sequence at SEQ ID NO. 9879
aagttgcgggggcggcgtaggcagcggcggcgtgctcgtgatctcaacaccaggcgctcgcttccggtcacccgtcgctccgcgcacccgtgtctaggaggaagaccagggagcccaaggaggagaatgtcacccttggccccactgtccgtgagggagagtatgtctttggtgttgctcgcgtctctgcatcctccaacgacgccttgattcatgttactgatttgtctggcagggaaactctggttcggatcactggtggcatgaatgtcaaggctgatcgtgatgaatcgtcaccttatgctgctaagcttgctgctcaagacgtgacagctcgcatgcgaggagctagggatcactgcgctgcgctttaagctt

SEQ ID NO: 9879 - protein, 36 aa, Panicum virgatum
  misc_feature: Ceres CLONE 1719589
  misc_feature: Functional homolog of the protein sequence given in SEQ ID NO 50135
  misc_feature: Useful for making plants with modulated biomass
MNVKADRDESSPYAAKLAAQDVTARMRGARDHCAAL

SEQ ID NO: 9880 - DNA, 293 bp, Panicum virgatum
  misc_feature: Ceres CLONE 1719589-R
ttagtggcttgaaaattgggcgcatagagcatgttacgccagttcccagtggccgcactcgctgaaagggtggtaggaggggatggaggctgtaggcgtcttctccgggccatttcccatatcacggcgcaggccatgaagaaactagtcctctcggggtagtgttgccgttcccatgctggtcaagagagctttaattttcctctatgttgaggatcatttaccgttcgtcgaacctgcgatgtggcatggaggatgttttggttgaggaattgacttgtcatattgatgcc

SEQ ID NO: 9881 - DNA, 593 bp, Panicum virgatum
  misc_feature: Ceres CLONE 1719592
  misc_feature: Encodes the peptide sequence at SEQ ID NO. 9882
agcgccgccaccatctagggcgcattccccactcctctccgccgccgccgccgagcctgcgccagccctgcaagatggtgctccagaacgacatcgacctgctcaaccccccggcggagctcgagaagctcaagcacaagaagaagcgcctcgtccagtcccccaactctttcttcatggacgtcaagtgccagggatgcttcagcataaccactgttttcagccactcccagactgttgtggtgtgcccgggctgccaaactgtcctctgccagcccactggaggaaaggctaggctcacggagggctgctccttccgccggaagggagactagaatgtagtctggaagacgatgtttgttctgagccaagtttttcacttgagtatgtagccgtcaaattttgtgctatgtgaaatgttagggccctgaactgctgcttactataaggctttcaatatctattcctatgttatgtactggatactactactcaatgttctgtttggcacctgctttatctaattagctggggttgttttggattatgatgaaccaagtggtgaaattgttgaatactctcggttggcttgc

SEQ ID NO: 9882 - protein, 86 aa, Panicum virgatum; identical to SEQ ID NO: 9875
  misc_feature: Ceres CLONE 1719592
  misc_feature (30)..(84): Pfam Name: Ribosomal_S27e Pfam Description: Ribosomal protein S27

SEQ ID NO: 9883 - DNA, 566 bp, Panicum virgatum
  misc_feature: Ceres CLONE 1719623
  misc_feature: Encodes the peptide sequence at SEQ ID NO. 9884
gtcgccctcaacctcaagacctcaaccaagggaagggaagggaaggtagggtaaggtacaggcgcccagtccaatccaatcccccctcgatggcggcggtagatctgtccaagctggtgaaggagaagcgcttctgggtggcctccttcctcgtcgcatgggcagccgcgctgcagggccacatgatgtggatgcagcgccaggaagccttcaagcacaagtttggcgcagacgcctccgacgcctcttcctccttggattcctcctctacctagcaattttaccaccggatgcgccagattaggggttgtcagtctgtctgttgaacctctgctaccttatctagccatgtttagttcccactctataaaccccgtaaacgcaaaaaacatcacatcaaatatttagtacttcaaattagtaagattccgtcgcaatttttttttgcgtttcatctaaacacacccctagcattctactatagctggctctcacaacagctgctgtttctctgagttagtacatgcaccgggaaaataaaaaacaaggctagtgaatgacttgct

SEQ ID NO: 9884 - protein, 61 aa, Panicum virgatum
  misc_feature: Ceres CLONE 1719623
  misc_feature: Functional homolog of the protein sequence given in SEQ ID NO 50131
  misc_feature: Useful for making plants with modulated heat sensitivity
MAAVDLSKLVKEKRFWVASFLVAWAAALQGHMMWMQRQEAFKHKFGADASDASSSLDSSST

SEQ ID NO: 9885 - DNA, 741 bp, Panicum virgatum
  misc_feature: Ceres CLONE 1719630
  misc_feature: Encodes the peptide sequence at SEQ ID NO. 9886
aagtttcggcggcggcgtaggcagcggcggcgtgctcgtgatctcaacaccaggcgctcgcttccggtcacccgtcgctccacgcagccatgtcgaggaggaagaccagggagcccaaggaggagaatgtcacccttggccccactgtccgtgagggagagtatgtctttggtgttgctcacgtctttgcatccttcaacgacaccttcattcatgttactgatttgtctgggagggaaactctggttcggatcactggtggcatgaaggtcaaggctgatcgtgatgaatcgtcaccttatgctgctatgcttgcagctcaagacgttgcagctcgttgcaaggagcttggtatcactgcgctgcacattaagcttcgtgccactggaggcaacaaaaccaagactcctgggcctggtgctcagtctgctcttagggctcttgctcgttctggcatgaaaattgggcgcatggagaattggagggcggcttctcctggctatttgccatatcatggcgcaggccatgaagaaactagtcctctctgggtagtgttgctgttcctatgcttgtcaagagagctttaattttgctctatgttgaggatcatttaccgttagtcgaacctgtgatgttgcatggatgatgttttgttttaggaattgacttgtcatatttatgctaaaaaaacatgtgttttcactctagaactttgtgttagtaatgtacctgttggatggt

SEQ ID NO: 9886 - protein, 165 aa, Panicum virgatum
  misc_feature: Ceres CLONE 1719630
  misc_feature (28)..(132): Pfam Name: Ribosomal_S11 Pfam Description: Ribosomal protein S11
  misc_feature: Functional homolog of the protein sequence given in SEQ ID NO 50135
  misc_feature: Useful for making plants with modulated biomass
MSRRKTREPKEENVTLGPTVREGEYVFGVAHVFASFNDTFIHVTDLSGRETLVRITGGMKVKADRDESSPYAAMLAAQDVAARCKELGITALHIKLRATGGNKTKTPGPGAQSALRALARSGMKIGRMENWRAASPGYLPYHGAGHEETSPLWVVLLFLCLSREL

SEQ ID NO: 9887 - DNA, 610 bp, Panicum virgatum
  misc_feature: Ceres CLONE 1719649
  misc_feature: Encodes the peptide sequence at SEQ ID NO. 9888
actcgacgcaccaactctctctctctctctctcacttcctcaggagcgctagggttttcctgcggcggcggcggaggaaggcggcgatggggcactccaacgtgtggaactcgcaccccaagaactacgggcccggatcccgcgtctgccgggtctgcgccaaccctcatggactgatcaggaagtacgggctgatgtgctgcaggcagtgcttccgcagcaacgccaaggacattggcttcatcaagtaccgctgaagtcagctgtgggctatgagaatgccatcttcgggtatgacatggaccatgttttagaagcgaggcgataatttaaattccagtaatttagatgttttgttcagaactctgcaagtgaagtctgttgcctgtgtttttgatggagaacttggccatgtcggtcatgtttgaatcatgagttacctgcatatgtgcagaatttgagctaccttgtttgataaccatcttatctttgtctagttgagcatcaagtggatggttattgttgaacttgcgatatttaacatgccataaagacccatttgtggtgcctttggattgatattggaatattgaacatgtgatcaagatgc

SEQ ID NO: 9888 - protein, 56 aa, Panicum virgatum
  misc_feature: Ceres CLONE 1719649
  misc_feature (3)..(56): Pfam Name: Ribosomal_S14 Pfam Description: Ribosomal protein S14p/S29e
  misc_feature: Functional homolog of the protein sequence given in SEQ ID NO 50136
  misc_feature: Useful for making plants with modulated nitrogen use efficiency
MGHSNVWNSHPKNYGPGSRVCRVCANPHGLIRKYGLMCCRQCFRSNAKDIGFIKYR

SEQ ID NO: 9889 - DNA, 383 bp, Panicum virgatum
  misc_feature: Ceres CLONE 1719651-R
  misc_feature: Encodes the peptide sequence at SEQ ID NO. 9890
cattcaagacaaaggtcttccatccgaatatcaacagcaatgggagcatctgtcttgatatcttgaaggaacaatggagcccagcattgacagtttctaaggtactactctcaatttgctcccttttgacggacccaaaccctgatgacccattggttccggagattgctcacatgtacaagagtgatcgggcgaaatatgagtccactggtaggagctggacccagaaatacgcaatgggctgacgttgccggctaccgggaagatgatgacctagcaatatgctcgtgttatgtgcctttgttccagttctaatgtattgccttctgtcgttcgtgcatcgaacaatctctataatggaaggtgaaacattgattgtgttc

SEQ ID NO: 9890 - protein, 80 aa, Panicum virgatum
  misc_feature: Ceres CLONE 1719651-R
  misc_feature (1)..(74): Pfam Name: UQ_con Pfam Description: Ubiquitin-conjugating enzyme
  misc_feature: SWISSPROT Homolog: EC 6.3.2.19 Ubiquitin--protein ligase
  misc_feature: Functional homolog of the protein sequence given in SEQ ID NO 50118
  misc_feature: Useful for biocontainment applications
FKTKVFHPNINSNGSICLDILKEQWSPALTVSKVLLSICSLLTDPNPDDPLVPEIAHMYKSDRAKYESTGRSWTQKYAMG

SEQ ID NO: 9891 - DNA, 172 bp, Panicum virgatum
  misc_feature: Ceres CLONE 1719651
cttcctgcttctcgatcggattgggttgggggttctgggtaggtgtggtgatctttccagtagttagcaccggcttcctgtggcgaccatgtactattatgagaatgtttatttatgttgtaccttcttgaacattcttagattaattcagcaataagttgtatcctgctac

SEQ ID NO: 9892 - DNA, 754 bp, Panicum virgatum
  misc_feature: Ceres CLONE 1719665
  misc_feature: Encodes the peptide sequence at SEQ ID NO. 9893
accagcgcatcgcattccaatcccatttcccccttgagcaaaaaagaggcagccagagagagcatcaccatgtcgggcatcatccacaagatcgaggagaccctccacatggggggcgaccacaagaaggaggaggagcacaagaaggcggaggcgcacaagaaggccgaggagcaccacaagaaggacggggagcacaaggagggcatcgtcgagaagatcaaggacaagatcaccggcgagcacggcgacaagtccggcgagcacaaggacgacaaggaccacaaggagaagaaggacaagaagaagaagaaggagaagaagcacggcgagggccaccacgacggccacagcagcagcagcgacagcgactgatcgcctcgccgcgcgccgtgcttgccggtaaatacgcatgcactgccgctcagatcctttctaatgaataataaagaaattgttcgcctttataatttcctttttttttgctggatcacctgatattcaagtcgtttgagcttttgtgatcttttttcgcgtgcatacaggtgaaaaaggtgcttggagaggactatctaccggaagctgtgtgatgtaatgtttcatgagtgccatgcgtgtgtgtgtgtgtgctaatcaagggagaaatgcaaaaaaaaaaatcctttatgttggtgaatgtactcctaatgatggctccatggtgctagcttgtaataaaatgttaatgcagaaattggtctgctagcttgtgtcg

SEQ ID NO: 9893 - protein, 101 aa, Panicum virgatum
  misc_feature: Ceres CLONE 1719665
  misc_feature (2)..(101): Pfam Name: Dehydrin Pfam Description: Dehydrin
MSGIIHKIEETLHMGGDHKKEEEHKKAEAHKKAEEHHKKDGEHKEGIVEKIKDKITGEHGDKSGEHKDDKDHKEKKDKKKKKEKKHGEGHHDGHSSSSDSD

SEQ ID NO: 9894 - DNA, 762 bp, Panicum virgatum
  misc_feature: Ceres CLONE 1719685
  misc_feature: Encodes the peptide sequence at SEQ ID NO. 9895
atctctagctccctgctctgcatccagccagccatggccaccttccagatcacccctgtgcttgtggagcgcaacgagctcaagttcagtggcctctacatgtatcacacgacctccggcccgaaccgtaaccaagagtcactggtaagcaagaacgggttgggttcgctggttgcgaacaactgggaagtacgcgacggccctgatcccaacgccaaagtcatcgcccgcgcacagagcatgcatatgaacaccggtgtcaaccaaatctggcagaatttcttctgtctggccttcgaggacggcaggttcaagggttccacgtttcaggtgatgggattagatgtcgtcaggggtgaatgggctattgtggggggaacgggagaattctccatggcaacgggtaccatttacaagaagttccacaagaaaacgagtgaaggggacatagtggaacttacaatccatggattttgtcccgttctcgaagggtcaaagcaggacaaccactgctcgtcatctggtgcctgacgtctcgttgtgctcctgcatcttttgtatcgagcggatctttgctcctgccgacctgtgtgtttgtgtttgctcctgtcatcccgtgtcaaataaagatctcgatcagagactgtgttcctgtgcttctgtatccgttgtgaaataaagatccttgtttgtaaaccactattaaattggtcacacacagtgctcattttcttattaactactgcacgatcacgctccgtc

SEQ ID NO: 9895 - protein, 165 aa, Panicum virgatum
  misc_feature: Ceres CLONE 1719685
  misc_feature (1)..(150): Pfam Name: Dirigent Pfam Description: Dirigent-like protein
MATFQITPVLVERNELKFSGLYMYHTTSGPNRNQESLVSKNGLGSLVANNWEVRDGPDPNAKVIARAQSMHMNTGVNQIWQNFFCLAFEDGRFKGSTFQVMGLDVVRGEWAIVGGTGEFSMATGTIYKKFHKKTSEGDIVELTIHGFCPVLEGSKQDNHCSSSGA

SEQ ID NO: 9896 - DNA, 473 bp, Panicum virgatum
  misc_feature: Ceres CLONE 1719690
  misc_feature: Encodes the peptide sequence at SEQ ID NO. 9897
atagaaccaggacgaagagcaatgacacgatatgcacgtcgtggtggaaaaatctgggtgcgtatctttcccgacaaaccggttacaataagacccacagaaacacgtatgggctcgggaaagggatcccccgaatattgggtagccgttgttaaaccacgtcgaatactttatgaaatgagcggagtatccgaaactgtagctagagcagctatctctatagctgccagtaaaatgcccatacgaagtcaatttcttcgattagagatatcgaaccccaaaaaggagtattgaagataaaaaacctcgggtttttctttctggaaagacaatatttctttcatcctttcgcattgaaataacaaatcgaaatcaaaataatatgattcaacctcagacccttttaaatgtagcagagaacagtggagctagaaaattgatgtgtattccagtcataggagccgctggttaat

SEQ ID NO: 9897 - protein, 97 aa, Panicum virgatum
  misc_feature: Ceres CLONE 1719690
  misc_feature (1)..(87): Pfam Name: Ribosomal_L16 Pfam Description: Ribosomal protein L16
IEPGRRAMTRYARRGGKIWVRIFPDKPVTIRPTETRMGSGKGSPEYWVAVVKPRRILYEMSGVSETVARAAISIAASKMPIRSQFLRLEISNPKKEY

SEQ ID NO: 9898 - DNA, 419 bp, Panicum virgatum
  misc_feature: Ceres CLONE 1719697
  misc_feature: Encodes the peptide sequence at SEQ ID NO. 9899
ggctcactggccggtgttttacgacggcgtgactgggaaatccctgtcgttacccagatgaatcaccttgcagcagatcgccctttctcgagtcggcgtactaccgaagaggcccgcaccgatcccccttggcagcacatgaacaacctgattggcgaatggcacgcgacctgaagaggcgcatcacgtgcggcgggcgcggtggttactcgcagcgtgaccaccacgcttgacagctccgtagcgcccgctgcgttctcattcttcccttactctcgaacgacatgcgccagcttttatcgttagtctctgaacttggggatacctttatggatccgatatttcgctctccggctcttcgatcgcgaaaaagttgattacggagatggttcgcgtaaagggttctcgacgtaatacac

SEQ ID NO: 9899 - protein, 57 aa, Panicum virgatum
  misc_feature: Ceres CLONE 1719697
  misc_feature: SWISSPROT Homolog: EC 3.2.1.23 Beta-galactosidase
GSLAGVLRRRDWEIPVVTQMNHLAADRPFSSRRTTEEARTDPPWQHMNNLIGEWHAT

SEQ ID NO: 9900 - DNA, 375 bp, Panicum virgatum
  misc_feature: Ceres CLONE 1719697-R
ctgttgagtgagaagagatttcttgtctcacacgagcgactaggagaagggagtccgcgagatgaggaggcggaagagagcactataaagaatccgtctctccccgcagggtggccgattgatttagaaagctggctggacaggtttccagatgggaaatcgggcagtgagcgcaaggctattaatgtgcagtgagactcgctctttaggcaccccaggcttgtcactttatgcttccggatggaaattgatgtggaattgtgaagggatcataatttctgacatccaccatctatttccatgattgcgccaagcgcgcaattaaccctcactaaagggaacaaaagcaggagctccaccacggaagcgaccact

SEQ ID NO: 9901 - DNA, 761 bp, Panicum virgatum
  misc_feature: Ceres CLONE 1719721
  misc_feature: Encodes the peptide sequence at SEQ ID NO. 9902
aaaaaaaaaactcgccgcgccgcgccgcagccaccccccaccagcaccccgagtcctggagagaagcagatcggcggcgcgtcactcgcaactgccggtaagcttaaatggcgacggttcctgattctctgatctgggagatcgtgaggaagaataactccttcctggtcaagcagtttggcaatggcaatggcaatgccaaggttcagttcagcaaggagcctaacaacctctacaatgtccactcctacaagcactctggccttgccaacaagaagaccgtgactgtgcaaccagccagtggcaaggagatagcggtggtcctcttgacaaccaagacaaagaagcagaacaagcctgccagcctcaaccacaagtctgtcatgcgcaaggaattccgcaagatggccaaggctgtcaagaaccaggtcggtgacaattactacaggcctgatcttaccaagccagctcttgcaaggctgagcgcagtgtaccgcagcctccagattgccaagtctggtgtcaagaagaataacaggcaggcgaactaagtcacaaggagttgttttgatgggtggtgtttatgtttcatggtttctagatctggactatgatggatgatgtgcgtacctaagactgccacaaattttcattgtaggttccacctttgtacccaactacccatgacataattaagcatgtgaatatccttttagtaattgttgccttttggtgcttgccatgcctgaggttctactacg

SEQ ID NO: 9902 - protein, 147 aa, Panicum virgatum
  misc_feature: Ceres CLONE 1719721
  misc_feature (5)..(139): Pfam Name: Ribosomal_L28e Pfam Description: Ribosomal L28e protein family
  misc_feature: Functional homolog of the protein sequence given in SEQ ID NO 50137
  misc_feature: Useful for making plants with altered oil content
  misc_feature: Useful for making plants with modulated cold sensitivity
MATVPDSLIWEIVRKNNSFLVKQFGNGNGNAKVQFSKEPNNLYNVHSYKHSGLANKKTVTVQPASGKEIAVVLLTTKTKKQNKPASLNHKSVMRKEFRKMAKAVKNQVGDNYYRPDLTKPALARLSAVYRSLQIAKSGVKKNNRQAN

SEQ ID NO: 9903 - DNA, 864 bp, Panicum virgatum
  misc_feature: Ceres CLONE 1719722
  misc_feature: Encodes the peptide sequence at SEQ ID NO. 9904
aatgctacttgactaaaaccccacggttctcggggttccgatcgcctcactgtgctgctgctgcttcgcataatctgctctgctctccgattcctcctgagcagctgcggttggatctcggatcggtgatcacattaacaatggtgaaggctgttgctgtgcttggtaacagcgagggtgtcaagggcaccatctacttcacccaagagggagatggccccaccactgtcaccggaagtgtctctggcctcaagcctggcttccatgggttccatgtgcatgcacttggtgacacaacaaatggctgcatgtcaactggaccgcattacaaccctgcgggcaaggagcatggagcaccagaagatgagaaccggcatgctggtgatctcggaaatgtcaccgccggagatgatggtgttgctaacttcactgttaccgacagccagatcccactgactgggccaaactcaatcattggcagagctgttgttgttcatgctgatcctgatgatcttggaaagggtgggcacgagctgagcaagagcactggaaacgctggtggccgtgttgcctgcgggatcatcggactccagggctgagagtgatcaccgaactcaagtgccgaaagtgtcgtcgtccccgctgtcaccactcaccactggaccagcctgagcatcctctggatatgtgaaataagagcgcctgatctatgatcggcgtgtttgtgttctcgctcctgtagcacctaccgatgaactgaaacctgtgttggtgtaacgctgtttcacctggacctgtgtttcatacatttcgctttgagaacgcctggaccgatctgtggaaataagaaggcacttgttgcgg

SEQ ID NO: 9904 - protein, 152 aa, Panicum virgatum
  misc_feature: Ceres CLONE 1719722
  misc_feature (1)..(152): Pfam Name: Sod_Cu Pfam Description: Copper/zinc superoxide dismutase (SODC)
  misc_feature: SWISSPROT Homolog: EC 1.15.1.1 Superoxide dismutase
MVKAVAVLGNSEGVKGTIYFTQEGDGPTTVTGSVSGLKPGFHGFHVHALGDTTNGCMSTGPHYNPAGKEHGAPEDENRHAGDLGNVTAGDDGVANFTVTDSQIPLTGPNSIIGRAVVVHADPDDLGKGGHELSKSTGNAGGRVACGIIGLQG

SEQ ID NO: 9905 - DNA, 1028 bp, Panicum virgatum
  misc_feature: Ceres CLONE 1719723
  misc_feature: Encodes the peptide sequence at SEQ ID NO. 9906
ttttcccctatccaacccccggaaacccccgaaaacctccctgccatggcgaccgccgcccaggccgccgccgtcttcctctcgttcctttcttcctcccccagccaccacagcgccccctcctccgtctccctcggggcaacccctgtcctaccagtctccctccgggtcgctgctgcggctggcccacggctgtcttcccccctcaggggccgtcgcatcagcgccgtcatcgcccaactccccaccgcgcatcccgaggtatccaatggggacaagaagatcagatggtcttcaagggcggtgcggtcatttgcgatggcagagctggaggctcggaagatgaggtatcctacaacaggcactgaggggctcctcatgggcattcttgttgaaggaactagcggtgcggcaaaacttttgcgtgctaatggaatcacacttctcaaagtgcgtgaggaggcagcaaatgtgcttgggaaatcagaaatgttttattttagtcctatgcatccaccattgacaaaagctgcacaacaagttcttgattgggctgtcaatgagaaactgaagtcaggcgaggatggagaagtaactgccaatcatttgctgctggggatatggtcagataaggagtcggctggtcataaaatcctggcttcacttgggtttgatgatgagaaagccatattactcgcgaaaacagctggtgaagaggctgcaatgagtcctaggtagcaaaatgagggcttattctacttctttgaggctgttggtgtgggctcgagtactgtcaacgcatactgggtcgggttgcttctgcaaaatttaggacataagatacgttaggctgaatccaatatttgtactctcactattgctgatgcctgtaaaagcgtcgtgatttctttgcaggatgatggcttttgctccttgcacagctggatttatgaactgttaggtcgaatccgatatttgtgctcacaacattgctgatgcctgtaaaaacattgggatttttttgcacg

SEQ ID NO: 9906 - protein, 230 aa, Panicum virgatum
  misc_feature: Ceres CLONE 1719723
  misc_feature (93)..(145): Pfam Name: Clp_N Pfam Description: Clp amino terminal domain
MATAAQAAAVFLSFLSSSPSHHSAPSSVSLGATPVLPVSLRVAAAAGPRLSSPLRGRRISAVIAQLPTAHPEVSNGDKKIRWSSRAVRSFAMAELEARKMRYPTTGTEGLLMGILVEGTSGAAKLLRANGITLLKVREEAANVLGKSEMFYFSPMHPPLTKAAQQVLDWAVNEKLKSGEDGEVTANHLLLGIWSDKESAGHKILASLGFDDEKAILLAKTAGEEAAMSPR

SEQ ID NO: 9907 - DNA, 739 bp, Panicum virgatum
  misc_feature: Ceres CLONE 1719729
  misc_feature: Encodes the peptide sequence at SEQ ID NO. 9908
cgactcctctcgcccgcaacccccacttctctccctccgtctctccctccgcgagttcgattccaaacggcggcggcgagatgaaggtcacggtgatgaccgccgacgagcagattctctccctcgacgtagaccccgacgaatccgtggagaatctaaaggcgcttctcgaggtggagactcgtgtaccgttgcgacagcagcagcttcacttcaatgggaaggagatgcagaactccgacaagctcagctccattggggtccatgatggtgatcttgtcatgatgctcccctcaaacgaaagggcctctcaggatgttctaaagttaaatcctgacggaactgctgctaatcctcaagcttttcaacaacatgttcgaggtgattcacaacttatggcacagcttcttcagagtgatccgcaactagcacaagctattcttggagacaacatcaatgaactacagaatatactgcgctcccgccacctacagaaaatggaactgaaacgcaaacaagaagaagagcttgctttattgtatgctgatccttttgatgtcgaagctcagaagaaaattgaagctgcaattcggcaggtaggtattactttctcaggacaacacatattggttatggcaatttttctttctttcatatgtcactgaaaaaaacattacatatgatggatatcattagataaacatctaatggttaaggaggcttaaataatgtgcactac

SEQ ID NO: 9908 - protein, 194 aa, Panicum virgatum
  misc_feature: Ceres CLONE 1719729
  misc_feature (6)..(75): Pfam Name: ubiquitin Pfam Description: Ubiquitin family
MKVTVMTADEQILSLDVDPDESVENLKALLEVETRVPLRQQQLHFNGKEMQNSDKLSSIGVHDGDLVMMLPSNERASQDVLKLNPDGTAANPQAFQQHVRGDSQLMAQLLQSDPQLAQAILGDNINELQNILRSRHLQKMELKRKQEEELALLYADPFDVEAQKKIEAAIRQVGITFSGQHILVMAIFLSFICH

SEQ ID NO: 9909 - DNA, 633 bp, Panicum virgatum
  misc_feature: Ceres CLONE 1719760
  misc_feature: Encodes the peptide sequence at SEQ ID NO. 9910
agggcggcgtgcggcgagttttattgagaggccaggtccgtctgcttgctctcgatcatcttcctaagccgaccgccacaggaaccaattctaactcccgtcgattctctccgcgacttcagggttcattgcgtgccggaccgtgtcgcgagtcccgatggcggagccggcgaagcccgaggtgacggaggaggccaagatggacctgctcgaggacgacgacgagttcgaggagttcgagatcgaccaagagtgggatgacaaggaagaaggcaacgaagcacttcagcaatgggaggatgactgggacgacgatgacgtcaacgatgacttctcgctgcagttgaggaaggagctggagagcaatgcgcccaagaagtagccaacatatgcagccttgtatcgagttggagagcggtgtgatggtgtccaaggactagttggcgtatgcagccttgtatccattattgtcagatagggactggtgtacggtgacgatggttgggacactgctactgttgttcggcgctcgtccttcttggcatggtcactgatttagtcgttccgcttgcttttgatggatcatttccctgtttccgtctactaataactggtgcaccttggttaaaaggc

SEQ ID NO: 9910 - protein, 74 aa, Panicum virgatum
  misc_feature: Ceres CLONE 1719760
  misc_feature (8)..(70): Pfam Name: DSS1_SEM1 Pfam Description: DSS1/SEM1 family
MAEPAKPEVTEEAKMDLLEDDDEFEEFEIDQEWDDKEEGNEALQQWEDDWDDDDVNDDFSLQLRKELESNAPKK

SEQ ID NO: 9911 - DNA, 560 bp, Panicum virgatum
  misc_feature: Ceres CLONE 1719761
  misc_feature: Encodes the peptide sequence at SEQ ID NO. 9912
agaaggggcagcaagaacaggccacagaaagaacaatcccagcaatggcagcaaggtgtgctctttctgccccatccagcgtggttcgccaacccctctacggcaacaagctcgccaagaatctcactccatgcctgccgtcgccaagagccgtgagggtgagagtgaatgctgcaaagcttcctccaggggttgaggtgcccagggtgcagccgaagctgagcgagcccttcttggggttcacccagactgccgagatctggaactccagggcctgcatgatgggcctcatcggcaccttcatcgtggagctggtgctgaacaaggggattcttcagataattggggtggaggtggggaagggcctcgaccttcctctttaattgccattggcaaagctgattgcaagccttactctctctctctctctctctctctctctctctctctctctctctctctcgaaacctaggagtacctattatattgctctaaacattattctgtcgaatatagatactcatgcaattctgttgcgtaaccatatgacagagtttttc

SEQ ID NO: 9912 - protein, 112 aa, Panicum virgatum
  misc_feature: Ceres CLONE 1719761
  misc_feature: SWISSPROT Homolog: EC 4.99.1.1 Ferrochelatase
MAARCALSAPSSVVRQPLYGNKLAKNLTPCLPSPRAVRVRVNAAKLPPGVEVPRVQPKLSEPFLGFTQTAEIWNSRACMMGLIGTFIVELVLNKGILQIIGVEVGKGLDLPL

SEQ ID NO: 9913 - DNA, 686 bp, Panicum virgatum
  misc_feature: Ceres CLONE 1719788
  misc_feature: Encodes the peptide sequence at SEQ ID NO. 9914
ttacacattatccgactaaacccagggggccatctgcaaaaccgccagaacgccccccacccccttcttcgcttggttggggtccaggcgtccagcccagccgaactagggtttcctctcgccgccgccttccttctcgcctccacgcccaggtaagactgccggctctacttggtgagccgcacggatggcggaggaagccaatggaaagaaggaggaggaggaattcagcacaggccccctgtcagtgcagatgatgagcgtcaagaacaatacccaggttcttatcaactgccggaacaacaagaagttacttggtcgtgtgagggcatttgatcgacattgcaacatggttcttgagaatgttagggagatgtggactgagataccaaagactggtaaaggcaagaagaaggctcttccggtgaacaaagacaggttcataagcaagatgttcctccgtggggattcagtcatcatagttctcaggaacccgaaatgagttggacaactttgctcgcttgatgtctagtctgtatgccaaacactccaaacatgggtgtataagagacgattcttgagacggatttatccgtagtgatggttgagtgttttagttggatgctgtgatgcacctcttgtattcactggtactttctatttggctcgatcatcagtatatcaat

SEQ ID NO: 9914 - protein, 104 aa, Panicum virgatum
  misc_feature: Ceres CLONE 1719788
  misc_feature (22)..(101): Pfam Name: LSM Pfam Description: LSM domain
MAEEANGKKEEEEFSTGPLSVQMMSVKNNTQVLINCRNNKKLLGRVRAFDRHCNMVLENVREMWTEIPKTGKGKKKALPVNKDRFISKMFLRGDSVIIVLRNPK

SEQ ID NO: 9915 - DNA, 786 bp, Panicum virgatum
  misc_feature: Ceres CLONE 1719796
  misc_feature: Encodes the peptide sequence at SEQ ID NO. 9916
cgaaaaccctagaagctcctcaccctcccctgcggcggccgccttctcctcgcgaaatccttctcgcgtcgcgaaaatgagccaggaggcggtgaacccgaaggcgtacccgctggcggatgcgcagctgacgcttagtatcctcgagatcatccagcaggccgctaactacaagcagctcaagaagggcgccaacgaagcgacgaagaccctgaacaggggaatatcggagttcgtggtgatggcggctgacaccgagccgctcgagatccttctccacctccccttgctagctgaggataagaacgtgccatatgtatttgttccatcaaagcaagctcttggtcgtgcttgtggtgttacaagaccggttattgcttgctcagtgaccagcaatgagggtagccagctgaaacagccgattcagaatctcaaggactctatcgagaagcttctcatctgatttaccgaagacctttcagtgtgatgggcctcagcgacacatttttcagaggcttggactggtgatggtgtcttgtttactagattttgtgcgttccaaactatgtttgaagactgttaaaagtcgatcatactggaatttgtgctgcggcttcttatatttgtgacttgtgtaagatgtctgtatcatggtggctggtttctgtcgagattccgaccattattgtaacagctgtgtctggttgcaacttcttgcgaccacttgcaagcacaaaaggttcatttgtgttggctaggtgaaattgggtgcctaaggttgttgcc

SEQ ID NO: 9916 - protein, 128 aa, Panicum virgatum
  misc_feature: Ceres CLONE 1719796
  misc_feature (20)..(114): Pfam Name: Ribosomal_L7Ae Pfam Description: Ribosomal protein L7Ae/L30e/S12e/Gadd45 family
MSQEAVNPKAYPLADAQLTLSILEIIQQAANYKQLKKGANEATKTLNRGISEFVVMAADTEPLEILLHLPLLAEDKNVPYVFVPSKQALGRACGVTRPVIACSVTSNEGSQLKQPIQNLKDSIEKLLI

SEQ ID NO: 9917 - DNA, 397 bp, Panicum virgatum
  misc_feature: Ceres CLONE 1719846
  misc_feature: Encodes the peptide sequence at SEQ ID NO. 9918
agggtttcctcgccaccgccgcttccgccttcgccgccgcagccgcagccatgccgtcccacaagaccttccggatcaagaagaagctggccaagaagcagcgccagaaccgccccatcccctactggatccgcatgcgcaccgacaacaccatcaggtacaacgcgaagcgcaggcactggcgccgcaccaagctcggattctgagcgggggaagagatgccgggcaccgatgcttggggaaactgggatttacgagccggcctcgggacgcttccatgtttccgcatgctaggggagctcttgtttagattttgcttgtgttaatttgatgttatcagttgttcctgtagcgtactgagaataccatgctttgctgatgattgaacaccctttac

SEQ ID NO: 9918 - protein, 51 aa, Panicum virgatum; identical to SEQ ID NO: 9830
  misc_feature: Ceres CLONE 1719846
  misc_feature (9)..(51): Pfam Name: Ribosomal_L39 Pfam Description: Ribosomal L39 protein

SEQ ID NO: 9919 - DNA, 884 bp, Panicum virgatum
  misc_feature: Ceres CLONE 1719889
  misc_feature: Encodes the peptide sequence at SEQ ID NO. 9920
taccccctgcgccagcacacacacccacccggcagggagagagagcccctcggcggcggagaagatggtgtcgctcaagctgcagaagcgcctcgcctccagcgtgctcaagtgcggcaagggcaaggtctggctcgaccccaatgaagtcagcgagatctccatggccaactcccgccagaatatccgcaagttggttaaggatggttttatcatcaggaagcctcagaagatccactccaggtcccgtgcaaggagggcgcatgaggccaagcagaagggacgtcattctggatatggtaagcgcaggggtacgagggaggctaggctccccaccaagattctttggatgaggaggatgcgtgttctgaggcgcctgctgcgcaagtaccgtgaagccaagaagatcgacaagcacatgtaccatgacatgtacatgaaggtcaagggtaacagtttcaagaacaagagggtgctcatggagagtatccacaagtccaaggctgagaaggctagagagaagacactctctgatcagtttgaggccaagcgcgccaagagcaaggcaagccgtgagaggaagattgccaggagggaggagaggttggcccagggcccgagggaaccagcagctgcagctccagctgcagcggccccaaagaaggcaaagaagtgaaggggttgatctgaagctttagctttctggtaccaggagtagcctaattttggagcgcctctaaactgttttgctgttattatatatccaagctgttgtgccttgatatcgctgaatatcatcttgtttatgttgggttggataatgtagtggacttgtttatgcagagttttctttgcgacagatcaaagaaaatcccgttatgttt

SEQ ID NO: 9920 - protein, 203 aa, Panicum virgatum
  misc_feature: Ceres CLONE 1719889
  misc_feature (2)..(149): Pfam Name: Ribosomal_L19e Pfam Description: Ribosomal protein L19e
MVSLKLQKRLASSVLKCGKGKVWLDPNEVSEISMANSRQNIRKLVKDGFIIRKPQKIHSRSRARRAHEAKQKGRHSGYGKRRGTREARLPTKILWMRRMRVLRRLLRKYREAKKIDKHMYHDMYMKVKGNSFKNKRVLMESIHKSKAEKAREKTLSDQFEAKRAKSKASRERKIARREERLAQGPREPAAAAPAAAAPKKAKK

SEQ ID NO: 9921 - DNA, 579 bp, Panicum virgatum
  misc_feature: Ceres CLONE 1719905
  misc_feature: Encodes the peptide sequence at SEQ ID NO. 9922
gacttctccgataggttttcctcgcgccgccgccgctactgccgtcgcttccgtcttccccgccgccgcagccatgccgtcccacaagaccttccggatcaagaagaagctggccaagaagcagcgccagaaccgccccatcccctactggatccgcatgcgcaccgacaacaccatcaggtacaacgcgaagcgcaggcactggcgccgcaccaagctcggattctgagcgggggaagagatgccgggcaccgatgcttggggaaactgggatttacgagccggcctcgggacgcttccatgtttccgcatgctaggggagctcttgtttagattttgcttgtgttaatttgatgttatcagttgttcctgtagcgtactgagaataccatgctttgctgatggttgaagaacaccctttataaatttgcagaagctatcttggtctgccatgtgttaattagttgatcccgacagttttttttgcatttcagtatttcgatttacttgtcttgtgtagatgctagttcatgttcattgatggcttaaattgctatgatttttatagttggtttactc

SEQ ID NO: 9922 - protein, 51 aa, Panicum virgatum; identical to SEQ ID NO: 9830
  misc_feature: Ceres CLONE 1719905
  misc_feature (9)..(51): Pfam Name: Ribosomal_L39 Pfam Description: Ribosomal L39 protein

SEQ ID NO: 9923 - DNA, 602 bp, Panicum virgatum
  misc_feature: Ceres CLONE 1719911
  misc_feature: Encodes the peptide sequence at SEQ ID NO. 9924
aaccaaagacgccgttgtgcgggagacgaagagggaaagtgaagagcagcgtcggactagtgagccatgctcgcctcgccggcgctcaccggcgcccactccttcgcggcgtccgtgcccggcagcctcagcatacccctaccttccgtccccgcgcccttgcccacgccggcgcggcgcgcagtgctgtccgtcgtcgccaaggtcaaggtgcccacgccccaggacgaccgcatcgcccgccatgtccgcctccggaagaaggaggtagcacaaaagattggtgaagtgattgccaagtcttgcctggagaaaggaattaccaaagttgtcttcgaccgaggtggtttcctctaccacggccgcataaaagctcttgctgatgctgctagagagcacgggcttgagttctgaatatttacctcaaatgtttgttcatatttcaatgatcacctgtaatcttctcttttcaccccctctatgttgaacagagtttgtagtcacctgccttgttttgcagagtgcagactgggccaaactttgatcgcatcagatttttgttccagtctttgcattcaaaagcttctcaacacgatattatg

SEQ ID NO: 9924 - protein, 115 aa, Panicum virgatum
  misc_feature: Ceres CLONE 1719911
  misc_feature (36)..(115): Pfam Name: Ribosomal_L18p Pfam Description: Ribosomal L18p/L5e family
MLASPALTGAHSFAASVPGSLSIPLPSVPAPLPTPARRAVLSVVAKVKVPTPQDDRIARHVRLRKKEVAQKIGEVIAKSCLEKGITKVVFDRGGFLYHGRIKALADAAREHGLEF

SEQ ID NO: 9925 - DNA, 824 bp, Panicum virgatum
  misc_feature: Ceres CLONE 1719917
  misc_feature: Encodes the peptide sequence at SEQ ID NO. 9926
attttttttccggcctcttcctcgcgcggcgcctacccacccaaccccccgggttcgaagcgtgcgaagggagcgaagcagcgcggagagatggcccgtaccaagcaaactgctcgcaagtccacgggagggaaggctcccaggaagcagcttgcaactaaggctgcccgtaagtcagccccgaccactggaggagtgaagaagccccatcgctaccgccctggcactgttgccctccgtgagatccgcaagtaccagaagagcactgagctgttgatcaggaagctgcccttccagaggcttgtcagggaaattgcacaggacttcaagactgatctgcgtttccagagccatgctgtgcttgccctccaggaggctgctgaggcgtaccttgttggtctgtttgaggacaccaacctgtgcgccatccatgctaagcgtgtgaccatcatgcctaaggacatccagctggccaggaggatccgtggcgagagggcttaatcatctcaatcatgacaatcaaagtcaagtgtcgaagtagtgggttaatgtggtgccctgttcaggacatctgagtagggcttgttttgtggatcatattaagttcctcttctgcagcactatatgttgctactacctttgttggtgttgttactagggtcgtcgaatacttaaattgtctcgtctagtgttggtaccgcgttgacagtttgacatttgtgtgctatgttgctgctgactagcagtgtttgtgcgctgctggattgtaagcttcattgctgtggctgatctgttcgttaaatggtatcgtgttacgttgtgtg

SEQ ID NO: 9926 - protein, 136 aa, Panicum virgatum; identical to SEQ ID NO: 9871
  misc_feature: Ceres CLONE 1719917
  misc_feature (58)..(132): Pfam Name: Histone Pfam Description: Core histone H2A/H2B/H3/H4

SEQ ID NO: 9927 - DNA, 601 bp, Panicum virgatum
  misc_feature: Ceres CLONE 1719934
  misc_feature: Encodes the peptide sequence at SEQ ID NO. 9928
actacccgccgccggaccactcgtcgccctcctctcccccgcgagcgctcgcttcggaagcaagggattcgagatggccaagtcgaagaaccacacggcgcacaaccaatcgtacaaggcgcacaagaacggcatcaagaagcccaagcgccaccgccagacctccaccaaggggatggaccccaagttcctgaggaacctgaggtactctaggaagaacaacaagggtgacgaggctaaatcggaggagtaagatggaatgctcttagaaaagcaaagatgtgtttacccttcctagctcagttttacctttaggctctggattttctctaaagatggaatttgaatggtgttatgtatgatgggaaggaccctctgatgcccctgaagtgttactatgatattatgtgttaagttcatgctaccctttgaatagtttttcctcaagaattgattagtttccccattggggactgaaatagaatttctggatcatgtctgttgttttaggttttgtgctttgaggctatgttcaatctgacgcgattcagtgttaaactgggctctcggccattgtcaatattgaaggctcgttcagttc

SEQ ID NO: 9928 - protein, 59 aa, Panicum virgatum
  misc_feature: Ceres CLONE 1719934
  misc_feature (3)..(42): Pfam Name: Ribosomal_L29e Pfam Description: Ribosomal L29e protein family
MAKSKNHTAHNQSYKAHKNGIKKPKRHRQTSTKGMDPKFLRNLRYSRKNNKGDEAKSEE

SEQ ID NO: 9929 - DNA, 253 bp, Panicum virgatum
  misc_feature: Ceres CLONE 1719955
  misc_feature: Encodes the peptide sequence at SEQ ID NO. 9930
cttctcgatcggattgggttgggggttctgggtaggtgtggtgtgctcgggagttggggcttcttcgttgctttgcttcgctcatgcgcaagggaaagagaacaaggaggagaaatacgcggggaggcagatggcatcgaagcagatcctcaaggagctcaaggacctgcagaaggatcctcccacctcctgcagcgcatgcccgctcacggatgatccgtcccaccgtcaagcgaccgtaccgggatcgtca

SEQ ID NO: 9930 - protein, 40 aa, Panicum virgatum
  misc_feature: Ceres CLONE 1719955
  misc_feature: SWISSPROT Homolog: EC 6.3.2.19 Ubiquitin--protein ligase
  misc_feature: Functional homolog of the protein sequence given in SEQ ID NO 50118
  misc_feature: Useful for biocontainment applications
MASKQILKELKDLQKDPPTSCSACPLTDDPSHRQATVPGS

SEQ ID NO: 9931 - DNA, 438 bp, Panicum virgatum
  misc_feature: Ceres CLONE 1719955-R
  misc_feature: Encodes the peptide sequence at SEQ ID NO. 9932
tttttggtcacaattcacttccctccagactacccattcaaaccgcctaaggttgcattcaagacaaaggtcttccatccgaatatcaacagcaatgggagcatctgtcttgatatcttgaaggaacaatggagcccagcattgacagtttctaaggtactactctcaatttgctcccttttgacggacccaaaccctgatgacccattggttccggagattgctcacatgtacaagagtgatcgggcgaaatatgagtccactgctaggagctggacccagaaatacgcaatgggctgacgttgccggctaccgggaagatgatgacctagcaatatgctcgtgttatgtgcctttgttccagttctaatgtattgccttctgtcgttcgtgcatcgaacaatctctataatggaaggtgaaacattgattgtgttc

SEQ ID NO: 9932 - protein, 99 aa, Panicum virgatum
  misc_feature: Ceres CLONE 1719955-R
  misc_feature (1)..(93): Pfam Name: UQ_con Pfam Description: Ubiquitin-conjugating enzyme
  misc_feature: SWISSPROT Homolog: EC 6.3.2.19 Ubiquitin--protein ligase
  misc_feature: Functional homolog of the protein sequence given in SEQ ID NO 50118
  misc_feature: Useful for biocontainment applications
FLVTIHFPPDYPFKPPKVAFKTKVFHPNINSNGSICLDILKEQWSPALTVSKVLLSICSLLTDPNPDDPLVPEIAHMYKSDRAKYESTARSWTQKYAMG

SEQ ID NO: 9933 - DNA, 655 bp, Panicum virgatum
  misc_feature: Ceres CLONE 1719977-R
  misc_feature: Encodes the peptide sequence at SEQ ID NO. 9934
agagctatcggaggaggaggagagcttttgggcttttgggggtgcgtggtgcgccatgggggaggtgaagcacctgtgcctggtgaagttcaaggagggcgtcgtggtggaggacgtcctcaaaggcatgaccgaccttgtcgcccagatggacatggtcaaatccttcgagtggggccaggacgtgctgaaccaggagatgctgacgcagggcttcacgcacgtcttctcgctcaccttcgcctccgccgacgacctcaccacctacatgggccacgacaagcacgccgcgttcgccgccacgttcatggccgcactcgagaaggtggtcgtcatcgacttccccgtcgtcatcgccaagccaccgccatcggcatgatcgacctgccacagcatctgtcggccattgtacggtgccttttcaggtagcagatcatcgcctatttgcagcggtgatgtactgcgtgtctaagtacgtactatgtactaagctccttattactactcgttctgcctgatgctgtgtcccgtactctaggacgtctattgtagctgtaaggcaaagatatctatagcgtacgtgcagcactccgtgctccacagtccctaatggttggttatctttggaataaattttggtgatctttctggtagc

SEQ ID NO: 9934 - protein, 107 aa, Panicum virgatum
  misc_feature: Ceres CLONE 1719977-R
  misc_feature (4)..(98): Pfam Name: Dabb Pfam Description: Stress responsive A/B Barrel Domain
MGEVKHLCLVKFKEGVVVEDVLKGMTDLVAQMDMVKSFEWGQDVLNQEMLTQGFTHVFSLTFASADDLTTYMGHDKHAAFAATFMAALEKVVVIDFPVVIAKPPPSA

SEQ ID NO: 9935 - DNA, 451 bp, Panicum virgatum
  misc_feature: Ceres CLONE 1719977
atcatcgcctctcctctcctctctgcgagctgtgctatgagaagaagaggttatcttcttttctttttgcggtgcgtgccgtgccgtaggggaagtgactctcctttgcctggtgaagttcagggatcgcgtcgtgggacatgacctcctccatggcctaccctacctcgccgaccgaattgacctggtcctatccttcgagtcgggacatgacgtgccaaaccatgctatcctgacgcttcgctcccctctcctcttctccctccccttcccctcaccacaccacctcaccccttgcccgcgccacgaccgccacgcccccctccccgccactgtcctcgccgcactcggtaatgtggtcgtccttcacttccccctcctcctcgccaccccactcccattgatctaatcgacacaccatctctcctcccttccactgtaccgtgccttg

SEQ ID NO: 9936 - DNA, 857 bp, Panicum virgatum
  misc_feature: Ceres CLONE 1719991
  misc_feature: Encodes the peptide sequence at SEQ ID NO. 9937
aactgagcgctggcatcactcggagccttgcctctgtaggtagagagtgtgttgtttgcagggggaagaagggaagagggcaatggcgacctccttccaggggacgaccaccaagtgcaccgcctgcgacaagacggtgtacctcgtcgacaagctcaccgccgacaaccgcgtctaccacaaggcctgcttccgctgccaccactgcaagggaaccctcaagcttgcgaactacaactccttcgagggggtgctctactgcaggcctcacttcgaccagctgttcaagaggacggggagtctggacaagagcttcgaaggaacccccaaggttgtcaagccagaaagaaagaatgagaatgctattaaagtctccagtgcctttgctggcaccagagagaaatgtgttggatgcagcaagacagtctatccaattgagagggtaactgtcaacaacactatgtatcacaagagctgcttcaagtgctgccatggaggatgcaccatcagcccttcgaactacatcgcgcacgaggggaagctctactgcaagcatcatcacatccagctgatcaaggagaaggggaacttcagccagctcgagaatgatcatgagaagacatcacaggctggatcgctggaggacgaagaagcagagtactaatctttgagcatttccacagatgaataatgaatctccttgcatttgctcgagagcaatatacctttctatggcacggtttggtttcagttttaccaatgggggtcatgagcactcagagaacaatgatacgtcatcttgtatcttcatgtaaaccttgttatatctgagtcaaattctctacccagttttcacc

SEQ ID NO: 9937 - protein, 193 aa, Panicum virgatum
  misc_feature: Ceres CLONE 1719991
  misc_feature (108)..(164): Pfam Name: LIM Pfam Description: LIM domain
  misc_feature (12)..(68): Pfam Name: LIM Pfam Description: LIM domain
  misc_feature: SWISSPROT Homolog: EC 2.7.11.1 Non-specific serine/threonine protein kinase
  misc_feature: Functional homolog of the protein sequence given in SEQ ID NO 50126
  misc_feature: Useful for making plants with altered carbohydrate content
  misc_feature: Functional homolog of the protein sequence given in SEQ ID NO 50127
  misc_feature: Useful for making plants with modulated heat sensitivity
  misc_feature: The sequence is a functional homolog of SEQ ID NO 428 in the 10/412,699 US patent application
  misc_feature: The sequence is a functional homolog of SEQ ID NO 616 in the 11/435,388 US patent application
  misc_feature: The sequence is a functional homolog of SEQ ID NO 992 in the 11/479,226 US patent application
MATSFQGTTTKCTACDKTVYLVDKLTADNRVYHKACFRCHHCKGTLKLANYNSFEGVLYCRPHFDQLFKRTGSLDKSFEGTPKVVKPERKNENAIKVSSAFAGTREKCVGCSKTVYPIERVTVNNTMYHKSCFKCCHGGCTISPSNYIAHEGKLYCKHHHIQLIKEKGNFSQLENDHEKTSQAGSLEDEEAEY

SEQ ID NO: 9938 - DNA, 887 bp, Panicum virgatum
  misc_feature: Ceres CLONE 1720027
  misc_feature: Encodes the peptide sequence at SEQ ID NO. 9939
aagtaaatccaatgcttggtttccgtgggtgcaggcttggtatatcgtatcctgaattaacagaaatgcaagctcgtgccatctttgaagctgctatagcgatgaccaaccaaggtgttcaagtttttccagagataatggttcctcttgttggaacacctcaggaactggggaatcaagtggcccttatccgtcaaactgctaacaatgttttcactgctatgggtaaaaccattgagtacaaaattggaactatgattgaaattcccagggcagctctagtggctgatgagatagcagagcaggctgaattcttctcttttgggacgaacgaccttacacagatgacgtttggctacagcagggatgatgtggggaagtttctccccatttatctttctcagggtatcctccaacatgatccctttgaggtgcttgatcagagaggagtgggcgagctggttaagtttgctacagagaggggacgcaaaactaggcctaacctgaaggtgggcatctgtggagaacatggtggggagcctcagtcagttgctttcttcgcaaaggctgggctggattatgtttcttgctcccctttcagggttccgattgctaggctggctgcagctcaggtgctcatctgagagcacctcctcatcggcaaccggatcgccagctcttggtgcatctggtgaagaataatcatacaggtccatgaaacggtggaaactctgctttctggcaaaggctgttgtatgtagtcttctctgtgtgcgcgcgcatgtaagccttaatgggtggtgttctgaatttcccttgaactggcatggtaatgtagtaccaaattaaacagcgatgatgacgaagagctatcgaatatattggcg

SEQ ID NO: 9939 - protein, 213 aa, Panicum virgatum
  misc_feature: Ceres CLONE 1720027
  misc_feature (1)..(213): Pfam Name: PEP-utilizers_C Pfam Description: PEP-utilising enzyme, TIM barrel domain
  misc_feature: SWISSPROT Homolog: EC 2.7.9.1 Pyruvate, phosphate dikinase
VNPMLGFRGCRLGISYPELTEMQARAIFEAAIAMTNQGVQVFPEIMVPLVGTPQELGNQVALIRQTANNVFTAMGKTIEYKIGTMIEIPRAALVADEIAEQAEFFSFGTNDLTQMTFGYSRDDVGKFLPIYLSQGILQHDPFEVLDQRGVGELVKFATERGRKTRPNLKVGICGEHGGEPQSVAFFAKAGLDYVSCSPFRVPIARLAAAQVLI

SEQ ID NO: 9940 - DNA, 814 bp, Panicum virgatum
  misc_feature: Ceres CLONE 1720038
  misc_feature: Encodes the peptide sequence at SEQ ID NO. 9941
atgttttccggccccatcttcctcgcgcggcgcctgccccccctgccggttagaagcgtgcgaagaagcagcgcggagagatggcccgtaccaagcaaaccgctcgcaagtccacgggagggaaggctcccaggaagcagcttgcaactaaggctgcccgcaagtcagccccgaccactggaggagtgaagaagccccaccgctaccgccctgggactgttgccctccgtgagatccgcaagtaccagaagagcactgagctgttgatcaggaagctgcccttccagaggcttgttagggaaattgcacaggacttcaagactgatctgcgtttccagagccatgctgtgcttgccctccaggaggctgccgaggcgtaccttgttggtctgtttgaggacaccaacctgtgcgccatccatgctaagcgtgtgaccatcatgcccaaggacattcagctggccaggaggatccgaggcgagagggcttaatcatgatcatgacaatcaaaatctcgtgtcgtagtagtggtttaatgtggtgccatgttcggacatcagtagggcttgttttgtggatcataagtttctcttctgcagcactatgtgttgcgactaccgttgttggtgttattactagggtcgtcgaatacttaaattgtctcgtctagtgttgttaccgcgttgacagtttgacatttgtgtgctttgttgctgctgactagcagtgctgtttgtgcgctgctggattgtaagcttcattgctgttgctgatccgttcgttaatgtcaagtttcgtgtaatagttcgtgtac

SEQ ID NO: 9941 - protein, 136 aa, Panicum virgatum; identical to SEQ ID NO: 9871
  misc_feature: Ceres CLONE 1720038
  misc_feature (58)..(132): Pfam Name: Histone Pfam Description: Core histone H2A/H2B/H3/H4

SEQ ID NO: 9942 - DNA, 951 bp, Panicum virgatum
  misc_feature: Ceres CLONE 1720056
  misc_feature: Encodes the peptide sequence at SEQ ID NO. 9943
acaaacaccgcgacgcaccactagaatgcagccatgatcgcctcctcgctgtcgcggctccccctccgctgcttctccctccaccccaccgccaccgccggcgccgcctaccgctcccctccgaccaccacggtccccttcccaagaatcgctcttggctgccaccgccgccgcctggccgcctccgcgaccgagagcagcagcagcgaggaagaagcggctgggagcaccaacgggtccctcccgggccttccccccgtggaggacgacgacgacgagttctgcccggtggactgtgtgacggagttcaagacggacgaggagttccggcggcacctggatcggtccagggccacgggcgcgctggtggtggtggacttctaccggccgtcgtgcggcagctgcaagtacatcgagaagcgcttcatgcgcctctgcaagggctccggcgacgacggcgcccccgtcgtcttcctcaagcacaacgtgatcgacgagtacgacgagctgtcggaggtggcggaacggctgcggatcaaggtcgtgccgctgttccacttctacaaggacggcgagctggtggagtcgttcgcgacgagggacaaggagaggatcatcgccgccatcgggaagtacacctcgcctgagcctgagacgaccgaagaagagccgcaggagtgaatattccactggaacatcgtttttttttttgaagaaatattccactggaacatcaatttgagggtgcggatacttaggggcataaaccaggattctttggttttcctatgcctgtccacgcatttgggagatttcagctattggtatatgatgggtctggatcaatgtaccatcatctgtaatacgaggcatgtataatatctgaattaagcattactgctgctacactaccgtagtgtagacattcaatggaatctgacgcactctgcg

SEQ ID NO: 9943 - protein, 215 aa, Panicum virgatum
  misc_feature: Ceres CLONE 1720056
  misc_feature (89)..(201): Pfam Name: Thioredoxin Pfam Description: Thioredoxin
  misc_feature: SWISSPROT Homolog: EC 5.3.4.1 Protein disulfide-isomerase
MIASSLSRLPLRCFSLHPTATAGAAYRSPPTTTVPFPRIALGCHRRRLAASATESSSSEEEAAGSTNGSLPGLPPVEDDDDEFCPVDCVTEFKTDEEFRRHLDRSRATGALVVVDFYRPSCGSCKYIEKRFMRLCKGSGDDGAPVVFLKHNVIDEYDELSEVAERLRIKVVPLFHFYKDGELVESFATRDKERIIAAIGKYTSPEPETTEEEPQE

SEQ ID NO: 9944 - DNA, 1071 bp, Panicum virgatum
  misc_feature: Ceres CLONE 1720059
  misc_feature: Encodes the peptide sequence at SEQ ID NO. 9945
ggcttattccgtccccgcctccgcggtgtctggtttccttctcccttctccccctctccgccgacaccagagctcgtttctcctcatggtcggtaacctcgccggctgcgacgctagccatcaaaccaggatccttcgacacgaagcttcgctattcgcaccctgctcttccccgccctttactgctggtattctgtggggtggaggtccgaccgcgatcggatcgattgtttgggcggtggggttcaacggattgaacccccatggccgacgtcgagtccgctcctggcgcgggcgcgaaggctccgccttacaaggaaaccgaccggttcctactcgagttggagttcgtgcagtgcctcgctaaccctacctacattcactatctagcacagaatagatattttgaggatgaggcattcatcggataccttaagtacctaaaatattggcagcgcccggagtatatcaagtacataatttatccacactgccttttctttcttgagctcctccaaaacgccaatttccgtaatgccatggcacatccagcaaacaaggagcttgctcacaggcagcaatatttcttctggaaaaactacaggaataatagactgaagcacatcctaccacgccctccacccgagccagctctggcgcttgcaccttcacaaggacctgcaacgatgcccctaccaccatcagtaccgacacctgtggccccacctgttcctgcaccggcatcatctatgccacctgtggcagcaggtggtgcatctgcaatgtctcctatgcagtttgtaggaactccaggcaccaatatgccgaagactgacatgagaaatgctatgggcaacagaaagaggaagatgggctagttgaacatgttgggcagttcaatagtcgacaaatgggatgcaagccagaagtcgctgcctatggagccttttcaatgttcggtaggccttgtagttgagaagtcatgtttgatactgctctgtgggagctgcagatgtaactttagatgtcaatatgctcctgaatgactaatcatttgtgttggcgttgttc

SEQ ID NO: 9945 - protein, 204 aa, Panicum virgatum
  misc_feature: Ceres CLONE 1720059
  misc_feature (18)..(120): Pfam Name: SOH1 Pfam Description: SOH1
MADVESAPGAGAKAPPYKETDRFLLELEFVQCLANPTYIHYLAQNRYFEDEAFIGYLKYLKYWQRPEYIKYIIYPHCLFFLELLQNANFRNAMAHPANKELAHRQQYFFWKNYRNNRLKHILPRPPPEPALALAPSQGPATMPLPPSVPTPVAPPVPAPASSMPPVAAGGASAMSPMQFVGTPGTNMPKTDMRNAMGNRKRKMG

SEQ ID NO: 9946 - DNA, 343 bp, Panicum virgatum
  misc_feature: Ceres CLONE 1720080-R
  misc_feature: Encodes the peptide sequence at SEQ ID NO. 9947
gcctctggtgttcttctggctggtgcttttcatcttgctgtcacggggcttgctgttccatatcccgggcaagtgcaggatcatagagttgggcaacttccacaccagcgctctctccatcgtcgtccactccatcgtattcttgtgctgtcatcgccatcgttcatgatcgccataggcgtgcacatgtacctcgggtcgtagtgggtagctttttttagcaggaggcatacctgctttccgatggtgttagtggatcagcttgcagatcgattgtgttcttgtttgctagttgcccatctataattaaggggttattttttgtatacacatgtatagaata

SEQ ID NO: 9947 - protein, 55 aa, Panicum virgatum
  misc_feature: Ceres CLONE 1720080-R
  misc_feature: Functional homolog of the protein sequence given in SEQ ID NO 50117
  misc_feature: Useful for making plants with altered cell wall content and/or composition
PLVFFWLVLFILLSRGLLFHIPGKCRIIELGNFHTSALSIVVHSIVFLCCHRHRS

SEQ ID NO: 9948 - DNA, 413 bp, Panicum virgatum
  misc_feature: Ceres CLONE 1720080
gagatgagttggacacaccaacgacttgacagggaaaaggttgacgtataaccagttagagcactggctggacgatccctcttcgaggtctggtctattcacgattacgccagaacaaaacaacatacgggagaatatgcaagactgggcgccggtgttcatctccctggtgctcttcatcctgctgccgccggggctgctgttccacatcccctgacagtgccagatcatcgagtcctagcacttccacacctccgctctctccatcctcttccactccatcctcttcgtctttctcatcaccatcttcctcatcggcttcctcgtgcgcatgtacctcgggtcctaccgggcctctttctctaaccactatgcctacctggatggctatggtgttgggccatcagcttgat

SEQ ID NO: 9949 - DNA, 558 bp, Panicum virgatum
  misc_feature: Ceres CLONE 1720088
  misc_feature: Encodes the peptide sequence at SEQ ID NO. 9950
tcagctcatcagcggctaaagaccatctgacacagaaggttctctgaacattcagccaggaaagcaggggaagcaaccatgatcagcgccaagagacttgtccaaatggcgaagaagtggcagagaatggccgctctggcgaagtagcggctcacgtcgacgccaacggaagaagccgaaggatcatgcggcacctcatactccatggccagcaagggccactgcgtcgtgtactcggccgacggccggcgattccaggtccccctggcgtacctcggcacggtggtcttcggcgagcttctgatgctgtcgcaagaagagtttgggttcgcgagcgacgacggcaagatcacgctgccctgcgacgccgcggtggtggagtacgtggtgtccttgctcaggcgagatgcctcggaagaggttctgagggtgttcttgagttccatggtcaggccatgccacattgtcaacagcgtggcgccatgcagtcagcagctagcctattagattctggtgtacgtaattttgtacagttgttgaatcataggaaatggtatg

SEQ ID NO: 9950 - protein, 100 aa, Panicum virgatum
  misc_feature: Ceres CLONE 1720088
  misc_feature (1)..(66): Pfam Name: Auxin_inducible Pfam Description: Auxin responsive protein
MASKGHCVVYSADGRRFQVPLAYLGTVVFGELLMLSQEEFGFASDDGKITLPCDAAVVEYVVSLLRRDASEEVLRVFLSSMVRPCHIVNSVAPCSQQLAY

SEQ ID NO: 9951 - DNA, 1075 bp, Panicum virgatum
  misc_feature: Ceres CLONE 1720102
  misc_feature: Encodes the peptide sequence at SEQ ID NO. 9952
acggccttctgcttaggaaacagacgctctatccactgagctacaggcgccctctcggttaattgttgtcacaattccttgataacctaatatattctcccctattgcttcctctgctgacttttttttttttttgaaaatagttcctctgctgactagcactcgcgatctgatcgttacccttccagccacctccgccgcctcctcgtcgccggccatgattcacgcggtgatggtgataagcacccaggccaagccccgcctcctcaagttctacagtttccagccaccggagaagcatcaggagctcgtccgcagtgtcttccaattactctctgcaaggcctgacggcgtgagcaatttcgttgaggtggactcgatctttggcccgggaacaaaaatggtctacaagcatttggccaccctatactttgtttttgtctttgatagctctgagaatgaactcgccatgcttgatctcatacaagtttttgttgaaacattggatagatgcttcaagaatgtatgtgagcttgatattgtatttaacttcaacaagctgcacacaattttggatgagatgatactggggggacaggtgattgaaacaagctcggagcaaataatgaaatctgtggaagagattgcaagactggagaaacaatcaagcacaaccagcctcatacccaagtcgatttcagagcgtttcagtcgttaaggtttcactcgcttccacgactgaacattcatggtgtgatctgaaccacagaagacaagattggcccttgagcttaccttcagttctctaaagatttgaatccactggacacagtcacttgttattggttaatatgcgtctcactgtatcgcgcccgagctgtatggtttgaagcctgtgacctgaatgtagtccagtactgtttgcttggactgattgtctgaatgtgcttgctgaggttcagacattatgcatctgtagcaatatagagggatagctggtttctcattcgcctcttgatctcagctgtatgaacttagatcgatgtgaaattttttgggccagacgttggcattc

SEQ ID NO: 9952 - protein, 166 aa, Panicum virgatum
  misc_feature: Ceres CLONE 1720102
  misc_feature (1)..(147): Pfam Name: Clat_adaptor_s Pfam Description: Clathrin adaptor complex small chain
MIHAVMVISTQAKPRLLKFYSFQPPEKHQELVRSVFQLLSARPDGVSNFVEVDSIFGPGTKMVYKHLATLYFVFVFDSSENELAMLDLIQVFVETLDRCFKNVCELDIVFNFNKLHTILDEMILGGQVIETSSEQIMKSVEEIARLEKQSSTTSLIPKSISERFSR

SEQ ID NO: 9953 - DNA, 711 bp, Panicum virgatum
  misc_feature: Ceres CLONE 1720119
  misc_feature: Encodes the peptide sequence at SEQ ID NO. 9954
acggaacgcaatcttgcaatccagcccccgaaagtaaccttaaatcgcccccaggttctcgatcgcaccgaggaaggaggaggaatggcggccgaggtgatcgcgtgccacaccaaggaggagttcaagacccagatggacaaggccaaggaggccggcaagctggtgatcattgacttcactgcctcctggtgtggtccttgccgcatcatcgcccctgtgtttgctgaattagccaagaagttcactgatgctttcttcctgaaggttgatgttgacgagctgaaggacattgccgcggagtacaatgtcgaagcgatgccaaccttcctcttcatcaagaatggtgaaaagatccacactgttgtcggtgccagtaaggaggagctccagaccggcatcgagaagcatgccgcacccactgctgcttccgcgtccgcctaaggcgatagcgtgtcacctgtcatcaataagggccagcccatggcgtggtagcagtaggcgtcgcaactttcagtttggtttgggtgaattgtgagctatgtccaactctggaggccggatatgtttggttcccgtgctggatctgttatcatcctgaatgcctgtgttgatatggatgctttgtgactgaagtttgaatccggattgtctgactttaacttctgttttgagcttcgaatatggctgaatgaaccacacgatgttggc

SEQ ID NO: 9954 - protein, 119 aa, Panicum virgatum
  misc_feature: Ceres CLONE 1720119
  misc_feature (5)..(109): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
  misc_feature: Functional homolog of the protein sequence given in SEQ ID NO 50138
  misc_feature: Useful for making plants with modulated nitrogen use efficiency
MAAEVIACHTKEEFKTQMDKAKEAGKLVIIDFTASWCGPCRIIAPVFAELAKKFTDAFFLKVDVDELKDIAAEYNVEAMPTFLFIKNGEKIHTVVGASKEELQTGIEKHAAPTAASASA

SEQ ID NO: 9955 - DNA, 753 bp, Panicum virgatum
  misc_feature: Ceres CLONE 1720120
  misc_feature: Encodes the peptide sequence at SEQ ID NO. 9956
agcggtggcgactgggcgagcggcggcgcacgtcttcgtccagccctttgccggcgacgagcatcctccagcagcacctggttttccgagcgagcgcaggagcggagatgcagaggctaggggatttcaggctgcctcccttcttcaactacccgccttacttcactttgcagcctgtgcgcgaaacgcgggaaaagcaagtccagttatggaaagatctgatacttgattactgtagaagtcacaagatacatacaatatccctggaagaagatttctccttgttctccaatccaaagatcgagagatctcttagccatgaagcgaaggaagtgttccttgcagctcttgttagtgaaggtcgtgcagagtggatggacaaaggtcacaagaaatgcctcattctttggctaagaatacaggattgggccaatttcatattaaattttgtaaaggataatggattggaagtaatgaccatcgaagaaatacgctctggaatcgatactcgtggaactgaacttgagggaatcgatcgtggtgttctcatgcgggctctgaggcaattggaacagaaaggcaaagcagctatcttcaaaggcacttcggccgatgacgaaggcgtgaagttttctgtgtaaatttctttgcgatcctcaaactggcaggcaaataaactgatcgatcagcagtgtctttgaacatgacctgaaaaatcacatcgttgtcaagtagcggtattttttttcctgc

SEQ ID NO: 9956 - protein, 177 aa, Panicum virgatum
  misc_feature: Ceres CLONE 1720120
  misc_feature (7)..(176): Pfam Name: ESCRT-II Pfam Description: ESCRT-II complex subunit
MQRLGDFRLPPFFNYPPYFTLQPVRETREKQVQLWKDLILDYCRSHKIHTISLEEDFSLFSNPKIERSLSHEAKEVFLAALVSEGRAEWMDKGHKKCLILWLRIQDWANFILNFVKDNGLEVMTIEEIRSGIDTRGTELEGIDRGVLMRALRQLEQKGKAAIFKGTSADDEGVKFSV

SEQ ID NO: 9957 - DNA, 791 bp, Panicum virgatum
  misc_feature: Ceres CLONE 1720126
  misc_feature: Encodes the peptide sequence at SEQ ID NO. 9958
atcatcgccgcatttccccaaccagaccaagccttcttcctccccgctcccacaaccccatcctcaccgtcaccggcgccctagccctccgcaaaccttaactgcgcgccgccatgaaggccaaggctggcaccgacacctcgttcaaggccaccggcgccaagcgcaagaaggccggcggtcccaagcgcgggctcacccccttcttcgcgtttctggctgagttcaggccgcagtacctggagaagcaccctgagctcaagggcgtaaaggaggtttccaaggcggctggggagaagtggcgctctatgtccgatgaggagaaggcgaagtatggcgggggcaagaaacagcaggaagacaaggcaagcaagcccgcaaacaagaaaaaggagagcaatagctccaagaaggccaagactgatggtggggagggagaggaagcggaaggttctgacaagtccaagtctgaggttgaggatgatgatgagcaggatggcaacgaggatgaagatgaggagtaaatattaggatggggaacagcagctatgcaatagggcgtttgcttcttttgtacctagcttcctatgccgctgttccttttgatgttatatgctgtaaggagaatttgtagacggaaggtgccctagggctatgacatgctggagtacccgtttaactattagcagggaaagagctggatactgttgccagcctcatccgcatgtgtaaacagttgttttgcttgttttatcgaccgattgggtgactacctgttggtttgccgttac

SEQ ID NO: 9958 - protein, 136 aa, Panicum virgatum
  misc_feature: Ceres CLONE 1720126
  misc_feature (24)..(91): Pfam Name: HMG_box Pfam Description: HMG (high mobility group) box
MKAKAGTDTSFKATGAKRKKAGGPKRGLTPFFAFLAEFRPQYLEKHPELKGVKEVSKAAGEKWRSMSDEEKAKYGGGKKQQEDKASKPANKKKESNSSKKAKTDGGEGEEAEGSDKSKSEVEDDDEQDGNEDEDEE

SEQ ID NO: 9959 - DNA, 698 bp, Panicum virgatum
  misc_feature: Ceres CLONE 1720130
  misc_feature: Encodes the peptide sequence at SEQ ID NO. 9960
tatccgcaggaccgttgcttccccgctggtgcggtggccgatctagatcgccccccgtagatctccgttcaccgccccaacgtctctccctctcccgtggcttcattccgggcggcgccgccctctccgtcgggtccttcgccggcgaatagcacccaccaggatccagagcgtatacaggaggtatgccagcctgtatttctgcatgtgcattgatgctgatgaccatgagctcgaagtcctcgagatcatccatcatttcgtccagatactggaccgctatttcggcagcgtatgtgaactggatttgatattcaattttcacaaggcctactacatactggatgagattcttatcgctggcgagcttcaagaatctagcaagaaaaatgttgcaagacttattgctgcacaggattcattagtcgaggctgcgaaagaggaagccagctccataagtaacatcattgctcaagctacaaaataaaattctacaccactctaatgccggcccctttactctatcctgtcgtttttgtacaagtaaatgtaatgcactggactgttctgtccatttgctctgtttgtttttttctaaggaatacatctctcaagactccatatcatttagaatgagcgtgatgtgtgactacattgtatgtgttcctttgcaagtaaaattggcatgttcctgacag

SEQ ID NO: 9960 - protein, 93 aa, Panicum virgatum
  misc_feature: Ceres CLONE 1720130
  misc_feature (1)..(74): Pfam Name: Clat_adaptor_s Pfam Description: Clathrin adaptor complex small chain
MCIDADDHELEVLEIIHHFVQILDRYFGSVCELDLIFNFHKAYYILDEILIAGELQESSKKNVARLIAAQDSLVEAAKEEASSISNIIAQATK

SEQ ID NO: 9961 - DNA, 562 bp, Panicum virgatum
  misc_feature: Ceres CLONE 1720151
  misc_feature: Encodes the peptide sequence at SEQ ID NO. 9962
cctcctgcgaccgttccgagccgccgatacaggcgggcgcctcgcttcctctcccctcgtccagatgacgaagcgcaccaagaacgccggaattgctgccacctatggcactctggatggtgctagtttacgtaagctaatcggggggatggatgtctctctcccctccaagtacttctgtgagttctgggggacgtttgctgcgaagacgacagcatttctaatatcgggatgcaagtgactgtgcktaaggtcaaggctggtgcgtgcttatgccatgaactatgctagtgccgtctcaatcagaagcgcagaccattgtttgagggagcgcactgaagcgtaattgtggttcttttcatccagaatcccggggtactctatttggactataagctattggatcgccaacatgtttcagttttttttgtgtatgctttaggatcatctaaaggtgtggtgataagatttttacttgatttccatgagttatgactctgccaagtgatatgatgtccaattttcgttctggttttatacctcaccagtcattttagatgcc

SEQ ID NO: 9962 - protein, 58 aa, Panicum virgatum
  misc_feature: Ceres CLONE 1720151
  misc_feature: Functional homolog of the protein sequence given in SEQ ID NO 50139
  misc_feature: Useful for making plants with modulated cold sensitivity
MTKRTKNAGIAATYGTLDGASLRKLIGGMDVSLPSKYFCEFWGTFAAKTTAFLISGCK

SEQ ID NO: 9963 - DNA, 522 bp, Panicum virgatum
  misc_feature: Ceres CLONE 1720188-R
  misc_feature: Encodes the peptide sequence at SEQ ID NO. 9964
gagcaagaaaagacagagtcaacttctacacgctcaacgtcgacaagttcaaagatttggcggaggaagctggcgtggaggcgctaccgatgtacgttctactgaagaatgacgatgtgatcgacatggtcgttggcgtcaggaggcacgagctcgagaacgccataaaaaacaatatctaacgactgatccgatcagatcatccatgagtcgagaacgaacgggaaatgaatgattcatagttaaataagcccactactgtacgtcccatgtgttgtatcacggatactgaaactcgtgtgtgcatgtacacatcctagctagctcagccgccgtagatccccatgttatacattgtacgtatggatctcgattatcgattgtcccatgtttgatttcctaaacttctgtggaagtagatccccatgttatgtatactctggtttgaaacagtttgcaataaatcaatgtctggctagtatatttcttatttttgtttaatagaaataatattggtttgac

SEQ ID NO: 9964 - protein, 59 aa, Panicum virgatum
  misc_feature: Ceres CLONE 1720188-R
  misc_feature: SWISSPROT Homolog: EC 1.8.1.8 Protein-disulfide reductase
ARKDRVNFYTLNVDKFKDLAEEAGVEALPMYVLLKNDDVIDMVVGVRRHELENAIKNNI

SEQ ID NO: 9965 - DNA, 195 bp, Panicum virgatum
  misc_feature: Ceres CLONE 1720188
acacaggagcccgcggagtgattgaaaaagctagtaacatgagaagatgaccgacgttgtgatgaccgtccgtactaccgcggatttggacagcgaacttaataaatacgacctgctgattgactgggacttcatgcagccctggagtgatccatgcaaggtaatgaaggagccttatacgcaaatcggcagagc

SEQ ID NO: 9966 - DNA, 643 bp, Panicum virgatum
  misc_feature: Ceres CLONE 1720201
  misc_feature: Encodes the peptide sequence at SEQ ID NO. 9967
ctatacaattgccagtacaagtcgttttttgttgcattctctggcttgacagagcagatcaagttagaccgttatcttcagcctcatttccgctactacatgcgggaagtgcgtactgttgtctactcacaattcttggagtcgtacaagagtgtaacaatggaagcaatggctgctgcttttggtgtgactgttgatttcattgaccaggaactgtcacggttcattgcagctgggaagcttcactgcaagattgataaggttgctggtgttcttgagacgaaccggccagatgagaggaacgctttctaccaggcgaccatcaagcaaggggacttcttgctgaaccgcatacagaagctttcacgagtcattgacctgtaagagttgctgtttctgttggagctccttcagtgccctgccaatgtttcctgcactggaagggtgagctcaacttatccacctcgactttcataagacatgagcattgctcttcttgtgtgaggaacaaattgctaagagaacttgtgtgttaatcgtgaattcactacatgtatcccatggctttataggaggaaggtgcagctcaatcccatggacgttacttttgtggtgaaccttggtttttcttttcacgtctcag

SEQ ID NO: 9967 - protein, 127 aa, Panicum virgatum
  misc_feature: Ceres CLONE 1720201
  misc_feature (1)..(96): Pfam Name: PCI Pfam Description: PCI domain
LYNCQYKSFFVAFSGLTEQIKLDRYLQPHFRYYMREVRTVVYSQFLESYKSVTMEAMAAAFGVTVDFIDQELSRFIAAGKLHCKIDKVAGVLETNRPDERNAFYQATIKQGDFLLNRIQKLSRVIDL

SEQ ID NO: 9968 - DNA, 511 bp, Panicum virgatum
  misc_feature: Ceres CLONE 1720215
  misc_feature: Encodes the peptide sequence at SEQ ID NO. 9969
aaaccataagcgccccttgtttccccgacccgatctccatttccaagagcaagaacccgaggaagcagccatggcggtgtcgatcgagctcaccaaggagtacgggtacgtcgtgctggtgctggtggcctacgccttcctcaacttctggatgggcttccaggtcggcaaggcccgcagaaagtacaaggtgttctaccccaccatgtacgccgtcgagtcggagaacaaggacgccaagctcttcaactgcgtgcagagggggcatcaaaactcgctggagatgatgcccatgttcttcgtcatgctgctgctcggcggtctgcagcacccgaccatcgccgccggactgggcgccttctacacggtcgcgaggttcttctacttcaagggatacgccaccggcgtcccggacaaccgtctcaagattggggggttcaacttcctcgctgtgtttgggctgatcatctgcacggcatctttcggcatcaacctggtcatcagggagacg

SEQ ID NO: 9969 - protein, 146 aa, Panicum virgatum
  misc_feature: Ceres CLONE 1720215
  misc_feature (9)..(140): Pfam Name: MAPEG Pfam Description: MAPEG family
  misc_feature: SWISSPROT Homolog: EC 2.5.1.18 Glutathione transferase
MAVSIELTKEYGYVVLVLVAYAFLNFWMGFQVGKARRKYKVFYPTMYAVESENKDAKLFNCVQRGHQNSLEMMPMFFVMLLLGGLQHPTIAAGLGAFYTVARFFYFKGYATGVPDNRLKIGGFNFLAVFGLIICTASFGINLVIRE

SEQ ID NO: 9970 - DNA, 362 bp, Panicum virgatum
  misc_feature: Ceres CLONE 1720215-R
acgctctgaagttcaggcttacacgtgatctgcagactgtattaacgggacaaattacttcttgtggcctgggtagtgaaactttgtgaggcagtcatctaggtttgtattagtcgtatactcgcatctttttttttcgtgttgataagcaaagtagcggatgtgtgcgtgtgcatgtgtttcacttttgttaatgccggaataagagatggaggagatggcttgaagcatgaaccttacagttcgtgctgcttgttagttgttactctgttttcgctgtaaaggattgtcgatggattgtgcctcattgtttgctgtaattttttatggaggtaaaatcggctggtaacagctctgctttt

SEQ ID NO: 9971 - DNA, 1085 bp, Panicum virgatum
  misc_feature: Ceres CLONE 1720223
  misc_feature: Encodes the peptide sequence at SEQ ID NO. 9972
catcgcatcgattttctggttgtgtttgggagggccttcgggagatctaggccgcggcaacccatctccggcgccatggggttcctcgaggacttccaagccagtgttgaatcattgccatctatgctgcaccggaactattcattaatgcgagagttagataaaagtttgcaaggtgtgcaactagaaaatgaacagcgctgtcagcaagaaatagaggacattaagcatggacttgaatctggaagtatcacatatgacccagcaaaactgaaattttctgaagaagcaatcgaggagcagaaacattgtgttagaattgctgatgagaaggtggctttggccactcagacttatgacctggttgatgctcatatccaacagctagatcaatttttgaggaagcttgaaaaaattcgacaggaaaaggaggcagcagcagctgttgctgttactgctgctgctgctactccagctgcaagtgctggagcatcaactgctgatgctactccaaaaactggaagatctggcgaaagaggcagagggggtcgtaagaaggctaaggtacccactgagccaccagcaccggctattgatttagaattgcctgtggatcctaatgaaccgacatactgcttctgcaaccaagtcagctatggtgatatggtcgcatgcgacaatcctaattgcaagatcgagtggtatcacattggctgtgtgggggtgaaggagctgcccaagggaaagtggtattgtccaagttgcgttggattccagaagaagcgaaaaggcaaatgatactcaattctcatgctgctctgctagtgtgtaggccttggttgtggaacgttgctgatgttgggtaacaaatgttgttgctcttagttgtgacagtgcatgccgttgtagatcccagtgatctgtacatgttactcctatggtgtcgaggagtgccctagacctgctagagttaggaccatgcaatgtaggcggtgtgtaacttcattgccttttggcgatcggatataactcttgccccttgcagtgtacgtgtttcaactttcaatcattgtacagaactcttc

SEQ ID NO: 9972 - protein, 240 aa, Panicum virgatum
  misc_feature: Ceres CLONE 1720223
  misc_feature (186)..(233): Pfam Name: PHD Pfam Description: PHD-finger
MGFLEDFQASVESLPSMLHRNYSLMRELDKSLQGVQLENEQRCQQEIEDIKHGLESGSITYDPAKLKFSEEAIEEQKHCVRIADEKVALATQTYDLVDAHIQQLDQFLRKLEKIRQEKEAAAAVAVTAAAATPAASAGASTADATPKTGRSGERGRGGRKKAKVPTEPPAPAIDLELPVDPNEPTYCFCNQVSYGDMVACDNPNCKIEWYHIGCVGVKELPKGKWYCPSCVGFQKKRKGK

SEQ ID NO: 9973 - DNA, 563 bp, Panicum virgatum
  misc_feature: Ceres CLONE 1720279
  misc_feature: Encodes the peptide sequence at SEQ ID NO. 9974
cttcccaattctctccgcgcccccactcgtctctccgccgcccgccgtgtcggctgcggcgacccgaccagcgtcactcgccatgactacctcaaggcgtcttgctgataggaaaattgcacgatttgagaagaacatcacaaagaggggagctgttcctgagacaatcaagaaagcaaatgattatccttttggacctattctgcttgggttcttcgtcttcgttgttgttggatcatctctctttcagatcatcaggactgcctcaaatgctggtctattctgagcatggttctttacttaacttacagattatatcggtaaagtggaggaacatggttgatatatgcagtttgtcacatagaaaacaaaagtgcgtggcgtagctggtactctatgatgctaccctataatatattgtagtagtatggtgaagtggagaagtttaaattatatggtgacaatatatgtgtaacataggggtaactgggtaacccaagtcactcgggcgctaggaaagatgattccgtaatacatgytgagaagttrkagctcgtgttagt

SEQ ID NO: 9974 - protein, 67 aa, Panicum virgatum
  misc_feature: Ceres CLONE 1720279
  misc_feature (1)..(63): Pfam Name: RAMP4 Pfam Description: Ribosome associated membrane protein RAMP4
  misc_feature: Functional homolog of the protein sequence given in SEQ ID NO 50140
  misc_feature: Useful for making plants with modulated nitrogen use efficiency
MTTSRRLADRKIARFEKNITKRGAVPETIKKANDYPFGPILLGFFVFVVVGSSLFQIIRTASNAGLF

SEQ ID NO: 9975 - DNA, 148 bp, Panicum virgatum
  misc_feature: Ceres CLONE 1720349
  misc_feature: Encodes the peptide sequence at SEQ ID NO. 9976
ccacgaccaacactggtgccgtacccatggatccacttcttgctttcgtccgatgcaccaaccatagcggctgagaacgcccatcacgagaggctgtctgtatgctgagatcaccaacagcgccttcgagccttcctccgtgatggcc

SEQ ID NO: 9976 - protein, 35 aa, Panicum virgatum
  misc_feature: Ceres CLONE 1720349
  misc_feature: Functional homolog of the protein sequence given in SEQ ID NO 50141
  misc_feature: Useful for making plants with altered cell wall content and/or composition
PRPTLVPYPWIHFLLSSDAPTIAAENAHHERLSVC

SEQ ID NO: 9977 - DNA, 759 bp, Panicum virgatum
  misc_feature: Ceres CLONE 1720360
  misc_feature: Encodes the peptide sequence at SEQ ID NO. 9978
acgcacctgcgcagctgctctgcaaccgtgacacagctagaagggtttcttcgggtcctttcgaggggcagggccgcagggggctttatccacggaacactttccggcggcgaccacttggtgcccggggaggcgatcgatccctcaccatgtcatcggagaaggaggcggcgctcgccgccgtgcccaacgacagccccaccatatttgacaagatcataaaaaaggaaataccatctactgtcatttatgaggatgagaaggtattggctttcagagacatcaaccctcaagctccaacacacatcctaatcattcccaaagtcaaggatggattaactggcctttcgaaggcagaagagaggcacgttgagatacttggccatctcctctatgttgccaaagtaattgcgaagcaggaaggacttgaagatggctaccgtgttgtcatcaatgatggccccagtggatgccaatctgtttaccacatccacgttcatctccttggaggcaggcagatgaactggcccccaggctaagaatctcggttgatctgtctccatggcgatgattgatgctgcatctctatcgaataattcctgtaattcccacaaaatttagcgtgttgaccttgtgctgtatttgtggaattactggaaccaccctgctgtgatttatggacgagaaacttgcacttggaagttggaatcatggaatgacatgtcctcgttgatccgctcatcaaattgtctttgcccc

SEQ ID NO: 9978 - protein, 129 aa, Panicum virgatum
  misc_feature: Ceres CLONE 1720360
  misc_feature (25)..(124): Pfam Name: HIT Pfam Description: HIT domain
  misc_feature: SWISSPROT Homolog: EC 3.6.1.17 Bis(5'-nucleosyl)-tetraphosphatase (asymmetrical)
MSSEKEAALAAVPNDSPTIFDKIIKKEIPSTVIYEDEKVLAFRDINPQAPTHILIIPKVKDGLTGLSKAEERHVEILGHLLYVAKVIAKQEGLEDGYRVVINDGPSGCQSVYHIHVHLLGGRQMNWPPG

SEQ ID NO: 9979 - DNA, 779 bp, Panicum virgatum
  misc_feature: Ceres CLONE 1720413
  misc_feature: Encodes the peptide sequence at SEQ ID NO. 9980
acaaacagaagaagagaagaggtgaggaaaggcgaagcttctcctcgcaacgatggcgatgaccgtcgaagtgctggctgggctcgcttttatgttctcgacgagcattctgctgcaaatactggcatgtgctttgtacaacaactggtggcccatgttagcagctctcatgtatgtccttgtaccgatgccatgcctgttttttggtggtggatccacacactttttgacaagcagagaaggtggagggtggattaatgctgcaaaattcctgactggtgcatctgccatgggaagcctcgcgatcccagctattctgaggcacgcaggcctaattgagactggtgccatgttcatcgagttcacgtccttcttcatccttgtatgcacggtgctgtgcttccatagggctaccctagatgaagattggtaaatgtgcatgcacggacccctgaagaatagcaattctgtggccgcttctctccatgctaagcagaagaatttctgttggaagttaacaattagcatggatatgtacaaagaagtgtatttgaaacccctggctgatgtttcatataggcactctttaagatctgtggtgacgtggcaaggcagatgttatttcgatcacttgacattgcagtcgcatgtttctgtgaaggaacccaatctgtgcaaaacatgagcaagagcctgtacacggtacaccattcttctttgctggccgctacattgccttaacatgttattcagtgaagtgatggaaacttgatgctgac

SEQ ID NO: 9980 - protein, 126 aa, Panicum virgatum
  misc_feature: Ceres CLONE 1720413
  misc_feature (8)..(124): Pfam Name: Vps55 Pfam Description: Vacuolar protein sorting 55
MAMTVEVLAGLAFMFSTSILLQILACALYNNWWPMLAALMYVLVPMPCLFFGGGSTHFLTSREGGGWINAAKFLTGASAMGSLAIPAILRHAGLIETGAMFIEFTSFFILVCTVLCFHRATLDEDW

SEQ ID NO: 9981 - DNA, 789 bp, Panicum virgatum
  misc_feature: Ceres CLONE 1720452
  misc_feature: Encodes the peptide sequence at SEQ ID NO. 9982
gccgcctctaatcgcccgttcttaatctcagtttggggaaaaaagcctcgcgggtcgcaaaccactctccgctgatttgggaggcgctcgagaccttagtgacacatggctcgtactaagcagaccgctcgcaagtccactggaggaaaggctcctaggaagcaactagccaccaaggctgcccgtaagtctgcgcccacaactgggggagtgaagaagcctcaccgttaccgccctggaactgttgctcttcgtgaaatccgcaagtaccagaagagcactgacctgctcattaggaagcttccattccagaggcttgttagggagattgcccaggatttcaagactgatctgcgtttccagagccatgcggtgcttgccctgcaggaggctgcggaagcatacctggtgggtctgttcgaggacaccaacctgtgtgccatccacgccaagcgcgtgacgatcatgcccaaggacattcagctggctaggaggattcgcggcgagagggcttagtttcactgctctggtgtgcatctgtttgatgcagctgcctttgcgatgttggtgctttaacttctgtcagtgttttgaactctgaatagttatagtgttcgttcgtggtgctaggttaggtgctgctgcaatcttattatgttttagagtttaatcgcttggtaccgaatacatcttgtaagtgctggtttcatccatccacctgatgggtgtggtttctatctgaattctgaaccttgaactggtatgttaagcaagttgttaacttggttc

SEQ ID NO: 9982 - protein, 136 aa, Panicum virgatum; identical to SEQ ID NO: 9774
  misc_feature: Ceres CLONE 1720452
  misc_feature (58)..(132): Pfam Name: Histone Pfam Description: Core histone H2A/H2B/H3/H4

SEQ ID NO: 9983 - DNA, 837 bp, Panicum virgatum
  misc_feature: Ceres CLONE 1720453
  misc_feature: Encodes the peptide sequence at SEQ ID NO. 9984
ccaagcgaaataatttagcagctcaacaagaggtttggaaatggcgaacaagtttgtagttcttcttggtgttgtcctggcctttctcctcgtctgccaggatttggcatgtgctagagggctcactgaaaccaatgagtctgaaggaaaagatgtgaagcctgctggaggagtgcctggactcaaggatgaaaagttgggaggtggttacaatggaggatatggcaatggcggcagttatggtggtgggtacggtggtggctatgggcctagatatggtggaggataccaccatggccacggaggaggctataggcccggatatggtggaggatatggatctggayayggtggtggstatggtggccctggatacggtggcgggtatggtcagcctgggtatggcggaggatatggcggtggctatggtggtggctatggaggaggatatggtagtggcagcgggtatggtggaggtgggggctatggaggcggatatggaggaggtggacaccatggtggatggaattaagtggtagagctatgctatgtttctctatgtcaaataattaagaaacacatcgtgatgatagatttgaatgttgcatggcactttggtgatacaaatcatgtctacgtatggtataaaacatggtgatggatgtactgttgtgtacattagatggatttaatcctgtcttgcatgaagtgtggtaataagagctaggcagctagccatgtatggcagtgtgcactagctggcttttagaactggtacctcatcatgtctggacctatgtatacatataaataaatgactatcctttaaagttgtgc

SEQ ID NO: 9984 - protein, 163 aa, Panicum virgatum
  misc_feature: Ceres CLONE 1720453
  misc_feature (1)..(157): Pfam Name: GRP Pfam Description: Glycine rich protein family
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: Functional homolog of the protein sequence given in SEQ ID NO 50142
  misc_feature: Useful for making plants with altered lignin content
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: Functional homolog of the protein sequence given in SEQ ID NO 50143
  misc_feature: Useful for making plants with altered alkaloid content
  misc_feature: Functional homolog of the protein sequence given in SEQ ID NO 50144
  misc_feature: Useful for making plants with altered terpenoid content
  misc_feature (103)..(103): Xaa is any aa, unknown, or other
MANKFVVLLGVVLAFLLVCQDLACARGLTETNESEGKDVKPAGGVPGLKDEKLGGGYNGGYGNGGSYGGGYGGGYGPRYGGGYHHGHGGGYRPGYGGGYGSGXGGGYGGPGYGGGYGQPGYGGGYGGGYGGGYGGGYGSGSGYGGGGGYGGGYGGGGHHGGWN

SEQ ID NO: 9985 - DNA, 446 bp, Panicum virgatum
  misc_feature: Ceres CLONE 1720461
  misc_feature: Encodes the peptide sequence at SEQ ID NO. 9986
agggttttcgcgctgccgtcgccgcttcttcgtctccaccggaacgatgccgtcgcacaagaccttccagattaagaagaagctggcgaagaagatgcgccagaaccgccccatcccctactggatccgcatgcgcaccgacaacaccatcaggtacaacgcgaagcgcaggcattggcgccgcaccaagctcggcttctgagcgaggggatggacctgctgctgcgtcggaaggctggggtttaggtgttatcttccttatgttttatgggtgtttcagtgtttctgcaagctaggaagtgattccaggatgcttttattgaggctttggtgatgttaagaaaattggtagtactctgttgtactctggataccatgcattgccatgctaagtaaagtacccttgttgcccgatatatgtagtggtgcagttatttctgaggccg

SEQ ID NO: 9986 - protein, 51 aa, Panicum virgatum
  misc_feature: Ceres CLONE 1720461
  misc_feature (9)..(51): Pfam Name: Ribosomal_L39 Pfam Description: Ribosomal L39 protein
MPSHKTFQIKKKLAKKMRQNRPIPYWIRMRTDNTIRYNAKRRHWRRTKLGF

SEQ ID NO: 9987 - DNA, 694 bp, Panicum virgatum
  misc_feature: Ceres CLONE 1720464
  misc_feature: Encodes the peptide sequence at SEQ ID NO. 9988
tatctgtatactaatcacgggcctcagcaaaaaccatcgccgttgctacctctcacctcaccggccaccgcatcgcgagtcgcgactcgtacccaccccaacttctgctccccgcccccctcgccgcggcgatggcgtccgggaacagcggcaagcagaggagcgaggaggaatggcgcgccatcctctcccccgagcagttccgcatcctccgcctcaagggcaccgagttacccggcacaggagagtacaacaaatttaaagctgacggggtttataactgtgttggctgcggaacccccctgtacaagtcggacaccaaattcgagtcaggttgcggctggccagcgttctttgaggggcttccaggagccataaaccgaacaccggatcctgatggtcggagggtagagatcacgtgcgcagcgtgcggcgggcatctgggccatgtgttcaagggagaaggcttcaagacgcccacggatgagcgccactgcgtgaacagtgtctcaatcaagttcactcctgcctcctaaatcatcgtctctagattagcactcgcatgtctggaactggaagcactacagaacgttgaataagatctgtatccagcacatatgtgtgtgcgtgtcacctgttactttggctgtgagctgaatctgctgtcataataagttattactgcaagtgatcc

SEQ ID NO: 9988 - protein, 134 aa, Panicum virgatum
  misc_feature: Ceres CLONE 1720464
  misc_feature (12)..(133): Pfam Name: SelR Pfam Description: SelR domain
  misc_feature: SWISSPROT Homolog: EC 1.8.4.12 Peptide-methionine (R)-S-oxide reductase
  misc_feature: Functional homolog of the protein sequence given in SEQ ID NO 50145
  misc_feature: Useful for making plants with modulated heat sensitivity
MASGNSGKQRSEEEWRAILSPEQFRILRLKGTELPGTGEYNKFKADGVYNCVGCGTPLYKSDTKFESGCGWPAFFEGLPGAINRTPDPDGRRVEITCAACGGHLGHVFKGEGFKTPTDERHCVNSVSIKFTPAS

SEQ ID NO: 9989 - DNA, 1099 bp, Panicum virgatum
  misc_feature: Ceres CLONE 1720482
  misc_feature: Encodes the peptide sequence at SEQ ID NO. 9990
gttctgctccgacccatcactgccccaatcaactgatcgcccgcaaaacggagtagcagccgcagcaaggcaggctggcggcttggttcgccgaattcgaaggcgcagacactgagttcacaccatgacttctttggacactgtgagaggagatcttgctctcgtcattctgtacctaaacaaggctgaagcaagagataagatctgcagagctatacagtatggatcaaagtttctgagtaacggagaaccagggccggcgcagaatgtcgacaagtcaactagtctagctcggaaagttttcaggctttttaagtttgttaatgacctgcatgctctcattagtcctcctgccaaaggaactccacttccactgatcttactcggaaagtcgaagaatgcaatgctgtcaactttcctcttcctggatcagattgtgtgggctgggaggacaggaatatacaagaacaaggagcgagcggagttcctcagccggatagctttctattgctttctaggttctaatacctgcacaaccattattgagcttgctgagctcgaacggttgtacaattcgatgaagaagctagagaaggaactcaaaccccaagagttgtacaagaacgagcaataccagatgaagctgcagaagtccaaagagcggcgtctggctctgatcaagtcgagccttgacatagttgtggccgtggggctgctgcagctggccccgaagaaggtgaccccccgcgtcaccggggcgttcggcttcgccagctcactgatcgcttgctaccagttgcttccgagcccatccaagagcaagtgataccatctgtagctgagggcagctggtgcctccatcccctactgatggcatcgacgacaacaaataaatccagaagaaactctccgtgtagcatattgggcacgccagctggcgttaagcgcggtggtggtcgtgctgtttggtagatacttgtattgttgacttggttatagtcctttgtggctgattattgtacgatccaagttgtagcttgcggtgccggggcttgtcatcagttgtcacgaaataagaaatggcccgtttgaactgtgg

SEQ ID NO: 9990 - protein, 233 aa, Panicum virgatum
  misc_feature: Ceres CLONE 1720482
  misc_feature (11)..(226): Pfam Name: PEX11 Pfam Description: Peroxisomal biogenesis factor 11 (PEX11)
MTSLDTVRGDLALVILYLNKAEARDKICRAIQYGSKFLSNGEPGPAQNVDKSTSLARKVFRLFKFVNDLHALISPPAKGTPLPLILLGKSKNAMLSTFLFLDQIVWAGRTGIYKNKERAEFLSRIAFYCFLGSNTCTTIIELAELERLYNSMKKLEKELKPQELYKNEQYQMKLQKSKERRLALIKSSLDIVVAVGLLQLAPKKVTPRVTGAFGFASSLIACYQLLPSPSKSK

SEQ ID NO: 9991 - DNA, 779 bp, Panicum virgatum
  misc_feature: Ceres CLONE 1720493
  misc_feature: Encodes the peptide sequence at SEQ ID NO. 9992
cgcgcggacgctctccaccacccgagccttcccgctgtcgccgcctcgctccgcgcgaccgatctgccgccatgtcgctgatcgcgggtgaggacttccagcacatcctgcgtctgctgaacaccaacgtggatgggaagcagaagatcatgttcgcgatgacctccatcaagggtatcggccgccgcttctccaacatcgtctgcaagaaggccgacatcgacatgaacaagagggccggcgagctgacgcctgacgagctggagaggctgatgacggtggtggcgaaccccaggcagttcaaggtgccggactggttcctcaacaggaagaaggactacaaggacggcaggttctcgcaggtcgtctccaacgccctcgacatgaagctcagggacgacctcgagagactcaagaagatcaggaaccaccgtggtctgcgtcactactggggcctccgtgtccgtggccagcataccaagactactggcaggcgtggaaagaccgttggtgtctctaagaagcgataagctatatatctaccaatcttggccttattactgtgttggttcgtgtccaaacagtcttgatgaagcttttctgtttagacagttccctgaaatgatgttttgccctaggaaaatcatgcagttatggaaccttaatatattgtatcgtacaatgtgttttttgcaacctctaagagtaatttgattttgatgagacagttgtggattgactctttacattttattgttatctgagtgatcgttccctcc

SEQ ID NO: 9992 - protein, 152 aa, Panicum virgatum
  misc_feature: Ceres CLONE 1720493
  misc_feature (14)..(142): Pfam Name: Ribosomal_S13 Pfam Description: Ribosomal protein S13/S18
MSLIAGEDFQHILRLLNTNVDGKQKIMFAMTSIKGIGRRFSNIVCKKADIDMNKRAGELTPDELERLMTVVANPRQFKVPDWFLNRKKDYKDGRFSQVVSNALDMKLRDDLERLKKIRNHRGLRHYWGLRVRGQHTKTTGRRGKTVGVSKKR

SEQ ID NO: 9993 - DNA, 586 bp, Panicum virgatum
  misc_feature: Ceres CLONE 1720508-R
  misc_feature: Encodes the peptide sequence at SEQ ID NO. 9994
tgccgacctacgaggacaaggacggtgactggatgctcgtcggcgacgttccgtgggagatgttcgtcgaatcgtgcaagcgccttcggatcatgaagggatcagaagccattggcctggcgcccagggccatggagaaatgcaagaacagaaactgaacacatggggccgccagatgcaagaaccaagtctagctctgcagctctgctcgtctctgtatcatactcgtccctgttctccaagcctgtacctcctgatcagtgaagtcattttggtgtgtcaactgttctatcagttccagtgagtcagtcagccagccaggcgtcagtcagtcagtgttcaagtctcatcttgtcatatacaaaagagagaagccaggaacatgtacctgtcctgtcctataacaatgtctttttgctctacctgctctttttatttttgggcacaaaatgcaaaggcaccctgctcctaatcaaggggcccttttgcatcttgtccaccaaaagttgtttaattatattaccatggtgtgtcaatggaacaaataattgttgcaagctgttaaaaaaatgtattgtatgagcct

SEQ ID NO: 9994 - protein, 51 aa, Panicum virgatum
  misc_feature: Ceres CLONE 1720508-R
  misc_feature: The sequence is a functional homolog of SEQ ID NO 2006 in the 10/374,780 US patent application
  misc_feature: The sequence is a functional homolog of SEQ ID NO 288 in the 10/412,699 US patent application
  misc_feature: The sequence is a functional homolog of SEQ ID NO 664 in the 11/479,226 US patent application
  misc_feature: Functional homolog of the protein sequence given in SEQ ID NO 50146
  misc_feature: Useful for making plants with altered terpenoid content
  misc_feature: Functional homolog of the protein sequence given in SEQ ID NO 50147
  misc_feature: Useful for making plants with modulated nitrogen use efficiency
  misc_feature: The sequence is a functional homolog of SEQ ID NO 2004 in the 10/374,780 US patent application
  misc_feature: The sequence is a functional homolog of SEQ ID NO 660 in the 11/479,226 US patent application
  misc_feature: Functional homolog of the protein sequence given in SEQ ID NO 50148
  misc_feature: Useful for making plants with altered alkaloid content
  misc_feature: The sequence is a functional homolog of SEQ ID NO 2002 in the 10/374,780 US patent application
  misc_feature: The sequence is a functional homolog of SEQ ID NO 644 in the 11/479,226 US patent application
  misc_feature: The sequence is a functional homolog of SEQ ID NO 739 in the 10/374,780 US patent application
  misc_feature: The sequence is a functional homolog of SEQ ID NO 890 in the 10/412,699 US patent application
  misc_feature: The sequence is a functional homolog of SEQ ID NO 738 in the 10/374,780 US patent application
  misc_feature: The sequence is a functional homolog of SEQ ID NO 736 in the 10/374,780 US patent application
  misc_feature: The sequence is a functional homolog of SEQ ID NO 636 in the 11/479,226 US patent application
  misc_feature: The sequence is a functional homolog of SEQ ID NO 648 in the 11/479,226 US patent application
  misc_feature: The sequence is a functional homolog of SEQ ID NO 204 in the 10/225,066 US patent application
  misc_feature: The sequence is a functional homolog of SEQ ID NO 292 in the 10/412,699 US patent application
  misc_feature: The sequence is a functional homolog of SEQ ID NO 40 in the 10/225,068 US patent application
  misc_feature: The sequence is a functional homolog of SEQ ID NO 82 in the 10/374,780 US patent application
  misc_feature: The sequence is a functional homolog of SEQ ID NO 656 in the 11/479,226 US patent application
  misc_feature: The sequence is a functional homolog of SEQ ID NO 290 in the 10/412,699 US patent application
  misc_feature: The sequence is a functional homolog of SEQ ID NO 674 in the 11/479,226 US patent application
  misc_feature: The sequence is a functional homolog of SEQ ID NO 1780 in the 10/412,699 US patent application
  misc_feature: The sequence is a functional homolog of SEQ ID NO 2008 in the 10/374,780 US patent application
  misc_feature: The sequence is a functional homolog of SEQ ID NO 678 in the 11/479,226 US patent application
  misc_feature: The sequence is a functional homolog of SEQ ID NO 598 in the 10/666,642 US patent application
  misc_feature: The sequence is a functional homolog of SEQ ID NO 904 in the 11/435,388 US patent application
  misc_feature: The sequence is a functional homolog of SEQ ID NO 686 in the 11/479,226 US patent application
  misc_feature: Functional homolog of the protein sequence given in SEQ ID NO 50149
  misc_feature: Useful for making plants with altered lignin content
PTYEDKDGDWMLVGDVPWEMFVESCKRLRIMKGSEAIGLAPRAMEKCKNRN

SEQ ID NO: 9995 - DNA, 460 bp, Panicum virgatum
  misc_feature: Ceres CLONE 1720508
caatcgcaagtcccctcctaccaccctcttccctctcaaagcagccaagcaagaagccaggcagcgagcgagcgagcaagaagcgccgcgcgtgctagcagaggggacaagaaggcgaggaggtgactagctgagcgaggtggctgcggcagcaatggcggcggacctggggttcgaggagaccgagctccggctgggcctgcccggcggcggcggaggcggaggggaagatggcgaagggacaatgagctcctccggctagaggggcttcgccgagaccatcgatctcacgctgaagctggagtcggcggcagccgccgtcgtggaagaggagaaggaggtggagtagagatggtgccaccacctggaggagcatgtaccggctttggttcaaaacttaattttgacatgggaagagctgacatgatcaaccaggggaaggaggtcctggtaaggtatg

SEQ ID NO: 9996 - DNA, 546 bp, Panicum virgatum
  misc_feature: Ceres CLONE 1720510
  misc_feature: Encodes the peptide sequence at SEQ ID NO. 9997
agatcagatttccgatcaccccagttccgtccccgatctcgtgttcgctcgtgtcgcggtttccagggacgcctccggctcgtcgctccgcagagatctccgcccccccacaagatgcagatctttgttaagaccctgactggcaagaccatcactcttgaggtcgagagctcggacaccattgataatgtgaaggccaaaatccaggacaaggagggaattcctcccgatcagcagaggctcatcttcgctgggaagcagctggaagacggacgtaccttggcagattacaacatccagaaggaatccactctccatcttgtcttgcgcctccgcggtggccttgctaactaagggatcaagtaggtgtgttctgatccggagttgatgtggttggatcttgtagtgtgataccctagtacctcgcagtattctgtgtttcatcatgtaaactctgctattacttttgttttcgtactcagtactcctggtttcttttcagacactttaccagtgttgaatatggcaattatgctcgttcgtgtt

SEQ ID NO: 9997 - protein, 79 aa, Panicum virgatum
  misc_feature: Ceres CLONE 1720510
  misc_feature (6)..(74): Pfam Name: ubiquitin Pfam Description: Ubiquitin family
  misc_feature: SWISSPROT Homolog: EC 3.1.2.15 Ubiquitin thiolesterase
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
MQIFVKTLTGKTITLEVESSDTIDNVKAKIQDKEGIPPDQQRLIFAGKQLEDGRTLADYNIQKESTLHLVLRLRGGLAN

SEQ ID NO: 9998 - DNA, 272 bp, Panicum virgatum
  misc_feature: Ceres CLONE 1720513
  misc_feature: Encodes the peptide sequence at SEQ ID NO. 9999
atctacaagggactcgtcagctcaagcaggcctgcctcctcgatcttccccttattagtcaataatactagcagtaataagcatatgctaccaagcctcgccatggcccccaccgtgatggcctcgtccgccacctcagtggctccattcgagggcctcaagtccaccgatggccaccccatcgacagacgctcccgaaactgcgccggcttcggcaacgtcaccgcctgcggacggatcaggtgcctgcacgtgtgaccaacggagaacac

SEQ ID NO: 9999 - protein, 51 aa, Panicum virgatum
  misc_feature: Ceres CLONE 1720513
  misc_feature: SWISSPROT Homolog: EC 4.1.1.39 Ribulose-bisphosphate carboxylase
MAPTVMASSATSVAPFEGLKSTDGHPIDRRSRNCAGFGNVTACGRIRCLHV

SEQ ID NO: 10000 - DNA, 196 bp, Panicum virgatum
  misc_feature: Ceres CLONE 1720520
  misc_feature: Encodes the peptide sequence at SEQ ID NO. 10001
ccccgcctctcctcgtcctgagatccccaaatcctcctcttgatttctaactcggcctcggctcaagtggtgaatgggggcagagaggggaaagatggggctcgctttgggtaagctcttctctccgatcttcgacagaaaagatatgtcgatcctggaggtcggtctccactccacccgtagatccacgatgctc

SEQ ID NO: 10001 - protein, 40 aa, Panicum virgatum
  misc_feature: Ceres CLONE 1720520
  misc_feature: Functional homolog of the protein sequence given in SEQ ID NO 50150
  misc_feature: Useful for making plants with altered alkaloid content
  misc_feature: Useful for making plants with altered lignin content
MGAERGKMGLALGKLFSPIFDRKDMSILEVGLHSTRRSTM

SEQ ID NO: 10002 - DNA, 656 bp, Panicum virgatum
  misc_feature: Ceres CLONE 1720552
  misc_feature: Encodes the peptide sequence at SEQ ID NO. 10003
ccccactggtcctacgccataccaaaccaatcagaaggaggagcaggagctgagagcacacacggtggagtggaggccgtcgttggtcggagatcatggcggactgggcgccggtgttcatcggcctggtgctgttcatcctcctctccccgggcctgctgttccagatccctgggaagggccggatcatcgagttcggcaacttccataccagcggcctctccatcctcatccacgccatcatctacttcaccctcatcgccatcttgctccttgccatcggcgtccacgtgtacctcggctagccatcagccgaccgcagcggcggcctcctcgatctctgaccggcaagattaggtacagtggtagaggcatgttcaccctccgttggtggttggctgcttggtatactaggggatcaatgtgataaggttagtggtgtctattgggcatttgtcaggttaaaggctcactattgttgttctgcaaaatgtaatcttatctcttatgtacgtgcagtactgcgctgcttctcatgatgacagtcatcgtctttaatttttttcagcatgtgtctcctttagcatgaggtgttagtactggctgactcagcttggatttgctagagatgttaatcctcatagggtcgatttgcc

SEQ ID NO: 10003 - protein, 69 aa, Panicum virgatum
  misc_feature: Ceres CLONE 1720552
  misc_feature: Functional homolog of the protein sequence given in SEQ ID NO 50117
  misc_feature: Useful for making plants with altered cell wall content and/or composition
MADWAPVFIGLVLFILLSPGLLFQIPGKGRIIEFGNFHTSGLSILIHAIIYFTLIAILLLAIGVHVYLG

SEQ ID NO: 10004 - DNA, 1005 bp, Panicum virgatum
  misc_feature: Ceres CLONE 1720554
  misc_feature: Encodes the peptide sequence at SEQ ID NO. 10005
acccaactccgtttcgaattctagggttttgctgctcttccgtgctctgaaggccgcatcgccgcatcaggtgcggttcctcgcgtgcgaccgtaatggcgctgccgaaccaggggactgtcgattaccccagcttcaagctcgtcatcgttggcgatggcggaacaggcaaaaccacattcgtgaagaggcatctcactggagagtttgagaaaaaatatgagccaaccattggtgtggaagttcatccattggatttcactactaactgtggtaagatccgtttctactgctgggatactgctggacaagagaagtttggtggcctcaggaatggatactatatccatggccagtgtgcgatcattatgtttgatgttacctcaaggctgacttataagaatgttcctacatggcatagggacttatgcagggtgtgtgaaaacatccccattgtcctgtgtggtaacaaggttgacgtgaagaacaggcaggtgaaggccaagcaggtcaccttccacaggaagaagaacctgcagtactatgaaatttctgccaagagcaactacaacttcgagaagcctttcctttaccttgcaaggaagctggctggggatcccaacattcactttgttgaagctgtcgctcttaagccgccggaagttaccattgatttggccatgcagcaacagcatgaagctgagcttactgctgcagcagcacaacctcttcctgatgacgatgatgatttgattgagtagaaagtggataatgagtatcagacttgagctgatggagtggtgccttgcccaagagttgtcttggggccgaactctctctagagttagtgttgtctgaacctggatcttttcccgtctctcggtcatgttgctacttttgaatgtctgaaatcttgatggacatgccgccatgaatttgctggctctttatacattgctttgtaactctggtactctagttattgatggtgaacgttgttgtggc

SEQ ID NO: 10005 - protein, 221 aa, Panicum virgatum
  misc_feature: Ceres CLONE 1720554
  misc_feature (15)..(173): Pfam Name: Ras Pfam Description: Ras family
  misc_feature (15)..(128): Pfam Name: Miro Pfam Description: Miro-like protein
MALPNQGTVDYPSFKLVIVGDGGTGKTTFVKRHLTGEFEKKYEPTIGVEVHPLDFTTNCGKIRFYCWDTAGQEKFGGLRNGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDPNIHFVEAVALKPPEVTIDLAMQQQHEAELTAAAAQPLPDDDDDLIE

SEQ ID NO: 10006 - DNA, 687 bp, Panicum virgatum
  misc_feature: Ceres CLONE 1720590
  misc_feature: Encodes the peptide sequence at SEQ ID NO. 10007
tcatcgcatcggcactcctctctgcaaagccagccatcggagaaggagaaggagagcttttgggctttttgggggtgggtggtgcgccatgggggaggtgaagcacctgtgcctggtgaggttcaaggagggcgtcgtggtggaggacgtcctgaaaggcatgaccgaccttgtcgcccagatggacatggtcaaatccttcgagtggggccaggacgtgctgaatcaggagatgctgacgcagggcttcacgcacgtcttctcgctcaccttcgcctccgccgacgacctcaccacctacatgggccacgacaagcacgccgcgttcgccgccacgttcatggccgcgctcgagaaggtggtcgtcatcgacttccccgtcgtcatcgccaagccaccgccatcggcatgatcgacctgccacagcatctgtcggccattgtacggtgccttttcaggtagcagatcatcgtctatttgcaacggtgatgtactgcgtgtctaagtacgtatgtattaagctccttattaccacttgttctgctatatgtcctgcactctaggacgtctattgtagctgtaaggcaaagatatctacaccgtaccgtacgtgcagcactccgtgttcaaggccctattggttggttaactttggaataaatttcggtgatctttctggtagcagct

SEQ ID NO: 10007 - protein, 107 aa, Panicum virgatum
  misc_feature: Ceres CLONE 1720590
  misc_feature (4)..(98): Pfam Name: Dabb Pfam Description: Stress responsive A/B Barrel Domain
MGEVKHLCLVRFKEGVVVEDVLKGMTDLVAQMDMVKSFEWGQDVLNQEMLTQGFTHVFSLTFASADDLTTYMGHDKHAAFAATFMAALEKVVVIDFPVVIAKPPPSA

SEQ ID NO: 10008 - DNA, 876 bp, Panicum virgatum
  misc_feature: Ceres CLONE 1720631
  misc_feature: Encodes the peptide sequence at SEQ ID NO. 10009
atagactcgccccgcggccgtcctgtcagtgtcactcccttcctcagccggctctagtgagctcttcagatcaggctcgccttccctcccgctcttccgccgccgccgccgccgccctcgtcgatcccgtgaactgcgccggagtggcgatccgtcggacctcttctgccgctgtatagcacattacttttgtggctgtaaagttccgtaattccggaggaccaagatggaggttattatcatcatctcacttgtcattcttttggcactaggagctctctttgtgatcccgaagtcccaaaacaaaggtaaatcaaagggaactgattcaggagatggaacggcatctaagagttatacaaaggaagagatctctaaacataacacaaggaaggattgttggatcatcgtcaaagacaaggtctatgatgtcactccttatgtggaggaacatccaggtggagatgccattctaaataatgctggtggtgattccacagaaggcttttttggaccccagcacggcactagagtcttcgatattattgaggatttctgtatcggacagttgaaggcttcatgatattaagggtagattgtattgatttcatggaattttcctggaatcagtttatgagaagctatatatatggtagccatgttttcagccttgtcaaggtcaggtgtgatatgtcggagtcaaactgttctgcacttgtgatcagggctaccctcagctttgcgatgtaacctcattcttgtgctggaaccatgtcagcgtcaccctagaattgcttgttgtgtttgtacgtttaagttcttaaacagggattctgaaacgattgcaattgtttaggttaatcagaaaccaattcg

SEQ ID NO: 10009 - protein, 118 aa, Panicum virgatum
  misc_feature: Ceres CLONE 1720631
  misc_feature (43)..(116): Pfam Name: Cyt-b5 Pfam Description: Cytochrome b5-like Heme/Steroid binding domain
MEVIIIISLVILLALGALFVIPKSQNKGKSKGTDSGDGTASKSYTKEEISKHNTRKDCWIIVKDKVYDVTPYVEEHPGGDAILNNAGGDSTEGFFGPQHGTRVFDIIEDFCIGQLKAS

SEQ ID NO: 10010 - DNA, 437 bp, Panicum virgatum
  misc_feature: Ceres CLONE 1720634
  misc_feature: Encodes the peptide sequence at SEQ ID NO. 10011
acttctgcgcctccccgtctctctcgtcctccctcgccgccgccgagaaggaaggaataggaggaggaaggagcaagcggagatgggccactccaacgtctggaactcgcaccccaagaactacgggcccggctcccgcgtctgccgggtctgtgctaacccccatggattgatcaggaagtatggactcatgtgctgcaggcagtgcttccgcagcaacgccaaggacattggcttcatcaagtaccgctaaagacattgccttgctggcgtcgagaacttcacatgggttgaaaagaaatggatccttcaatagaaggctcaacttatgtgcattagattttcgttcagacttgagactgctagtaaactacttgttaaagttttgatgggtactatatgcctgttaaactaattataattaagtgattggagta

SEQ ID NO: 10011 - protein, 56 aa, Panicum virgatum; identical to SEQ ID NO: 9888
  misc_feature: Ceres CLONE 1720634
  misc_feature (3)..(56): Pfam Name: Ribosomal_S14 Pfam Description: Ribosomal protein S14p/S29e

SEQ ID NO: 10012 - DNA, 521 bp, Panicum virgatum
  misc_feature: Ceres CLONE 1720664
  misc_feature: Encodes the peptide sequence at SEQ ID NO. 10013
ctccgtacccgcccgttcacttctccaggaaagggtaggtccacatggcgccaccgcaacccaagtccggcctcttcgaggacatcaacaagggccatgtcgtcaccaagcgcgagctgccactgcgcccgtcccaccgcaaagggaaagcaacgaagcgggtgaccatggtcaggggcctgatcagggaggttgctgggttagctccttatgagaagcgaatcactgaacttctgaaggttggcaaggacaagcgtgcactgaaggtagctaaaagaaagctcggaactcacaagagggcaaagaagaagagagaggagatggccaatgtcctcacgaagatgagatctgctggtacccacactgataagaagaaatagagcatctcaagtacgtgaagctggtggcaacattctcctgtgtcggttttccctacctgtagaacctgatagacttgtcaaagtacctgccaggtgccagcaaaacatcatgttgttagttatgtgtagaaccaccccatg

SEQ ID NO: 10013 - protein, 111 aa, Panicum virgatum
  misc_feature: Ceres CLONE 1720664
  misc_feature (5)..(103): Pfam Name: Ribosomal_L36e Pfam Description: Ribosomal protein L36e
MAPPQPKSGLFEDINKGHVVTKRELPLRPSHRKGKATKRVTMVRGLIREVAGLAPYEKRITELLKVGKDKRALKVAKRKLGTHKRAKKKREEMANVLTKMRSAGTHTDKKK

SEQ ID NO: 10014 - DNA, 577 bp, Panicum virgatum
  misc_feature: Ceres CLONE 1720664-R
ccattcccaggagaagccggaggcggaggaagtgagatcgcgaggagccgcaggcggagatgaagacgttcgacccgtggccggtgttcttccgccgggagtggaagcgcaactggcccttcctcaccggattcgccatcaccggattcctcatcaccaagatgacggccaacttcaccgaggaggacctcaagaactccaagttcgtccaggagcacaagaagcactgatgaggccaggtggagttgccagaatcgcctatgccgtggccagttctactatgcctgtctgaaggaaaaaatagttcccctcctttttccccccttttatttaatctgaatatgtgcactctatgctccttttgtaatgtaataagaggcaaatgaattgttgaaccaaaagaatccagcttctgatgatacttaagtttgatccagtttactgacttggtatgtgggccaccgatcgtgttatcttgttaattggttggagcctgtttgaaaagaaaggggtcgaaatcttgtatgagatttaacattgtttacagatttgaatgtaaggcccccttaaaggaact

SEQ ID NO: 10015 - DNA, 541 bp, Panicum virgatum
  misc_feature: Ceres CLONE 1720709
  misc_feature: Encodes the peptide sequence at SEQ ID NO. 10016
acgccgccactcctcccaaccctagctgagcggaggagcaacaacgcaggaatggggaagggtacgggcagcttcggcaagcgccggaacaagacgcacacgctctgcatccgctgcggccgccggagcttccacctccagaagagcacctgctcctcctgcggctaccccgccgcccgcatccgcaagtataactggagtgtgaaggccatccggcgcaagaccactggaaccgggaggatgaggtacctccgacacgtgcctcgccgtttcaagagcaacttcacagaaggtaccgaggctacccccaagaaggctgctgctgcttccaactaggtcttgatgttgccatcaagaaccgcagaagctagaaattggaaccttttttggctgagttgtacagtccgaactatttagacttactatggaagtattggtttgtcgttctttaaattccagtcagacgaacatctgaatttgttgctccatggtttaatatatctttcttggtgagcgtatacaaccaccgagacacaaaaaa

SEQ ID NO: 10016 - protein, 94 aa, Panicum virgatum
  misc_feature: Ceres CLONE 1720709
  misc_feature (2)..(55): Pfam Name: Ribosomal_L37e Pfam Description: Ribosomal protein L37e
MGKGTGSFGKRRNKTHTLCIRCGRRSFHLQKSTCSSCGYPAARIRKYNWSVKAIRRKTTGTGRMRYLRHVPRRFKSNFTEGTEATPKKAAAASN

SEQ ID NO: 10017 - DNA, 481 bp, Panicum virgatum
  misc_feature: Ceres CLONE 1720763-R
  misc_feature: Encodes the peptide sequence at SEQ ID NO. 10018
gatgaagagcggcaagtacacgctgggctacaagaccgtcctcaggactcttaggaactccaagtcgaagcttgtgatcattgctaacaactgccctccccttcggaagtctgaaattgagtactatgcaatgctggctaaggtcactgttcaccatttccatggaaacaatgttgacctgggtacagcctgtggaaaatacttccgtgtctgctgtcttagcattattgatccaggtgattcggatatcatcaagactacatcgggtgaccagtaaggaagagatgccagtccccattggtgttctgagcttttctagtgtagtagtggatctttcaggacttgtcctttcaccttatattgtgttaaacactatttgcctgcccgtaatctgagtttttgggaacagtcttgcattgaaaattttgttcctggaattgacactatcaatggagctgtggcctatggttgtcctcacttc

SEQ ID NO: 10018 - protein, 91 aa, Panicum virgatum
  misc_feature: Ceres CLONE 1720763-R
  misc_feature (1)..(85): Pfam Name: Ribosomal_L7Ae Pfam Description: Ribosomal protein L7Ae/L30e/S12e/Gadd45 family
MKSGKYTLGYKTVLRTLRNSKSKLVIIANNCPPLRKSEIEYYAMLAKVTVHHFHGNNVDLGTACGKYFRVCCLSIIDPGDSDIIKTTSGDQ

SEQ ID NO: 10019 - DNA, 421 bp, Panicum virgatum
  misc_feature: Ceres CLONE 1720763
tgactggcacttttcgggcatatgtgagcggagaccctatttgcttatttctgtaaatgcattcacataggtatacccgcatcagacaatggcccagatacatgcttccctaatatagactggagaagattatgagtatgccctctttgcgtgtctgccttattccctttttgacggccttatcccttcctgtatttactcacccagaaacgctggtgcaaggcaaagaggctgaatatcactggggtgcactagggaggtacgtcgaactggatctcaacagcgttaagatccttgagagttttcgcccccaagaacgttttccaatgatgagcacttttaaagttctgctatgtggcgcggtattatcccgtattgacgccgggcaagagcagctcggtcgccgcatacactattctgc

SEQ ID NO: 10020 - DNA, 797 bp, Panicum virgatum
  misc_feature: Ceres CLONE 1720776
  misc_feature: Encodes the peptide sequence at SEQ ID NO. 10021
aaaccctcgcgctttgcccccatctccgccccgccgctgcagcgctccgcctccctccccctcgcacccgcaggctagggttctcctctagaggcggcgccatgttggtctaccaggatctgctcaccggcgacgagctgctctcggactcgttcccgtacaaggagatcgagaacggcgtgctctgggaggtcgagggcaagtgggtcgtccaaggagcagtggaggtgaacattggtgccaacccgtctgctgagggtggcgaggatgagggcgtagatgatcaggctgtgaaggttgtggacattgtcgacaccttccgtctacaggaacaacctgccttcgataagaagcagtttgtcacatttattaagcgctacataaaaaacctcacttccaagctggagccggagaagtctgatgagttcaagaagggcattgagggtgccaccaagtaccttcttggcaagttgaaggacctacagttctttgttggcgagagcatgcatgacgatgggagtctcgtgttcgcgtactacaaggaaggagccaccgacccgaccttcctctactttgcacatggcctgaaggagatcaagtgctaggtgctaggtgcccctgaccatacgggtgttatcgtgttcttaatttgtctggttttgttcgtattgtgctgagaaacattgtgctgagaaacggttgtcggcttttaccgccaaaagatactcttactttctggatgtgatctgttactccgtgtttctgttactttctggatgttctggatgtgatctgtt

SEQ ID NO: 10021 - protein, 167 aa, Panicum virgatum
  misc_feature: Ceres CLONE 1720776
  misc_feature (1)..(164): Pfam Name: TCTP Pfam Description: Translationally controlled tumour protein
MLVYQDLLTGDELLSDSFPYKEIENGVLWEVEGKWVVQGAVEVNIGANPSAEGGEDEGVDDQAVKVVDIVDTFRLQEQPAFDKKQFVTFIKRYIKNLTSKLEPEKSDEFKKGIEGATKYLLGKLKDLQFFVGESMHDDGSLVFAYYKEGATDPTFLYFAHGLKEIKC

SEQ ID NO: 10022 - DNA, 881 bp, Panicum virgatum
  misc_feature: Ceres CLONE 1720780
  misc_feature: Encodes the peptide sequence at SEQ ID NO. 10023
agggactccctactctctctggaacggaacggcgtcttccctgtgaccctgtccgcgttgtgctaccgccggctaccgcgaccaccgtcccctccgctcccctccccggcgccccgcagcgagctcgtcagcctctcgccatggagacctgcccgtcggtgaagaacatcctcttgctggactccgagggaaagcgcgtcgccgtgaagtactacagtgatgactggcccacgctgtccgcgaagctggccttcgagaagtctgtcttcgcgaaaacccagaaagcgaatgctggaacggaagctgagattgtaatgtttgacggccaaattgtggtatataagttcatccaagacctacacttttttgttactggaggagaagaggagaatgagcttattttagcatcagttcttcagggtttctctgatgctgttgaccgacttctcaaaaacatggttgacaaaagaacagcactcgagaatttggacctgatcctattatgtcttgatgaaattgttgatggagggattgttcttgaaacagaagggagagagatagctgagaaggtgacaggtcatggattggagagtgcttcatccgctgagcagaccttactcaatgccctaacgcaagcaagagagcacttggcaaagtctcttatgtgatgttattgctttctatttgggggtgaagatggtgtatcatcctatagttatgtttaaggatataatacattcttttagcatttgagaatgaaattttctgaagtctattgatgtgtaaaatggcaacattctctggccgttcagttttgcaagccttcgaagtttgtgtaacgtgattgctccaattatggctggttcagttcctggtcgttt

SEQ ID NO: 10023 - protein, 175 aa, Panicum virgatum
  misc_feature: Ceres CLONE 1720780
  misc_feature (6)..(151): Pfam Name: Clat_adaptor_s Pfam Description: Clathrin adaptor complex small chain
METCPSVKNILLLDSEGKRVAVKYYSDDWPTLSAKLAFEKSVFAKTQKANAGTEAEIVMFDGQIVVYKFIQDLHFFVTGGEEENELILASVLQGFSDAVDRLLKNMVDKRTALENLDLILLCLDEIVDGGIVLETEGREIAEKVTGHGLESASSAEQTLLNALTQAREHLAKSLM

SEQ ID NO: 10024 - DNA, 628 bp, Panicum virgatum
  misc_feature: Ceres CLONE 1720850
  misc_feature: Encodes the peptide sequence at SEQ ID NO. 10025
agtacccggaggagtagccgccgccgcgaacacaggagcagcgggaacatacaggaccggcaagatgcagatcttcgtgaagacgcttactgggaagaccatcaccctcgaggtcgagagcagcgacaccatcgacaatgtcaaggccaagatccaggacaaggaaggaatcccgccggaccagcagcgtctgatcttcgccgggaagcagctggaggatggccgcactctggcggactacaatatccagaaggagtccacgctccacctcgtgctcaggctccgtggtggaattattgagccctcgctgcaggcgctcgcgcgcaagtacaatcaggacaagatgatctgccgcaaatgctacgcacgccttcaccccagggccgtcaactgccgcaagaagaagtgtggtcacagcaaccagttactgtattgcaaaagcactgtgcctgaatctagctgaggcccaagaagaagatcaagaactgaggtgtgttgctgctaatcagtttcatcgaccgtttaaatcatctgttgtagcggtgtatcgtgtgctatgttgtgttgttgtccggatgttgaaccgtgtctgtttatccaaacttttcggcctgccgtgatgtttcag

SEQ ID NO: 10025 - protein, 132 aa, Panicum virgatum
  misc_feature: Ceres CLONE 1720850
  misc_feature (6)..(74): Pfam Name: ubiquitin Pfam Description: Ubiquitin family
  misc_feature (77)..(128): Pfam Name: Ribosomal_L40e Pfam Description: Ribosomal L40e family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
MQIFVKTLTGKTITLEVESSDTIDNVKAKIQDKEGIPPDQQRLIFAGKQLEDGRTLADYNIQKESTLHLVLRLRGGIIEPSLQALARKYNQDKMICRKCYARLHPRAVNCRKKKCGHSNQLLYCKSTVPESS

SEQ ID NO: 10026 - DNA, 824 bp, Panicum virgatum
  misc_feature: Ceres CLONE 1720883
  misc_feature: Encodes the peptide sequence at SEQ ID NO. 10027
acgttattagccatttagccttaaccgccgcgacgtcgggccccgagtggcaccggtcagctagctcgagcgcagctctcgccgcgctctccttgcgacgacgccatggccccgaccgcccgagccgccacgggcgcggcgagccccgcggcgccggccatcggcaagggcgagagcggcaatggcaaggccgtcgccgcgcgctccgtcgggctcgacctgcccgcgctgccgagcctcggtctcgcggcgcagggacagacccgcgccgcatcctgcaagcggctggagaggaacgtggtggccgtggccgcggggaccgccggggagccggcggcggcgccgacggtcgccaacgaggagctcaccgagttcctcaacgccttgaaacaggagtgggacgggatcgagaacaagttcgccatgaccacactcgccgtcactgtcacgctcgtcatgtggagcgccggtggagtagtatcggcgattgacaggctccccatagttccacgcctgatggaggttgttggaattggatacagtgggtggtttgcgtaccgctacctgctattcaagcctgacaggaatgctttctttgcaaaggtcatggagttctacgaggatataatcagcggctaacagaatataatgcaagctcatccaaattaaggaagctcatcttgagaggggcatgtatactagtctgctgctgttcagttgttctctgtaatatatttctggatagcatctaatttgatccttactcaatgtacggataaataatttggatgttaatcgtaaataacatgtaatccttttaagtc

SEQ ID NO: 10027 - protein, 177 aa, Panicum virgatum
  misc_feature: Ceres CLONE 1720883
  misc_feature: SWISSPROT Homolog: EC 6.1.1.9 Valine--tRNA ligase
MAPTARAATGAASPAAPAIGKGESGNGKAVAARSVGLDLPALPSLGLAAQGQTRAASCKRLERNVVAVAAGTAGEPAAAPTVANEELTEFLNALKQEWDGIENKFAMTTLAVTVTLVMWSAGGVVSAIDRLPIVPRLMEVVGIGYSGWFAYRYLLFKPDRNAFFAKVMEFYEDIISG

SEQ ID NO: 10028 - DNA, 847 bp, Panicum virgatum
  misc_feature: Ceres CLONE 1720892
  misc_feature: Encodes the peptide sequence at SEQ ID NO. 10029
atcgccgcgcctcacgaaacaaagctaagcgtttggtattacagccagcaccagcagcttagctcagctcagctccccgttcgacaccaccatggcctccgtctcgcgcctcctcgccgtggcgctcgtcgtcatggccgccgcgctcctcggcggcggcggcggcacgtgccacgccgcccgcctcctcgccgccctgccggtgcccgaggtgcctggcgtgccgttgccgacgttgcccgaggtgccgggcatcccgacactgccggtacctgaagtgccgatgccggaagtgccgaagctgccggtgcctgaagtgcccaagctgccggtgcccgaagtgcccaagctgccggtgcccgaagtgccgggcgtgcccgtgcctgaggtgcccggcgtgcccgccgtgccttaggtgccgcgcgctcatccgcggatgctgccggctcccggcgtggacgaaagcctctcccgcgccgcgctgcgtgcccatcggcctcgacgacgtcggtccgtgcgcaagtgccggcgcgggggtgtggtggtggtactcttctgtgtttatatgtgtgtgtgtgtgtgtgtgtgtgtgtgtgtgtgtgtgtgtgtgtgtgtgtgtgtgtgtgtgtgtgtgtgtgcgtgtgtgtgtgtgtgtgtgtgtgtacgcgagactacgtacgcgtcgcgtgtctctcgtttcgtcgtgatgtctgctacgtcgttgtagggtagggacgtgcacgcgatacggtgcgcgtgtaacaccacatatatactgctctatcgatgaatgttactagcttcgtcggtgtgagtagtaataattttacatcgttgccagggctgc

SEQ ID NO: 10029 - protein, 107 aa, Panicum virgatum
  misc_feature: Ceres CLONE 1720892
  misc_feature: Functional homolog of the protein sequence given in SEQ ID NO 50151
  misc_feature: Useful for making plants with modulated heat sensitivity
MASVSRLLAVALVVMAAALLGGGGGTCHAARLLAALPVPEVPGVPLPTLPEVPGIPTLPVPEVPMPEVPKLPVPEVPKLPVPEVPKLPVPEVPGVPVPEVPGVPAVP

SEQ ID NO: 10030 - DNA, 806 bp, Panicum virgatum
  misc_feature: Ceres CLONE 1720899
  misc_feature: Encodes the peptide sequence at SEQ ID NO. 10031
aaaaccctagccgaccacaccactccaccccgccgccgcaggcgagaagcagctccagctcaggtaaggccgtaagggcggccgccgccggggagggcgcgcctgcgaagatgcagatcttcgtgaagacgctgacggggaagaccatcacgctggaggtggagtcctcggacaccatcgacaacgtgaaggccaagatccaggacaaggagggcatcccgccggaccagcagcggctcatcttcgccggcaagcagctggaggacgggcgcaccctcgccgactacaacatccagaaggagtcgacgctgcacctggtgctccgcctccgcgggggagccaagaagcgcaagaagaagacgtacaccaagcccaagaagatcaagcacaagcacaagaaggtgaagctcgccgtgctccagttctacaaggtggacgacgccaccggcaaggtcacccgcctccgcaaggagtgccccaacaccgagtgcggcgcggggaccttcatggccaaccacttcgaccgccactactgcggtaagtgcggcctcacctacgtctacaaccagcaggcgtaggatggatgctccgctgttgtggtgggggaaaggaaaaaaaatggaaagtcttgctagatgataaatcttatttctttttttgtcgcatgttaagttaaagtagtttgttggaacagaacacctgcatctctcatggtgatgcgtacttttggttttgatgatatgatgtcgttctggatcgcaccaaacactgttgaattcaacctatgtttgtgttaatcttatact

SEQ ID NO: 10031 - protein, 155 aa, Panicum virgatum
  misc_feature: Ceres CLONE 1720899
  misc_feature (6)..(74): Pfam Name: ubiquitin Pfam Description: Ubiquitin family
  misc_feature (101)..(148): Pfam Name: Ribosomal_S27 Pfam Description: Ribosomal protein S27a
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDATGKVTRLRKECPNTECGAGTFMANHFDRHYCGKCGLTYVYNQQA

SEQ ID NO: 10032 - DNA, 731 bp, Panicum virgatum
  misc_feature: Ceres CLONE 1720908
  misc_feature: Encodes the peptide sequence at SEQ ID NO. 10033
aaaaatatcccacactcgctacgagcgcgagcagcagcagcagccatggggatagccgtggtggctcccgtcgcggcggcctcctcctacctcggggcgcggccgagggcgccggcccgcgcccacgtggcggcggccgggatgtccgcgagggcgtcctccttcgtcggcgcggggctcgcggtggcggccgcgtcgatagcggcgcggccgaggagggccggctccgggggcggcggggcgcttgggtgcaagtgcctcttcgggctcggggtgccggagctcgcggtaatcgccggcgtcgccgcgctggtgttcgggcccaagcagctccccgagatcggccgcaacatcggcaagaccgtcaagagcttccagcaggcggctaaggagtttgaaactgaactgaagagagcctggggaaggtggtgacgagcccccgcctgcaacccccacggcggtaggcgatggggaagagaaaaagggggcttgaggcatcgccaagtagcaaggagcacacacatgaggatctatcaagagttgtgagttagggttctgtatgtacaactgtattctgggcttctggagttcgctacaaattcctgcccgtttattttgatcaccttgcagtttcaggccacatagcgatattgtttgtagtttttgtacccgggaagaataacttttctgtgaacgatatcgtgttattcaatatgaggcttaccttgagc

SEQ ID NO: 10033 - protein, 128 aa, Panicum virgatum
  misc_feature: Ceres CLONE 1720908
  misc_feature (75)..(127): Pfam Name: MttA_Hcf106 Pfam Description: mttA/Hcf106 family
MGIAVVAPVAAASSYLGARPRAPARAHVAAAGMSARASSFVGAGLAVAAASIAARPRRAGSGGGGALGCKCLFGLGVPELAVIAGVAALVFGPKQLPEIGRNIGKTVKSFQQAAKEFETELKRAWGRW

SEQ ID NO: 10034 - DNA, 840 bp, Panicum virgatum
  misc_feature: Ceres CLONE 1720925
  misc_feature: Encodes the peptide sequence at SEQ ID NO. 10035
actcgcccgccccgacttcaccacttgctcctcgccgacgatctcgcggagcagcggcgcgcatggcgagcgacggcgcggcggccacgccggcgaaggtgaccccgaagaaggccaacatcctcgacccgcactccatcaagcacctcctcgacgataccatctccgatgtcgtgaagagcaagggatacaccgaggacacgcggctgggcaacttgaagctggggatcggggcggccgtgatcgccgtcgccctactcgcgcaattctacccgaagaagttcccgcagaaccgcgagttcctcctcggctgcatcgcattgtatgtggtgttgaatgtggttctgctgatccttagctacaccaaggagaaggatgccatcctcttcacccacccccctgcgggttctttcaacagcaccggcctcattatttcttctaagctaccaagattctcagacatgtacactctcacaatagccagtgcggacccgcagtctatctctgcgaataagccagtccatttcacaaagagtgtgacaaagtggtttactaaggaaggggttcttgtggaaggtctattctggaaggatgttgagaagctgattgatgactacaacagcgagcgcaagagtaaatgaattggtagctcgtgtctctgaccatccggagagacattggttgtctggggaaacccctcttatggaagagagcttagcctaatctaaacagacatttttgcatactgtacttgttgatcagtgaatgaataccgttcaagacataaaccttggttctgtgttttctgacatgtctatcacagtaactatctgtcccctc

SEQ ID NO: 10035 - protein, 192 aa, Panicum virgatum
  misc_feature: Ceres CLONE 1720925
  misc_feature (12)..(190): Pfam Name: SPC25 Pfam Description: Microsomal signal peptidase 25 kDa subunit (SPC25)
MASDGAAATPAKVTPKKANILDPHSIKHLLDDTISDVVKSKGYTEDTRLGNLKLGIGAAVIAVALLAQFYPKKFPQNREFLLGCIALYVVLNVVLLILSYTKEKDAILFTHPPAGSFNSTGLIISSKLPRFSDMYTLTIASADPQSISANKPVHFTKSVTKWFTKEGVLVEGLFWKDVEKLIDDYNSERKSK

SEQ ID NO: 10036 - DNA, 871 bp, Panicum virgatum
  misc_feature: Ceres CLONE 1720945
  misc_feature: Encodes the peptide sequence at SEQ ID NO. 10037
gggctaaacctagggtttcttagtcgagagccgccgccgccgccgccggagggagcagggagggagtgccgcgatggcggagaagaagcagctggaggatggccgcacccttgctgactacaacatccaaaaggagtccactcttcacttggtgctccgtctgcgtggtggtatgcagatttttgtgaagaccctgactggcaagactatcacccttgaggttgagtcctcagacacgattgacaatgtgaaagcaaagatccaggacaaggagggcatcccccctgaccagcagcgtctcatctttgccggcaagcagcttgaggatggccgcacccttgctgactacaacattcagaaggaatccacccttcaccttgtgctcaggctcaggggtggtatgcagatctttgtgaagaccctcaccggcaaaaccattaccctggaagttgagtcatctgacactatcgacaacgtgaaggcgaagatccaggacaaggagggaatccccccggaccagcagcgtctgatttttgctggcaagcagctggaggatgggcgcaccctggcggactacaacatccagaaggagtccaccctccaccttgtgctccgcctccgtggtggccagtaagttctgagggccatggagctgctgttatccctgggttcacaagtctggtgcttcctttgtctctcgaatggaggggttgtctctgtgtaccgtggtctgtcctggtcttgtggtgcgggtgtcttcgcctgtcctgatggaagtcctatgtcgtctggttgtgtctgaacatttgctgctgtgcagcatgctacttgtttgaattgtgatgaataagtgaaccctgaacttcgtgcg

SEQ ID NO: 10037 - protein, 186 aa, Panicum virgatum
  misc_feature: Ceres CLONE 1720945
  misc_feature (39)..(107): Pfam Name: ubiquitin Pfam Description: Ubiquitin family
  misc_feature (115)..(183): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
MAEKKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 10038 - DNA, 643 bp, Panicum virgatum
  misc_feature: Ceres CLONE 1720956
  misc_feature: Encodes the peptide sequence at SEQ ID NO. 10039
aagatcatagttcttgctggacacacgcatcatccatccatcccgcgacagtgggcaagcagctgatcgatcgatcgaatccatccgttccgtcatgagctaccaagcaggctacccgccgccgggtcagcaggcctacggcggcgcgcctccgccgcaggcctacgtcgcgccgccgccggcgtacccgcccacccaggacggcgggtaccagcagcagccggagaccaccagccgcggcggcgacggcttctggaaaggatgctgcgccgccatctgctgctgctgcctcctcgacatgtgcttttgaggacgacgattggattggcgacaccagctagctgctcatgaccatgattcgttgcatttcccctctcatttccgtcggagaagtattgatcattgacgagaggcattctgcggttccattcaagatcgtcacgtcatacatgttgatagccttgtcgtgtggtatggttgtgcgtgtttttttttttgtaacgttggttgtacgtgtattcagtagtagttttttcatttattttatgatgacagctattttcttggtgtccgacatactgcttggctctgtggacaacccttgtacacacttttttttaaaaaaaatgtatttttatcatgg

SEQ ID NO: 10039 - protein, 71 aa, Panicum virgatum
  misc_feature: Ceres CLONE 1720956
  misc_feature: Functional homolog of the protein sequence given in SEQ ID NO 50152
  misc_feature: Useful for making plants with altered carbohydrate content
  misc_feature: The sequence is a functional homolog of SEQ ID NO 252 in the 10/714,887 US patent application
  misc_feature: The sequence is a functional homolog of SEQ ID NO 252 in the 11/435,388 US patent application
  misc_feature: The sequence is a functional homolog of SEQ ID NO 568 in the 10/666,642 US patent application
MSYQAGYPPPGQQAYGGAPPPQAYVAPPPAYPPTQDGGYQQQPETTSRGGDGFWKGCCAAICCCCLLDMCF

SEQ ID NO: 10040 - DNA, 689 bp, Panicum virgatum
  misc_feature: Ceres CLONE 1720990
  misc_feature: Encodes the peptide sequence at SEQ ID NO. 10041
atcgactccggttactcccgaatctgcggagacgagcccgggctaccacgtcatcatctttccctgctatcccatatcggatggagggaaccccgcggcgcgaggcgagctcgaggtgatgaattgttacggtttatggacggagcaagcaaggagcctctccacaaggactactacaaagttctggaggttgactatgatgcatctgatgacacgatcaaattgagttatagaagattagctttgatgtggcatccagataagcataagggggataatgatgtcacagctaaatttcaggagattaatgaagcatacaaggttttaagtgatccagctaagcgattagaatatgacctttccggctgttatgagatcaatcaatatactttgcgtgagtacctaacaagatttaagggcatgatacttacctgcaatggccttggcatagatcacaactcaaaatgggctcgacatttgagggaattgaagccccattgatcaacaggtacagatgtactatcactgatgctcatcagatttactactgtactttgttaaatacgctgtgaagtgtcacatacaatggcactttgcccctttctgccaaaagagatccatgtatacactatttccagttctcttattggtgactgactggtcgtgaatacaaaattagctcctttctc

SEQ ID NO: 10041 - protein, 121 aa, Panicum virgatum
  misc_feature: Ceres CLONE 1720990
  misc_feature (12)..(74): Pfam Name: DnaJ Pfam Description: DnaJ domain
  misc_feature: Functional homolog of the protein sequence given in SEQ ID NO 50153
  misc_feature: Useful for making plants with modulated heat sensitivity
MDGASKEPLHKDYYKVLEVDYDASDDTIKLSYRRLALMWHPDKHKGDNDVTAKFQEINEAYKVLSDPAKRLEYDLSGCYEINQYTLREYLTRFKGMILTCNGLGIDHNSKWARHLRELKPH

SEQ ID NO: 10042 - DNA, 453 bp, Panicum virgatum
  misc_feature: Ceres CLONE 1720992
  misc_feature: Encodes the peptide sequence at SEQ ID NO. 10043
ttccctccctacagccgccgccgcctctcccagcctccgcgcctccgtcgccgccgccgcttcctcagccatgggtaaggtgcacggatcgttggcccgtgccgggaaggtccgcggccagacgcccaaggtggcgaagcaggacaagaagaagaagccccgcggccgcgcgtacaagaggatgcagtacaaccgccgattcgtcaccgccgtcgtcggcttcggcaagaagcgcgggcccaactcatccgagaagtaggcgccgcgccgcgcagccgccggctcgccccgctccggttcctcctttccgttctcagtatgcttatgctcttgttggtagtagtttcgttgtgcaagcaaaggaagaaccttttgtagtttcagtttcgttgttcatgtgatgtgatgggaacttgagatggtatgtttaccccgtttaagagtttgagacgg

SEQ ID NO: 10043 - protein, 62 aa, Panicum virgatum
  misc_feature: Ceres CLONE 1720992
  misc_feature (3)..(61): Pfam Name: Ribosomal_S30 Pfam Description: Ribosomal protein S30
MGKVHGSLARAGKVRGQTPKVAKQDKKKKPRGRAYKRMQYNRRFVTAVVGFGKKRGPNSSEK

SEQ ID NO: 10044 - DNA, 741 bp, Panicum virgatum
  misc_feature: Ceres CLONE 1721009
  misc_feature: Encodes the peptide sequence at SEQ ID NO. 10045
ataacatagccatcagtaggaaaggaaatccaagcaacaaacttggcaccaccctgttcctgccaagagaatcaaccatgagacctcaggtgttgctcgccacactagctgctctcgccgtcctcgcagctctgccactcatgagcaaagggagcgaggagggaggaggagtggcggccgccagcgacgacaacgcgagcccatggccgtgctgcgaccagtgcgacttctgcttcaggtcgaacccacccaagtgccggtgcctggacatctcgcgccaaggttgccacccgtcgtgccaaaactgcgtcaagtacagagccgtcggtagcgcccacgagctgcccgtctaccgctgcgccgacaccctcaccaactactgcgagcaccgctgcacaccggccgccgccgccgctgcataatattatctgaatgaacgctgccagcgacctctggttatcagctagctttgccttctcttcctgcgtgcttcgtcagagaagacaggcttcctttgcttgctcatcgttttctactgtttctggaataaagagctgtgtgctgtgcgtacatgctcagagctcaagtgtttgtgttgcttcgtggcatgtactagcgctgtgttgtcatggcgggtaatctggtgtcatgtgtttgttgttgtaatgcctggtctgagaagtataacttctcctttatcagtatgataatatatatgcaactctcgtgcctcttcgtttc

SEQ ID NO: 10045 - protein, 114 aa, Panicum virgatum
  misc_feature: Ceres CLONE 1721009
  misc_feature (45)..(71): Pfam Name: Bowman-Birk_leg Pfam Description: Bowman-Birk serine protease inhibitor family
MRPQVLLATLAALAVLAALPLMSKGSEEGGGVAAASDDNASPWPCCDQCDFCFRSNPPKCRCLDISRQGCHPSCQNCVKYRAVGSAHELPVYRCADTLTNYCEHRCTPAAAAAA

SEQ ID NO: 10046 - DNA, 735 bp, Panicum virgatum
  misc_feature: Ceres CLONE 1721020
  misc_feature: Encodes the peptide sequence at SEQ ID NO. 10047
ctttccgaccaaagagccgccggcggcgccgccatgtcctcggagactatcgccgctgcggccacctccgccctcggcacccgccgcccgcgtcatccccctgccgccaccgcctccttcctctccttccgtttgcgccccacggcgcggctgccaggagccgtcgcagcctccgcctcccgcctctgcaaggccaaggctcacggtgacgaccaacttatgctggatgtagcagagtcgacatgggatgatctcgtccttggctctgagtctccggtgcttgtcgagttctgggcaccgtggtgtggcccgtgccgtctgatgcaccctgtcatcgaaggtgtggcgaaagcatacactggcaggctacggtgcctcaagctcaacactgacaagaaccgggacatcgcaacaagttacggcatcagaagcatccctaccatcttgattttcaaaaatggggagaggaaggagacggtgatcggcgctgtcacagataccacactggcaacgacggtggagaggttcttgtaagccacccacaggctgttcaccatctactgagaggtcaaaattctgcaaacataaaaagatactgagattgcatacagtactcgtgaagtgttttgttttttatatattttgggcatattgacgatgattgctgccgtcattaccaataccggcggttgcaaacatgaaaagaaacatcttggtatgcatggtacacgtggt

SEQ ID NO: 10047 - protein, 166 aa, Panicum virgatum
  misc_feature: Ceres CLONE 1721020
  misc_feature (66)..(165): Pfam Name: Thioredoxin Pfam Description: Thioredoxin
  misc_feature: SWISSPROT Homolog: EC 1.8.1.8 Protein-disulfide reductase
MSSETIAAAATSALGTRRPRHPPAATASFLSFRLRPTARLPGAVAASASRLCKAKAHGDDQLMLDVAESTWDDLVLGSESPVLVEFWAPWCGPCRLMHPVIEGVAKAYTGRLRCLKLNTDKNRDIATSYGIRSIPTILIFKNGERKETVIGAVTDTTLATTVERFL

SEQ ID NO: 10048 - DNA, 855 bp, Panicum virgatum
  misc_feature: Ceres CLONE 1721024
  misc_feature: Encodes the peptide sequence at SEQ ID NO. 10049
aatcactcgggccccgtcctttcgaacaaattcaaatccatctatccaccagtcgcgttcctcctcgccgcggccgccacttggcagccggcaccctccgcactggcgccggcgccggcgccggcgccagcctgccacggtggcgcaagggcggagcaggcggaggtggagttcgtgcgcggctgctgcgcgcgcacgctctacccgcgcctctgccacgcggggctggccccgcacgcggcctccgtccactccagccacgcgcgcctcgcggtggcctccgccaacctcatgctcgcggccctcggcgcgctcgccgcgcgcatcccgccgccgggccccggcgcgccctccggcgcgctcggcgactgcgccaaggccgccgcgtcggccgtggaccaggcggcgcgcgcggccgagcggctgcgcggggtcgagcaggccgtgggcctcgaggtgctctggcgcgtggacgacgcgctgacgtggctcagcgccgccatgaccaacgaggacacgtgcgccgacggcctgtggccccggaaatccgcgccggcgccggtgcgggccgagctgcgcgccagggtgcgccgcgccaagcagtacaccagcatcgctctcgcgctcgtcaacatgttagtcggcaataatccaagaagttagccagacgcccgaaccttggtcgcttatcagttgtaactgcgatgtaaattgacaatctcgcattgctctctgtctgtgttaactttacgtctactttacataggagtaataagaagggatgaagctatgcgccctggattgtaactatccacatactactttattacaatcatcaaatgatattgcttttgc

SEQ ID NO: 10049 - protein, 220 aa, Panicum virgatum
  misc_feature: Ceres CLONE 1721024
  misc_feature (53)..(209): Pfam Name: PMEI Pfam Description: Plant invertase/pectin methylesterase inhibitor
NHSGPVLSNKFKSIYPPVAFLLAAAATWQPAPSALAPAPAPAPACHGGARAEQAEVEFVRGCCARTLYPRLCHAGLAPHAASVHSSHARLAVASANLMLAALGALAARIPPPGPGAPSGALGDCAKAAASAVDQAARAAERLRGVEQAVGLEVLWRVDDALTWLSAAMTNEDTCADGLWPRKSAPAPVRAELRARVRRAKQYTSIALALVNMLVGNNPRS

SEQ ID NO: 10050 - DNA, 709 bp, Panicum virgatum
  misc_feature: Ceres CLONE 1721053
  misc_feature: Encodes the peptide sequence at SEQ ID NO. 10051
aattttggcccagtcgggtggagattctttccaccagtcattagcagaggcagcggagcagaggcggataaaggcggctggccggacggaggacgggaggagcagagagcagagcacccagccaggaggaggaagaggaaggcgaagcgagggtcggagcctccgaggatgccgtgcctgaacgtgtcgacgaacgtcaacctggagggggtggacacctctgccatcctcggcgaagcctccacggccgtcgccaacatcatcggcaagccggaggcctacgtgatggttgttctcaagggttcagtgcctatggcatttggaggtacccaggagcctgcagcttatggtgagctggtttccattggagggctaaaccctgatgtcaacaagaagctgagtgctggcattgcttctattctggagtcaaagctgtccattcccaagtcccgcttctacctcaagttccacgactcaaagcgctcggactttggttggaatggctccaccttctagattcgaggtccatgggtgtggctccaccgctccagtgaaggaagatcgtgttccctaattacctaataaggacactgttgtaagatatcagttaatttgtgttgaactgaagtgaaaactgtcatgtggaactggagcacagacttgttcaatgcaacctagcatattcgtgctgtgctgtgttggcttgcac

SEQ ID NO: 10051 - protein, 115 aa, Panicum virgatum
  misc_feature: Ceres CLONE 1721053
  misc_feature (2)..(115): Pfam Name: MIF Pfam Description: Macrophage migration inhibitory factor (MIF)
  misc_feature: SWISSPROT Homolog: EC 5.3.2.1 Phenylpyruvate tautomerase
MPCLNVSTNVNLEGVDTSAILGEASTAVANIIGKPEAYVMVVLKGSVPMAFGGTQEPAAYGELVSIGGLNPDVNKKLSAGIASILESKLSIPKSRFYLKFHDSKRSDFGWNGSTF

SEQ ID NO: 10052 - DNA, 884 bp, Panicum virgatum
  misc_feature: Ceres CLONE 1721057
  misc_feature: Encodes the peptide sequence at SEQ ID NO. 10053
ctatccattcagagctctcgcttcgaaactgaaccagcacacccagctgccgttgccgtttctagagaactccctgccgttcgagatcccgctcgccacgatgcctgctctcgccaagcccgcctcgcggcccgccaagaccgccgcggcgccgaagccgaagcccgccgccgccaagcccaaggccgcggccgccgctggcgcctcgcacccgccctacttcgagatgatcaaggaggcgatcacggcgctcaaggagaggaccggctcgagctcgcacgccatcgccaagtacatggaggacaagcacggcccgtcgctgccggccaactacaagaagatgctctccatccagctccgcgggttcgccgccaagggcaagctcgtcaaggtcaaggcctcgtacaagctctccgacgccgccaagaaggaggcgcccaaggccaagaccgccgcggccaagccagccaaggccgccgcgaaaccgaagaagagtgccgccgccgccgccgccgccgccgccaagcccaagaagaccgccgccgggaccaagcgcaaggcgccggagaagaaggtcgtcgcgaagccgaagaagtcccccgcggcgaaggccaaggccaagcccaagacggtcaagtcccccgcctccaagaaggcccggaaggttgccgcatgagatggttccgtaggtcgtagctctgatcgtggtgtgcgtgtccctaggagttgtacaaatgaagtgcgtgccccaagcgtctctgatatccgatgttgtgtttggcaggttcaatctatccaggtcggtgttagtgtaacagatggataggtttcttgggatggagatgtatctcgcgctcttatatgatatgaagttgcagttcgcc

SEQ ID NO: 10053 - protein, 191 aa, Panicum virgatum
  misc_feature: Ceres CLONE 1721057
  misc_feature (36)..(106): Pfam Name: Linker_histone Pfam Description: linker histone H1 and H5 family
MPALAKPASRPAKTAAAPKPKPAAAKPKAAAAAGASHPPYFEMIKEAITALKERTGSSSHAIAKYMEDKHGPSLPANYKKMLSIQLRGFAAKGKLVKVKASYKLSDAAKKEAPKAKTAAAKPAKAAAKPKKSAAAAAAAAAKPKKTAAGTKRKAPEKKVVAKPKKSPAAKAKAKPKTVKSPASKKARKVAA

SEQ ID NO: 10054 - DNA, 720 bp, Panicum virgatum
  misc_feature: Ceres CLONE 1721065
  misc_feature: Encodes the peptide sequence at SEQ ID NO. 10055
atccatcaccatagccgccgccccgccgccacactcttcttgctcacggctctagcccaccgagcgcaggaatggcgtcgttcgccgtggcaacggtcccgtcgctggcggccccagcggccaggaagaggtccggcggcgtcacctacgtcgagggcatgaacgcctacagcggcctcaaggggctcaacaaggtcaccgtgctcgggctgcgcaagaccgccgactactccttcgccaagatcgtggcgtcgctcagccccgccggcaagacgcggcgcggcagcgcgttcggggctcagatgaacgccgcggcggagatcttcaggatcgccgccatcatgaacggcctcgtgctcgtcggcgtcgccgtcgggttcgtgctgctccgggtggaggccgccgtcgaggagtccgagtagggatggacgcgcgcccgcccaccctaatagcagccactctgctgccgcctcttgcctcatctaagccgtgatatataaaacgtaatgtgtgtttttgattgaatttacttcaagtatgtatccatgacaattgatgaataccgtgcaaacatgttttcggagtcgaggtctgcaatagaccttcaggtgtttttgtgactatgagatcagaatgcaaaaacatccacgtcttgcaaatgaaatcgtgtataaatttgtagcaggagggagagaggcaaccaaagtttttattctttgc

SEQ ID NO: 10055 - protein, 116 aa, Panicum virgatum
  misc_feature: Ceres CLONE 1721065
  misc_feature (78)..(114): Pfam Name: PetM Pfam Description: PetM family of cytochrome b6f complex subunit 7
MASFAVATVPSLAAPAARKRSGGVTYVEGMNAYSGLKGLNKVTVLGLRKTADYSFAKIVASLSPAGKTRRGSAFGAQMNAAAEIFRIAAIMNGLVLVGVAVGFVLLRVEAAVEESE

SEQ ID NO: 10056 - DNA, 765 bp, Panicum virgatum
  misc_feature: Ceres CLONE 1721069
  misc_feature: Encodes the peptide sequence at SEQ ID NO. 10057
cttgcccacccctcgccgccgccgcagcagcagacgcatccctacgccggtcgcagccatggtgaagtactcaagggagccgaacaaccccaccaagtccgccaaggccatgggccgggacctccgtgttcacttcaagaacacccgtgagacagcttttgccctcaggaagttgcctctcactaaggccaaaaggtaccttgaggatgtgattgcccacaagcaggccatccccttccgcaggtactgtggcggtgttgggcgtactgctcaggctaagtcacgccactcaaatggacagggacgctggcccgtcaagtctgctagattcattcttgatcttctaaagaatgctgagagcaatgctgaggtcaaaggtcttgatgtcgataccctgtatgtgtcgcacattcaagtaaaccaggctcagaagcagcgtcgcaggacctaccgtgctcatggacgcatcaacccttacatgtcctccccgtgccacattgagctgatcttgtcggagaaggaagagccagtgaagaaagaggcggagtctcagattgcgaccaggaaggcttaaacaagggagctctgcagtgttagagtggattgtaggtcgtcattgcctaagtgaaaattttggctggttatttgtcgcctcctttatcagtgtactgctagctcgtactgtcaccgtgatcagtgtctgtactgcctatacaattcgaatctatgaatgaagtgtttgtggattatttccatatttatatt

SEQ ID NO: 10057 - protein, 171 aa, Panicum virgatum
  misc_feature: Ceres CLONE 1721069
  misc_feature (17)..(153): Pfam Name: Ribosomal_L22 Pfam Description: Ribosomal protein L22p/L17e
MVKYSREPNNPTKSAKAMGRDLRVHFKNTRETAFALRKLPLTKAKRYLEDVIAHKQAIPFRRYCGGVGRTAQAKSRHSNGQGRWPVKSARFILDLLKNAESNAEVKGLDVDTLYVSHIQVNQAQKQRRRTYRAHGRINPYMSSPCHIELILSEKEEPVKKEAESQIATRKA

SEQ ID NO: 10058 - DNA, 792 bp, Panicum virgatum
  misc_feature: Ceres CLONE 1721070
  misc_feature: Encodes the peptide sequence at SEQ ID NO. 10059
tcgggcatttcttcgtctccacagctcccgccgcagccgccgccgcttggggtcagtgcgttcctcaccaccgggcaccggcgcctcctcgttcacgcggcgaccatgggagagcagacggagaaggctttcttgaaacagcccaaggtgtttctctgtcccaagaaggctgccaaggggaacaagcctggcaagggtgggaacaggttctggaagaacatcggccttgggttcaagacccccagggaagccattgaaggaacctacattgataagaaatgcccattcactggcactgtgtctatcaggggtcgcatcattgctggaacatgccacagtgccaagatgaacaggaccatcattgttcgtaggaattaccttcactttgtcaagaagtaccagaggtatgagaagaggcactccaacatccccgcacacatttcaccatgcttccgcgtgaaggaaggagaccatgtgatcattggccagtgcagaccactatcaaagactgtgaggttcaatgtgctcaaagtcattccggcaggttcaaagagtggagcagtgaagaaagctttcacggctgcttaagatgatgatgagtaacccatctgagggcctgaaaagcctttgttataccattttgatgctgtctagcctttttcttttcatatctactgtgtactaggaacttgaatcacttccagtgcttgaaatsgtggaaatttcagarccctgtgttgctcagtaccatccgattttagtcgtatttgtatgaaatgtttgcatctatac

SEQ ID NO: 10059 - protein, 160 aa, Panicum virgatum
  misc_feature: Ceres CLONE 1721070
  misc_feature (74)..(143): Pfam Name: Ribosomal_S17 Pfam Description: Ribosomal protein S17
MGEQTEKAFLKQPKVFLCPKKAAKGNKPGKGGNRFWKNIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPLSKTVRFNVLKVIPAGSKSGAVKKAFTAA

SEQ ID NO: 10060 - DNA, 819 bp, Panicum virgatum
  misc_feature: Ceres CLONE 1721103
  misc_feature: Encodes the peptide sequence at SEQ ID NO. 10061
accactcggaaggcaacgacggcgagatgttcctgcggcggatcctgaccggcgggggcggcctggcggcgctgcgtgcggcgcgcgccgtcaagcagacgacggggatcgtgggcctcgatgtggtgcccaacgcgcgggaggtgctcatcggtctatacaagcgcacgctcaaggagatcgaggcggtccccaaggacgagggctaccgcaaggccgtcgagtccttcaccaaccaccgcctccagatctgccaggaggaggacgactggaagcgcatcgaggaccgaatcggatgcgggcaggtcgaggagctcatcgaggaggccgaggacgagctcaagctcatcgccaaaatgattgaatgggatccctggggtgttcctgaagactatgaatgcgaggtgattgaagatgacaccccaattccgaagcatgttcctcagcaccggcctgttgcgcttcctgaggagttcttcaagacactagatgctgtcaaatccgatcccgctctgcagggcgatgctcctcctcaagtgaaggcataaagatggggagtcttcacgagtatggcatttcacattttgctgtgttgagtagagactagtttctttgtgtcatttgccagcaatgtgcttgttgttccaagcagaataaatttctggtgagtactatcaaatagtgagtttcaactcagtgatttgacacagtaaatttgttgtccatgaatccttaatatccctaaaacatcatttactttgatgttaatcgatgttgacgaaatatcgaatgctagttgggctctggctcaatttcttg

SEQ ID NO: 10061 - protein, 173 aa, Panicum virgatum
  misc_feature: Ceres CLONE 1721103
  misc_feature (35)..(91): Pfam Name: ETC_C1_NDUFA5 Pfam Description: ETC complex I subunit conserved region
MFLRRILTGGGGLAALRAARAVKQTTGIVGLDVVPNAREVLIGLYKRTLKEIEAVPKDEGYRKAVESFTNHRLQICQEEDDWKRIEDRIGCGQVEELIEEAEDELKLIAKMIEWDPWGVPEDYECEVIEDDTPIPKHVPQHRPVALPEEFFKTLDAVKSDPALQGDAPPQVKA

SEQ ID NO: 10062 - DNA, 827 bp, Panicum virgatum
  misc_feature: Ceres CLONE 1721104
  misc_feature: Encodes the peptide sequence at SEQ ID NO. 10063
aaaaaactctaatagccggttcttaatctcaggtttgggggaaaaaaagcctcgcaaaccacaactctccgctgatttgggaggcgctcgagttttcaggtaaaccagaccattgggacacatggctcgtactaagcaaaccgctcgcaagtccactggaggcaaggctcctaggaagcaactagccaccaaggctgcccgtaagtctgcgcccacaactgggggagtgaagaagcctcaccgttaccgccctgggactgttgctcttcgtgaaatccgcaagtaccagaagagcactgacctgctcataaggaagcttccattccagaggcttgttagggagattgcccaggatttcaagactgatctgcgtttccagagccatgcggtgcttgccctgcaggaggctgcggaagcatacctggtgggtctgttcgaggacaccaacctgtgcgccatccacgccaagcgtgtgacgatcatgcctaaggacattcagctggctaggaggattcgcggcgagagggcttagtttcactgctctggtgtgcatctgttcgatgcaactgcttttgcgatgttggtgctttaacttctgtcagtgttttgaactctgaatagttatagtgttcgtttgtggtgctaggttaggtgctgctgcaatcttattatgttttagagtttaatcgcttggtaccgaatacatcttgtaagtgctggtttcatccatccacctgatgggtgtggtttctatctgaattctgaaccttgaactggtatgttaagcaagttgtgaacttggttcaatagtgtcaagctctagttgc

SEQ ID NO: 10063 - protein, 136 aa, Panicum virgatum; identical to SEQ ID NO: 9774
  misc_feature: Ceres CLONE 1721104
  misc_feature (58)..(132): Pfam Name: Histone Pfam Description: Core histone H2A/H2B/H3/H4

SEQ ID NO: 10064 - DNA, 426 bp, Panicum virgatum
  misc_feature: Ceres CLONE 1721121
  misc_feature: Encodes the peptide sequence at SEQ ID NO. 10065
agaagagaagtaggggagagagaggcgggggaggggagatcgcccgcgccgagcctctctcccccggcgacggccttcgcggccgcggacgtggaccccaggacgacggccgccgaaggccgcgtctggttccccgtggcgcccctccgcagcttcccggtgccgtctagcgggccggggacgccgccggggatctcccacgaggctgtccgacagcatcatgaaggcggaggagacgtgcgcggacgacaacgtctccggggagtgcgcggcggcgtgcgacgagatggcggagctcagcgccgcggcgagccacgcccgggacaagctcaaggacagcagcgacccgctcgataactactgccaggagaaccccgagaccgacgagtgccgcatctacgacaactagagcaagcctgctgtata

SEQ ID NO: 10065 - protein, 62 aa, Panicum virgatum
  misc_feature: Ceres CLONE 1721121
  misc_feature (2)..(62): Pfam Name: CP12 Pfam Description: CP12 domain
MKAEETCADDNVSGECAAACDEMAELSAAASHARDKLKDSSDPLDNYCQENPETDECRIYDN

SEQ ID NO: 10066 - DNA, 636 bp, Panicum virgatum
  misc_feature: Ceres CLONE 1721121-R
ccggcgcccccgtctacctcgccgccgtcctcgagtacctcgccgccgaggtcctcgagcttgcggggaacgcggcgcgggacaacaagaggaaccggatcatcccgcggcacgtgctgctggcgatccgcaacgacgaggagctcgggaagctgctggccggcgtcaccatcgcgcacggcggggtgctgcccaacatcaaccccgtgctcctccccaagaagtccgcctctgccgcctccaaggaaggcaaggagggtaaggagacgaaatcacccaagaaggccgccaccaagtcgcccaagaaggcggccgccgcgtaggtccgggcaaatggtggtgccctgtctctcgctatctccctgtccgctytgaactgaaacgctcctagctgtcgtcgtcatcatgatcttcgctgcttgtcgtggttgtttgtgtgtaattgcgtgccttttgctaaatcatcatgcactgtgtaggttgacactggtctagttcgatctgaaaaccacctgtttaggttcggaggagtgtgagctgtgaagggcaatggaggcgtgggaactgtgaatcattaggtgttgtttgtaataagattgtgaagatgtgtaaaatgatggacctccattctgtgct

SEQ ID NO: 10067 - DNA, 1065 bp, Panicum virgatum
  misc_feature: Ceres CLONE 1721129
  misc_feature: Encodes the peptide sequence at SEQ ID NO. 10068
aaatccaagctcctcctctcccctcgacctctcctggcagacatcgacgatccaaagatagcgcaaccgcctccctctccgatctccccctatttgaggatcccaccgagacctcctcttcttctcccacggcacgatcgaggacccaagaatccaattccagccgagaaagagaaagcaagcaggcaatttcgagagagatttaatctaaaggagcgatctttgaggcaagcagaggagaggatcaacatccatggcggcggtgatgatggcgaggcaggggcgggagctgcagcggtacagcgacagcaccggcgggcgcatcgtggtggggtgcatcccgtaccgcctcggcgccggcggcgaggtggaggtgctggtgatcagctcgcagaagaagggccccgcggggggcgtgctgatccccaagggcgggtgggagctggacgagtccatggacgaggcggcccggcgcgaggccgcggaggaggccggcgtggtcggcgagacgggccccgcgctggggcggtggtgctaccgcagccgcagctacgacgcgacctacgagggattcgtgctcccgctgcgcgtcacggcggagctggagcggtggcccgagatgggcgcccgccgccgggagtgggtctcccccgccgaggccgtcgcgcggtgcccgcacgcgtggatgcgcgaggcgctgcagcgcttcgccggcaccgtcgtcgccggggccggggccacggcggcgctcctcggctccgccctgtagccgggcgcgcgggctcggctccggcctcgcgcgtttttcggccggccaaacccggacgcgcgcgcgcggcgggaggctccggctgcacggagacatgggtaacggcagtagatcgacggtgtggcacggccatcgtactgtggccaaatcgatgtcacaaggacacggttttgtacagtcctggctggttggggattttctttcggaagaaacatgtaaatctgacgtactagtagttgacacaattcttcattgtgacacgagcaaggaatttaaaacggcagcaaagattcacc

SEQ ID NO: 10068 - protein, 171 aa, Panicum virgatum
  misc_feature: Ceres CLONE 1721129
  misc_feature (22)..(155): Pfam Name: NUDIX Pfam Description: NUDIX domain
  misc_feature: SWISSPROT Homolog: EC 3.6.1.52 Diphosphoinositol-polyphosphate diphosphatase
MAAVMMARQGRELQRYSDSTGGRIVVGCIPYRLGAGGEVEVLVISSQKKGPAGGVLIPKGGWELDESMDEAARREAAEEAGVVGETGPALGRWCYRSRSYDATYEGFVLPLRVTAELERWPEMGARRREWVSPAEAVARCPHAWMREALQRFAGTVVAGAGATAALLGSAL

SEQ ID NO: 10069 - DNA, 645 bp, Panicum virgatum
  misc_feature: Ceres CLONE 1721131
  misc_feature: Encodes the peptide sequence at SEQ ID NO. 10070
acacctcgcacagtagatatagacaaggcacatcgcatcacacacaatctggctgcacaaatggcgtctacggtggcgagccgctctaccccggcggcggcctttgccggcgcggacgtagtcccgaggaggaagatcgccggccgagtgaggttccccggggcacgccacgtcggcttcgagaggagggcgagcgggccggggactccgccggggatctgggacaaggtgtcagagagcatcgagaaggaagaggagacgtgcgcggacgaaaaggtctacggagagtgcgcggcggcgtgggacgaggtggaggaactcagcgccgaggcgagccacgcccgggacaagctcagggagaacagcgacccgctggagaactactgcaaggagaaccccgagaccgacgagtgccgcatctacgacaactagaccatgcctgtatccagtggcggagccagggggctggcaggggccatgccccccccccccccccggcgagcttggtgcaagtctacgatcatacagatctaatgatgactgaacaagctacaaaatgcaaagaataaacacatctactggaaatgtgaaaaaaaaaacaaataagctcgatctcggggggcccgcccaccctctaacttcgct

SEQ ID NO: 10070 - protein, 123 aa, Panicum virgatum
  misc_feature: Ceres CLONE 1721131
  misc_feature (53)..(123): Pfam Name: CP12 Pfam Description: CP12 domain
MASTVASRSTPAAAFAGADVVPRRKIAGRVRFPGARHVGFERRASGPGTPPGIWDKVSESIEKEEETCADEKVYGECAAAWDEVEELSAEASHARDKLRENSDPLENYCKENPETDECRIYDN

SEQ ID NO: 10071 - DNA, 654 bp, Panicum virgatum
  misc_feature: Ceres CLONE 1721131-R
cggccgtttaatttccttagcttgcgctgcagctgaaggaccgtaaaatgttgaggttatcgttcattagagagtaatgtgtaatgctcgatcgatcgtcgcgtcgcaggcttcgtgcggggcggccgggtgtcggcgaggaacccgctgatgacgaggaacctggagaggaacggcaggatcacctgcatgacgttcccccgggactggctgcggagggacctgagcgtgatcggcttcgggctcatcgggtggatcggcccctccagcgtcccggtcatcaacggcaacagcctcacggggctcttcttctccagcatcggccaggagctcgcccacttccccacgcccccgcccgtcacctcccagttctggctgtggctggtgacgtggcacctgggtctgttcatcgtgctcaccttcggccagatcggcttcaagggcaggaccgaggactacttcgagaagtgagaagaagcaagcggctgagctcgatctcgatctgctgcccgcattccaactttgctttgcatagggctctgatcgatttgcccccccccccgccgagcttggtgtaagtctgatataaaacatcaacaatgatccccgtacaagtataaaattaaagaatacaataatctactgtagacatag

SEQ ID NO: 10072 - DNA, 609 bp, Panicum virgatum
  misc_feature: Ceres CLONE 1721135
  misc_feature: Encodes the peptide sequence at SEQ ID NO. 10073
aactcggagccccggcggaagaccacgccctcgcttctgaaggtctgatctccggccggtgcgaccacaggcgaatcgaagatgcagcagggggacggcacggaggcgcaggtgacgtgggaggaccaacagaatatcaaccgcttcggccgcctcaacaaccgcctccacgagctccaggacgagatcaagctcgccaaggaagcaaatgaaaacctagaggatgctgggaacgagctcatcttgtcagatgaagatgtggtacggttccagattggggaagtgtttgcccacatgccaagggacgacgtcgagactaggctggagcagatgaaagcggacgcggcgaagaagctggagaggctggaggaggagaaggaatccatcctcgcccagatggccgagctgaagaaaatactgtacggaaagttcaaggatgccatcaacctggaggaagattagcagcgagtacttgagctgttgcccgttcagttgtacgtcgctttttttagtgctgtttttcgctagcttgcgtaacagaagacagttgagcctgctgtatttaaaaaaaaaaacagaagacagttgagcttcggaagcttttttacc

SEQ ID NO: 10073 - protein, 126 aa, Panicum virgatum
  misc_feature: Ceres CLONE 1721135
  misc_feature (16)..(120): Pfam Name: Prefoldin_2 Pfam Description: Prefoldin subunit
MQQGDGTEAQVTWEDQQNINRFGRLNNRLHELQDEIKLAKEANENLEDAGNELILSDEDVVRFQIGEVFAHMPRDDVETRLEQMKADAAKKLERLEEEKESILAQMAELKKILYGKFKDAINLEED

SEQ ID NO: 10074 - DNA, 659 bp, Panicum virgatum
  misc_feature: Ceres CLONE 1721137
  misc_feature: Encodes the peptide sequence at SEQ ID NO. 10075
atatgagaagaagctgaagccattgccaggcctcaaaggagttaatgttgagagcttggagaagacatctggcgcaaggcatgttgaagggcctcaagacatgaaggtagacgttcctgaggaagtgaagaagcaaaaggcaaagaagaggaagcggaagcctagatacccgaagggctttgatccagcaaacccggggccgccaccggatcctgagagatggctgcccaggagagagcgatccagttaccgtccaaagaggaaggataagagggctcaggtcagaggttctcaaggagctgtaactagagagacagcggctgccagtggttcttcaaaaggaagccaaaacaccagttcatcaaagactccagcggcaaacaccgatcagccaaaggctagcaacaaatccaggaagaagaagtcgaggtcttaggtgatttttttaagttaaacaaactgacagtgcaaaaggacatgcccatttaccttgttgacttgcaattttttggttggattgcttgcgtatttgctttgcttttgcagtttgtttaaagtgacttgaaaattttgttgagctcaatcgcgatggaacgctccactagatttctgttctctttataagtttatatacagtacttttgttgtacttttaactc

SEQ ID NO: 10075 - protein, 144 aa, Panicum virgatum
  misc_feature: Ceres CLONE 1721137
  misc_feature (24)..(85): Pfam Name: SRP72 Pfam Description: SRP72 RNA-binding domain
YEKKLKPLPGLKGVNVESLEKTSGARHVEGPQDMKVDVPEEVKKQKAKKRKRKPRYPKGFDPANPGPPPDPERWLPRRERSSYRPKRKDKRAQVRGSQGAVTRETAAASGSSKGSQNTSSSKTPAANTDQPKASNKSRKKKSRS

SEQ ID NO: 10076 - DNA, 627 bp, Panicum virgatum
  misc_feature: Ceres CLONE 1721159
  misc_feature: Encodes the peptide sequence at SEQ ID NO. 10077
agatgcgcaaacaccgaatcgccggaccggtcgctgccctgctcgccctcaccctcaccctctcgctcccccgcagcgcgcaagaggagccgcccatggccgaccgcgggccgctggctggcggcgtcacggacgcgccgcagaacgacaacgacatccacctccaggagctcgcccgcttcgccgtcgacgagcacaacaagaagaccaatgctctcctggagttcgagaagcttgtgaaggcgaagacgcaagtggttgctggaaccatgtactatctcactgttgaggtgaaggatggggaagccaagaagctctatgaagctaaggtctgggagaagccatgggagaacttcaaggagctgcaggaattcaagcctgtggaagagagtgctagcgcttaaggatccctcgtcttccacgtgcaattgctgcctgcagcgctaaacagacttgcagaataaggagctggatcggatgtaatagctgtgtcgttgtgagctccgttgtgtaatatcgtatgaacaccttgccctttgtgtaatatcatgaatgacagtgccctttgtgtataactaaataactgcgctgagttttcattagtacgagtcgcgacggaattctcat

SEQ ID NO: 10077 - protein, 133 aa, Panicum virgatum
  misc_feature: Ceres CLONE 1721159
  misc_feature (40)..(128): Pfam Name: Cystatin Pfam Description: Cystatin domain
MRKHRIAGPVAALLALTLTLSLPRSAQEEPPMADRGPLAGGVTDAPQNDNDIHLQELARFAVDEHNKKTNALLEFEKLVKAKTQVVAGTMYYLTVEVKDGEAKKLYEAKVWEKPWENFKELQEFKPVEESASA

SEQ ID NO: 10078 - DNA, 1128 bp, Panicum virgatum
  misc_feature: Ceres CLONE 1721167
  misc_feature: Encodes the peptide sequence at SEQ ID NO. 10079
agcgtttgcgtttccgtgtccagcaacagacgagcaagaaagagtatcggaactcggaagaggacagcgcacggaaagcgaggagaggagggagaggtcgcatcggacgggggcgaagatgctggcggtgttcgatcccacggtggccaagtgcccggagggcctccgcagcccgccggtggccggcgctaccgctgccgcggccggcggcgtgggcgcgctgatgaagggcttctccgccgcgcacgacggcgccgtcaccgtcagcctgggcccctccggcgcgctggcatactcggcggccaaccagagccccctcgtccccaggttgtttggtgctgtgaatgacatcttctgcctgttccaagggcacattgagaacattgcaaacctgaagcagcactacggcctgagcaagactgcgaacgaggtgaccatcctcatcgaggcctacagaaccctgagggacaggggtcccgtccctgccagccaggtcgtgagagatctaagtggaaagttcgcgttcatcttgtacgacacgctgtcaaagtccaccttcgttgccgctgatgctgatggcagcattcccttcttctggggcgtcgactctgaggaccacctcgtattctctgacgatgctgggctactcaagaccggctgcggcaactcgtttgcgccattccccaaaggttgcttctacaccacctccggcgggctgcagagctacgagcacccactgcacgaggtcaaggccgtgccgcgcgtggacagccagggccagatgtgcggctccaccttcaaggtcgacagtgaggccaagaagaagcaggacgccagcatcccccgcgtcggcagcgccgctgactggtcgaaccagttctgaccgccggcttcttccatcgtctttccccggcatctttgggatgtcgtcggtgtatctgatgaaccgctgagacgctgagttctgctacgtctcttacgcatttgttgaacgctgtgagaccctcagatcgcgttttatctacgttgtcttggtgctgatactaatcatacggagtgtcccaggtggtggtagatgtatctgcaaaatctatctcccatgtttcaataaagctgaataagaggctc

SEQ ID NO: 10079 - protein, 254 aa, Panicum virgatum
  misc_feature: Ceres CLONE 1721167
  misc_feature: SWISSPROT Homolog: EC 6.3.5.4 Asparagine synthase (glutamine-hydrolyzing)
MLAVFDPTVAKCPEGLRSPPVAGATAAAAGGVGALMKGFSAAHDGAVTVSLGPSGALAYSAANQSPLVPRLFGAVNDIFCLFQGHIENIANLKQHYGLSKTANEVTILIEAYRTLRDRGPVPASQVVRDLSGKFAFILYDTLSKSTFVAADADGSIPFFWGVDSEDHLVFSDDAGLLKTGCGNSFAPFPKGCFYTTSGGLQSYEHPLHEVKAVPRVDSQGQMCGSTFKVDSEAKKKQDASIPRVGSAADWSNQF

SEQ ID NO: 10080 - DNA, 642 bp, Panicum virgatum
  misc_feature: Ceres CLONE 1721171
  misc_feature: Encodes the peptide sequence at SEQ ID NO. 10081
aacaaatcatcacagtgagtcaccccctctcgcccaccaccacaccagacctccgacggcggcggcgaccccagtcgagaacacgaaggcgacggcgatggcgacggcgctcaaccgcggcctccgctccgggatccgcctcctcgccgccggcgccgaggcgtccaagccagcttctcgtggattccatgccactggtgtgaagagaatgggagggcacggccatgatgagccgtactatctccatgccaagcacatgtacaacttgcacaggatgaagcatcaggggttgaaggtgactctttccgtgctgggagcagttagcatcggcgttggagtccctgtgtacgcagtcattttccagcagaagaagaccgcctcaggttgagcgatcatgctctcaaagcctacatatcggagacttattttcaacaagattttgtgaagttaaaagcttggacttcattcttaccttgcttgttgcttattaccatgttttcttacgagaagttgtattgtaacctcgtttcttgccattatcagtaggacacaactttctgttaataatatcgtggcttgaactttccaggctgtggagaaacctcagcagtgatatcatttgttgttgtgcggtttcttgtc

SEQ ID NO: 10081 - protein, 96 aa, Panicum virgatum
  misc_feature: Ceres CLONE 1721171
  misc_feature: Functional homolog of the protein sequence given in SEQ ID NO 50154
  misc_feature: Useful for making plants with modulated nitrogen use efficiency
MATALNRGLRSGIRLLAAGAEASKPASRGFHATGVKRMGGHGHDEPYYLHAKHMYNLHRMKHQGLKVTLSVLGAVSIGVGVPVYAVIFQQKKTASG

SEQ ID NO: 10082 - DNA, 854 bp, Panicum virgatum
  misc_feature: Ceres CLONE 1721199
  misc_feature: Encodes the peptide sequence at SEQ ID NO. 10083
cagccccaacccgcccatccccagacgccgcccccagacccccgcctctcgccgccacctcctcgcggcccgcctccgccacccgcctgccgccgcaagcccgcagcgccgccacccactggcaagccacacagccccctttccccacctcgatctcgctcgcctagggtttcgtctcgccgacctcctccaccaccgccaagatgccgaagaacaagggtaagggaggcaagaaccggaagcggggtaagaacgaggcggacgacgacaagcgcgagctcgtcttcaaggaggacgggcaggagtacgcgcaggtgacccgcatgctcggcaacggccgctgcgaggccatctgcgtcgacggcacgcgccgcctctgccacatccggggcaagatgcacaagaaggtctggatcgcggcgggcgacatcgtcctcgtcggcctccgcgactatcaggacgacaaggccgacgtcatcctcaagtacatgaacgacgaggcccgcctgctcaaggcctacggcgagctccccgagacgctcaggctcaacgagggagtcgacgtcgacgggcccgaggacggcgaggagggcagcgactacatccagttcgaggacgaggacatcgacaaaatctaagattcttgtttctcctcgcggttactttcttgtatgcgacatattgttatgtgttctagtggcatgtggtgatatggtttaggctggctgttatggatttgcacttttgccagcataatctggtgatgcaacgagatgtggttaaataatcgcggattaatatcgttccaatctggtacatgctgttattacaacaagttctattttggtgctgct

SEQ ID NO: 10083 - protein, 144 aa, Panicum virgatum
  misc_feature: Ceres CLONE 1721199
  misc_feature (30)..(94): Pfam Name: eIF-1a Pfam Description: Translation initiation factor 1A / IF-1
MPKNKGKGGKNRKRGKNEADDDKRELVFKEDGQEYAQVTRMLGNGRCEAICVDGTRRLCHIRGKMHKKVWIAAGDIVLVGLRDYQDDKADVILKYMNDEARLLKAYGELPETLRLNEGVDVDGPEDGEEGSDYIQFEDEDIDKI

SEQ ID NO: 10084 - DNA, 838 bp, Panicum virgatum
  misc_feature: Ceres CLONE 1721210
  misc_feature: Encodes the peptide sequence at SEQ ID NO. 10085
agagcgtgttgcgccggcctagctcttgggtcgtcaagtctccgttcgttctttctttctccaaccggcagctgatctcctgtgttaatcccgaccggagctgcctgcgatgggcatcgtcgacgtcgtctccgtgttctgcaccctgccgaggactcgccggcacctcaagaagaggaagcagttccagacggtggagatgaagatgcggatcgactgcgaggggtgcgagcgcaaggtgcgcaaggcgctggagggcatggagggcgtgagctccgtggaggtggcgccgcggcagcacaaggtgacggtggccgggtacgtggacgccggcaaggtgatgcggcggttggcgcggcggacgggcaagcgcgtggagccgtggccctacgtgccctacgacgtggtggcgcacccctacgcgccgggcgcctacgacaagaaggcgccgcctgggtacgtgcgcaacgtcgtcgccgaccccgccgccgcgccgctcgccagggcctcctccaccgaggtcaggtacaccgccgccttcagcgacgagaaccccaacgccgcctgcgccgtcatgtaggagtagcagctagccggggaggagtagtagatagagtagcaagttgctgctggtgtttgttgctgttggagcattttttttcctactttatattctctgctacgcttgtgcgtgctctagttggatgttgatttggaaatccttagtggcagtaagtaaggcttgtaaaggctagctagtagtagtgtttgttgccttgttgatctctggctgtgttcacttctaaaatttctcttcaaacttcactatttacctatc

SEQ ID NO: 10085 - protein, 156 aa, Panicum virgatum
  misc_feature: Ceres CLONE 1721210
  misc_feature (29)..(91): Pfam Name: HMA Pfam Description: Heavy-metal-associated domain
  misc_feature: Functional homolog of the protein sequence given in SEQ ID NO 50155
  misc_feature: Useful for biocontainment applications
MGIVDVVSVFCTLPRTRRHLKKRKQFQTVEMKMRIDCEGCERKVRKALEGMEGVSSVEVAPRQHKVTVAGYVDAGKVMRRLARRTGKRVEPWPYVPYDVVAHPYAPGAYDKKAPPGYVRNVVADPAAAPLARASSTEVRYTAAFSDENPNAACAVM

SEQ ID NO: 10086 - DNA, 834 bp, Panicum virgatum
  misc_feature: Ceres CLONE 1721239
  misc_feature: Encodes the peptide sequence at SEQ ID NO. 10087
ctcgtttccacggcatccgcacgccgccggcgagcgggcgagcggcgagaacctcggctcacagaaggaagggtacgaggagagggggctgtaagaggatggggtcggcgttgctgccgacgctgcggctgaagcgggaggtggacgctgccatccgcgacaccctcgacaaggtcctcgtccttcgattcggccgcaccgccgacgccgcctgcctccacctagactacatccttgctaaatcttcatgggacatatccaagtttgcttcggtagcattggttgatatggattctgaggaaattcaagtttacattgattattttgatattacattggttccagcaaccatatttttcttcaatgcccatcacatgaaaatggattcagggacacctgatcacacaaagtggataggctctttcagcattaagcaagactttattgatgtaattgaggcaatttttagaggtgcgatgaaaggtaaattgatagtgtcttgcccccttccacctgagaggatacccagattccagcttcttttcaaggatgtctgaggaaactatagctcgtcaactctcacatgcttaatcgttgtcttcgtcatggtatgaaaagaaaatgttttactttactatacacaaccagctacgtagctcatgtactgtttcttttagctacctagctcatgtattatttctctttcttctgcatcacgagtgatacggcagatgatctgccgaaggatatggatctgtccatggccagctgaagtttgtgaagaataatcatgagctagtacccgtaaagatatctttcatctcacttccttac

SEQ ID NO: 10087 - protein, 152 aa, Panicum virgatum
  misc_feature: Ceres CLONE 1721239
  misc_feature (5)..(139): Pfam Name: DIM1 Pfam Description: Mitosis protein DIM1
MGSALLPTLRLKREVDAAIRDTLDKVLVLRFGRTADAACLHLDYILAKSSWDISKFASVALVDMDSEEIQVYIDYFDITLVPATIFFFNAHHMKMDSGTPDHTKWIGSFSIKQDFIDVIEAIFRGAMKGKLIVSCPLPPERIPRFQLLFKDV

SEQ ID NO: 10088 - DNA, 793 bp, Panicum virgatum
  misc_feature: Ceres CLONE 1721245
  misc_feature: Encodes the peptide sequence at SEQ ID NO. 10089
atgcacagacgacagcgagccaagtgtactactcccagtgaagccgcactagctagccacaccagcagcttgacaagctagctagctagctaggccgcagccatgtcggaggagaagcaccaccacttcttccaccaccacaagaaggacgaagaggagcagcccgccggcgggtactcggaggtggtggccgccggcgagagcgagtacgagaggtacaagaaggaggagaaggagcacaagcacaagcagcacctcggcgaggccggcgccgtcgccgccggcgccttcgcgctctacgagaagcacgaggcgaagaaggacccggagcacgcgcaccggcacaagatcacggaggagatcgccgccacggcggccgtcggcgccggcggctacgccttccacgagcaccacgagaagaagaaggaccacaaggacgccgaggagaccagcggcgagaagaagcaccaccacctcttcggctgacccgccggcgagcgagctccggcccggccgccgcgcacccgcctgcttgctccaataattgtggccatgatttcgcaataagtcccttccggacccttagcttgcttgcttgtgtgagactgagaggtggggcccgcgcgtcgaggtgtgttccggcctgtacgtgcttgatttttctttgcgtccgtaattgcgttgaataaccgggagcgatgcacgtgtggctcccagtctgtctgtctgtggttgagtgtctgtatcctgatgatcaactcgtggaagtttttacacccgtttttccgtgcag

SEQ ID NO: 10089 - protein, 127 aa, Panicum virgatum
  misc_feature: Ceres CLONE 1721245
  misc_feature (37)..(116): Pfam Name: ABA_WDS Pfam Description: ABA/WDS induced protein
MSEEKHHHFFHHHKKDEEEQPAGGYSEVVAAGESEYERYKKEEKEHKHKQHLGEAGAVAAGAFALYEKHEAKKDPEHAHRHKITEEIAATAAVGAGGYAFHEHHEKKKDHKDAEETSGEKKHHHLFG

SEQ ID NO: 10090 - DNA, 844 bp, Panicum virgatum
  misc_feature: Ceres CLONE 1721250
  misc_feature: Encodes the peptide sequence at SEQ ID NO. 10091
gtctcggccgcctgctttttccgcgagctggggtttcagcggcgcgaagggggaagagggggagagagacgaggacgggaaggggaagatgagccggagcctgggaatccccgtgaagctgctccacgaggcggcgggccacgtggtgacggtggagctcaagaccggcgaggtgtaccgggggtccatggtcgagtgcgaggacaactggaactgccaactcgagaacatcaccttcaccgccaaggatgggaaggtgtcgcagctggagcacgtcttcattagaggaaacagagtgagatttatgattataccggatatgctcaagaacgctcctatgttcaagcgtttggaagcgaggattaggggcaaaggatcagctgttggagttggccgtggtcgtgcggtcgcgatgcgtgctcgggctgctgctgggcgtggtggtggtcccgtggggcgaggtggcgcacctccggtgaggaggtagatttcttcatgaggaggttgctgtcttcagtatcagaaccaacgttgtctcagtaattaaaactggtgcctcctgtatgatctatctgctcaagggacagatgcggcttgttgttagtgccgatgtgatgtgttaacggtgggcagagatagaagcttgaatacaatctgttcgtcggtctgtacgtttatatcccgtaagaaattagctttcgttgaagtccggcagtattcgtggcagctgttttgatttgtcagaatgacatgttttatctgggtattttgtttgattcatattcttcattggccccttgggcatcatcgttggcattattagggcgagtgagatgccttgtcc

SEQ ID NO: 10091 - protein, 132 aa, Panicum virgatum
  misc_feature: Ceres CLONE 1721250
  misc_feature (10)..(75): Pfam Name: LSM Pfam Description: LSM domain
MSRSLGIPVKLLHEAAGHVVTVELKTGEVYRGSMVECEDNWNCQLENITFTAKDGKVSQLEHVFIRGNRVRFMIIPDMLKNAPMFKRLEARIRGKGSAVGVGRGRAVAMRARAAAGRGGGPVGRGGAPPVRR

SEQ ID NO: 10092 - DNA, 736 bp, Panicum virgatum
  misc_feature: Ceres CLONE 1721259
  misc_feature: Encodes the peptide sequence at SEQ ID NO. 10093
ggaggcgcgcgaccccatcggcmgmttyrccgccacggcaccgcaaccgcaagcccggacggctataaagacgagcctctcctccaagccggcggcgatgaagaagacaagctccccgctcctccaacctcgtagccctctcctgatcctcctcttcctgacagcagcagccatggcggccgagccggagcagaacgcggcccccgcggcggcggcgcaggaggcggccgtgcacatcgtgtacgtggaccgccccgagggcgccgacccggaggagttccacctccgcaccctcacccccgtcctcggcagcgagcagaaggccaaggacgcggtgctctaccactacaagcacgccgccagcgggttctccgcgaagctcaccccccagcaagtcgaggagctaaagaagcaaccatgtgttcttcaggttgtgccgagccagacctaccatctccatggacctgaatctggcactcaccagggcacgacgcgcaccatgggccttatgtgaaggcataaccgagaggactctgttctagtacggcagcggcctcactagtgaatgtacaatatataaataagagatgtatcgaatgtacctacttctacacaggttcaggcctgttttgaagtgtgtaatgctgtgttgcgtactacatgtttgcttaatgcaatggcagacgactatattatctagattcaaaagaccttttatgaatctagaagtgcacag

SEQ ID NO: 10093 - protein, 138 aa, Panicum virgatum
  misc_feature: Ceres CLONE 1721259
  misc_feature (44)..(121): Pfam Name: Subtilisin_N Pfam Description: Subtilisin N-terminal Region
  misc_feature: SWISSPROT Homolog: EC 3.4.21.25 Cucumisin
MKKTSSPLLQPRSPLLILLFLTAAAMAAEPEQNAAPAAAAQEAAVHIVYVDRPEGADPEEFHLRTLTPVLGSEQKAKDAVLYHYKHAASGFSAKLTPQQVEELKKQPCVLQVVPSQTYHLHGPESGTHQGTTRTMGLM

SEQ ID NO: 10094 - DNA, 965 bp, Panicum virgatum
  misc_feature: Ceres CLONE 1721262
  misc_feature: Encodes the peptide sequence at SEQ ID NO. 10095
tgcatctcgcttcgatttcgatctcctgcctcgcattgatctcctagctgcttgctcgtttcgctcctctttaattatttgctcgatcgaacgacggcaatggcgtccggtggcgcgtcgctggccttggccgccctgctcctcgtgggctgcgtcgcggcggcggcggcgaccaagtacaccgtcggcgacacctccggctggacgaccaccggcgattacgccacctgggccagcggcaagaagttcaaagtcggcgacactctccagttcacgtacgccggcggcgcgcacacggtggacgaggtgagcgcggcggactacgccgcctgctcctccagcaacgcgctccgcagcgacagcgccggctccaccaccgtgaccctcaagacggccggcaagcactacttcatctgcggcgtcgcgggccactgcagcagcggcatgaagctcgtggtggacgtcgccgcggccaagacgtcgcccgcccccgttccggcgccggcgccggacgccgcggacaccaccccggacgccactcccgccacgaccacgacccccaagtcgccctcgagctccggcggcgccacggccaagaccccggtcacggtcctctcgccgccggccaagaagtccacctccggcgccgccgggctcagcgccgccgcgtgggccggcgtgggcctcgccgggctcgtggccgtgcacctcggcgcgttctagggcccacggccagggcggaggcactgcttgcttgttttattctcgttttattttcatattaaataggatgcacgccatcgattcacgtattggttgaggacctgagaggtttcttttgatccaggcaactagtgcttttgctacgcggcgctggtggcagatagttgatggatacttggatattatgctcttgttatcatattcttttcatgccttttttatcaatatgtttcacttctatc

SEQ ID NO: 10095 - protein, 207 aa, Panicum virgatum
  misc_feature: Ceres CLONE 1721262
  misc_feature (35)..(116): Pfam Name: Cu_bind_like Pfam Description: Plastocyanin-like domain
MASGGASLALAALLLVGCVAAAAATKYTVGDTSGWTTTGDYATWASGKKFKVGDTLQFTYAGGAHTVDEVSAADYAACSSSNALRSDSAGSTTVTLKTAGKHYFICGVAGHCSSGMKLVVDVAAAKTSPAPVPAPAPDAADTTPDATPATTTTPKSPSSSGGATAKTPVTVLSPPAKKSTSGAAGLSAAAWAGVGLAGLVAVHLGAF

SEQ ID NO: 10096 - DNA, 750 bp, Panicum virgatum
  misc_feature: Ceres CLONE 1721273
  misc_feature: Encodes the peptide sequence at SEQ ID NO. 10097
gcacgcccgcaggccacacacctacaaacctcccgtcccccgtctcgcactgtcgctcccaacaaccactcctctcgttccgtcccagcctccgcctcgtttcgccgtcgtcgtcgagtggtagagagaagagatggcgggccgtggcaaggcgatcggtgcgggcgcggcgaagaaggcgacgtcgaggagctctaaggccgggctccagttccccgtcggtagaatcgccaggttcctcaaggccggcaagtacgccgagcgcgtcggcgccggcgcccccgtctacctcgccgccgtcctcgagtacctcgctgctgaggttcttgagctggccggaaacgccgcaagggacaacaagaagacccgtatcgtgccgcgccacatccagcttgccgtccgcaacgacgaggagctctcgcgcctcctgggcacggtgaccatcgctagcggtggtgtcatgcccaacatccacaacctactgctccccaagaaggcgggcggcggcagcgccaaggctgtggccggcgatgaggactagatccctgactgcaccgtccttcgggtggtcgtgcttcttgtggatgccgcgtatcacttgtgcttgtgtagtagtgtcttctagactcgcctagtagggaggttgtatgtgtgtgcctgtaccgatgctaaaactagtttactcttggttcgctaaggattagttttttctgtatttgttgccatgtctctataaaagatccatcgttc

SEQ ID NO: 10097 - protein, 135 aa, Panicum virgatum
  misc_feature: Ceres CLONE 1721273
  misc_feature (19)..(92): Pfam Name: Histone Pfam Description: Core histone H2A/H2B/H3/H4
MAGRGKAIGAGAAKKATSRSSKAGLQFPVGRIARFLKAGKYAERVGAGAPVYLAAVLEYLAAEVLELAGNAARDNKKTRIVPRHIQLAVRNDEELSRLLGTVTIASGGVMPNIHNLLLPKKAGGGSAKAVAGDED

SEQ ID NO: 10098 - DNA, 914 bp, Panicum virgatum
  misc_feature: Ceres CLONE 1721279
  misc_feature: Encodes the peptide sequence at SEQ ID NO. 10099
accacagctcagctcacacactcatcatcagtcatctttgctcactttgctcgagcgcttcccttccgaccctgagctctgccatcgcatcgttagagagacgcagagcgaaacacatggcggctcagggaaggggcagtgctgctcgtggcagcagcagcggcgccgccgcggcggccctggtcctcctctgcgtgctcctccacggcgagatcgccgagtcggcggtgtacaccgtcggcgaccgcggcggctggagcttcaacaccgccagctggcccagcggcaagcgcttccgcgccggcgacgtgctcgtgttcaagtacagcccgaaggcgcacaacgtggtgcccgtgagcgcggccgggtacagctcgtgcgccgcgcccaggggcgccagggcgctcacctccggtaacgaccgcgtcacgctgaagcgcggcgccaactacttcatctgcagctttcccggccactgccaggccggcatgaaggtcgccgtcaccgccgcgtgaggcccggccggccgccgccaacggcgctgcttatagcttattaattttccccttcagaaaaaaagagagaataataaagcgctgtaactaattactccgtttggtgtcataccgtgtcgtcggcggctcgtcgcgcacgtaagtacgtctcggtgcgtgcgtgttgctagttggcacgttggcactgcagagagggacacacattggagcaatgtactagcgtctgtgttgacgcgagcgagtttatacggctgcgtttgtcagcgctgcatcgatgacgtacaatacaactttggcaattcaataatcaatacggtgttttctgttgtgtatcgtcgcatctcgtctggtaaatgctagtacctccgttcataaatataaaaaacgccgtatattcgg

SEQ ID NO: 10099 - protein, 132 aa, Panicum virgatum
  misc_feature: Ceres CLONE 1721279
  misc_feature (47)..(125): Pfam Name: Cu_bind_like Pfam Description: Plastocyanin-like domain
MAAQGRGSAARGSSSGAAAAALVLLCVLLHGEIAESAVYTVGDRGGWSFNTASWPSGKRFRAGDVLVFKYSPKAHNVVPVSAAGYSSCAAPRGARALTSGNDRVTLKRGANYFICSFPGHCQAGMKVAVTAA

SEQ ID NO: 10100 - DNA, 1041 bp, Panicum virgatum
  misc_feature: Ceres CLONE 1721289
  misc_feature: Encodes the peptide sequence at SEQ ID NO. 10101
ttttcggtcggtaggttgattacttgtgaggatgttggcggtgttcagcggcgaggtggtggaggtgccggcggagctggtggcggccggcagccggacgccgtcgcccaagacgagggcgtcggagctggtcagccgcttcctggggagctcggagccggctgtgtccatccagctcgccgacctcgggcacctcgcctactcccacaccaaccaggccctcctccgcccaaggtcgttcgcggcaaaggacgagatattctgtctgttcgagggtgtgctggacaacctggggcggctgagccagcagtacgggctgtccaagggcaccaacgaggtggtcctcgtcatcgaggcctacaagacactgcgggaccgggcgccatacccggccagcttcatgctctcgcagctcaccggcagctacgccttcgtgctcttcgacaagtccaccaactccctgctcgtcgcatctgatcccgagggcaaggtgccgctcttctgggggatcactgcggatggctgcgtcgccttctctgacgacattgacatgctcaaaggatcatgtggcaagtcactagcacctttcccacaaggttgcttctactccaatgctcttggaggcttgaagtgctatgagaaccctaagaacaaggtgactactgttcctgcaaacgaagaagaaatctgtggtgcaactttcaaggtggaaggctctacagtcctctctgcgctgcattaggaggagatgttcgtgcggaggcgggtcaatgcaaaactctgtccatggcggtgtatcataatggcaaggctgcatgcaactggtctacctgtatcatcccccgtaaaaagagaagtactgccagcgtagcaagaacttcatcagtgttgtttgttgttgatgtgtgtgtctgaatctgctgtatgcatgtatcccttgttgctcaatttatatggaacttgagaccgggttctagtcgaccagttgcatggatgaacgaagttgtgtatctgcagcaaataattgaactttacttcttc

SEQ ID NO: 10101 - protein, 236 aa, Panicum virgatum
  misc_feature: Ceres CLONE 1721289
  misc_feature: SWISSPROT Homolog: EC 6.3.5.4 Asparagine synthase (glutamine-hydrolyzing)
MLAVFSGEVVEVPAELVAAGSRTPSPKTRASELVSRFLGSSEPAVSIQLADLGHLAYSHTNQALLRPRSFAAKDEIFCLFEGVLDNLGRLSQQYGLSKGTNEVVLVIEAYKTLRDRAPYPASFMLSQLTGSYAFVLFDKSTNSLLVASDPEGKVPLFWGITADGCVAFSDDIDMLKGSCGKSLAPFPQGCFYSNALGGLKCYENPKNKVTTVPANEEEICGATFKVEGSTVLSALH

SEQ ID NO: 10102 - DNA, 692 bp, Panicum virgatum
  misc_feature: Ceres CLONE 1721301
  misc_feature: Encodes the peptide sequence at SEQ ID NO. 10103
aaaacgccactcctccctctcctctcgtctcggcctcaggatcagcgggatcggagcagcagcaatggcgatggcgtcgtcgagcgggctccggagctgcagcgccgtgggcgtgcccagcctgctggcgccgtcgtcccgctccggccggctgccgttctgcgccagcgccaccacctcgggccgcgtcaccatgtccgccgagtggatgcccggccagccccgccccgcccacctcgacggctcctcccccggggacttcggattcgaccccctcggcctcgccaccgtgccggagaacttcgagcggttcaaggagtcggaggtgtaccactgccgctgggccatgctcgccgtgcccgggatcttggtgccggaggcgctggggcttggcaactgggtgaaggcgcaggagtgggcggccgtgcccggcgggcaggccacgtacctgggcaacccggtgccgtggggcactctgcccaccatcctggtgatcgaattcgaggcgacgggcagacgggctgcgctgggagagtgtactggatagatcgatggtgttttctgtgtgtggattactgggcactgcctgcgtgcgtgcagcaactgtacaacgaccgacggcggcgacgactttccggccggccgggaaccacttgtccttgtgtaatgtaaagcttgttgatgtagcggct

SEQ ID NO: 10103 - protein, 160 aa, Panicum virgatum
  misc_feature: Ceres CLONE 1721301
  misc_feature (53)..(158): Pfam Name: Chloroa_b-bind Pfam Description: Chlorophyll A-B binding protein
MAMASSSGLRSCSAVGVPSLLAPSSRSGRLPFCASATTSGRVTMSAEWMPGQPRPAHLDGSSPGDFGFDPLGLATVPENFERFKESEVYHCRWAMLAVPGILVPEALGLGNWVKAQEWAAVPGGQATYLGNPVPWGTLPTILVIEFEATGRRAALGECTG

SEQ ID NO: 10104 - DNA, 666 bp, Panicum virgatum
  misc_feature: Ceres CLONE 1721320
  misc_feature: Encodes the peptide sequence at SEQ ID NO. 10105
attccgctttgagcttgcttgcagctccagctcccctcgtctcttggtggctacgccatggccaccgtagtcctgatgagctgcagcctccgcgcgccggcctgcagcggcttatctggcgtccgcgccgccccggcaccggccatcgtcgccatgcccgccgccaagcagcaggttgttggccgcggcgccaggctgcgcgcgcaggccacctacaacgtgaagctcatcacgcccgacggcgaggtagagctgcaggtgcccgacgacgtgtacatcctggaccaggccgaggaggaagggatcgacctgccctactcgtgccgcgcggggtcctgctcctcctgcgccggcaaggtcgtctccggcagcgtcgaccagtccgaccagagcttcctcgaagacgaccaggtcgccggcggctgggtgctcacctgcgccgcctaccccacctccgacgtcgtcatcgagacgcacaaggaggaggagctcacctcctcttcgtaatccgatccagtatatgcggctttcattgcttattaattatctcagctcccttgattatatatatatatatatatatatatatatatatatatatatatatatatatatatatatatatatatacatacacatatacatacatgcatgcttatacaatcg

SEQ ID NO: 10105 - protein, 149 aa, Panicum virgatum
  misc_feature: Ceres CLONE 1721320
  misc_feature (58)..(133): Pfam Name: Fer2 Pfam Description: 2Fe-2S iron-sulfur cluster binding domain
MATVVLMSCSLRAPACSGLSGVRAAPAPAIVAMPAAKQQVVGRGARLRAQATYNVKLITPDGEVELQVPDDVYILDQAEEEGIDLPYSCRAGSCSSCAGKVVSGSVDQSDQSFLEDDQVAGGWVLTCAAYPTSDVVIETHKEEELTSSS

SEQ ID NO: 10106 - DNA, 493 bp, Panicum virgatum
  misc_feature: Ceres CLONE 1721320-R
ctctttctctctctcacacacacatacaaccgacaaacaactctctctctctctctcacacacacacacacacacacacacgcgcacgcgcgcactctcgccaccaacacacacatatagcgcgctcccgcgctatatctatatatctatctcaataaaaaaaaaagatatctatatatctatcgcgctcgcacgcacgcacgcccgcgcgtatgtatatatttatatatatatatatatatatatatatatatatatatatatatatataattaaaccctacgtcgtgcgtgctatagctatagctatagctatactatacttaattggtttgcaattcagctatatgcataatgcatgctagctgtggctatttatatctggtttatttgcaattgatcgagctattttttttgtgttaatgtttcagctccatataaataatgtaatgtttaaatgatatgcttgtctatgaaatattgaaataaaactc

SEQ ID NO: 10107 - DNA, 738 bp, Panicum virgatum
  misc_feature: Ceres CLONE 1721349
  misc_feature: Encodes the peptide sequence at SEQ ID NO. 10108
accagcgcttgcaacaactcatccatccagcaccgtatcgtgccctcatcacattcacgcacaatggctcgcgctcagcaggtcgtggcgatcgccgtcgttgccgccgtcgtgctgctcgccgccgcggccacctccgaggccgccgtgacctgcgggcaggtcaactccgccatcggcccctgcatcgcctacgcccgcgggtccggctccggcccctcctcagcctgctgcagcggagtcaggagcctcaactccgccgccaggagcaccgccgacaggcgcgccgcatgcaactgcctcaagtccgccgcaggcagggtgagcggcctcaacgccggcaacgccgccagcatcccgtccaagtgcggagtcagcatcccctacaccatcagcccatccgtcgactgctccaaggtggcttaatatcgtgatgagttggttggagcctgcatgctgccaagcacatccaccgagatatatatatctagctatcgtctatatatgatcgatcgagttctcgctagctcgctgatgaataaaatctctccgccgtcgctcatcatgtgagagacacggccggatcggatgtgtcagtccctgctacgttttgtacgtgtctgctgcatgtacacctccatttctgtaccttgtccactaccttttaatacatacaccactttttggtatgtatatatgctccgatccatgagtttatttcgatgcttctgatgtttc

SEQ ID NO: 10108 - protein, 120 aa, Panicum virgatum
  misc_feature: Ceres CLONE 1721349
  misc_feature (31)..(116): Pfam Name: Tryp_alpha_amyl Pfam Description: Protease inhibitor/seed storage/LTP family
MARAQQVVAIAVVAAVVLLAAAATSEAAVTCGQVNSAIGPCIAYARGSGSGPSSACCSGVRSLNSAARSTADRRAACNCLKSAAGRVSGLNAGNAASIPSKCGVSIPYTISPSVDCSKVA

SEQ ID NO: 10109 - DNA, 868 bp, Panicum virgatum
  misc_feature: Ceres CLONE 1721352
  misc_feature: Encodes the peptide sequence at SEQ ID NO. 10110
actacctcttccgccttgcgtgtgcgcagccgcaacttttcctcctctccatcctctacccgcggcgaaacccccaaaccctcccctcctccacccccgcccgatccacccgtcagcgatgggcagctccgtcgccggatcgagcgtcgtcgttcctaggaacttcaggctattggaagagcttgagcgtggagagaagggcattggtgatgggacagtgagctatggaatggatgatgcagatgacatctacatgaggtcatggactggtaccatcattggcccccacaatactgtacatgagggccgcatctaccagcttaagttgttctgtgacaaggattatcctgagaagccaccatctgtcagattccattcaagaatcaacatgacatgtgttaatcacgagacaggagtggttgatccaaagaagtttggtttgctggcaaactggcagcgggattacacaatggaaaacatcctaacccagctcaagaaggagatggctgcctcacacaatcgcaagctagtacagcctccggaagggacattcttctaaagaagaattgggtggcccatcttgggattcaacaacagtaactgataagttgtgttaatggggggaaaacaacttctacatctggtccctgtgcttgtgttttccagtttcctatgctatgttctgcaatctgtgaacagctgtgaacaatcgaagtatctcccttgcgatttgcatagtggctgctggggatgttgcaagttccagggatgtatcttgaaactgtcgtagtgccctgattaaggaatagacaacatctccgtgttacctatataatatagcctctgtgtgcgcgcgtcttccaagttc

SEQ ID NO: 10110 - protein, 146 aa, Panicum virgatum
  misc_feature: Ceres CLONE 1721352
  misc_feature (17)..(138): Pfam Name: UQ_con Pfam Description: Ubiquitin-conjugating enzyme
  misc_feature: SWISSPROT Homolog: EC 6.3.2.19 Ubiquitin--protein ligase
MGSSVAGSSVVVPRNFRLLEELERGEKGIGDGTVSYGMDDADDIYMRSWTGTIIGPHNTVHEGRIYQLKLFCDKDYPEKPPSVRFHSRINMTCVNHETGVVDPKKFGLLANWQRDYTMENILTQLKKEMAASHNRKLVQPPEGTFF

SEQ ID NO: 10111 - DNA, 849 bp, Panicum virgatum
  misc_feature: Ceres CLONE 1721356
  misc_feature: Encodes the peptide sequence at SEQ ID NO. 10112
accaaacaaccgcagcgaggcaaaccaaaccgctcctcactctcctctagctccccagcagctcgcaagcaagcaaggcaaggcagcgcacggcggccatgagcgtggtgatcctggacggctcgacggtgcgcgccttcgtggcggacgaggcggcgttcgcgcgcagcgtggacgcgcgcttcgcggcgctggacgccaacggcgacggcgtgctgtcgcgcaccgagctccggcgcgcgctcgagtcgttccgcctcctcgacggcggcggcttcgggtccgccgcgccggcgccgctccccgccgaggtcgccgcgctctacgacgccgtctttgagcagttcgacgccgaccacagcggcgccgtcgaccgcgccgagttccgcgacgagatgcgccgcatcatgctcgccgtcgccgaggggctcggctcgcagccgctccaggtcgccgtcgacgacgagggcggcagcttcctgctcgaggccgccgagcacgaggccgccgcgatcgccgccaaggtcgacgccgagcgcaaggccgaggccgacgccgccaataagtgacgcgtgccgcgtgggggcggtgccggtgggtgacccgtaaccttgtgctctgcgctgctcgctgtactgcttctagatgttggtgtgcttggacgtgtcagccgttgcgctgctacacgtgtacgttaacagaaaaccggccggcggtggcgctcctcctcctcctcctcctgctgctggtgggaaatgagagttttattctactgtactttagtaacttgtgaacggaataaaacggcttccaagtctcggatgtaacttggcggcaactttgtccatc

SEQ ID NO: 10112 - protein, 156 aa, Panicum virgatum
  misc_feature: Ceres CLONE 1721356
  misc_feature (24)..(52): Pfam Name: efhand Pfam Description: EF hand
  misc_feature (75)..(103): Pfam Name: efhand Pfam Description: EF hand
MSVVILDGSTVRAFVADEAAFARSVDARFAALDANGDGVLSRTELRRALESFRLLDGGGFGSAAPAPLPAEVAALYDAVFEQFDADHSGAVDRAEFRDEMRRIMLAVAEGLGSQPLQVAVDDEGGSFLLEAAEHEAAAIAAKVDAERKAEADAANK

SEQ ID NO: 10113 - DNA, 794 bp, Panicum virgatum
  misc_feature: Ceres CLONE 1721364
  misc_feature: Encodes the peptide sequence at SEQ ID NO. 10114
aaatcgatcggagcacaacagaagccacacgctcacaacacacaagcaagcaagcaatctgaggagaagccggccgccgatttccccagcccgtgcattgttcccgatggcgaccatggtgatggcctccgccgcgagctccctcgccttcgccgccaccggcgcgaacgccggccgcttccccgcccggcttccggcggcggcggggctcgcgccgcgccggcgcgcaccgctcgtcagggcgcaggctaataagggtcctgagaagccggcagcgagcccgggactctgggacgcgctggcgttcagcggcccggcccctgagcgcatcaacgggcggctcgccatggtcggcttcgtgtccgcgctcgccgtcgaggcgtcccgcggcgggggcctcctctcgcaggccggcagcgggtctgggctggcctggttcgtggccacggccgccgtgctctccgtggcgtcgctggtgccggtcctcaagggggagagcgccgaggcccgcagcggcggcgtcatgagcgccgacgccgagctctggaacggccgcttcgccatgctcgggctcgtcgcgctcgccgtcaccgagtacatcaccggcgcgcccttcgtcaacgtgtaaaatataacggcctacgttgttgtacgggcacgtgtagccgtgtagtagaggaggtagtgtaaaccttggctaggacactctggacatgactccttcgtaaaactcttccgctaaacggtcatgtaaaattgttgatttgaaatgactttctttgcgacacagagtt

SEQ ID NO: 10114 - protein, 173 aa, Panicum virgatum
  misc_feature: Ceres CLONE 1721364
  misc_feature: SWISSPROT Homolog: EC 4.99.1.1 Ferrochelatase
MATMVMASAASSLAFAATGANAGRFPARLPAAAGLAPRRRAPLVRAQANKGPEKPAASPGLWDALAFSGPAPERINGRLAMVGFVSALAVEASRGGGLLSQAGSGSGLAWFVATAAVLSVASLVPVLKGESAEARSGGVMSADAELWNGRFAMLGLVALAVTEYITGAPFVNV

SEQ ID NO: 10115 - DNA, 845 bp, Panicum virgatum
  misc_feature: Ceres CLONE 1721377
  misc_feature: Encodes the peptide sequence at SEQ ID NO. 10116
gagactgatcgaccggagaagtgcacacacaaaccagccaaggcccccgagctgctgagatggcacaagccatggcgtccatgaccggcctctcgccgggcgtgctgcccagcaggcgcgccgccagcagggccagggcggccgtcgtcagggcgtcggccgagggcgaggccgcggcgcaggctggccgccgcgccgtgctcgggctggtggccaccggcatcgtcggcggcgtcttcatccaggcggtgcgcgccgatgaggccgtcaagaccatcaagatcgggcccccgccgccgccctctgggggacttcccgggaccttgaactctgaccaggccagggacttcgacctcgccttgaaggagcggttctacctgcagccgttgccaccggcggaggccgcagcgagggccaagtcgtcggcgcaggacatcctcaacctcaagccactcatcgacaagaaggcttggccgtatgtcatgaacgacctccgcctccgggcctcctacctgcgctacgacctcaacaccgtcatcgcctccaagcccagggaggagaagaagagcctcaaggagctcaccggcaagctcttcagcaccatcgacgatcttgaccatgcggcaaagatcaagagcaccccagaggctgagaaatactacgcggcgaccaaatctgccctcgatgatgttttcgccaagctaggctagatggaatataatgggctaatggccatgtaatttcagacttttgtgtttgttcatatggatatggagccggcaatgtgccatttcctgttgatattatatcaacaagcacgtaactatgatgctatcgtgagggtc

SEQ ID NO: 10116 - protein, 212 aa, Panicum virgatum
  misc_feature: Ceres CLONE 1721377
  misc_feature (8)..(212): Pfam Name: PsbQ Pfam Description: Oxygen evolving enhancer protein 3 (PsbQ)
MASMTGLSPGVLPSRRAASRARAAVVRASAEGEAAAQAGRRAVLGLVATGIVGGVFIQAVRADEAVKTIKIGPPPPPSGGLPGTLNSDQARDFDLALKERFYLQPLPPAEAAARAKSSAQDILNLKPLIDKKAWPYVMNDLRLRASYLRYDLNTVIASKPREEKKSLKELTGKLFSTIDDLDHAAKIKSTPEAEKYYAATKSALDDVFAKLG

SEQ ID NO: 10117 - DNA, 822 bp, Panicum virgatum
  misc_feature: Ceres CLONE 1721381
  misc_feature: Encodes the peptide sequence at SEQ ID NO. 10118
gaactcaaccagcgtcgtcgggctcaagcccgccgcggcggtgccgcaggccgccacctcctcgccggcggcgaagcgggtccaggtcgcgcccaaggaccgggcggccgagggccggcgcgcggcgctcctcggcctggcggccgtcttcgccgtcacggccaccaccgggtcggccaaggccgggatcatcgacgagtacctcgagaagagcaaggccaacaaggtcagtttaaatttcttccttgtatggatcgtacgtatcagaattgctgatcgtttgcctgaaagtgaacactgacaaggttacatttgttgctgtgatcaggagctgaacgacaagaagaggctggctaccagcggcgccaacttctcccgcgcctacaccgtcgagttcggcagctgccagttcccctacaacttcaccggctgccaggacctcgccaagcagaaggttctcagcacatcagtcacacggcactgtcttaaccggaaggcctgaatttttggtttctgatcttgccgtgtctctgcacctgtgttcctgcagaaagttcccttcatcactgacgacctcgagatcgagtgcgaggggaaggagaagtacaagtgcggctccaacgtcttctggaagtggtgaagcgcacgcttgattggcttggaactggagggggcgctggcggtgtaacgtgtgtacctagatgcccaaactgcaggaaaaatttggatgtgtaatttaccgtcactgtatctgtgccatctcatcatcgtctgaacatgaacctcttgtattggggagtgtgaaattgtagttggttgacg

SEQ ID NO: 10118 - protein, 99 aa, Panicum virgatum
  misc_feature: Ceres CLONE 1721381
  misc_feature (5)..(84): Pfam Name: PsaN Pfam Description: Photosystem I reaction centre subunit N (PSAN or PSI-N)
NSTSVVGLKPAAAVPQAATSSPAAKRVQVAPKDRAAEGRRAALLGLAAVFAVTATTGSAKAGIIDEYLEKSKANKVSLNFFLVWIVRIRIADRLPESEH

SEQ ID NO: 10119 - DNA, 921 bp, Panicum virgatum
  misc_feature: Ceres CLONE 1721385
  misc_feature: Encodes the peptide sequence at SEQ ID NO. 10120
gttttcctgccatctccttccgctctccgctctccgcccgccccgcactaccctcgccgccgccgcatcagccgccgcgatgcacaagacggcgcaggcctggtttaccggcggcaccgccgcctcttccgcggccgccagcgagtcgcagccgtccctcctcgccgactggaactcctacgccgccacccgctccgacgcctcctcctcctcctccccgctccccttcgacatcgaggccgccgtccgctccgccaacgacactgtctccggcacctttagctcggtgaccaagggcgtgcgggagctaccggggagcttccagagcgcgaccagcagcttcccctcggggagggcgctcatgtacttcggcctcttcctcgccaccggcatcttcttcgtcttcatcgccttcgcgctcttcctccccgtcatggtgctcatgccgcagaagttcgccctcagcttcacgctcggatgcgcgctcatcatcgcctcgctcttcgcgctcaaggggccagccaaccagctcgcccacatgacctccaaggagaggctaccattctcagtgggttttattggatgcatggttggtacgatttatgtttcaatgatgcttcacagctatttcctctcagtgatcttctcagtccttcaggttctggcccttgcgtattataccatatcctacttccccggaggatctagtggattgaaatttatctcgtccagtcttttgtcttcggtgacaagttgctttggtcgataatggtagcctgtcgtacatttacttgtttttgtatgtagttgctgatcatctccccgatatgaccccaaaaaaccctctccagtcatcacgttgtttacattagacttggatgggtgttggatatagattatagagtgaaaagggtgtttgtt

SEQ ID NO: 10120 - protein, 229 aa, Panicum virgatum
  misc_feature: Ceres CLONE 1721385
  misc_feature (88)..(212): Pfam Name: SFT2 Pfam Description: SFT2-like protein
MHKTAQAWFTGGTAASSAAASESQPSLLADWNSYAATRSDASSSSSPLPFDIEAAVRSANDTVSGTFSSVTKGVRELPGSFQSATSSFPSGRALMYFGLFLATGIFFVFIAFALFLPVMVLMPQKFALSFTLGCALIIASLFALKGPANQLAHMTSKERLPFSVGFIGCMVGTIYVSMMLHSYFLSVIFSVLQVLALAYYTISYFPGGSSGLKFISSSLLSSVTSCFGR

SEQ ID NO: 10121 - DNA, 568 bp, Panicum virgatum
  misc_feature: Ceres CLONE 1721387
  misc_feature: Encodes the peptide sequence at SEQ ID NO. 10122
atcatcgcagcggcactcctctgtgcaaagccagccatcggaggaggagaaggagagcttttgggctttttgggggtgggtggtgcgccatgggggaggtgaagcacctgtgcctggtgaggttcaaggagggcgtcgtggtggaggacgtcctcaaaggcatgaccgaccttgtcgcccagatggacatggtcaaatccttcgagtggggccaggacgtgctgaatcaggagatgctgacgcagggcttcacgcacgtcttctcgctcaccttcgcctccgccgacgacctcaccacctacatgggccacgacaagcacgccgcgttcgccgccacgttcatggccgcgctcgagaaggtggtcgtcatcgacttccccgtcgtcatcgccaagccaccgccatcggcatgatcgacctgccacagcatctgtcggccattgtacggtgccttttcaggtagcatagcagatcaccgtctatttgcaacggtgatgtactgcgtgtctaagtacggccctgtttagttcccttcaaaattccaaaactttacaagattccccatcag

SEQ ID NO: 10122 - protein, 107 aa, Panicum virgatum; identical to SEQ ID NO: 10007
  misc_feature: Ceres CLONE 1721387
  misc_feature (4)..(98): Pfam Name: Dabb Pfam Description: Stress responsive A/B Barrel Domain

SEQ ID NO: 10123 - DNA, 782 bp, Panicum virgatum
  misc_feature: Ceres CLONE 1721388
  misc_feature: Encodes the peptide sequence at SEQ ID NO. 10124
aaatcgatcggagcacaacagaagccacacgctcacaacacacaagcaagcaagcaatctgaggagaagccggccgccgatttccccagcccgtgcattgttcccgatggcgaccatggtgatggcctccgccgcgagctccctcgccttcgccgccaccggcgcgagcgccggccgcttccccgcccggcttccggcggcggcggggctcgcgccgcgccggcgcgcaccgctcgtcagggcgcaggctaataagggtcctgagaagccggcagcgagcccggggatctgggacgcgctggcgttcagtggccccgcgccggagcggatcaacgggcgcctcgccatggtgggcttcgtgtccgcgctcgccgtcgaggcggcccgcggggacggcctcctcgcgcaggtcggcaacggcgccgggctcgcgtggttcgcgtacacggccgtcgtgctgtccgcggcgtcgctggctccgctgctccagggggagagcgccgaggacaggagcggcggcttcatgaccgccgacgccgagctctggaacggccgcctcgccatgctcggcctcgtcgcgctcgctgccaccgagtacctcaccggcgcgcctcttgtcaacgtgtaaatacggcgtacattacgtacgcatacgtgtagctgtatgtgtagaggcggtagtgtatatacgtgtgtatttgtatgtacggccggggtacttgtgagctcggctaagtataatttgacacaaaaatgatcttaaaaattgcactggcgacctc

SEQ ID NO: 10124 - protein, 173 aa, Panicum virgatum
  misc_feature: Ceres CLONE 1721388
  misc_feature (49)..(164): Pfam Name: Chloroa_b-bind Pfam Description: Chlorophyll A-B binding protein
  misc_feature: SWISSPROT Homolog: EC 4.99.1.1 Ferrochelatase
MATMVMASAASSLAFAATGASAGRFPARLPAAAGLAPRRRAPLVRAQANKGPEKPAASPGIWDALAFSGPAPERINGRLAMVGFVSALAVEAARGDGLLAQVGNGAGLAWFAYTAVVLSAASLAPLLQGESAEDRSGGFMTADAELWNGRLAMLGLVALAATEYLTGAPLVNV

SEQ ID NO: 10125 - DNA, 710 bp, Panicum virgatum
  misc_feature: Ceres CLONE 1721397
  misc_feature: Encodes the peptide sequence at SEQ ID NO. 10126
actcttcccagccctcctccaatcgattttgcaggctcgtccagcccgttactcacagttcacaatggccatgatgatgaaggcaagcaacaaggtggccgccaaggccccttgcgccaaggcctccaagatgatggtgtggcagcccatcaacaacaagttcttcgagaccttctcctacctgcctcctctgaccgacgagcaggtggcccgtcaggtggactacattgtgaacaacggctggaccccctgcctggaggttgctgacgccaccgtggcttacatctccaacgacaacctgagccgcatcagtgtgtcccctggctactacgacaaccgctactggaccatgtacaagctgcccatgttcggctgcactgacgccagccaggtgctgcgtgagatccagaacgccacccgcagcttccccgacgcatacgtgcgcctggcggccttcgacgccgtgaagcaggtgcaggtggcggccatgctggtgcaccgcccccccaaggtccgcgactaccgcctgcccaacgagcgccaggcttaagcggtgcccgagcgccagctagctgtttgtcgcagatcagcctcgtcaactgatgtggctgggccggcaacgcgcagttttggttgagagggagcggctgaaaagcttcacagcgtgtatcaatatgtcagcttgccatgtaaactgaaattgatacacc

SEQ ID NO: 10126 - protein, 161 aa, Panicum virgatum
  misc_feature: Ceres CLONE 1721397
  misc_feature (33)..(147): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
MAMMMKASNKVAAKAPCAKASKMMVWQPINNKFFETFSYLPPLTDEQVARQVDYIVNNGWTPCLEVADATVAYISNDNLSRISVSPGYYDNRYWTMYKLPMFGCTDASQVLREIQNATRSFPDAYVRLAAFDAVKQVQVAAMLVHRPPKVRDYRLPNERQA

SEQ ID NO: 10127 - DNA, 959 bp, Panicum virgatum
  misc_feature: Ceres CLONE 1721408
  misc_feature: Encodes the peptide sequence at SEQ ID NO. 10128
aagccgtcttctaattctctcgggtcctcgaaagctgttgttcctcctttctctcatgcccacaatgctcgcagccagctctgtacggaatctcgcttgctcatcaaggttatcatcctgttcagaatacacatctggcaattcctggcgtcccatagaggctgcaaaactccacaggacatattctgtgagctcgattcgtataagctgtgctgctactaagcctgcgaagacacctgctgaagtagagtggaaagttaagcggcaactcctagcagaaaagcgggtacgcagtgttgatgtgaaggaagcactgcgccttcagaaggagaacaactttgtgattcttgatgtcagaccagaagcagagtttaaagaggctcatccacctggcgccatcaatgtacaaatatacagattaataaaggaatggacggcatgggatattgcaaggcgtgcagcatttgcgttctttggcatatttgctggaacagaagagaatcctgagttcatacaaagtgttgacacgaaaattggtaaagatgcaaagataattgtggcatgttctacaggagggacactaaagcctacacaaaattttcctgatggaaagcaatctcgatccctgatagcggcttacctgctggtcctcaatggctacaaaaatgtgtaccatctggaaggagggctttacacatggttcaaggaaggcctaccagctgctgaaggagaagaataagcaggagagacctatttcttgttacgacactgttgttcacatgctggagttgtgagttgtaatcatgcgcttcacaggatcttagatcgtttctcccccattgagatgtctcatgtcgccttggttgcccaacgtattggtggtgtatgatgcttgagcatgacggtatgatgactattagctttgaccaataaaagtgagcagaagcatagttcctttt

SEQ ID NO: 10128 - protein, 227 aa, Panicum virgatum
  misc_feature: Ceres CLONE 1721408
  misc_feature (83)..(218): Pfam Name: Rhodanese Pfam Description: Rhodanese-like domain
  misc_feature: SWISSPROT Homolog: EC 2.8.1.1 Thiosulfate sulfurtransferase
MPTMLAASSVRNLACSSRLSSCSEYTSGNSWRPIEAAKLHRTYSVSSIRISCAATKPAKTPAEVEWKVKRQLLAEKRVRSVDVKEALRLQKENNFVILDVRPEAEFKEAHPPGAINVQIYRLIKEWTAWDIARRAAFAFFGIFAGTEENPEFIQSVDTKIGKDAKIIVACSTGGTLKPTQNFPDGKQSRSLIAAYLLVLNGYKNVYHLEGGLYTWFKEGLPAAEGEE

SEQ ID NO: 10129 - DNA, 402 bp, Panicum virgatum
  misc_feature: Ceres CLONE 1721411-R
  misc_feature: Encodes the peptide sequence at SEQ ID NO. 10130
aggttccaggtgaggaacatggtgaagcaggcggccatcagggacgtccaggaggggggcgtccagaaaggatacgtccttcccaagctgtacgccaaggtgcgccactgcgtgtcgtgcgagatccgcggggacatgggcggcgcccgatccggggagaagggcagggtacgccagccgcgggagcgcttcaggcgcagggaggataggcgcgctggcgagcgaggaggcccccgcccgggtggacctggccctgctgataaagctgccgctccgccaccaaagggtgctgaccctataaggcttagcttatcgcccgctacgtgtgaagtttggcctggtgttggggagcgctggatgtcagcatcactaggtcctgaagggggggaggttggagttgct

SEQ ID NO: 10130 - protein, 133 aa, Panicum virgatum
  misc_feature: Ceres CLONE 1721411-R
  misc_feature (1)..(80): Pfam Name: Ribosomal_S26e Pfam Description: Ribosomal protein S26e
RFQVRNMVKQAAIRDVQEGGVQKGYVLPKLYAKVRHCVSCEIRGDMGGARSGEKGRVRQPRERFRRREDRRAGERGGPRPGGPGPADKAAAPPPKGADPIRLSLSPATCEVWPGVGERWMSASLGPEGGEVGV

SEQ ID NO: 10131 - DNA, 190 bp, Panicum virgatum
  misc_feature: Ceres CLONE 1721411
tcccaaactgtacaccaagctgcatcagtgcgtctcgagagacgatccacgataacatcggctgcgaccgcaacactgacaagtgcacgatcagcatgccgctggaccatattacggctccagcaggataggcattgtgccgccaccgtggacccctccctagagaacctcgccgcgttggtgctattag

SEQ ID NO: 10132 - DNA, 731 bp, Panicum virgatum
  misc_feature: Ceres CLONE 1721415
  misc_feature: Encodes the peptide sequence at SEQ ID NO. 10133
atcttgcgccgccgccgccgcctcctcctcccatccacactcctccgtccccctccctgctcccgcgccgccctccaccgccaagatgaacaaggagaggctcatgaagatggccggcgccgtccgcaccagcgggaagggcaccgtgcgcaggaagaagaaggctgtccacaagacggccaccacggacgacaagaggctgcagagcacgctcaagagagtaggggtcaataccattcctgcaatcgaggaggtcaacatcttcaaggacgacctcgtcatccagttcttgaatcccaaagtgcaagcttccatcgctgcaaacacatgggtggtcagtggatccccacagacgaaaaagctacaagatgttctgcctgggatcatcaaccagttgggtcctgacaacatggagcacctgaagaggattgctgaagagatgcagaagcaggtggctgctgctggtgccgcagcacaggccaaggaagataatgatgatgatgttccagagcttgttcctggagagacttttgaggaagtagcccaggaggcaaaagcctgatcatagaatccaaatagtgaaatgttactcgaccgctgcaatgaggtcatggttttcttgtgatggcactcttttcctccccccacttaggccagccactctttgtattcgcagtctgaaacttttagtttctccaagcttttacctgaagttatgcatgttgagatgc

SEQ ID NO: 10133 - protein, 158 aa, Panicum virgatum
  misc_feature: Ceres CLONE 1721415
  misc_feature (34)..(92): Pfam Name: NAC Pfam Description: NAC domain
  misc_feature: The sequence is a functional homolog of SEQ ID NO 1614 in the 11/479,226 US patent application
  misc_feature: The sequence is a functional homolog of SEQ ID NO 784 in the 10/412,699 US patent application
  misc_feature: Functional homolog of the protein sequence given in SEQ ID NO 50156
  misc_feature: Useful for making plants with modulated biomass
  misc_feature: The sequence is a functional homolog of SEQ ID NO 1617 in the 11/479,226 US patent application
  misc_feature: The sequence is a functional homolog of SEQ ID NO 786 in the 10/412,699 US patent application
MNKERLMKMAGAVRTSGKGTVRRKKKAVHKTATTDDKRLQSTLKRVGVNTIPAIEEVNIFKDDLVIQFLNPKVQASIAANTWVVSGSPQTKKLQDVLPGIINQLGPDNMEHLKRIAEEMQKQVAAAGAAAQAKEDNDDDVPELVPGETFEEVAQEAKA

SEQ ID NO: 10134 - DNA, 753 bp, Panicum virgatum
  misc_feature: Ceres CLONE 1721418
  misc_feature: Encodes the peptide sequence at SEQ ID NO. 10135
ctttctcccccacacacgcctcctgcacccaccgatcgacaacaatggcgatggcggcggcgaggagagccctcctggcgcacctccgcgtcccggtggcacgccccgcagccgccgccgcggcggcgggaaccgtccccgtcgcggcccggaggctcctgtcttcgactacggaggagacgaaggggtcgttcctggacaagggcgaggtcgccgaccgcgtcgtctcggtcgtcaagaacttccagaaggttgagcccgcaaaggtgacacctactgctcatttccagaaggacctcgggctcgatagcttggacaccgtcgagatcgtgatggcgttcgaggaagaatttggattcgagatccctgacaacgaggcggagaagattgactccatcaagtcggcagtcgacttcatcgcctcacatcctcaagcaaaatgagaacatttcttgttttcccatttcagcacgctttggcatccagaacttgtgtgcagacagcataacaattttctgtagcttgccccagcgggtgcatggcctgaaacctccctgcctgcacctgctgatggataggaagccagttctttctctttctcgatcatgttgaaataaaccgtgtacctattggttgttacggttttgtgaccctgtttgcaggtgttggaacaccttttacggccaaacttgtgtacaaggtgcgtggaagtcctcagtagcacattaatccatagatgcattcggatgtgtt

SEQ ID NO: 10135 - protein, 132 aa, Panicum virgatum
  misc_feature: Ceres CLONE 1721418
  misc_feature (58)..(125): Pfam Name: PP-binding Pfam Description: Phosphopantetheine attachment site
  misc_feature: SWISSPROT Homolog: EC 2.7.1.6 Galactokinase
MAMAAARRALLAHLRVPVARPAAAAAAAGTVPVAARRLLSSTTEETKGSFLDKGEVADRVVSVVKNFQKVEPAKVTPTAHFQKDLGLDSLDTVEIVMAFEEEFGFEIPDNEAEKIDSIKSAVDFIASHPQAK

SEQ ID NO: 10136 - DNA, 789 bp, Panicum virgatum
  misc_feature: Ceres CLONE 1721423
  misc_feature: Encodes the peptide sequence at SEQ ID NO. 10137
ctagtcagccggatcgctgcgtcgctccgcctcggccttccgccctcgcgcggcgccttcctcggttcgtcggtccagcttgggagatgtcggactctgaggagcaccatttcgagtcgaaggccgacgccggagcctccaagacttacccgcagcaggccggcaccatccgcaagaacggatacatcgtcatcaagggccgcccgtgcaaggttgttgaggtctccacttcaaagacagggaagcacggtcatgcgaaatgccacttcgtggccattgacattttcaatggaaagaagcttgaggatattgtgccatcttcccataactgtgatgtgccccatgtcaaccgtactgactatcagctgattgacatatctgaagatggatttgtaagccttctgactgaaaatggaggcaccaaggatgatctgaggctccctactgatgaaactctgctttcccagattaaagctggattcgatgatgggaaggacctgattgttagtgtgatgtctgccatgggtgaggagcagatctgcggtctgaaggatatcggcaagaactagagctgcattgccactgttggttgtttgtccggtcgcctatctgggaggtggtgtgttgatgatataagcgtgtttggttacgagtaacatgcttatggactgccgttttgtcttgtcgtttatgcagagtgatttggatgtacctttgttcttttgaaccaagtagcttggctacacctcaatcgaaatcatatgcatcagatgagaagtgggctttcag

SEQ ID NO: 10137 - protein, 160 aa, Panicum virgatum
  misc_feature: Ceres CLONE 1721423
  misc_feature (86)..(155): Pfam Name: eIF-5a Pfam Description: Eukaryotic initiation factor 5A hypusine, DNA-binding OB fold
  misc_feature (30)..(64): Pfam Name: KOW Pfam Description: KOW motif
MSDSEEHHFESKADAGASKTYPQQAGTIRKNGYIVIKGRPCKVVEVSTSKTGKHGHAKCHFVAIDIFNGKKLEDIVPSSHNCDVPHVNRTDYQLIDISEDGFVSLLTENGGTKDDLRLPTDETLLSQIKAGFDDGKDLIVSVMSAMGEEQICGLKDIGKN

SEQ ID NO: 10138 - DNA, 698 bp, Panicum virgatum
  misc_feature: Ceres CLONE 1721440
  misc_feature: Encodes the peptide sequence at SEQ ID NO. 10139
atccacgagcgaaccagcagcgcaggcgcagggggaggggagagccgaggccgagcacggagcaagcgccagcaggatgccgacgctgatcctgagcaccaacgtgccggtggacgccgtcgtcgccgccgacatcctcaaggactgctccaaggcaatcgccaggatcatcggcaagccggaatcctacgtcatggtgtcgataaacgggtcggtgcccatgtcgttcgcggcgagcgaggaaccggcggcgtacggtgagctcgtctccatcggcgggatcggccccggcgtcaacgggaagctgagcgcggccgtggccgaaatcctcgagaccaagctctcggtcagcaggtccagattctacatcaaattcgatgacgtgcagagattcaacttcggcttcaacggatcgacattctaaagaaaaccccatcagagaatggtgatcgctgcgtcccaagcaaccacctcaacctgcccacacataccaccatcagttcgtcaataaacggggatggtcaagtgcttcatttgtatctcctacacctccaatggatattctgctcatgtgtgagacagcactaaattatatgctttatttcaactaaagaatgcagcccagcatgccaccatgtacctcattcctcatttcatgatactttgttcttcagtagaatcgatgaactctttctagc

SEQ ID NO: 10139 - protein, 115 aa, Panicum virgatum
  misc_feature: Ceres CLONE 1721440
  misc_feature (2)..(115): Pfam Name: MIF Pfam Description: Macrophage migration inhibitory factor (MIF)
  misc_feature: SWISSPROT Homolog: EC 5.3.2.1 Phenylpyruvate tautomerase
MPTLILSTNVPVDAVVAADILKDCSKAIARIIGKPESYVMVSINGSVPMSFAASEEPAAYGELVSIGGIGPGVNGKLSAAVAEILETKLSVSRSRFYIKFDDVQRFNFGFNGSTF

SEQ ID NO: 10140 - DNA, 732 bp, Panicum virgatum
  misc_feature: Ceres CLONE 1721489
  misc_feature: Encodes the peptide sequence at SEQ ID NO. 10141
accaccacctacaaggctaaggctccaagctagctaggaactcaaaatactaacaatggcctccctctcctctgccgccgtcaccgccccttccttcgccgcggctgcccggcccgcccccaggcgctctgctgctttcaccgtgcgcgcctcgctcggcaaggccgccggcaccgccgccgtggccgtggccgccagcgccctgctcgcaggcggcgccgccatggcccaggaggtgctgctgggcgccaacggaggcgtcctcgtcttcgagcccagcgagttcaccgtcaaggccggcgaggccatcaccttcaagaacaacgccgggtacccccacaacgtggtcttcgacgaggacgaggtgcccagcggcgtcgacgctgccaagatctcgcaggaggagtacctcaacgcgcccggcgagacctactccgtcacgctcaccgtgccggggacctacggattctactgcgagccgcaccaaggagccggaatggtcggcaaggtcaccgtcaactgatgcatgctgcgatatatctatcatctgcgcatgcatctactgcgtgctatcaattacagtactacaagtattatgtattcaaacgtatgtacctaccaggaggctaggctagctagctagagagcttattagcttgccttcccctcaagagtcagtgaccatcttgtacctaccaagtggcctgaatgcatgcatgctattgcttcatc

SEQ ID NO: 10141 - protein, 155 aa, Panicum virgatum
  misc_feature: Ceres CLONE 1721489
  misc_feature (59)..(155): Pfam Name: Copper-bind Pfam Description: Copper binding proteins, plastocyanin/azurin family
  misc_feature: Functional homolog of the protein sequence given in SEQ ID NO 50157
  misc_feature: Useful for making plants with modulated nitrogen use efficiency
MASLSSAAVTAPSFAAAARPAPRRSAAFTVRASLGKAAGTAAVAVAASALLAGGAAMAQEVLLGANGGVLVFEPSEFTVKAGEAITFKNNAGYPHNVVFDEDEVPSGVDAAKISQEEYLNAPGETYSVTLTVPGTYGFYCEPHQGAGMVGKVTVN

SEQ ID NO: 10142 - DNA, 515 bp, Panicum virgatum
  misc_feature: Ceres CLONE 1721493-R
  misc_feature: Encodes the peptide sequence at SEQ ID NO. 10143
tggcgtgagagacgcctggtctggtggagttggaggcgccgtggtgcgggccgtgccgatcgatcgcggcggtgatcgtcgagttggccaaggggtacgcgggccatatcaagtgcggcaaggtgaacacggaggagtgccccaacggggcgtcggcgtgcggcatcagcagcatcccccccttggtcatgttcaggggcggcgggaagaaggagagagtcatgggcgccgtgcccaagaccacgctcgccaccatagtcgccaagtacattggcagctggtgagccagacaactttaaatacatatgtgtcggagctcgcgtgtacacgccatgtatgggtatctcctgtttagcagcaaggatgatgcacgcgataactcaggcagcggtctgctcccgcatccgttattttaggtccaatccaactcctttaattagtttgtatcggaacatgattttcacagtgaatattacaaaccaactcatgcaagtcatcaagatgggtctattatt

SEQ ID NO: 10143 - protein, 31 aa, Panicum virgatum
  misc_feature: Ceres CLONE 1721493-R
  misc_feature: Functional homolog of the protein sequence given in SEQ ID NO 50158
  misc_feature: Useful for making plants with modulated heat sensitivity
MFRGGGKKERVMGAVPKTTLATIVAKYIGSW

SEQ ID NO: 10144 - DNA, 717 bp, Panicum virgatum
  misc_feature: Ceres CLONE 1721493
gactcagggatacaagtcctatcctcctgcacctagatcaccacagtctctccgcgcgtcgcgtgagccgcctacgatggccctggagacgtgcttcacatcgtgggcgctgcacgcctcccccgccggcggaaaagacaggctcgccttcgggagcagcttcacgccggccaagcgggccgccgccgcgcccctgtcagtatgacgcttccccacgcgaaggtcgcgacacttctgctaatcacaaaacgccatccactaactgctggtggcggaacagaagaactgggacgggatggtgatggggtgctagacgccggtgctggtggagttctgggcgcctcgttgcgggccttgccggatgatcgtatcggtgatcaactagctggccaatgactacgccggccgaataaagtgctgctaggtgaactccgactactgccccgaagtgctctcctcctacggcatccgcggcatccgcacattgctcatcttcaaggatggtgagaataaagagaacgtcttctgagccgtacccactaccacactcaccaccgtctctgacgactgcatcggaacctcgtgagccagaccactataaatacatacttgtccgtgctctcgagtgcaccccatgtatgtgtatcgcttgcttcccagctgagatgatgatgctctagctctggctgccttctgctcctgctctgtgatactctg

SEQ ID NO: 10145 - DNA, 871 bp, Panicum virgatum
  misc_feature: Ceres CLONE 1721496
  misc_feature: Encodes the peptide sequence at SEQ ID NO. 10146
agcagacagccaactcgcatatataaaaaaatagaaaaaggaaaacccccgcagccacagagccagaggaagaataatccattcgccttgcttgggcctcccgtctgcgtgcgctcgacgcagagaggcgcgggcgctcaacgccaccgccaccgccaccgccaccctccggctccgatccgatggccttcatgcggtcgcactcaaatgcatcttccggcatgggagttgctcctaacatcagggagacattcgttgagcttcagatgaagaaggcattccgatatgttatcttcaaaattgaggaaaagcaaaagcaggtggttgtcgagaagactggcgctactactgaaagctatgatgactttttggcctccctcccagaaaatgactgcagatacgctctgtatgattttgacttcgtcacgggggagaacgtgcagaaaagcaagatatttttcattgcctggtccccgtcgacttcccgcattcgtgcgaagatgctgtactccacctccaaggaccgcatcaagcatgagctcgatgggttccactacgagatccaagcaaccgacccgtcagaggtggacattgaagtcctcagagagcgggctcactgaagctggtttacctatgaagggacctgtggagggccttggaacttcagccagattcaaattctatattcaaagatgctcctgccatggtatttgttaataagttcatgtaagcatatgatttagtcgtgatgctggactctagctggtgaagcgctgtcgaaggtctttctgtatgagatcttgagcctgtaaacgaagcaatttgcaaactcatggtattgtggtaatgatactggttacgggaactctgg

SEQ ID NO: 10146 - protein, 145 aa, Panicum virgatum
  misc_feature: Ceres CLONE 1721496
  misc_feature (18)..(145): Pfam Name: Cofilin_ADF Pfam Description: Cofilin/tropomyosin-type actin-binding protein
  misc_feature: Functional homolog of the protein sequence given in SEQ ID NO 50159
  misc_feature: Useful for making plants with modulated time to senescence
MAFMRSHSNASSGMGVAPNIRETFVELQMKKAFRYVIFKIEEKQKQVVVEKTGATTESYDDFLASLPENDCRYALYDFDFVTGENVQKSKIFFIAWSPSTSRIRAKMLYSTSKDRIKHELDGFHYEIQATDPSEVDIEVLRERAH

SEQ ID NO: 10147 - DNA, 1048 bp, Panicum virgatum
  misc_feature: Ceres CLONE 1721499
  misc_feature: Encodes the peptide sequence at SEQ ID NO. 10148
cctcctcctcacctcgatcgtcaccgctgctggaacgaggaggaggcggcggcggcggcggaggggtgatgatggcgagcggcgctggaggcggagcggcaggggaaggcgagtggctcatggtcgcccagctcagggccacggtccaggcgcaggacccccgcgccaaggaggtggacaacctgacgctgcggaggttcctgcgcgcgcgcgaccacaacgtcgacaaggccgccgccatgttcctcaagttcctccagtggcggagggaggcggtgcccgagggcttcgtgccggaggagaaggtccggagggagctcccgcaggacaaggtctgcatgggcggcgtcgacaggaccggacgccccatcctcgttgccttcccggccaggcacttctccgccaaccgcgacctgacagagttcaagagttatgttgtctacttcttcgacacgatctgtgccagcattcccagaggccaggagaaattcctcctcctcgttgatttcaagagctgggggtattcgaactgcgacatccgggcctacttggcagctatagagatcatgcagaactactacccggagcggctcggcaaggcgctgatgatcaatgtgccctacctcttcatgaaggcgtggaagatgctctacccgttcatcgacaacaacaccagggccaagttcgttttcgtgaacaacaagagcctgcacgagacactgcgccgggagatcgacgagacccagctcccagagttccttggagggaagacgcccctgatctccctcaaggactgtgcccggcagcctcaatccgtttgaccctacacactgtcatgcttttagaaggtacgagagcacatgattatccatggtgttgtaacagggattgtatctagataaggtcccgaaataatggtgtaactgtaagatgcagcagtgtctgcttgcatggggcggggtctattcactagttcgactgaaatcaattaaccgagctctggctgtatgcatatgaaaactatgaacaggaaggcaccttccaagcc

SEQ ID NO: 10148 - protein, 249 aa, Panicum virgatum
  misc_feature: Ceres CLONE 1721499
  misc_feature (87)..(249): Pfam Name: CRAL_TRIO Pfam Description: CRAL/TRIO domain
  misc_feature (4)..(72): Pfam Name: CRAL_TRIO_N Pfam Description: CRAL/TRIO, N-terminus
  misc_feature: SWISSPROT Homolog: EC 3.1.3.48 Protein-tyrosine-phosphatase
MASGAGGGAAGEGEWLMVAQLRATVQAQDPRAKEVDNLTLRRFLRARDHNVDKAAAMFLKFLQWRREAVPEGFVPEEKVRRELPQDKVCMGGVDRTGRPILVAFPARHFSANRDLTEFKSYVVYFFDTICASIPRGQEKFLLLVDFKSWGYSNCDIRAYLAAIEIMQNYYPERLGKALMINVPYLFMKAWKMLYPFIDNNTRAKFVFVNNKSLHETLRREIDETQLPEFLGGKTPLISLKDCARQPQSV

SEQ ID NO: 10149 - DNA, 685 bp, Panicum virgatum
  misc_feature: Ceres CLONE 1721519
  misc_feature: Encodes the peptide sequence at SEQ ID NO. 10150
cggccgcgtgcggctgtctcgtgaattttctaccaaccgcatttctccgccgcggctcgagctcgactcgcgaaatcacacatggccgctgccgccgccgcagcttcctgccccgcgccgccgcgccggcttagctccgccatggcgctgctgccggcgccctcccccgccgcgccctggcgccggagggcggtcggctacggctccttctccgcccggcggtggccgtgccgccgctgggcgcaccggccggagtcctcggcgccccggatccggcgtcagtcgccgtcgcggcgcggcgcggcggtgagggtgagctgcgcttactcccccggcgctgaaagaattactgcatgctcttggaatgaatatgtgatctgcagtgatgtacctgtccttattgagttttgggcctcctggtgtggaccttgcaggatggtcacacgaattgtcgatgagatagcacaagagtatgctgggagaataaaatgctataagcttgacactgatgattacccacaggttgctactgcttacagtatcgagaggattccaactgttttactctttaaggatggagagaaaatacatagtattacagggacactgccaaaggctgtttatgtgaaagccattgagaaatctatttcagacaatgatatatttgattagtatactttggtcc

SEQ ID NO: 10150 - protein, 176 aa, Panicum virgatum
  misc_feature: Ceres CLONE 1721519
  misc_feature (65)..(168): Pfam Name: Thioredoxin Pfam Description: Thioredoxin
  misc_feature: SWISSPROT Homolog: EC 1.8.1.8 Protein-disulfide reductase
MALLPAPSPAAPWRRRAVGYGSFSARRWPCRRWAHRPESSAPRIRRQSPSRRGAAVRVSCAYSPGAERITACSWNEYVICSDVPVLIEFWASWCGPCRMVTRIVDEIAQEYAGRIKCYKLDTDDYPQVATAYSIERIPTVLLFKDGEKIHSITGTLPKAVYVKAIEKSISDNDIFD

SEQ ID NO: 10151 - DNA, 824 bp, Panicum virgatum
  misc_feature: Ceres CLONE 1721551
  misc_feature: Encodes the peptide sequence at SEQ ID NO. 10152
agacaaatcctatcctcctccacctagtcaccacagtcgtctctccctgcgccgcgtgagctgccaacgatggcccttgagacgtgcttcagagcgtgggcgctgcacgccgcccctgccggcggcaaggacaggctcgccgtcggcggcggcggcagcagcttcgcgccgtccaagcgggccgccgccgccgccgcgccgctgtccgtcggccgcgtcgccacgcggcggccccggcacgtctgccagtccaagaacgccgtcgacgaagtgctggtggcggatgagaagaactgggacgggatggtgatggcgtgcgagacaccggtgctggtggagttctgggcgccgtggtgcgggccctgccggatgatcgcgccgttgattgacgagctggccaaggactacgccggcaagatcaagtgctgcaaggtgaacacggacgactgccccaacgtcgcctccacctacggcatccgcagcatccccaccgtgctcatcttcaaggccggcgagaagaaggagagcgtcatcggcgccgtgcccaagaccacgctcaccaccatcatcgacaagtacatcggcagctcgtgatcgagccaactggggttgatgggtgatgttgttgttggagatgaactaaatacatacgtgtccgtgctcgcgcatacacaccatgtatctcttgttgcgatgatgcgataactcaggcagccgtctgctcctgctcccttatactatgtcgaatccaactccattaattagtttccagtgcatgatttcacagtgaatattataaattaagtcgtgtgtatattattatt

SEQ ID NO: 10152 - protein, 174 aa, Panicum virgatum
  misc_feature: Ceres CLONE 1721551
  misc_feature (67)..(170): Pfam Name: Thioredoxin Pfam Description: Thioredoxin
  misc_feature: SWISSPROT Homolog: EC 1.8.1.8 Protein-disulfide reductase
  misc_feature: Functional homolog of the protein sequence given in SEQ ID NO 50158
  misc_feature: Useful for making plants with modulated heat sensitivity
MALETCFRAWALHAAPAGGKDRLAVGGGGSSFAPSKRAAAAAAPLSVGRVATRRPRHVCQSKNAVDEVLVADEKNWDGMVMACETPVLVEFWAPWCGPCRMIAPLIDELAKDYAGKIKCCKVNTDDCPNVASTYGIRSIPTVLIFKAGEKKESVIGAVPKTTLTTIIDKYIGSS

SEQ ID NO: 10153 - DNA, 751 bp, Panicum virgatum
  misc_feature: Ceres CLONE 1721553
  misc_feature: Encodes the peptide sequence at SEQ ID NO. 10154
accagcgcttgcaacaactcatccatccagcaccgtatcgtgccctcatcacattcgcgcacaatggctcgcgctcagcaggtcgtggcgatcgccgtcgttgccgccgtcgtgctgctcgccgccgcggccacctccgaggccgccgtgacctgcgggcaggtcaactccgccatcggcccctgcatcgcctacgcccgcgggtccggctccggcccctcctcagcctgctgcagcggagtcaggagcctcaactccgccgccaggagcaccgccgacaggcgcgccgcatgcaactgcctcaagtccgccgcaggcagggtgagcggcctcaacgccggcaacgccgccagcatcccgtccaagtgcggagtcagcatcccctacaccatcagcccatccgtcgactgctccaaggtggcttaatatatatcgtgatgagttggttggagcctgctgccaagcacatccaccgatatatctagctatcgtctatatatgatcgatcgagttcttgctagctcgctgatgaataaaatctctccgccgtcgctcatcatgtgagagacacggccggatcggatgtgtcagtccctgctacgttttgtacgtgtctgctccatgtacacctccatttccgttccagagtctgtaccttgtccactaccttttaatatatacaccactttttggtgtatatatatgctccgatccatgagtttatttcgatgcttctgagttctgatgcttc

SEQ ID NO: 10154 - protein, 120 aa, Panicum virgatum; identical to SEQ ID NO: 10108
  misc_feature: Ceres CLONE 1721553
  misc_feature (31)..(116): Pfam Name: Tryp_alpha_amyl Pfam Description: Protease inhibitor/seed storage/LTP family

SEQ ID NO: 10155 - DNA, 918 bp, Panicum virgatum
  misc_feature: Ceres CLONE 1721563
  misc_feature: Encodes the peptide sequence at SEQ ID NO. 10156
aaagccgctctcgcccccagaaataaagcagctcctcctgtggggcggcgaacaactccccatcgccaaaaccctagccccaatccgattccgatcgaggagcgctgcttccttgccatggcgggcaccgttagccaggcgagcctcctgctccagaagcagctcaaggatctcgcgaagaaccccgtggatgggttctctgccgggctggtggatgatagcaacgtcttcgagtggcaggtcaccatcatcggcccgcctgacaccctatatgacggaggctacttcaatgcaataatgaccttcccccagaattatcccaacagcccaccatcagtgagatttacttctgagatgtggcatccaaatgtttatcctgatgggcgtgtgtgcatttctattcttcatccacctggtgaagatcccaatggctatgaacttgcaagtgaacggtggacaccagtgcacacggttgaaagtatagttctgagcatcatttcgatgctctctagtccaaatgatgagtctccagcgaacattgaagcggctaaggattgcagagaaaagagggatgagttcaagaaaaaggttaggcacattgttcgcaaatctcaggaaatgctctgaaagaggatcatctggggagtgacgagtgctgcaaccggtgctgtgtctcaccatcatcaccccacgcccgcatttcagcttctcccctgtatattttccattcagtgtcattagtatggtggtgttggtctcttcgccagagaaactcgggaatgttgcttatccttaaaatttgattgtattatgtggcatggggtgttgatgtcgaaaatgtttgaacatgctgctacctaatcataattttcgttatgaacatcataaaaaagaagtgacggttgcctaatgcatctc

SEQ ID NO: 10156 - protein, 169 aa, Panicum virgatum
  misc_feature: Ceres CLONE 1721563
  misc_feature (11)..(162): Pfam Name: UQ_con Pfam Description: Ubiquitin-conjugating enzyme
  misc_feature: SWISSPROT Homolog: EC 6.3.2.19 Ubiquitin--protein ligase
MAGTVSQASLLLQKQLKDLAKNPVDGFSAGLVDDSNVFEWQVTIIGPPDTLYDGGYFNAIMTFPQNYPNSPPSVRFTSEMWHPNVYPDGRVCISILHPPGEDPNGYELASERWTPVHTVESIVLSIISMLSSPNDESPANIEAAKDCREKRDEFKKKVRHIVRKSQEML

SEQ ID NO: 10157 - DNA, 699 bp, Panicum virgatum
  misc_feature: Ceres CLONE 1721568
  misc_feature: Encodes the peptide sequence at SEQ ID NO. 10158
attttcctccacctcctgagccctccccacttcaccccggcggcggcgcagcagcagcagcagcagctgaagatggtgaagttcctgaagcccggcaaggccgtgatcctccttcagggccggttcgccggccggaaggcggtgatcgtgcgcgtgttcgaggagggcacccgcgaccgcccctacgggcactgcctcgtcgccggcctcgccaaataccccaagaaggtgatccgcaaggactccgccaagaagacggccaagaagtcccgtgtcaagtgcttcatcaagctcgtaaacttcacccacctcatgcccacccgctacacccttgacgttgacttcaaggacgtcgcctcgggcgggcccgacgcgctctccacccgggacaagaaggtcgccgcctgcaaagccgcgaaggcccgcctcgaggagaggttcaagacaggcaagaacaggtggttctttaccaagctccgcttctagatgccgggcgtccagcatagtacctgctttagttgtcaatttcatgtatcgcaaacccttatctatgttttggtattgccatgaagacttcgtgcttactgttatggatcttggagaggttgacatgtcgatgatgttttaaatgatgtcaatcatagaccttgtccaaattttgttcagaatcattgcgtggaatgtgctgttttcaatctt

SEQ ID NO: 10158 - protein, 137 aa, Panicum virgatum
  misc_feature: Ceres CLONE 1721568
  misc_feature (52)..(137): Pfam Name: Ribosomal_L27e Pfam Description: Ribosomal L27e protein family
  misc_feature (7)..(40): Pfam Name: KOW Pfam Description: KOW motif
MVKFLKPGKAVILLQGRFAGRKAVIVRVFEEGTRDRPYGHCLVAGLAKYPKKVIRKDSAKKTAKKSRVKCFIKLVNFTHLMPTRYTLDVDFKDVASGGPDALSTRDKKVAACKAAKARLEERFKTGKNRWFFTKLRF

SEQ ID NO: 10159 - DNA, 742 bp, Panicum virgatum
  misc_feature: Ceres CLONE 1721582
  misc_feature: Encodes the peptide sequence at SEQ ID NO. 10160
tagccgcgcggacgctctcccccacccgagccttcccgctgtcgccgcctcgctccgcgcgaccgatctgccgccgccgccgccgccatgtcgctgatcgcgggtgaggacttccagcacatcctgcgtctgctgaacaccaacgtggatgggaagcagaagatcatgttcgcgatgacctccatcaagggtatcggccgccgcttctccaacatcgtctgcaagaaggccgacatcgacatgaacaagagggccggcgagctgacgcctgacgagctggagaggctgatgacggtggtggcgaaccccaggcagttcaaggtgccggactggttcctcaacaggaagaaggactacaaggacggcaggttctcgcaggtcgtctccaacgccctcgacatgaagctcagggacgacctcgagagactcaagaagatcaggaaccaccgtggtctgcgtcactactggggcctccgtgtccgtggccagcataccaagactactggcaggcgtggaaagaccgttggtgtctctaagaagcgataagctatatatctaccaatcttggccttattactgtgttggttcgtgtccaaacagtcttgatgaagcgtttctgtttaggcagttccctgaaatgatgttttgccctaggaaaatcatgcagttatagaaccttaatatattgtatcgtacaatgtgttttttgcaacctctaagagtaatttgattttgatgagac

SEQ ID NO: 10160 - protein, 152 aa, Panicum virgatum; identical to SEQ ID NO: 9992
  misc_feature: Ceres CLONE 1721582
  misc_feature (14)..(142): Pfam Name: Ribosomal_S13 Pfam Description: Ribosomal protein S13/S18

SEQ ID NO: 10161 - DNA, 748 bp, Panicum virgatum
  misc_feature: Ceres CLONE 1721585
  misc_feature: Encodes the peptide sequence at SEQ ID NO. 10162
agaaatcctccgcaacttccccgagcatcctcgcattccaaccgagcaaaccctcgttcctccaccgccgagagaagccaagcggcatcgatggcgcccaaggcggagaagaagccagcggccaagaagcccgcagaggaggagcccgcggagaaggcggcgcctgcggagaaagcccccgcgggcaagaagcccaaggcggagaagcggctcccggcgggcaagtccgccggcaaagagggcggcgacaagaaggggaagaagaaggccaagaagagcgtggagacgtacaagatctacatcttcaaggtcctcaagcaggtgcaccccgacatcggcatctcctccaaggccatgtccatcatgaactccttcatcaacgacatcttcgagaagctcgccgcggagtccgccaagctcgcccgctacaacaagaagcccaccatcacctcccgcgagatccagacctcggtgcgcctcgtcctccctgaggagctcgccaagcacgccgtgtcagagggcaccaaggctgtcaccaaattcacctcgtcttaggctgtgatgaaaggcttgtttgcgcctacctatcatgtgtcgcttctcctggtagtagtagtagttgttcggagacttggctggtgtggtgtagtgaactgttccggtggcttttgacttgtatgaattatcgttctggcaatggaaggcaattgttatctgaaacttgatcagtaatccatgttttcttgtc

SEQ ID NO: 10162 - protein, 154 aa, Panicum virgatum
  misc_feature: Ceres CLONE 1721585
  misc_feature (61)..(131): Pfam Name: Histone Pfam Description: Core histone H2A/H2B/H3/H4
  misc_feature: Functional homolog of the protein sequence given in SEQ ID NO 50160
  misc_feature: Useful for biocontainment applications
  misc_feature: Useful for making plants with modulated flowering time
MAPKAEKKPAAKKPAEEEPAEKAAPAEKAPAGKKPKAEKRLPAGKSAGKEGGDKKGKKKAKKSVETYKIYIFKVLKQVHPDIGISSKAMSIMNSFINDIFEKLAAESAKLARYNKKPTITSREIQTSVRLVLPEELAKHAVSEGTKAVTKFTSS

SEQ ID NO: 10163 - DNA, 923 bp, Panicum virgatum
  misc_feature: Ceres CLONE 1721593
  misc_feature: Encodes the peptide sequence at SEQ ID NO. 10164
acccctaagccagctccctagaccacggtcgcagaacattagagtcgagagagaggttgaccacatcgcccgtcgcgatggcgttagcctgcacaggcaggctaatccaccccggcatggtgtccaagaacccaagaacgccaccaccaccgccgcacttgcacctccacacccataggcccgtggccatcacgatggcatcgtcgtcccatcatttcgcgctccactccgtcgacgtctccaaggacgacaagccgctggagacgccgccgccgccgccgactgcagagaccgctcagcaagacgccgccgcgccgttgcagccggaggaggacgacggcccgaagctggacctgcggcggtttgaggagaagttcgcggtgctcaacacggggatccacgagtgccgatcgtgcgggtaccggtacgaccaggcggcgggggacccgtcgtacccggtgccgccgggcctgccgttcgcgcagctgcccgacgactggcggtgccccacgtgcggcgccgcgcagtccttcttcgagagcaagagcgtcgagatcgccgggttcgcgcagaaccagcagttcgggctcggcggcaactccctcaccacgggacagaaggggctgctcatctacggcagcctcctcctcggcttcctcttcttcatctccggctatttcttgcaatgagaaccatgatgcaggctgctgctgctccatggtaatagcctgcaacgatggtcgtcgattgattctaggtgtgagcttgcttgcatgtttaattgctaagtcgatgtgaatacacaactgtaagcatcttccgtaccagagagatggttaattttgccgtgaatgcacttggggtaaatctctgcgataaatgctatagattttgcaagaccaattcattttcttttaccatgg

SEQ ID NO: 10164 - protein, 203 aa, Panicum virgatum
  misc_feature: Ceres CLONE 1721593
  misc_feature (107)..(153): Pfam Name: Rubredoxin Pfam Description: Rubredoxin
MALACTGRLIHPGMVSKNPRTPPPPPHLHLHTHRPVAITMASSSHHFALHSVDVSKDDKPLETPPPPPTAETAQQDAAAPLQPEEDDGPKLDLRRFEEKFAVLNTGIHECRSCGYRYDQAAGDPSYPVPPGLPFAQLPDDWRCPTCGAAQSFFESKSVEIAGFAQNQQFGLGGNSLTTGQKGLLIYGSLLLGFLFFISGYFLQ

SEQ ID NO: 10165 - DNA, 838 bp, Panicum virgatum
  misc_feature: Ceres CLONE 1721615
  misc_feature: Encodes the peptide sequence at SEQ ID NO. 10166
aaaaaagttactcgcgactcgccaaacccgatccgatccccaaaattccccacacccatggcggcgagcttgtggcgggcggtgatgggcaccggcgcggcgtccgcggacgccgatccggcgggcggcggcgtggagttctggcgtgttccggagcgcgtaggttggctgaccaagcagggcgagtacatcaagacgtggcggcggcggtggttcgtgctcaagcaagggaggctcttctggttcaaggactcgaccgtcacgcgcgcctccgtgccccgcggcgtcatccccgtcgcctcctgcctcaccgtcaagggcgccgaggacgtgctcaaccggccctacgccttcgagctctccaccccgcgtgagaccatgtacttcatcgcggacactgagaaggagaaggaggagtggatcaactccataggccgctccatcgtacagcactcccgctccgtcaccgacgctgaggtcgtcgactacgacagccgccctggcgagaagtgatcgatttattcgatttgattggtgagcaaggaccggacacgccttgtaactctgcaacatctctctatgttattgctcctttaggtttcgcgcttgcatcttcttgcttcgtggatatgatctgtgcatttgtataatacttcggtcattgggatgtatagctttctctctgatatgatctctgttcaaatttctggtcaattgattcatattggatgttctagttttttgtgaagccacgccattggatgtgtgatgttgctgcaaattttattgccgaattttgacttgtgctatttgaatatcatatcagttttgatccacg

SEQ ID NO: 10166 - protein, 151 aa, Panicum virgatum
  misc_feature: Ceres CLONE 1721615
  misc_feature (32)..(130): Pfam Name: PH Pfam Description: PH domain
  misc_feature: SWISSPROT Homolog: EC 2.7.11.1 Non-specific serine/threonine protein kinase
MAASLWRAVMGTGAASADADPAGGGVEFWRVPERVGWLTKQGEYIKTWRRRWFVLKQGRLFWFKDSTVTRASVPRGVIPVASCLTVKGAEDVLNRPYAFELSTPRETMYFIADTEKEKEEWINSIGRSIVQHSRSVTDAEVVDYDSRPGEK

SEQ ID NO: 10167 - DNA, 789 bp, Panicum virgatum
  misc_feature: Ceres CLONE 1721616
  misc_feature: Encodes the peptide sequence at SEQ ID NO. 10168
cttcaactctgctctcccccttccttcccctccccccgtcccctgtccgtctccgcccagatccagatccagggttcaatcaccacaccaggataagcaaccgagacaatggcggcagactctagcgctcgtaggcagccaaccttcaccaaggttgaccagctgcgcccggggacccatggccacaacctcattgtcaaggtcgttgactccaagatggtcgtccagaggggccgcgatggagggccgcagggcaggcagatgcggattgctgagtgcttggtcggcgataaaaccggcatcatcgtcttcactgcaagaaacgaccaagtggatgtaatgaagcctggaacaactgttgaactgaggaatgcaaagattgacatgttcaagggttcgatgcggctcgccgttgacaagtggggaattgtgaaagctgcagaaagcccagctgagtttgcagtcaaggaggacaacaacctgtccttgattgagtttgagctggtgaccgtggtggagtgaaaaccaccttttgtaggaggatgttgcgttatgttatgttgttgaacctattgggcaccaccaaaaaataaacaagacatggttgatgttctcgtatacattggaggttggttatggttagtgatgtttagttatcaaaatcagcgagagtcgtccatggcatctcccacatactagattgtagtgtggtgtagcccatcctcgttggacctgtcataatgcgttgtgagctgtcataatgcgttgtgagctgcctattgcggtatc

SEQ ID NO: 10168 - protein, 137 aa, Panicum virgatum
  misc_feature: Ceres CLONE 1721616
  misc_feature: Functional homolog of the protein sequence given in SEQ ID NO 50161
  misc_feature: Useful for making plants with modulated drought sensitivity
  misc_feature: Useful for making plants with modulated water use efficiency
MAADSSARRQPTFTKVDQLRPGTHGHNLIVKVVDSKMVVQRGRDGGPQGRQMRIAECLVGDKTGIIVFTARNDQVDVMKPGTTVELRNAKIDMFKGSMRLAVDKWGIVKAAESPAEFAVKEDNNLSLIEFELVTVVE

SEQ ID NO: 10169 - DNA, 947 bp, Panicum virgatum
  misc_feature: Ceres CLONE 1721617
  misc_feature: Encodes the peptide sequence at SEQ ID NO. 10170
actagcgccgcggcagtgctgcctcctctcttttcccgatccccggagccgaaacagagccggggcggagcggcaccggcggcgagggcatggcgagggccggggagaaggtggactacgtcttcaaggtggtgcttatcggcgactcggcggtgggcaagtcgcagatcctggcccgcttcgcccgcaacgagttcagcctcgactccaaggccaccatcggggtcgagttccagacccgcaccctcgtcatcgaccacaggagcgtcaaggcccagatctgggacaccgccggccaggagagatatagggctgtgacaagcgcgtattacagaggtgcactgggagctcttctggtctatgacatcaccaggcgccagagctttgatcatataccacggtggctagatgaactccgtgcccatgctgacaagaacatagtgataatgctagttggcaacaagagcgaccttgaggagcagcgagcggtgagtactgaggatgccaaggagtttgccgagaaggagaacctcttcttcctggagacttctgcacttcaggcaacaaacgtggagagtgctttccaaaccgtcttgacagagatcttcaaaatccacagcaagaagaacatggtgtccgagccaaagagcaatgggtctgccccagcaatgccagggaagaaggtccttgtcccaggtccggctcaggaaatcccgaagagcaagtgctgtagttccatgtgatgcttctatattatgtgttgagtatattcgtgcaatattgtttgatcgtatatccctgccgaaatgctcagattttggcgggttgattgtgttgaaccactgctgtatcttagattttgtcacaattgtgacatgagggggaaggatgttctgatgtcttgggtgttattgttctccgattgatacacatttttttcctgccag

SEQ ID NO: 10170 - protein, 217 aa, Panicum virgatum
  misc_feature: Ceres CLONE 1721617
  misc_feature (13)..(174): Pfam Name: Ras Pfam Description: Ras family
  misc_feature (13)..(127): Pfam Name: Miro Pfam Description: Miro-like protein
  misc_feature: SWISSPROT Homolog: EC 2.7.11.1 Non-specific serine/threonine protein kinase
  misc_feature: Functional homolog of the protein sequence given in SEQ ID NO 50162
  misc_feature: Useful for making plants with altered lignin content
  misc_feature: Functional homolog of the protein sequence given in SEQ ID NO 50163
  misc_feature: Useful for making plants with altered alkaloid content
  misc_feature: Functional homolog of the protein sequence given in SEQ ID NO 50164
  misc_feature: Useful for making plants with altered terpenoid content
MARAGEKVDYVFKVVLIGDSAVGKSQILARFARNEFSLDSKATIGVEFQTRTLVIDHRSVKAQIWDTAGQERYRAVTSAYYRGALGALLVYDITRRQSFDHIPRWLDELRAHADKNIVIMLVGNKSDLEEQRAVSTEDAKEFAEKENLFFLETSALQATNVESAFQTVLTEIFKIHSKKNMVSEPKSNGSAPAMPGKKVLVPGPAQEIPKSKCCSSM

SEQ ID NO: 10171 - DNA, 827 bp, Panicum virgatum
  misc_feature: Ceres CLONE 1721622
  misc_feature: Encodes the peptide sequence at SEQ ID NO. 10172
atattcgtactagcttctgttccggcgcccttctgatccacaggcagccatggcgttgcagcggatatcggaagtgatccgatttctgcactcgcccccgcatcgtgggttgatggtccgctccgctatcctctgggggctcggcgacgccgccgccgccgcccaggccatggtccactactccgctcaggataaagatgaggagtccatttctttcgggaataaagataaggagttcaaaatcaattggtatagagtgtacaaaacaagtgtttttggagtttttgcttgtattggaccagctgcatattaccggtttaggtttaataagaggctgtggagctccattactacagctgaagttgttagctcagcagctcgtgaaggtctctgggcaactataaatcttgccacgttcttcccgttcgtgggttccacgccaaagactaggagtgtggagcaggccaaggaagacatgaagagaggtttcacccctgctctagtgctgggcggagctgtggtgccaaccttgctgttcacaaactggcgcttcgtccccacgccataccagcttcattgtgccagcttgttcgccctggtaggcagctgttccctctcattgattgacttgagcaccacaaggatgatggcgcagcgtttctggaaggatggaacgagtatggcttgatctgacatctgcttttgagctagtagtagtcatgtgtgtatgttggtacggatcaaacatctgtaagatctggttgatccatgaagaaaacgggtttgcagaaaaactaactctagtacgcagtggggttcttcctcgg

SEQ ID NO: 10172 - protein, 212 aa, Panicum virgatum
  misc_feature: Ceres CLONE 1721622
  misc_feature (128)..(198): Pfam Name: Mpv17_PMP22 Pfam Description: Mpv17 / PMP22 family
MALQRISEVIRFLHSPPHRGLMVRSAILWGLGDAAAAAQAMVHYSAQDKDEESISFGNKDKEFKINWYRVYKTSVFGVFACIGPAAYYRFRFNKRLWSSITTAEVVSSAAREGLWATINLATFFPFVGSTPKTRSVEQAKEDMKRGFTPALVLGGAVVPTLLFTNWRFVPTPYQLHCASLFALVGSCSLSLIDLSTTRMMAQRFWKDGTSMA

SEQ ID NO: 10173 - DNA, 816 bp, Panicum virgatum
  misc_feature: Ceres CLONE 1721624
  misc_feature: Encodes the peptide sequence at SEQ ID NO. 10174
aagcaaccatccacagcaagagaaggaagcaactccaacggcagtcacggtgatggcctccatgggctccctcgccttcaccaccgccggcgcgcgtgccggcgtcctcccggtccgcgtcccggcggccgcgccgcggcggcgagccctggtcgtcagggcccaggccgaggacgccgagtcagcaacggaggcgacaaccgcggcgccctccactcccctgacggcgaagcccaaggcggcggcgaggcccgggctgtgggacgcgctggcgttcagcggcccggccccggagcgcatcaacgggcggctcgccatggtgggcttcgtgtccgcgctcgccgtcgaggcgtcccgcggcgggggcctcctctcgcaggctggcagcgggtccgggctcgcctggttcgcggccacggccgccgtgctctccgtggcgtcgctggtgccggtcctcaggggggagagcgccgagggccgcagcggcggcgtcatgagcgccgacgccgagctctggaacggccgcttcgccatgctgggcctcgtcgcgctcgccgtcaccgagtacatcaccggcgcgcccttcgtcaacgtgtagatgcccacggttgtgcgcgtggagttggacttggacttggaccccgtgtccgtgtggtgtgcctgtaacccaggcaggttctctgttctgtcctacatcaactagcttggaaaattcaacatattattccaaaaatattgcaggactccgatcctacaagcttcatttygtytccgttttccgaaacccaaacagaaaacaagtcaaattttcactgg

SEQ ID NO: 10174 - protein, 181 aa, Panicum virgatum
  misc_feature: Ceres CLONE 1721624
  misc_feature (51)..(172): Pfam Name: Chloroa_b-bind Pfam Description: Chlorophyll A-B binding protein
  misc_feature: SWISSPROT Homolog: EC 4.99.1.1 Ferrochelatase
MASMGSLAFTTAGARAGVLPVRVPAAAPRRRALVVRAQAEDAESATEATTAAPSTPLTAKPKAAARPGLWDALAFSGPAPERINGRLAMVGFVSALAVEASRGGGLLSQAGSGSGLAWFAATAAVLSVASLVPVLRGESAEGRSGGVMSADAELWNGRFAMLGLVALAVTEYITGAPFVNV

SEQ ID NO: 10175 - DNA, 754 bp, Panicum virgatum
  misc_feature: Ceres CLONE 1721647
  misc_feature: Encodes the peptide sequence at SEQ ID NO. 10176
aaatcgatcggagcacaacagaagccacacgctcacaacacacaagcaagcaagcaatctgaggagaagccggccgccgatttccccagcccgtgcattgttcccgatggcgaccatggtgatggcctctgccgcgagctccctcgccttcgccgccaccggcgcgagcgccggccgcttccccgcccggcttccggcggcggcggggctcgcgccgcgccggcgcgcaccgctcgtcagggcgcaggctaataagggtcctgagaagccggcagcaagcccggggctctgggacgcgctggcgttcagcggcccggcccctgagcgcatcaacgggcggctcgccatggtcggcttcgtgtccgcgctcgccgtcgaggcgtcccgcggcgggggcctcctctcgcaggccggcagcgggtccgggctggcctggttcgcggccacggccgccgtgctctccgtggcgtccctagtgccggtcctcaggggggagagcgccgaggcccgcagcggcggcgtcatgagcgccgacgccgagctctggaacggccgcttcgccatgctcgggctcgtggcgctcgccgtcaccgagtacatctccggcgcgcccttcatcaacgcgtaggtgccaacggtcttgcgtggagttggaccccgtgtggtgtgcattcaatttgtacctgtaaaccctgcaggttctctgttctgtccttgtacatcaactagctatgaaaattcaacatgttattcc

SEQ ID NO: 10176 - protein, 173 aa, Panicum virgatum
  misc_feature: Ceres CLONE 1721647
  misc_feature: SWISSPROT Homolog: EC 4.99.1.1 Ferrochelatase
MATMVMASAASSLAFAATGASAGRFPARLPAAAGLAPRRRAPLVRAQANKGPEKPAASPGLWDALAFSGPAPERINGRLAMVGFVSALAVEASRGGGLLSQAGSGSGLAWFAATAAVLSVASLVPVLRGESAEARSGGVMSADAELWNGRFAMLGLVALAVTEYISGAPFINA

SEQ ID NO: 10177 - DNA, 633 bp, Panicum virgatum
  misc_feature: Ceres CLONE 1721660
  misc_feature: Encodes the peptide sequence at SEQ ID NO. 10178
ttttatctgctactttatcatgccctattcattgagattctgcatgttcttctcccctgacaaacgtttcatgttttcccctcagaatccatacatggtcaacgttatacttggtggttatgataagaatgttggcgcttccttgtactacatcgactacattgcaaccttgcacaagattgacaagggtgcttttgggtacggctcctacttctgtttgtcgctaatggacaagctgtaccacccggacatgactgttgaggaagcagtagatcttgttgacaagtgcatcaaggagatccgtctgaggttggtcgttgcgcctcagaactttgtaatcaagatcgtggataaggatggggcgagggagtatgcgaggcgtgagctcgtcggcgacaacacatcagcatcagcatcagcatcagcgggagctgcagcaactacagttgccgcctgaggcgtgaactcgttggagcttgcatattgttaattgtttctcagcgctgctactatgtaatcacaagatactttgggggtcccagaactgtttttatcaattctagcccagacgtgtaactctgttgattctgcacttttcatgtcttcgctgcgtacaaggtagcgtttctcccc

SEQ ID NO: 10178 - protein, 151 aa, Panicum virgatum
  misc_feature: Ceres CLONE 1721660
  misc_feature (1)..(116): Pfam Name: Proteasome Pfam Description: Proteasome A-type and B-type
  misc_feature: SWISSPROT Homolog: EC 3.4.25.1 Proteasome endopeptidase complex
FICYFIMPYSLRFCMFFSPDKRFMFSPQNPYMVNVILGGYDKNVGASLYYIDYIATLHKIDKGAFGYGSYFCLSLMDKLYHPDMTVEEAVDLVDKCIKEIRLRLVVAPQNFVIKIVDKDGAREYARRELVGDNTSASASASAGAAATTVAA

SEQ ID NO: 10179 - DNA, 918 bp, Panicum virgatum
  misc_feature: Ceres CLONE 1721684
  misc_feature: Encodes the peptide sequence at SEQ ID NO. 10180
gccacgctcgccatgcacctcatcctctgctcctccacctcctcgtccccctcgcagcgccgccgctggcccctgcctcccggcgccaccggcgcgggcggctccgacaagtcgccgccgcagcagcagcagccggcgccgcagtccgccacgcggcggctggcggtggccgcgtcgacggcgctggccgccacggccgcgctcgccgcgcgccggcccgcggcgcccccgcccgcgatggccgcggaggcggcgttcgtgcccgcgccgacgccgccgggggccgtgccgcggtggggcaccaagtcgtacgtgcgggagcgcttcttcgagaaggagctcaccgccgaggaggccgccgcgcgcatccggcagaccgcggaggggatgcgcacgctgcgccccatgctggagaccatgtcgtggaagtacgtgctcttctacgtccggctcaagtccaagtacctcgaccgcgacctcaccaccgccatggccggcgtccccgccgcccgccgcgccgactacgtccgtgtcgccaacgagctcgtcgacaacatgacagaggtgcgcgcgtgcacgacgaccgtgtcctccaattttgcaaattccggctgaaaatgcggtttctaactgttttgttttattttgtttttctcaaacaattttggcatggcattctgcgttgtccgccgtgtgcagttcgatcgcttcgtgcggactcccaaggtctacgagtcgtacctcttctacgagaagacgctcaagtcgctggatgacgtggcagagttcctcgcctgacgtacatatatactgtataagttgttctaggatatgcatatggcactgtaatttgaccgtggatgaaggtttcgaacacaattttttttagaaaaaaaatacatgattgttttcgcgcag

SEQ ID NO: 10180 - protein, 204 aa, Panicum virgatum
  misc_feature: Ceres CLONE 1721684
  misc_feature (9)..(201): Pfam Name: PsbQ Pfam Description: Oxygen evolving enhancer protein 3 (PsbQ)
ATLAMHLILCSSTSSSPSQRRRWPLPPGATGAGGSDKSPPQQQQPAPQSATRRLAVAASTALAATAALAARRPAAPPPAMAAEAAFVPAPTPPGAVPRWGTKSYVRERFFEKELTAEEAAARIRQTAEGMRTLRPMLETMSWKYVLFYVRLKSKYLDRDLTTAMAGVPAARRADYVRVANELVDNMTEVRACTTTVSSNFANSG

SEQ ID NO: 10181 - DNA, 1148 bp, Panicum virgatum
  misc_feature: Ceres CLONE 1721700
  misc_feature: Encodes the peptide sequence at SEQ ID NO. 10182
gcggcggcactcaattcccctggcttgcggcggaaccggcgaggaagcccggcgccctcccgggaccgccggtgcgtccgtccccccgtcccctcgctcgtgttcacatgatgtatcatgctaagaatttttctgtgccctttgctccgcagagggctcagaataatgagcatgcaagtaatattggagctattggtggaaccaacataagcaaccctgctaatcctgtaggaagtgggaaacaacgtctaagatggacttcagatctccataatcgctttgtggatgccatcgcccagcttggtggaccagatagagctacacctaaaggggtgctcactatgatgggtgtgccagggatcacaatttatcatgtaaagagccatttgcagaagtatcgccttgcaaagtatataccagaatctcctgctgaaggattacaaatcaatgaagcattaaagatgcaaatggaggttcagaagcggctacatgagcagctcgaggttcaaaggcaattgcagctgagaattgaagctcaaggcaggtacttgcaaatgatcatagaggagcaacaaaagcttggtggatcattcaaagcttcagaggatcagaagctttcacattcacctccaagcttagatgagtaccctgagagcacgcagccttctcccaagaaaccaaggatagatgcgttgtcaccggattcagagcgcgatacgactcaagcagaattcgaatcccatctgattggtccatgggatcaagaaatctgcgggaaaaatctatgcggcgttgcattcccagtggaggagttcaaagcagaccctggtatgagcaaatcataaagcaaagccttccttgacgggcattcgtcatagttgacctctccactagatctcattcgcatgtgaatatatatcatcttaacaacaggatgttgttcggatcttctggatccgcacctgatccttgcagccatggccagttttgtcacggtagtattcatcatacaactcttgtaattatgaggatggtgttacaaagtttctagccagcatttccttagccctgagttgaaccatgtagcaagaaagaggacatgtttacacgcaatacatttgctgtgaagagggcgtgcccctggagcc

SEQ ID NO: 10182 - protein, 245 aa, Panicum virgatum
  misc_feature: Ceres CLONE 1721700
  misc_feature (47)..(98): Pfam Name: Myb_DNA-binding Pfam Description: Myb-like DNA-binding domain
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 2000 in the 11/479,226 US patent application
MMYHAKNFSVPFAPQRAQNNEHASNIGAIGGTNISNPANPVGSGKQRLRWTSDLHNRFVDAIAQLGGPDRATPKGVLTMMGVPGITIYHVKSHLQKYRLAKYIPESPAEGLQINEALKMQMEVQKRLHEQLEVQRQLQLRIEAQGRYLQMIIEEQQKLGGSFKASEDQKLSHSPPSLDEYPESTQPSPKKPRIDALSPDSERDTTQAEFESHLIGPWDQEICGKNLCGVAFPVEEFKADPGMSKS

SEQ ID NO: 10183 - DNA, 1129 bp, Panicum virgatum
  misc_feature: Ceres CLONE 1721705
  misc_feature: Encodes the peptide sequence at SEQ ID NO. 10184
aagccatctgcaagtcaagtctcactagtcactcctaatcctaaaccacaagacaccttggtgttagaagtgcaatggcgaccagcaccatggccctctcctctacggccttcgccggcaaggccgtcaacgtgccatcgtctctctttggcgaggcccgcgtgaccatgcgcaagaccgcggcgaagcccaagccggctgcctccggcagcccgtggtacggcccagaccgcgtgctctacctcggcccgctctccggcgagcccccgagctacctgaccggcgagttccccggcgactacggctgggacaccgccgggctctcggccgaccccgagaccttcgccaagaaccgggagctggaggtgatccactcccgctgggccatgctcggcgcgctcggctgcgtcttccccgagctgctcgcccgcaacggcgtcaagttcggcgaggccgtctggttcaaggcgggttcccagatcttcagcgagggcgggcttgactacctcggcaacccaagcctgatccacgcgcagagcatcctcgccatctgggcctgccaggtcgtgctcatgggcgccgtcgaggggtaccgcgttgccggcggcccgctcggcgaggtcgtcgacccgctctaccccggcggcagcttcgacccgctcggcctcgccgacgatcccgaggccttcgccgagctcaaggtcaaggagctcaagaacggccgcctcgccatgttctccatgttcggcttcttcgtgcaggccatagtcaccggcaagggcccgcttgagaacctcgccgaccatctcgccgaccccgtcaacaacaacgcctgggcctacgccaccaacttcgtgcccggcaagtgaggggtcggttcccgaactgttcgatctgtaggaggtccggatgtgagcgcgcattggtttcagtttgtaccatgatataaattactgggttccaaccgagaaggaaattgcttgctgtgttcgttgtctgaactcgaactgctgcatcgcaaataggcagtgctagttatgcctttggcaacgattagacgagaagttctggttatgtctacatcataagagacgcgaagaaaaaaaaaactatgatctgctctattgct

SEQ ID NO: 10184 - protein, 259 aa, Panicum virgatum
  misc_feature: Ceres CLONE 1721705
  misc_feature (58)..(226): Pfam Name: Chloroa_b-bind Pfam Description: Chlorophyll A-B binding protein
MALSSTAFAGKAVNVPSSLFGEARVTMRKTAAKPKPAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAVEGYRVAGGPLGEVVDPLYPGGSFDPLGLADDPEAFAELKVKELKNGRLAMFSMFGFFVQAIVTGKGPLENLADHLADPVNNNAWAYATNFVPGK

SEQ ID NO: 10185 - DNA, 776 bp, Panicum virgatum
  misc_feature: Ceres CLONE 1721721
  misc_feature: Encodes the peptide sequence at SEQ ID NO. 10186
atagatggagccatggcctcgcactgcctcttcaccatcatcagcttcaattcattctagctccttccacacgcgtcgtagatgaacgcacgatcgagctcacaccgagaagcagctaccgaccaagacgaagacgaagcggcgctagggtgcatgggactttccttgtgttcccagcagagatctccggccaggccagaaattgcgaccaggggtattcgtgatcgcctgcaacccagcgctgctgctgctattcagaagggccgtggtgagggcgataagatcaatatgccgccgaccaccgtgacggccatccaaagcaacgaaaggttgaagaacgtcttgaggcaggccaaggagccaaactccaacctggtggtgctggagttcacggcgccgtggtcggagccgtgcaagttcatgaggccggcgctggagaagatcgcctccgacttcaaggatcacgccgacttctacacgctcgacgtcgagcagttcaagacatttgctcggaacacccgggtggaggcgctgccgacgttcctgctggtgaggaagaccatcttggagcgcgtcatcggcgtcagcaaggacgagctgcggcgcagcatcgaaaaacacatatccggcattgccattgatcattgccatccataaattaaatccatgtctattcatctgttagactcacactcatcaacacatacatgcttgttacactacaatgttttaatttcctgatccaatggtgtgtgtatatacactttctttcggtg

SEQ ID NO: 10186 - protein, 167 aa, Panicum virgatum
  misc_feature: Ceres CLONE 1721721
  misc_feature (51)..(156): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MGLSLCSQQRSPARPEIATRGIRDRLQPSAAAAIQKGRGEGDKINMPPTTVTAIQSNERLKNVLRQAKEPNSNLVVLEFTAPWSEPCKFMRPALEKIASDFKDHADFYTLDVEQFKTFARNTRVEALPTFLLVRKTILERVIGVSKDELRRSIEKHISGIAIDHCHP

SEQ ID NO: 10187 - DNA, 880 bp, Panicum virgatum
  misc_feature: Ceres CLONE 1721731
  misc_feature: Encodes the peptide sequence at SEQ ID NO. 10188
actcctcattgccccagcatcatcctgcttcgaagccgctgccagctcctccaagagctagccaatcaagccgatcgatggccatggccacgcaagcctccgccgcgacgcgccacctgctggcggcggcgtggtcgccggcggcgaaggcgccgcggccgtcgcagctcgcggtcccgtcgtcctcccgcgggccggccccgctccgcgcggccgccgaggaggccgcggcggcgaccgaggaggcgcccaaggggttcgtgcccccgcagctggaccccaacacgccgtccccgatcttcggcggcagcacgggcgggctgctccgcaaggcgcaggtggaggagttctacgtgatcacgtggacgtcccccaaggagcaggtgttcgagatgcccacgggcggcgccgccatcatgcgggaggggcccaacctcctgaagctggcgcgcaaggagcagtgcctggcgctgggcaccaggctgcgctccaagtacaagatcaactaccagttctaccgcgtcttccccaacggcgaggtccagtacctgcaccccaaggacggcgtctacccggagaaggtcaacgccggcaggcagggcgtcggccagaactaccgcagcatcggcaagaacgtcagccccatcgaggtcaagttcaccggcaagagcaccttcgacctctgatgtgttaattactgctagctgttgggttcgtggttgatggatctgaaggctcggtcgatgtgtaattttactatcaagcttttcttggtgattgtggagaggtgatacatggaatcccttaattaattatatgatgtacatgtttatttggtgatgcgaggttgtccgtcagtccatgcacgttattaaccttt

SEQ ID NO: 10188 - protein, 202 aa, Panicum virgatum
  misc_feature: Ceres CLONE 1721731
  misc_feature (64)..(201): Pfam Name: PsaD Pfam Description: PsaD
MAMATQASAATRHLLAAAWSPAAKAPRPSQLAVPSSSRGPAPLRAAAEEAAAATEEAPKGFVPPQLDPNTPSPIFGGSTGGLLRKAQVEEFYVITWTSPKEQVFEMPTGGAAIMREGPNLLKLARKEQCLALGTRLRSKYKINYQFYRVFPNGEVQYLHPKDGVYPEKVNAGRQGVGQNYRSIGKNVSPIEVKFTGKSTFDL

SEQ ID NO: 10189 - DNA, 693 bp, Panicum virgatum
  misc_feature: Ceres CLONE 1721735
  misc_feature: Encodes the peptide sequence at SEQ ID NO. 10190
atctgtagccttcgccaatcgccagcgccggaagggaaagaagaggacgtcgcggccgcaactcccccacagaggaagaagaagagaccctgctagcgaggatggggaagggcgtcctggaggtgcacctcgtcgacgctaggggcctctccggcaccgatttcctagggaagatcgacccctacgtgatcgtgcagtatcggagccaggagtgcaagagcagcgtcgcccgagatcaggggaggaacccgtgctggaacgaggtgttcaagttccagatcaactcttcggcgtccagcgcgcagcacaagctcatcctccggatcatggaccacgaccacttctccagcgacgacttcctcggggaggcgacgatcgacgtgacggacatcatcagcctgggcgcggagcacggctcgtaccacctcaacgcggcgaagcacagcgtcgtcctcgccgacagcacgtaccacggcgagatcaaggtcggcatcaccttcaccgccgccaaggttgaggaagatgatgaggattttggaggctggaagcacagaaacttcaatgagtaggtgctgtgaactctgaagttctttggttggtttgtagtatagtaattcaggttgggtgtagttcgcattatcattggcttgttaactatgtgtaatcaagtgtgcttaaagccgttgttgatcg

SEQ ID NO: 10190 - protein, 155 aa, Panicum virgatum
  misc_feature: Ceres CLONE 1721735
  misc_feature (6)..(91): Pfam Name: C2 Pfam Description: C2 domain
  misc_feature: SWISSPROT Homolog: EC 3.1.1.4 Phospholipase A(2)
MGKGVLEVHLVDARGLSGTDFLGKIDPYVIVQYRSQECKSSVARDQGRNPCWNEVFKFQINSSASSAQHKLILRIMDHDHFSSDDFLGEATIDVTDIISLGAEHGSYHLNAAKHSVVLADSTYHGEIKVGITFTAAKVEEDDEDFGGWKHRNFNE

SEQ ID NO: 10191 - DNA, 860 bp, Panicum virgatum
  misc_feature: Ceres CLONE 1721751
  misc_feature: Encodes the peptide sequence at SEQ ID NO. 10192
ccaccgcagactcttccgccgtcatcgcgtctcctcgctaggtaggtaggagaggaagagggcgaaatggtgaagcacaacaacgttatccccaacgggcacttcaagaagcactggcagaactatgtcaagacatggttcaaccagcccgcccgcaagcagcggcgccgcatcgctcgtcaaaagaaggctgcgaagatattcccacgcccaactgctggacctcttcgccccattgtccaatgccaaactctcaagtacaacatgaagtcaagggctgggagaggcttcactctcgaggagctgaaggctgcgggcattccgaagaagcttgctccaaccattggcatttctgtggatcaccgccgcaagaacaaatcacttgagggactccaggctaatgtccagaggctgaagacgtacaaggccaagctggttatcttcccaaggcgtgctcgcaaggtcaaggctggtgactctactcctgaggagcttgccagcgccacccaggtccagggtgactacatgccttttactcgtggtgagaagcgctcggttgaggttgtgaaggtcagcgatgagatgaagtcgttcgcagcgtatggcaagatccgccttgagaggatgaacaagaagcaccttggtgcccgccagaagaaggccgctgaggctgagaaggaagagaagaagtaaagtgaccatcggatatagtatcttctagttgatgctacagccaagggcttgttctaggttttgttttgttcctgaaagtagagaccagtggattgttttggtgtccttgtactgtttgatacctggtacgcatttgctgtcctcttgcgcatctgaattgctgtcat

SEQ ID NO: 10192 - protein, 208 aa, Panicum virgatum
  misc_feature: Ceres CLONE 1721751
  misc_feature (6)..(185): Pfam Name: Ribosomal_L13e Pfam Description: Ribosomal protein L13e
  misc_feature: Functional homolog of the protein sequence given in SEQ ID NO 50165
  misc_feature: Useful for making plants with modulated nitrogen use efficiency
  misc_feature: Functional homolog of the protein sequence given in SEQ ID NO 50166
  misc_feature: Useful for making plants with modulated phosphate use efficiency
MVKHNNVIPNGHFKKHWQNYVKTWFNQPARKQRRRIARQKKAAKIFPRPTAGPLRPIVQCQTLKYNMKSRAGRGFTLEELKAAGIPKKLAPTIGISVDHRRKNKSLEGLQANVQRLKTYKAKLVIFPRRARKVKAGDSTPEELASATQVQGDYMPFTRGEKRSVEVVKVSDEMKSFAAYGKIRLERMNKKHLGARQKKAAEAEKEEKK

SEQ ID NO: 10193 - DNA, 526 bp, Panicum virgatum
  misc_feature: Ceres CLONE 1721757
  misc_feature: Encodes the peptide sequence at SEQ ID NO. 10194
tacaacagtagaccctacacatacaagaaggaaaagagatcgaagaacccgcacaagcacatttctttcaagcagcgcaccatcgcacacatggagcccttcacgctcgacgtcttcatctccaagcgctttgtctcggcgtccctcacgcaccgttcgacgtgcaggcaggtcgcggtcgcggggaccaattcgaaggacatcaaggctgcgctcaagtcgaggtccgacataccggcctgcctggccgtgggccgtttcctggcggagagggcgaaggaggccgacgtctacacctgcacctacacgccgagggagcgggacaggttcgaggggaagatcagggctgttgtccagtcgctgatcgataacgggatcaatgtgaagctctaccttgactgagcttttgatgtatggaactatgggcgacttttctggtacttgcaaaatgagcagcctgtggcatggtgttctgctatcatggccgcgatcactaccaccctgttgtgatatgccacttttttct

SEQ ID NO: 10194 - protein, 133 aa, Panicum virgatum
  misc_feature: Ceres CLONE 1721757
  misc_feature (11)..(128): Pfam Name: Ribosomal_L18p Pfam Description: Ribosomal L18p/L5e family
YNSRPYTYKKEKRSKNPHKHISFKQRTIAHMEPFTLDVFISKRFVSASLTHRSTCRQVAVAGTNSKDIKAALKSRSDIPACLAVGRFLAERAKEADVYTCTYTPRERDRFEGKIRAVVQSLIDNGINVKLYLD

SEQ ID NO: 10195 - DNA, 778 bp, Panicum virgatum
  misc_feature: Ceres CLONE 1721758
  misc_feature: Encodes the peptide sequence at SEQ ID NO. 10196
aataacaacacaacaaacacacaacatcacctctccctccctctcacgcacacagctgcacgcgcgtgcgtggacacaacacacagagcatgggttccctaggcccaaccaccattagtagcatgagcagcatggcgaaggcagcagcagccagcattggtacgaagaatagcgtggttgccgtcgccgatcagcagcaagctgcaggccagaagaactgcggcagctgcgccttccagatgccgctgcactacccgcagtacaagaaggcggactacgagaccatgccggagtggcgcgtcgactgcctgctccgcgagtacggcctccccgtcaccggcaacctcgaaagcaagagaaagttcgccatgggagccttcctctggcccgaccagtactgaaggaactcatcatggccgcgctgaatataataaccgacctgatgaggttgacaagagaccaagtacagtggctggagcttcgtcatgtgcaacgctgcctctgagttcatgaaaacaattaggagcgccttgttgttactgtcttagcttgctgaaacgtcaagtatagttcttgttctacgtactggcagcaatctagctagcatttctacgtactgacatgctgatcatctatgcatgctcttgcgctgaatgatatatgtattgcatctatcaatataaaaattagtaaatgtatgcatggtgccagtttctgttttcagcacttacctctatctcacgtttttgtcaaaaccacaactgagctgattgatcag

SEQ ID NO: 10196 - protein, 103 aa, Panicum virgatum
  misc_feature: Ceres CLONE 1721758
  misc_feature: Functional homolog of the protein sequence given in SEQ ID NO 50167
  misc_feature: Useful for making plants with modulated nitrogen use efficiency
MGSLGPTTISSMSSMAKAAAASIGTKNSVVAVADQQQAAGQKNCGSCAFQMPLHYPQYKKADYETMPEWRVDCLLREYGLPVTGNLESKRKFAMGAFLWPDQY

SEQ ID NO: 10197 - DNA, 785 bp, Panicum virgatum
  misc_feature: Ceres CLONE 1721760
  misc_feature: Encodes the peptide sequence at SEQ ID NO. 10198
gttcagccttcctgcccgttcgtatcctcttcctgttcaatcgttccccacctcgccgacaagctagggtttcctccgccgcccgttccagccgccaccatgcctcgccgcagctcaggaaggtctgcgtcgcgccctgctccgcgtgctgctccgatgaggaacccgccacagccagcgcgccaggctcctcctccagctcctgctcagagtggtggtggctccatccttggaggaattgggtccacaattgctcaaggtatggcatttggtactggcagtgccatggcacacagagctgtcgatgctgtaatgggcccccgtaccattcagcatgagactgttgtctcggaggcggctgctgctgctcccgctgctccgatgatgaacgctgattcttgtggcaaccattccaaggccttccaagactgtctcaaccactatggcagcgacatcagcaagtgccagttctaccttgacatgctgaacgagtgccgccggggtggcgccacagcttaagctgctgcttcattggagttgattcctgggttcccttttcactttcattaataagacttaagtgaaactatgaactgcagccacaacctgatgtgtgccgtggccattatcattggtgcatgctgttgaggttgtggtaatgttctgttatcctgggagtagtacattctgctatcctatattgttggtgcagacttctatagcactgatgattataaatatttgaatcaagcagtgatcttgggataaagtttgttctgtgtagc

SEQ ID NO: 10198 - protein, 139 aa, Panicum virgatum
  misc_feature: Ceres CLONE 1721760
  misc_feature (94)..(135): Pfam Name: CHCH Pfam Description: CHCH domain
MPRRSSGRSASRPAPRAAPMRNPPQPARQAPPPAPAQSGGGSILGGIGSTIAQGMAFGTGSAMAHRAVDAVMGPRTIQHETVVSEAAAAAPAAPMMNADSCGNHSKAFQDCLNHYGSDISKCQFYLDMLNECRRGGATA

SEQ ID NO: 10199 - DNA, 799 bp, Panicum virgatum
  misc_feature: Ceres CLONE 1721761
  misc_feature: Encodes the peptide sequence at SEQ ID NO. 10200
gaacgaaaagggactaggcttcactgtgccgctgacatcgggacgataccgtcgcaaagcaagggaggcgcagaggcagagaggccgcctgcgaagcgctggcgcgtgcgataaggcactgacgagacggcatggccgccacggcgtactccacggcgcttcacggcggggcgcgcctcgccgccgtcggcggcgccgccgtgccgtcctccgtcctcgtcccgcggcgtaacctgctgacgcctctccggctccaagatgctccgaggctgtcgctgctccgggcgaaggcctccgacgacgacacctcggccgacgagctcatcgccgacttgaaagccaagtgggacgccgtcgagaacaagaccaccgtcatcacatacgccggcggcgccatcgtcgctctttggctgacctccgtcatcgtcggcgccatcaactccgtgcctctgcttccaaagatcatggagctcgtcggtcttggatacaccggatggttcgtctaccgctaccttctcttcaaggaaagcaggaaagagttggctagcgacatcgagtcactcaagaaaaagattgctgggacagagtagtaaaatgtttgctcccgtgattttttttggatgattcctgcgaaagctcattaccttttctctccttttgtcctaagaaacaagtcactttagcattcaatatttatcctaaaaaataagccatatgtgtatgcaaaaatcaattagtgctaaatatgaataattaataggataaaatagagataaacatggtcgttttatcttcttat

SEQ ID NO: 10200 - protein, 152 aa, Panicum virgatum
  misc_feature: Ceres CLONE 1721761
  misc_feature: SWISSPROT Homolog: EC 6.1.1.9 Valine--tRNA ligase
MAATAYSTALHGGARLAAVGGAAVPSSVLVPRRNLLTPLRLQDAPRLSLLRAKASDDDTSADELIADLKAKWDAVENKTTVITYAGGAIVALWLTSVIVGAINSVPLLPKIMELVGLGYTGWFVYRYLLFKESRKELASDIESLKKKIAGTE

SEQ ID NO: 10201 - DNA, 797 bp, Panicum virgatum
  misc_feature: Ceres CLONE 1721771
  misc_feature: Encodes the peptide sequence at SEQ ID NO. 10202
atggacgaaccctaggcccgccaaactcgcacactgaaacggagaagctcggatcgatgcggcggtggtggtgcgccgccggcggcctcggccgccgcgtcctctcctcctcctcggccgccgccgccgccgcgtcccatgcccgcccgctgcccccgcccctgatctccaaatcggcctccttcaacgcccctttctccgtgccctgccgccggcaccactccctccacgcgcccctgccccgggggctcttccacccggccatcgcttccgccttccgccctccgtcggggcttccgcagcaggtgcggcactacgccaagaaggagaggtcgcgcgcgccgctcacgcccaccaagtccaaagtcaagaaatacaagatgaaggccccctcgtccatgaagttcagattcagaaccatgaacgacgggcagatccgcaggtggagggcgggaaagcgccacaatgcgcacctcaagtccaaggaagcaaaacgaagacttcggaagcctgcattggtgcatttagcttatgcaaaagttataaaaaagctcaacttctgcgggtaggatatgaaagcagatacggtggagtttggcatgggaaacaaggaagctcaaccgctgcatccacatgcagattgtaaacgctggaatctcattggactagtttgaattcttgaattactacttttttgtcatttgatgctttgacttcaggtgttgtgctcttatctgttcagacactactgatgcgaagccgtttgttttcggctaaatgataaaaagttgcgctgc

SEQ ID NO: 10202 - protein, 170 aa, Panicum virgatum
  misc_feature: Ceres CLONE 1721771
  misc_feature (109)..(167): Pfam Name: Ribosomal_L35p Pfam Description: Ribosomal protein L35
MRRWWCAAGGLGRRVLSSSSAAAAAASHARPLPPPLISKSASFNAPFSVPCRRHHSLHAPLPRGLFHPAIASAFRPPSGLPQQVRHYAKKERSRAPLTPTKSKVKKYKMKAPSSMKFRFRTMNDGQIRRWRAGKRHNAHLKSKEAKRRLRKPALVHLAYAKVIKKLNFCG

SEQ ID NO: 10203 - DNA, 744 bp, Panicum virgatum
  misc_feature: Ceres CLONE 1721780
  misc_feature: Encodes the peptide sequence at SEQ ID NO. 10204
atttcatttcagagcgatagggaggatcaggttacccatccgccggggagcgctcttcggcaacaacagcggcgggaaaggaggagagggcaaggggaggagccatgggtaacgcgtcgtcgatgctgacccagtacgacatcgaggaggtccaggagcactgcaactacctcttctctcagcaggagatcgtgtccctgtacgagcggttctgccagctcgaccgcagcgccaagggcttcatctccgaggacgagttcctctccatccccgagttctccctcaacccgctctccaagaggttgctacgtatggttgatggattgaactttaaggattttgttgcctttctttctactttcagtgcaaaggccagtcttcggcagaagatcgaactaatatttaaggtttacgacatcgatggcaagggaaaagtaaccttcaaggacctgctagaagttttacttgacctaacagggtcgttcatgtctgatgaacaaagagagcaagtagtaactaaggtactagaagaagcggggtacaccaaggattgctcattttcagtagaagactttatccagattatcgaccatcctgggctaaagatggaggtggaagtgccaattgattagtgaaaacactgcagatttcagaaaattagtttaatctgcaaggacatagtgtccatactcgatgacatgtaacaggataatggcaccagcattagttgtcctatttgtgacc

SEQ ID NO: 10204 - protein, 175 aa, Panicum virgatum
  misc_feature: Ceres CLONE 1721780
  misc_feature (95)..(123): Pfam Name: efhand Pfam Description: EF hand
  misc_feature: SWISSPROT Homolog: EC 1.6.3.1 NAD(P)H oxidase
MGNASSMLTQYDIEEVQEHCNYLFSQQEIVSLYERFCQLDRSAKGFISEDEFLSIPEFSLNPLSKRLLRMVDGLNFKDFVAFLSTFSAKASLRQKIELIFKVYDIDGKGKVTFKDLLEVLLDLTGSFMSDEQREQVVTKVLEEAGYTKDCSFSVEDFIQIIDHPGLKMEVEVPID

SEQ ID NO: 10205 - DNA, 494 bp, Panicum virgatum
  misc_feature: Ceres CLONE 1721787
  misc_feature: Encodes the peptide sequence at SEQ ID NO. 10206
aagactccaaagagcagccagccagccgccgcacggacggacggcgcctccgggtctagctagggtttctgttccgcttcttctccccgcacgcgaagcagggcgcagcgttgatggcaacggcaccggcgccggcgcccgcggacccgaaggcggaggccgccaagatggacctcctggaggacgacgacgagttcgagatcgaccaagaatgggacgacaaggaagaaggcaatgaagctgtccagcagtgggaggatgactgggatgatgatgacgttaatgatgatttctcgcagcagctgaggaaagaactggagggaacccagaagagctgaagtgttttcttctgtagtataaatgttactcttgtatggccgttactttctgaacctctgtgtgcttcagacagtttgtgggtgtgcttctgggagcaccacctaatttgcggaatatttctacatgaaagtttatggtcgtgctatagtttccag

SEQ ID NO: 10206 - protein, 74 aa, Panicum virgatum
  misc_feature: Ceres CLONE 1721787
  misc_feature (12)..(71): Pfam Name: DSS1_SEM1 Pfam Description: DSS1/SEM1 family
MATAPAPAPADPKAEAAKMDLLEDDDEFEIDQEWDDKEEGNEAVQQWEDDWDDDDVNDDFSQQLRKELEGTQKS

SEQ ID NO: 10207 - DNA, 778 bp, Panicum virgatum
  misc_feature: Ceres CLONE 1721795
  misc_feature: Encodes the peptide sequence at SEQ ID NO. 10208
aaaacccttgctccagtcctcgtcccgccgccgccgccgccgccgccgccgccccctgcaccagcaccagccgccgcctagcagcagccgtcgccggagaagaaggggagggagccatgggtcgcgtccgcaccaagaccgtgaagaagacctccaggcaggtgatcgagaagtattactcccgcatgaccctcgacttccacaccaacaagaaggtgctggaggaggtctcgatcctgccctcgaagcgcctccgcaacaaggtggccggcttcaccacccacctgatgcgccgcatccagcgcggccccgtccgcggcatctcgctcaagctccaggaggaggagcgcgagcgccgcatggacttcgtcccggagaagtcggcgctcgaggtggaggagatccgcgtcgacaaggagaccatggagatgctcgcgtccctcggcatggccgatctccccggcgtcgagcgccaggctgaggtgtccagcgcccccacctacggccgcccgcagtacggtggcccccgccgcgaccgcgtctaggcttctagtcggttgcagtggttggatcttgatcgcttcacttatcgtcgttattatgctactatgtcaaacttgttttaggtcattggttgctttgtggcgattaagtcttgaacctatctgttttgctctgaattctgcactgttttgatctgcgtgtgatggacaagatctaaattctagcgccaatgaaatcttaatcgatttataagttacaatgagattttgcttcc

SEQ ID NO: 10208 - protein, 142 aa, Panicum virgatum
  misc_feature: Ceres CLONE 1721795
  misc_feature (1)..(122): Pfam Name: Ribosomal_S17e Pfam Description: Ribosomal S17
MGRVRTKTVKKTSRQVIEKYYSRMTLDFHTNKKVLEEVSILPSKRLRNKVAGFTTHLMRRIQRGPVRGISLKLQEEERERRMDFVPEKSALEVEEIRVDKETMEMLASLGMADLPGVERQAEVSSAPTYGRPQYGGPRRDRV

SEQ ID NO: 10209 - DNA, 670 bp, Panicum virgatum
  misc_feature: Ceres CLONE 1721797
  misc_feature: Encodes the peptide sequence at SEQ ID NO. 10210
aaaaaccatcatttgttgcccagccggccggccggatctcgcggagtggtgctcgagcgagacagaggcagggaggatcggcagcccggccgggaacgggaaggaggaggaggatgctggaggggaaggcgcgggtgcaggacacggacatgccggcgcggatgcaggcggcggcgacctcggcggcctcccgcgcgctcgacctcttcgacgtcgccgactgccgcgccatcgccggccacatcaagacggagttcgacaagcggtacggcgtcgggtggcagtgcgtggtgggcgccaacttcgggtgcttcttcacccacaccagcggcaccttcatctacttctccctcgagcgcctctccttcctgctcttcaaggccgccgctgcatcatcctgaatggatggatggatagatagtctcctcaggctcccatcgtcgcccggcaccgccgcacggccgctgctgcagcagccgttgctgttctcgatgcccgccggcgacggattgcaggccccgcgcggcaggaggcgtggtcctccacagaccgtgcgctgctgcatcactgtacgcccaaagctctattatgtccacacttgtacatagatcactcagaaccactctcgtttctggaatgtagcctcagccctccatgttcttcatttctc

SEQ ID NO: 10210 - protein, 95 aa, Panicum virgatum
  misc_feature: Ceres CLONE 1721797
  misc_feature (1)..(91): Pfam Name: Dynein_light Pfam Description: Dynein light chain type 1
MLEGKARVQDTDMPARMQAAATSAASRALDLFDVADCRAIAGHIKTEFDKRYGVGWQCVVGANFGCFFTHTSGTFIYFSLERLSFLLFKAAAASS

SEQ ID NO: 10211 - DNA, 952 bp, Panicum virgatum
  misc_feature: Ceres CLONE 1721815
  misc_feature: Encodes the peptide sequence at SEQ ID NO. 10212
ctaaggagtgtttgctgtattccaagacctggacttctcatttatggagatgaacccatttaccatggtgaatggagagccatatcctctggacatgaggggagaacttgatgacacagcagctttcaagaacttcaagaagtggggagctattgaattccctctaccatttggaagagtactgagccctacagaaagtttcatccatgaactagatgagaagacaagcgcctctctgaagtttacagttttgaacccaaagggacgcatctggacaatggttgctggaggtggtgctagtgtcatatacgctgatacagttggagatttggggtatgcttcagagcttggaaactatgcggagtatagtggtgctcccaatgaggaggaggttctgcattatgctagagttgtacttgattgtgcaactgctgatcccgatggtcgtaagagggcgcttctcattggaggtggcattgctaacttcactgatgtggctgccacattcaatggcatcatccgggccttaagagagaaggaatccaagttgaaggcttcaaggatgcacatttatgttcgccgaggtggcccgaattaccaatctggactggctaaaatgcgtaagcttggtgcagagctcggcattccaattgaggtgtatgggccagaagcgacaatgacaggaatctgcaaacaagcaattgaatgcatcatggctgcagcataattggaatgtagttctgggtagtttgggatctgcagacacgcaattgaatgtgtcatagactcggccacaaatgaggggtggagagtagttgcagtagttcactcccacacaggggttgttccctttctgtttcagatatgttgtagcgtggagttgtttgacgatatctttctagatcattcctgcaaagagttgtgatgcaataaatccgaggtctagtttcgt

SEQ ID NO: 10212 - protein, 227 aa, Panicum virgatum
  misc_feature: Ceres CLONE 1721815
  misc_feature: SWISSPROT Homolog: EC 2.3.3.8 ATP citrate synthase
  misc_feature: Functional homolog of the protein sequence given in SEQ ID NO 50168
  misc_feature: Useful for making plants with modulated root development
MEMNPFTMVNGEPYPLDMRGELDDTAAFKNFKKWGAIEFPLPFGRVLSPTESFIHELDEKTSASLKFTVLNPKGRIWTMVAGGGASVIYADTVGDLGYASELGNYAEYSGAPNEEEVLHYARVVLDCATADPDGRKRALLIGGGIANFTDVAATFNGIIRALREKESKLKASRMHIYVRRGGPNYQSGLAKMRKLGAELGIPIEVYGPEATMTGICKQAIECIMAAA

SEQ ID NO: 10213 - DNA, 816 bp, Panicum virgatum
  misc_feature: Ceres CLONE 1721827
  misc_feature: Encodes the peptide sequence at SEQ ID NO. 10214
attcccccacagcacacacagcagctaatccagactcacactactgcagcatttgctttgcttagcacgaccgccgatcgataattaataataatacaacgataatggaggctctgatgatgaagaacaagaagcagatgcaggcggtggtggccttggccgttgtggtggcggcggcggcgctggtggcgtcggcgtcggcggccatcacgtgcgggcaggtgggttcggcgctggcgccgtgcatcccgtacgcgacggggaaggcgagcgcgctgccgtcgtcgtgctgcggcggcgtgcgcagcctcaacagcgcggcgcggacgagctcggaccggcaggcggcgtgccggtgcctcaagagcctggccagcacagtcaagtcggtgaacatgggcaccgtcgccaccatccccggcaagtgcggcgtctccgtgccattccccatcagcatgtccactgactgcaacaaggtcaactaataaattgtgcatcaatataataatcctaccagctgatgaggaagctcagctcgatccgctcagaagctagctgctagctagagagctatattcaggagaataaaataaagttgaggcatcatcagcagcacatcatctatatatattattgttgtactcgatctgtgtgtacgtgcgcgtatacatacatgcatgcttatacgatcgatgtatatatatgtgctgcttctctcacaagtacgtgtgctcatatatatacatacatgtgtgctagctttgtgtcctgttgtgatcaataacaactactcctgctactgttcagtgctgcttc

SEQ ID NO: 10214 - protein, 126 aa, Panicum virgatum
  misc_feature: Ceres CLONE 1721827
  misc_feature (37)..(122): Pfam Name: Tryp_alpha_amyl Pfam Description: Protease inhibitor/seed storage/LTP family
MEALMMKNKKQMQAVVALAVVVAAAALVASASAAITCGQVGSALAPCIPYATGKASALPSSCCGGVRSLNSAARTSSDRQAACRCLKSLASTVKSVNMGTVATIPGKCGVSVPFPISMSTDCNKVN

SEQ ID NO: 10215 - DNA, 862 bp, Panicum virgatum
  misc_feature: Ceres CLONE 1721839
  misc_feature: Encodes the peptide sequence at SEQ ID NO. 10216
ccttccacctcggcctccactctctgccgccgccgccccgccgctgcgccgcgagccgatccaatggcgccgtcgtctaagctgtcactgagcatcaaaaaggcctcgcggtcccactcctaccaccgccgcgggctgtgggcgctcaagtccaagcacggcggcaccttccccaaggcggagaagcccgccgctgccgccgagctcaagttctaccccgccgatgacgtgaaaccgcgcaagcccagcacccgcaagccgaaacccaccaagctcaggtcgtccatcactccgggcaccgtactgatcctgctcgctgggaggttcatggggaagagagttgttttcctcaagcagctcaaatccggcatgctccttgttactggacctttcaagatcaacggagtcccaatccgccgtgtgaaccagacctacgtcgttgcaacctcaacgaagattgatgtctctggtgttaacgtgaagaaatttgatgacagctactttgccagggaaaagaagaaggcaaagaagaccgagggtgaacttttcgagaaagaggaggcgactgaggacctgccgcagttcaagaaggatgaccagaaggctctggatgctgcgctgatcaaagctattgaggccgtgccagatctgaaaacctaccttggtgcacggttctctctcagggatggtgataagccacatgagatggttttctagattagttggcgctaggtgcgaagctcaatagtcactttgcttggtctacctgagtgagctcttgaattttgtacctgaccggtgaacctttggtttctgtttgattcattgtcaaatctttaatgaagtcattgctccttaagtt

SEQ ID NO: 10216 - protein, 217 aa, Panicum virgatum
  misc_feature: Ceres CLONE 1721839
  misc_feature (112)..(217): Pfam Name: Ribosomal_L6e Pfam Description: Ribosomal protein L6e
  misc_feature: Functional homolog of the protein sequence given in SEQ ID NO 50169
  misc_feature: Useful for making plants with modulated nitrogen use efficiency
MAPSSKLSLSIKKASRSHSYHRRGLWALKSKHGGTFPKAEKPAAAAELKFYPADDVKPRKPSTRKPKPTKLRSSITPGTVLILLAGRFMGKRVVFLKQLKSGMLLVTGPFKINGVPIRRVNQTYVVATSTKIDVSGVNVKKFDDSYFAREKKKAKKTEGELFEKEEATEDLPQFKKDDQKALDAALIKAIEAVPDLKTYLGARFSLRDGDKPHEMVF

SEQ ID NO: 10217 - DNA, 565 bp, Panicum virgatum
  misc_feature: Ceres CLONE 1721842
  misc_feature: Encodes the peptide sequence at SEQ ID NO. 10218
aagagcccaaggacaataaccctatagtttggcgagggggggagggcggatctgctgctgcttggggtcgaccgtggcgagccattctacccccgggaccgccttcactgccgcttacttggtctctccagcgaggaagtgccgccgagggctcgcgatctggttccccttggcgcgccacgagacgacttcatgttgaggatgagcgggacagggagacgcgcagcccgggatctcccatctggtgtcagatagcctcaccaacgttgacaagacgtgcgcggacgaggaatgtctcacagggagtgcgctgcggcttgggacgaggtggaggatctcatcgccttcggcgagccagcgcccgggacaagctcaaggacagcaacgacccgctccagaactactgcgaggagaaccccgagaccgacgagtgccgcatctacgacaactagagcaagcctgctgtatatatcgatctgtgtatcagcaatcaaaataagttaaatttgttatagatatagataattaataaactaataaaggatatttgaccgcgggtcatatg

SEQ ID NO: 10218 - protein, 149 aa, Panicum virgatum
  misc_feature: Ceres CLONE 1721842
  misc_feature (95)..(149): Pfam Name: CP12 Pfam Description: CP12 domain
EPKDNNPIVWRGGEGGSAAAWGRPWRAILPPGPPSLPLTWSLQRGSAAEGSRSGSPWRATRRLHVEDERDRETRSPGSPIWCQIASPTLTRRARTRNVSQGVRCGLGRGGGSHRLRRASARDKLKDSNDPLQNYCEENPETDECRIYDN

SEQ ID NO: 10219 - DNA, 533 bp, Panicum virgatum
  misc_feature: Ceres CLONE 1721843
  misc_feature: Encodes the peptide sequence at SEQ ID NO. 10220
acggatccaaaggaaggctcggctcctctctcgcggcggcggcgcacccctcttctccatctccggcaaggcatttggcatctgacctcaacagcaagcaaatggcaggtggcagggttgcacatgccaccctcaagggcccgagcgtggtgaaggagatcttcattggagtcaccctcgggctgattgccggtggcatgtggaagatgcaccactggaacgagcagaggaagactagatccttctacgacatgctggacaagggccagatcagcgttgttgtcgaggagtagctttcacgcgccaagtctgaagttattttctcacagttgtttctgaaactctggagagcatgaagaagtgaatgctgtggagatttgtcttgaaaaataagcataaccatttgaggacaccatattttgttgaattttcttccgtttcatgaatatttgaacatgtccaggtcataccgatcaactgaatatctgatctagttttacataagttaatgtgattgtgaaatttgcaagtag

SEQ ID NO: 10220 - protein, 63 aa, Panicum virgatum; identical to SEQ ID NO: 9844
  misc_feature: Ceres CLONE 1721843
  misc_feature (2)..(63): Pfam Name: COX5C Pfam Description: Cytochrome c oxidase subunit Vc (COX5C)
  misc_feature: SWISSPROT Homolog: EC 1.9.3.1 Cytochrome-c oxidase

SEQ ID NO: 10221 - DNA, 645 bp, Panicum virgatum
  misc_feature: Ceres CLONE 1721845
  misc_feature: Encodes the peptide sequence at SEQ ID NO. 10222
acacacaaatcgaattgtttctaaccatttaatctcatagacaagagtgcatttgcttgaaagccaaaggcaggtagctacaatgatcaactccaagaagctagctcatctgtccaagaagtggcagggaatgagcgtaattgggctaaaaaggatcacaagtgtagacaaagagttcaacccatcttgcagcagcatggttgcagggaagggcaactgcattgtctattcttccgatgggaagcggtttgagatccccctcacgtacctccgcacgacagtctttgtggagctcctgaagttgtcacaggaagaatttgggttcacaagtgatgggagaatcacactgccttgctatacagcagtgatggagtatgtgatgtgtttactgaggagaaaggcctctgaagatgttgtgaaggcactcctcagttccatagtgatgcctagccaccaccaaatcagattatccaatggatagaaccaccaattcgctgtctgcagcacctgaagatgaatatatcatggatttgagcttgttttctctcttatcccccttccatctatttttcacatctgtaccttggagcacagtgttgtgcaacgttttatactatggcacactgtgcttatacttatgaatga

SEQ ID NO: 10222 - protein, 132 aa, Panicum virgatum
  misc_feature: Ceres CLONE 1721845
  misc_feature (7)..(104): Pfam Name: Auxin_inducible Pfam Description: Auxin responsive protein
MINSKKLAHLSKKWQGMSVIGLKRITSVDKEFNPSCSSMVAGKGNCIVYSSDGKRFEIPLTYLRTTVFVELLKLSQEEFGFTSDGRITLPCYTAVMEYVMCLLRRKASEDVVKALLSSIVMPSHHQIRLSNG

SEQ ID NO: 10223 - DNA, 868 bp, Panicum virgatum
  misc_feature: Ceres CLONE 1721850
  misc_feature: Encodes the peptide sequence at SEQ ID NO. 10224
ctctctccatgctagaaaaaggttacacgagaaaaatcaaatcaggagacggagattcgagagagctccgcccggtagggaagggaagaggaggcgaagggggggagcgaggaggtgccgaggcgggatgggggcggtcgagtccgtgccggagacctccatacacgaattcaccatcaaggattgcaacggcaaggaagtgagcctggagacctacaaggggaaggtcctcctcgttgtcaacgtcgcctccaaatgtgggttcacggagaccaattacacgcagctgacggagctttatcagaagtacagggacaaagactttgagatattagcattcccctgcaatcagttcttgcggcaagagccagggactgctgagcaggcaaaagactttgcttgcaccagatttaaagcagaatacccagtttttcagaaggtgcgtgtaaatggtccagatgctgcgccggtctacaagtttctgaaagcgagcaagcctggtttgtttgggtcaagaatcaaatggaattttactaagtttctcgtcgacaaaaatgggaaggtcattgaaagatatgcaacttcgactgctccaatgtcaattgagaaggacatccagaaggcccttgaggaatagatctcatgtcctctaatctcatccatcacccacttgcagaagtaggcgcttgcaaaaaatatattccattgtagcaacatttagatgcctttgctttctgtagtacatttctgtattattacccctgatcttcaccttcatgctcgtcgtgcctttgtttcctgttgtgtaagtagatcttgtatttgactagccatcatcttctccatcctgctctcttgcagttttttt

SEQ ID NO: 10224 - protein, 169 aa, Panicum virgatum
  misc_feature: Ceres CLONE 1721850
  misc_feature (12)..(120): Pfam Name: GSHPx Pfam Description: Glutathione peroxidase
  misc_feature: SWISSPROT Homolog: EC 1.11.1.12 Phospholipid-hydroperoxide glutathione peroxidase
  misc_feature: Functional homolog of the protein sequence given in SEQ ID NO 50170
  misc_feature: Useful for making plants with modulated flowering time
  misc_feature: Functional homolog of the protein sequence given in SEQ ID NO 50171
  misc_feature: Useful for making plants with modulated nitrogen use efficiency
MGAVESVPETSIHEFTIKDCNGKEVSLETYKGKVLLVVNVASKCGFTETNYTQLTELYQKYRDKDFEILAFPCNQFLRQEPGTAEQAKDFACTRFKAEYPVFQKVRVNGPDAAPVYKFLKASKPGLFGSRIKWNFTKFLVDKNGKVIERYATSTAPMSIEKDIQKALEE

SEQ ID NO: 10225 - DNA, 859 bp, Panicum virgatum
  misc_feature: Ceres CLONE 1721877
  misc_feature: Encodes the peptide sequence at SEQ ID NO. 10226
gagctcattcccatccagctgcaccagcattctcctagccctgtgtgctagcgcgctctctggggtttcacacacagtcgccatggcatccaaggccttcctcctcgttgccctcaacctgctcctctttgcggtggccaacgcctgcggcggcggctgcccgacgccgactccaccaacgccgacgccgccgtcaccgtcaccgtcgagcaaaggcaagtgccccaagaacgcgctcaagctcgcggcgtgcgccaacgtggccggcctcgtgagcgccgaggtcgggaagccgccggccgagccgtgctgcagccttctcggcggcctcgccgacctcgaggccgccgcctgcctctgcaccgccatcaaggccaacgtgctcggcatcaccctcgacatccctgtcaagctcagcctcattgtcaactactgtagcaagaacctccccagcggcttcatatgcgcttgatagatacgcgtgattacgtgcttgcatgcaacgcgcacgcttgaacacagccggttgttcattcgtgagtgcatgctgcatgcgtcggatttgttttctccgacttttgtttggtgtgctttctttgtcccgtcaggtggttctgaatgtagaaccacggacggatcaacaatgatgcatgtgcgcatcgagtgtttgattgtgttttaccttttactctttttccattcttccatctactcgtttgtctatggtaatttcttctccaaggtccaagctaggaaatgcactgttttgggttttatgtggtgtttaatttatctcattgttgtaattgcttgtagtggattccatggattgtatgtgctccaagcacaagtttatttg

SEQ ID NO: 10226 - protein, 129 aa, Panicum virgatum
  misc_feature: Ceres CLONE 1721877
  misc_feature (47)..(128): Pfam Name: Tryp_alpha_amyl Pfam Description: Protease inhibitor/seed storage/LTP family
  misc_feature: Functional homolog of the protein sequence given in SEQ ID NO 50172
  misc_feature: Useful for making plants with modulated biomass
  misc_feature: Useful for making plants with modulated flowering time
MASKAFLLVALNLLLFAVANACGGGCPTPTPPTPTPPSPSPSSKGKCPKNALKLAACANVAGLVSAEVGKPPAEPCCSLLGGLADLEAAACLCTAIKANVLGITLDIPVKLSLIVNYCSKNLPSGFICA

SEQ ID NO: 10227 - DNA, 802 bp, Panicum virgatum
  misc_feature: Ceres CLONE 1721882
  misc_feature: Encodes the peptide sequence at SEQ ID NO. 10228
agaaccctagaacccgcccctcatcctccgccgccgccgcagccgcaggccgctcgccgctcgcgccatgggtatcgacctcgtcgccggcggccggaataagaagaccaagcgcaccgctcccaagtccgacgatgtctacctcaagctcctcgtcaagctgtaccgcttcctggttcgcaggaccaagagcgacttcaacgccgtgatcctgaagcgtctcttcatgagcaagaccaaccaaccgccgctctcgctccgccgcctcgtcaagttcatggagggcaaggagaaccagattgctgtgatcgtgggcaccgtgaccgacgacaagagggtctacgaggtgccggcgatgaaggtggctgcgctcaggttcactgagacggcgagggcccggatcgtgaatgctggcggcgagtgcctcacctttgaccagctggcgctccgtgcgcctctgggccagaacacggttctgctgaggggacctaagaatgctagggaagctgtgaaacactttggcccagcgcctggtgtgcctcacagccacaccaagccatatgtccgctctaagggaaggaagtttgagaaggcaagaggaaggaggaacagcagaggcttcaaggtttaagttgccgtgtcttatccatttggtctcacctagtgggctaaataggtcttgcttgagcctgagttctatgttaatgttattacctcagttcaagtcttttgagggctatgttatttgtataccagttccaggatctgctcaattttgtcctgaatctgcgttttgtattag

SEQ ID NO: 10228 - protein, 187 aa, Panicum virgatum
  misc_feature: Ceres CLONE 1721882
  misc_feature (12)..(185): Pfam Name: Ribosomal_L18e Pfam Description: Eukaryotic ribosomal protein L18
  misc_feature: Functional homolog of the protein sequence given in SEQ ID NO 50173
  misc_feature: Useful for making plants with modulated nitrogen use efficiency
MGIDLVAGGRNKKTKRTAPKSDDVYLKLLVKLYRFLVRRTKSDFNAVILKRLFMSKTNQPPLSLRRLVKFMEGKENQIAVIVGTVTDDKRVYEVPAMKVAALRFTETARARIVNAGGECLTFDQLALRAPLGQNTVLLRGPKNAREAVKHFGPAPGVPHSHTKPYVRSKGRKFEKARGRRNSRGFKV

SEQ ID NO: 10229 - DNA, 695 bp, Panicum virgatum
  misc_feature: Ceres CLONE 1721893
  misc_feature: Encodes the peptide sequence at SEQ ID NO. 10230
acataggcatagccaggcaacacattacatagaagctcgatacaatggcgatccggaacatgcaggtggcgacgcgttcgctggacgcggacatgacggtggacgagttcaaggagtggctgcggcggttcgacacggaccgcgacgggcgcatcagccgcgacgagctgcggcgcgccatgcgcgccatccgcgcccggttcacggggtggcggagcaggcagggcatcagctacgccgacgcggacggcgacggctacatcgacgacagcgaggtggacggcctcatcgagttcgcgcagaagaacctcgggctcaagatcgtcgcctactgagctggtcgacgcaggtggcggccgggcgggccgggcggcggcgagagccatgggctagcagcagcacgccaccatctgcctgtccccgctaaaaataagaacaactgcttgatcgagcgcttgcttgcttaaagctttgctttcttgtacgtactctatcaattcatgggctctgtatccctctgtgtgtgatctatgtaaggtgtgtatggcggctgcctcctctgcaaggtcgagccctgccatgggtgccgccgccgcggattttcatttgtttgctctagtgaaattgacagtgtatccttgaccatcatatcccgtgtctcctctgaatctcccatgtatgatgaatcggttccg

SEQ ID NO: 10230 - protein, 96 aa, Panicum virgatum
  misc_feature: Ceres CLONE 1721893
  misc_feature (21)..(49): Pfam Name: efhand Pfam Description: EF hand
MAIRNMQVATRSLDADMTVDEFKEWLRRFDTDRDGRISRDELRRAMRAIRARFTGWRSRQGISYADADGDGYIDDSEVDGLIEFAQKNLGLKIVAY

SEQ ID NO: 10231 - DNA, 774 bp, Panicum virgatum
  misc_feature: Ceres CLONE 1721896
  misc_feature: Encodes the peptide sequence at SEQ ID NO. 10232
ggagagctagggtttgccgccgcctcctcgccgccgcctccccagcgaaccctaatcgttctcctcgcccgccaccgccgccgcggtcatgtccgggaggaggaagacgcgggagcccaaggaggagaacgtgacgctcggccccgccgtccgcgagggggagtatgtcttcggcgttgcccacatcttcgcctccttcaacgacaccttcatccatgtgacggatctgtctgggagggaaacgctcgtccgcatcactggtggcatgaaggttaaagctgatcgtgatgagtcatcaccttatgctgctatgcttgcctcacaggatgttgctcaaagatgcaaagagcttgggattactgctctgcacattaagctccgtgctactggtggaaacaagaccaaaactccaggtcctggtgctcagtctgcccttagagctcttgctcgatctggtatgaagattggtcgtattgaggatgtcacccctgtcccaactgacagcacacgcagaaagggtggcagaaggggaaggaggctgtaatttcaagtatattggctggtgtatccagatgtagcagttctagactgttttcatcttacactgagcaagttttgcaacatgtattgaagttttgagttgtcaactcgtggatccgtttcagtttaatccttgttgacgaagtatgtgccattcaacgtagcgagatacaattcaggagctcccacttctgcttgttggctcgataaatagttgcaaaagtgatttcagtc

SEQ ID NO: 10232 - protein, 151 aa, Panicum virgatum
  misc_feature: Ceres CLONE 1721896
  misc_feature (29)..(147): Pfam Name: Ribosomal_S11 Pfam Description: Ribosomal protein S11
  misc_feature: Functional homolog of the protein sequence given in SEQ ID NO 50135
  misc_feature: Useful for making plants with modulated biomass
MSGRRKTREPKEENVTLGPAVREGEYVFGVAHIFASFNDTFIHVTDLSGRETLVRITGGMKVKADRDESSPYAAMLASQDVAQRCKELGITALHIKLRATGGNKTKTPGPGAQSALRALARSGMKIGRIEDVTPVPTDSTRRKGGRRGRRL

SEQ ID NO: 10233 - DNA, 1051 bp, Panicum virgatum
  misc_feature: Ceres CLONE 1721902
  misc_feature: Encodes the peptide sequence at SEQ ID NO. 10234
gaaatacgtcggaagctgcaaatcttctccggcagcggtacgaatccgggaatccggcgctccgaatggacccagggtacaaccccaggacggtggaggaggtgttccgggacttcaagggccgccgcgccgggataatccgcgcgctcaccaccgatttggaagatttcttccagcaatgcgacccggaaaaggaaaacctgtgcctgtatgggtttcccaatgagaattgggaagtaaacttgcctgcagaagaggtgccacctgagctcccagagccagcattgggcatcaacttcgcacgagacggaatgcaagaaaaagattggttatccatggttgctgtgcacagtgatgcttggttgctttctgttgcattttactttggtgctcgattcggcttcgatagaaatgacaggaagcgcctgtttggtatgattaatgaactccccacgacttttgaagttgttagtgggaagagtaaaatcaaggcaccactgagtaataataaccatagcaataccaaatccaagtccaacaacaaaacgaaatcatcggagcctaaggtgaagcagccgaagccgccggcggcaccccaggtgaaggcagaagaccctgcccctgcagaggaaagcccagctgctgaggaggaaggtggtggcggcggtgtcagcgagggtgagcacggggagacactctgcggcgcatgcggggaaagctacggccctgacaagttctggatctgctgcgacatctgcgagaagtggttccatggcaagtgcgtcaagatcacggcagccaaagccgagcatatcaagcagtacaagtgcccggcctgcacgggcggtggtggcggcggcagcaagcgagcccgcccgtcataaggggaagttgcaattgcaatgttgtaaacttgtttaagtagtgcggttgtgtatttgtggctggctgctgacctgctgtaactctagaattcattcgtgttgaactagatttagaaaggatttcatttcgcatttgctctgaacatagcataatcgttactgttctc

SEQ ID NO: 10234 - protein, 272 aa, Panicum virgatum
  misc_feature: Ceres CLONE 1721902
  misc_feature (211)..(261): Pfam Name: PHD Pfam Description: PHD-finger
  misc_feature: SWISSPROT Homolog: EC 2.1.1.43 Histone-lysine N-methyltransferase
  misc_feature: The sequence is a functional homolog of SEQ ID NO 1052 in the 10/225,066 US patent application
  misc_feature: The sequence is a functional homolog of SEQ ID NO 2552 in the 10/374,780 US patent application
  misc_feature: The sequence is a functional homolog of SEQ ID NO 1981 in the 11/479,226 US patent application
  misc_feature: Functional homolog of the protein sequence given in SEQ ID NO 50174
  misc_feature: Useful for making plants with altered alkaloid content
  misc_feature: The sequence is a functional homolog of SEQ ID NO 1645 in the 11/479,226 US patent application
  misc_feature: The sequence is a functional homolog of SEQ ID NO 782 in the 10/412,699 US patent application
  misc_feature: The sequence is a functional homolog of SEQ ID NO 816 in the 10/412,699 US patent application
  misc_feature: Functional homolog of the protein sequence given in SEQ ID NO 50175
  misc_feature: Useful for making plants with altered lignin content
  misc_feature: Useful for making plants with modulated flowering time
MDPGYNPRTVEEVFRDFKGRRAGIIRALTTDLEDFFQQCDPEKENLCLYGFPNENWEVNLPAEEVPPELPEPALGINFARDGMQEKDWLSMVAVHSDAWLLSVAFYFGARFGFDRNDRKRLFGMINELPTTFEVVSGKSKIKAPLSNNNHSNTKSKSNNKTKSSEPKVKQPKPPAAPQVKAEDPAPAEESPAAEEEGGGGGVSEGEHGETLCGACGESYGPDKFWICCDICEKWFHGKCVKITAAKAEHIKQYKCPACTGGGGGGSKRARPS

SEQ ID NO: 10235 - DNA, 843 bp, Panicum virgatum
  misc_feature: Ceres CLONE 1721913
  misc_feature: Encodes the peptide sequence at SEQ ID NO. 10236
tgaagcagcagctagcatcacaagtaatccggccacacacaatcatcatccgatcctattgtcactctcgcacttgaaggttaagttccatccatggcggaggagaagcaccaccaccacctcttccaccacaagagggacgaggaggagcagcccgccggcgggtacggcggcgaggccgccaccgccgagtacacggagaccaccgtgacggaggtggtgtccaccggcgaggacgagtacgagaagtacaagaaggaggagaaggagcacaagcacaagcagcacctcggcgagtcaggcgccatcgccgccggcgccttcgcgctgtacgagaagcacgaggcgaagaaggaccccgagcacgcgcaccggcacaagatcgaggaggagatcgcggcggcggcggccatgggctccggcggctacgccttccacgagcaccacgagaagaagaaggaccacaaggacgccgaggaggccggcggcgagaagaagcaccaccacctcttcggctgatgtgtccagtcgtcgactcagtacatacgtgtgcggcggccccaccacatgtatatgatgatctgtctatatacgtatatatgctgcgcatcttaattaatgtctccgtgtgctactgctacgtacgcgtgtactgtaagagtgagaggctgagaggtggccccgcgcgccagctgtgtgtgtgtgtttgctttcctgggtagtacatatacatgtatacgtgttgaataaggggccccggctccgtgtatgtatgtgtgtatatgttgtatctacgagtggaaaatgtgtgcaactctgatttgcgtagctatacgcatactg

SEQ ID NO: 10236 - protein, 141 aa, Panicum virgatum
  misc_feature: Ceres CLONE 1721913
  misc_feature (51)..(130): Pfam Name: ABA_WDS Pfam Description: ABA/WDS induced protein
MAEEKHHHHLFHHKRDEEEQPAGGYGGEAATAEYTETTVTEVVSTGEDEYEKYKKEEKEHKHKQHLGESGAIAAGAFALYEKHEAKKDPEHAHRHKIEEEIAAAAAMGSGGYAFHEHHEKKKDHKDAEEAGGEKKHHHLFG

SEQ ID NO: 10237 - DNA, 740 bp, Panicum virgatum
  misc_feature: Ceres CLONE 1721914
  misc_feature: Encodes the peptide sequence at SEQ ID NO. 10238
actcccgaattcccccagcaaatcaaatcctccccccaaatccccccgccgccctttccctctcgccgccggctcgccgtcctcagcgcccgccgagccccgatggcccgcacgaagcagacagcgcgcaagtcgacgggcggcaaggccccgcggaagcagctcgcgaccaaggcggcgcgcaagtcggccccggcgacgggcggcgtgaagaagccccaccgcttccgccccggcaccgtcgcgctccgcgagatccgcaagtaccagaagagcacggagctgctcatccgcaagctccccttccagcgcctcgtccgcgagatcgcgcaggacttcaagaccgacctccgcttccagtcctccgccgtcgccgcgctgcaggaggccgccgaggcctacctcgtcgggctcttcgaggacaccaacctctgcgccatccacgccaagcgcgtcaccatcatgcccaaggacatccagctcgcgcgccgcattaggggcgagagggcctgagcgggccccaccgccttcctcgccgttgtcgatccctccttctcgtgctgtctgcttgtaggatctgtgcttctcttgggttccttctggtggcatgttattagtactagtatcgttgtggttgtgttcgtagtgccaggaacctgctagtttattttgccctgatgcagcttgctgtaatggtgatctgttactttaatctaatggaaatgaaatgttcttctcag

SEQ ID NO: 10238 - protein, 136 aa, Panicum virgatum
  misc_feature: Ceres CLONE 1721914
  misc_feature (58)..(132): Pfam Name: Histone Pfam Description: Core histone H2A/H2B/H3/H4
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIRGERA

SEQ ID NO: 10239 - DNA, 1081 bp, Panicum virgatum
  misc_feature: Ceres CLONE 1721918
  misc_feature: Encodes the peptide sequence at SEQ ID NO. 10240
ggctagctagcggcctctcccccaaatcgcatcgctctcctccaggcggcgacgcggaacggcgaccgaccaagaacggcggtcagcctcccctcccggtctcccctcggcgctcggccgtcgccggtcggcggtcgcgcctttgcgctgctgtggttacgagggcacgcgtggacgcggctgagcctagccctagcggcaagcatcccgactttggcgaccggcaggcgacgacgacggcgagcccggcgcttactgccgaccacccgcgcgccacgacggcctcggttcgtctccggcttgccgtgctgcttgaggcaaggccgcaagccgtgagattctagctccgccactgctcgccggcaacccccgtcgcctagagcccaaagcgaaggaaccgctggagacttggtctcatcctgctccgcctcgccggcgcgggagagtataagaggatggagtcggaggtggtgaggatggagatggtgttggcgccgtcgctgcctttcaagaaggtgcagacggcggacaagtatcccaagggccagtcccgggggcgccagtggaaacacctccgtcacctcctccaggccgcagatgcctcctccatgccccccgaccgccccaactatctgaatattcaatcgcccccatccatttacccatcaaagagatactgtgacataacaggttttgaggcaccgtatatggatccgaggacaaagctgcgctatgcagatccagatgtgttcaagcagatcatgatgcttcccgatgaatacgtccaaaggtatctgaccttgagaaatgcagcagttatactgagatagcaatccctgaacatggataagtcttgttgcaccactctttactatgtacggaggaggctgtttctgaatccttttaaacggatctttcttccgtgctcttgtatatcagggattgcctatgtgattacatcctgctttgtatttttcatactgaagattgcgaattgatgtttaagtatgttctctgctgtaggcgaattatgtggtatctatgtgctatattcaattcatacctaatttttttgttttgt

SEQ ID NO: 10240 - protein, 124 aa, Panicum virgatum
  misc_feature: Ceres CLONE 1721918
  misc_feature (73)..(102): Pfam Name: YL1_C Pfam Description: YL1 nuclear protein C-terminal domain
MESEVVRMEMVLAPSLPFKKVQTADKYPKGQSRGRQWKHLRHLLQAADASSMPPDRPNYLNIQSPPSIYPSKRYCDITGFEAPYMDPRTKLRYADPDVFKQIMMLPDEYVQRYLTLRNAAVILR

SEQ ID NO: 10241 - DNA, 543 bp, Panicum virgatum
  misc_feature: Ceres CLONE 1721922
  misc_feature: Encodes the peptide sequence at SEQ ID NO. 10242
ctggccaaacaaacgtcttgcagtttcagcctgcggggagaggcccccagaatggctgcaagaggtttcagtttcaagagagtttctcgctggttccctcgttcctccgcttcaggtggtttgcaggaagaagacgaggacagcggcgagaggagcggcttgctgaggagccacctagatcgtcagatcgtgccggtcaccgatcccggtgacacaaccaaagcgctagccctgcatgtggagccaaagaccgtggcgctgaaggtgtccatgcactgccatggctgcgcgaggaaggtcgagaagcaggtctccaagctgcaaggagttgtgtccttcaaggtggagctggagagcaagaaggtgaccgtcgtgggagacgttagccccacggatgtcctggagagcatatgcaaggtgatgaagcacgcagagcttctggtggtttgattatcagcgagcagttggcttgtttggtttctagaattctagaaatagtaatactttaaccgctaattactgtattaaataaagtcagtttac

SEQ ID NO: 10242 - protein, 132 aa, Panicum virgatum
  misc_feature: Ceres CLONE 1721922
  misc_feature (69)..(129): Pfam Name: HMA Pfam Description: Heavy-metal-associated domain
  misc_feature: SWISSPROT Homolog: EC 3.6.3.4 Copper-exporting ATPase
MAARGFSFKRVSRWFPRSSASGGLQEEDEDSGERSGLLRSHLDRQIVPVTDPGDTTKALALHVEPKTVALKVSMHCHGCARKVEKQVSKLQGVVSFKVELESKKVTVVGDVSPTDVLESICKVMKHAELLVV

SEQ ID NO: 10243 - DNA, 883 bp, Panicum virgatum
  misc_feature: Ceres CLONE 1721936
  misc_feature: Encodes the peptide sequence at SEQ ID NO. 10244
ttcttcagaggatcgcgtacctgaatgtcggcatctacccattcacatcaatcttcctcattgtgtactgcttcctgccagcgctgtccctcttctctgggcacttcatcgtgaagcaactcaacgtgaccttcctgacatacctgctggtgatcaccctgactctgtgcatgctcgcggtgctggagatcaagtggtcagggatcagcctggaggagtggtggcggaacgagcagttctggctgatcggaggaacgagcgcccatctggccgctgtgctgcagggccttctgaaggtgattgccggcatcgagatctccttcacgctgacatccaagtcaggcsgtgatgatgtggacgacgagtttgcagacctgtacatcgtcaagtggacgtcgctgatgatcccgccgatcgtgatcatgatggtgaacctgatcgccatcgcggtggggttcagccggaccatctacagtgagatcccgcagtggagcaagctcctgggtggcgtgttcttcagcttctgggtgctggcccacctgtacccgttcgccaaggggctgatggggcggaggggccggacsccgaccatcgtcttcgtctgggccggcctcctgtccatcaccatctcgctgctgtgggtggccatcaacccgccctcgcagaattcccagatcggtggatcgttcacgttcccgtgagcggtcatcgttacattccttgctttgcgctggtgggaagggggatttctgactgctgaaaaggaaggctaggtgcttatgttaaaatccatagtgctgtcatgagttacaatagttcttttgttctttaatttttgcactgtactgttccgatatgagatgagaattggctctgctggacc

SEQ ID NO: 10244 - protein, 232 aa, Panicum virgatum
  misc_feature: Ceres CLONE 1721936
  misc_feature: SWISSPROT Homolog: EC 2.4.1.12 Cellulose synthase (UDP-forming)
  misc_feature: Functional homolog of the protein sequence given in SEQ ID NO 50125
  misc_feature: Useful for making plants with modulated plant growth and development
  misc_feature: Functional homolog of the protein sequence given in SEQ ID NO 50176
  misc_feature: Useful for making plants with altered cell wall content and/or composition
  misc_feature: Functional homolog of the protein sequence given in SEQ ID NO 50177
  misc_feature: Useful for making plants with modulated biomass
  misc_feature: The sequence is a functional homolog of SEQ ID NO 6 in US patent 7285702
  misc_feature: Functional homolog of the protein sequence given in SEQ ID NO 50124
  misc_feature: Useful for making plants with altered carbohydrate content
  misc_feature: The sequence is a functional homolog of SEQ ID NO 26 in US patent 7312377
  misc_feature: The sequence is a functional homolog of SEQ ID NO 2 in US patent 7049481
  misc_feature (115)..(115): Xaa is any aa, unknown, or other
LQRIAYLNVGIYPFTSIFLIVYCFLPALSLFSGHFIVKQLNVTFLTYLLVITLTLCMLAVLEIKWSGISLEEWWRNEQFWLIGGTSAHLAAVLQGLLKVIAGIEISFTLTSKSGXDDVDDEFADLYIVKWTSLMIPPIVIMMVNLIAIAVGFSRTIYSEIPQWSKLLGGVFFSFWVLAHLYPFAKGLMGRRGRTPTIVFVWAGLLSITISLLWVAINPPSQNSQIGGSFTFP

SEQ ID NO: 10245 - DNA, 962 bp, Panicum virgatum
  misc_feature: Ceres CLONE 1721944
  misc_feature: Encodes the peptide sequence at SEQ ID NO. 10246
cttttcgacacacattcgctgtgtaccagcaagcttgcattggtgtgccactaccacctccaccgatttttaaaagccattacactttcctacactgcacaccacctcactcactcagcaggtccagctcatagtcccagacacccagccaccagtgcgcagcgccgcggagcagagaagagcacagccggccaccgggtcaggggcagccatgagcaagggggagaagcaccaccggcacgagcaccacctgcgccgctgctgcgggtgcctggcctcctgcctgctggcgctggtcctggtggtggccttcgtcgcgctggtcgtctacctggcgctgcgcccctccaagccgtccttctacctgcaggacctgcagctccgacggcccatcaccgtcggcgacccctccctctcggcgtccgcgcaggtcacgctcgcctcccgcaaccccaacggccgcgtcggcgtccactacaagcgcctcgacgtcttcgtcacctaccgcgaccagcccatcacggcgcccgtctccctcccgccgcagtaccagggccaccgcgacgtcaccgtctggtcccccgtgctggcggccgaggccgtgcccgtggcggcctacgtcgccgacgccatgaagcaggacgtcgccgccgggttcgtcgcgctgcaggtcaaggtcgacggccggatcaagtggaaggtcgggagctgggtctcagggagctaccacctcttcgtcagctgccccgccatgctctccgccgccggcggcttcggatcaggctccaacttcaccttgtcggcgctcaagttcgcgcagcccacgggatgcagcgtcgaggtgtaggatgcgccggtctcggccagccggccggtgaatatgtatgtagcgcccgggtaccctgtcaacgtggtgctctgttgattttctccgtgttaattacatcgttaattaagctgtt

SEQ ID NO: 10246 - protein, 211 aa, Panicum virgatum
  misc_feature: Ceres CLONE 1721944
  misc_feature (40)..(178): Pfam Name: Hin1 Pfam Description: Harpin-induced protein 1 (Hin1)
MSKGEKHHRHEHHLRRCCGCLASCLLALVLVVAFVALVVYLALRPSKPSFYLQDLQLRRPITVGDPSLSASAQVTLASRNPNGRVGVHYKRLDVFVTYRDQPITAPVSLPPQYQGHRDVTVWSPVLAAEAVPVAAYVADAMKQDVAAGFVALQVKVDGRIKWKVGSWVSGSYHLFVSCPAMLSAAGGFGSGSNFTLSALKFAQPTGCSVEV

SEQ ID NO: 10247 - DNA, 850 bp, Panicum virgatum
  misc_feature: Ceres CLONE 1721947
  misc_feature: Encodes the peptide sequence at SEQ ID NO. 10248
aaaatcaaccagaaataatggcgacgacgatgcagggacacagcggacccaggctcttcggccgggagaggacgctccacgcggcgctgggtggccggagagcggcggacatcatcctgtggagggacaagaaagcgtcggcgtccatcctcgcggccgcgacagcggcgtggggtctgttcgaggtggcggagttccatttcctgacgctggtctgctacgcggccatggtcggcatgctcgtcttcttcgtctggaccaacgcatcgtcgttcttcaacctgccggtccctcgagtgcctgaccctgagacgctcctgtcggagagggcgaccaggcaagcgatccaaggcgcgcacaggaggctgtccaggttggtccagacgctctacgacatcgcctgcggcaaggacctcaaaatgttcatcctgacggtattgtcgctgtacatcgcgtcggtggtcgccgactgcttcagctccctgacgctcctctacctcgtggtgctgggcgcgatgacgctgccggcgctgtacgagcggtacgacagcgaggtggatcacctggtggcgcgaggcgtgcacgacctgcggacccacttcgcggacatggattcaggcgttctcaggaagatcccgaggggggcaggcgctgcagcagccaagtgagatggagatcgagcagtgaggagggccccggctgaaaacacggcgccatctgatgtactgaaaccgaaactggtcgatcgatacaaagtgtatcgagcaccacggatgagtagcagtatacaagtgtatgtactaagtgtatagctcaaactgaatgaagagcacatgtcgaactgaccgtg

SEQ ID NO: 10248 - protein, 216 aa, Panicum virgatum
  misc_feature: Ceres CLONE 1721947
  misc_feature (29)..(216): Pfam Name: Reticulon Pfam Description: Reticulon
MATTMQGHSGPRLFGRERTLHAALGGRRAADIILWRDKKASASILAAATAAWGLFEVAEFHFLTLVCYAAMVGMLVFFVWTNASSFFNLPVPRVPDPETLLSERATRQAIQGAHRRLSRLVQTLYDIACGKDLKMFILTVLSLYIASVVADCFSSLTLLYLVVLGAMTLPALYERYDSEVDHLVARGVHDLRTHFADMDSGVLRKIPRGAGAAAAK

SEQ ID NO: 10249 - DNA, 623 bp, Panicum virgatum
  misc_feature: Ceres CLONE 1721958
  misc_feature: Encodes the peptide sequence at SEQ ID NO. 10250
gagcttcccgtccaccagcagctggcctatacccttgtgtgttgcattgcgcgttcggtgctcgtcacgatgtcctatggtggcttttgctgcatgcggtggctctccggagcgaagaagaaaccgacggaccacggcggcagatctccgggtgggcttacttgcataacaccaccagttgtggcgactactggcgacagttgcagtgacgtcggagatcaccatcacgacggtggctgtggaggtcaccatggtggctgcggaggtcaccatggtggtggcggcggcggcggcggaggtcactctggccaccatggcggtggcggcggcggaggtcactctggccaccatgttggccaccatggccaccatgttggcggaggaggccaccttggtggtggcttctagaactgggaaggggctctcgagctatattataggtatctttttctgattttcagtactgattattattttatatcggttgtttgtggtaaagtaatatggtgctgtatatttagtttaatgtaataatagaagtttgtactagtaattgccatgtgatcagtcagttgatatatttggatattattattattattattattattattattattatt

SEQ ID NO: 10250 - protein, 112 aa, Panicum virgatum
  misc_feature: Ceres CLONE 1721958
  misc_feature: Functional homolog of the protein sequence given in SEQ ID NO 50178
  misc_feature: Useful for making plants with modulated nitrogen use efficiency
  misc_feature: Functional homolog of the protein sequence given in SEQ ID NO 50179
  misc_feature: Useful for making plants with modulated phosphate use efficiency
  misc_feature: The sequence is a functional homolog of SEQ ID NO 2 in US patent 7189892
  misc_feature: Functional homolog of the protein sequence given in SEQ ID NO 50180
  misc_feature: Useful for making plants with altered alkaloid content
MSYGGFCCMRWLSGAKKKPTDHGGRSPGGLTCITPPVVATTGDSCSDVGDHHHDGGCGGHHGGCGGHHGGGGGGGGGHSGHHGGGGGGGHSGHHVGHHGHHVGGGGHLGGGF

SEQ ID NO: 10251 - DNA, 764 bp, Panicum virgatum
  misc_feature: Ceres CLONE 1721983
  misc_feature: Encodes the peptide sequence at SEQ ID NO. 10252
atccaaaatccgcaggccacgaactcacgaagcggcagcgagagccgagagaagccatggcgctgtccctctccctcgcgcgcgccgcgcccctcgccgtctccgcgggcgccggggccaggaggatccccgccgccagcctcgccttccctcccaagtccttcttcggcgcgccgctggccgccaccgccgcctccgtcgcgtcgccgctcccgcgcaggccggctacctccacctcgctcgaggtcgtcgcggcggggaagaaggggtacaagatgaagacccacaaggcgtcggcgaagcggttcagggtgacggggaggggcaagatcgtgcgccggtgcgccgggaagcagcacctgctcggcaagaagaacaccaagcgcaagaagaggctctccaagatggtccaagtaaacaagagtgactacgacaatgtgacaggcgcactgccctacctcaaagtgaataggaaagtagactgagttcttcttggtcttcaaaagccattctgtttcattccaccaacctgtaattttgtgtattttccgctgtattacctttcgaatatggaggctgtaattcatttcaagaaagcataaaaaactcttcgtaccaatagagtgcgctgctagctgtagttgtttttggttgcaaatttttgcaaagactggtacgtggcacgtgaaccatatcttagtaagctggtgtggatttaaatagtgtcctgtattgaatcacaagctgaaggtggtttcatcttt

SEQ ID NO: 10252 - protein, 142 aa, Panicum virgatum
  misc_feature: Ceres CLONE 1721983
  misc_feature (74)..(132): Pfam Name: Ribosomal_L35p Pfam Description: Ribosomal protein L35
MALSLSLARAAPLAVSAGAGARRIPAASLAFPPKSFFGAPLAATAASVASPLPRRPATSTSLEVVAAGKKGYKMKTHKASAKRFRVTGRGKIVRRCAGKQHLLGKKNTKRKKRLSKMVQVNKSDYDNVTGALPYLKVNRKVD

SEQ ID NO: 10253 - DNA, 885 bp, Panicum virgatum
  misc_feature: Ceres CLONE 1721986
  misc_feature: Encodes the peptide sequence at SEQ ID NO. 10254
cgagacccaaccacaagagcgacggcgcgggcggaccaggaggaggccgcggagcagcaggagcagccgggcaaggccaccgctgccaccatgggtatctcgcgtgactcgatgcacaagcgccgggccaccggtgggaagcagaaggcctggaggaagaagcgaaagtatgagcttggccgccagccagccaacaccaagttgtcaagcaacaagacggtgaggagggtccgtgtccgaggaggtaatgtgaagtggagggctctccgcctggataccggtaactactcatggggtagtgaggctgttacccgcaagacccgtatcctggatgttgtctacaatgcgtcaaacaatgagcttgttcggacccagacccttgtgaagagcgccattgtgcaagttgatgctgccccattcaagcagtggtacctcactcactatggagtggacattggtaggaagaagaaggccccggctgctaagaaggatgctgctgagggtcaagagggtgaggccgcagctgaggaaaccaagaagagtaaccatgtccagaggaagcttgagaagcgccagcagggacgcacacttgacccgcacattgaggagcaatttggaagtggaaggttgttggcatgcattgcttctcgccctgggcagtgtggccgagctgacggttacatcattgagggtaaagagctcgagttctacatgaagaagctccagaggaagaagggcaagggtgccgcagcttagaagcaatatattgtctggaagggggcgacttatcttatcctttactctgggttttgttagtcctcaagtgtgttatgtcgtgtagcagacctgataaacaccaattttaattttctgaaagtgattcta

SEQ ID NO: 10254 - protein, 221 aa, Panicum virgatum
  misc_feature: Ceres CLONE 1721986
  misc_feature (1)..(199): Pfam Name: Ribosomal_S8e Pfam Description: Ribosomal protein S8e
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLTHYGVDIGRKKKAPAAKKDAAEGQEGEAAAEETKKSNHVQRKLEKRQQGRTLDPHIEEQFGSGRLLACIASRPGQCGRADGYIIEGKELEFYMKKLQRKKGKGAAA

SEQ ID NO: 10255 - DNA, 814 bp, Panicum virgatum
  misc_feature: Ceres CLONE 1722003
  misc_feature: Encodes the peptide sequence at SEQ ID NO. 10256
aaaagacgaccccaaccccaatcatcatcgtcgtcaacgaccgatcacgcgagcaacttggggcgacggagcgcagccgccgtaaaacctagcacgggatcccgaaccgcggccggcgagatgcagatcttcgtgaagacgctgacggggaagaccatcacgctcgaggtcgagagcagcgacaccatcgacaatgtcaaggccaagatccaggacaaggagggcattcccccagaccagcaaaggctgatttttgctggtaagcaattggaagatgggagaacattagctgattacaacattcagaaggagtcgacacttcatttggtcctgaggctcaggggtggaactatgatcaaggtgaagacacttacagggaaggaaattgagattgacattgagcccactgacacaattgataggatcaaggagcgtgttgaggagaaagagggtatcccacctgttcagcagaggctcatttatgctggcaagcaacttgctgatgacaaaactgccaaggattacaacatcgaaggtggttcggtgctccatcttgtgcttgctctgaggggtggccagtagattcaacttctacccgtagcttatgttattgtgatttctacctatagttggttgagactttaagccttgtattgggtggttgattgaagtggattagtggactaagagtcaggtgtcatctgtgctggatatgaaatgcttgaactatgtttatcagccgtcatctgattgcccaaatactcctttcatgggttcactttgataaatcatggttcccaattatggaaaatcc

SEQ ID NO: 10256 - protein, 153 aa, Panicum virgatum
  misc_feature: Ceres CLONE 1722003
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
MQIFVKTLTGKTITLEVESSDTIDNVKAKIQDKEGIPPDQQRLIFAGKQLEDGRTLADYNIQKESTLHLVLRLRGGTMIKVKTLTGKEIEIDIEPTDTIDRIKERVEEKEGIPPVQQRLIYAGKQLADDKTAKDYNIEGGSVLHLVLALRGGQ

SEQ ID NO: 10257 - DNA, 713 bp, Panicum virgatum
  misc_feature: Ceres CLONE 1722032
  misc_feature: Encodes the peptide sequence at SEQ ID NO. 10258
ttctcttccccaatctctcgccctcctgcctaccccgtgcgctgcacctagaaagctatggtttcccctgccatccgatccgtctagtccaccctccccacccacatcgatagatgaccaagagccatagtaacatgatcaccctcgagagctctggacggtgcaggactgccaggtggacgacgccgtcgccatggactcccacaccatccgccacatgatgaacgacgactgcgccgactactgcatcccgctccccaacgtcaactccaagatcctctccaaggtaatcgattactgcaacaagtacctccacgccgcggccgcagcggcctcggcgtccaaggtcggctccgacgacgctggggcagccgtcaccaacagcaacgctgcctccggtgaagaccttaagaactgggacgccgacttcgtcaaggtcgatcaggccactctgttctacctcatcttggctgcaaactatctcagcatcaaagggctgctggacctgacgtgccagactgttgctgacatgatcaagggtaagactcctgaggagatccgcaagaccttcaacatcaagaacgacttcacccctgaagaggaagaggagatccgcagagagaaccagtgggccttcgagtagagaggcgcttgagcccctgatctcttgatgcctaggttctgtcgcacctattaccttgcaatgtctgctt

SEQ ID NO: 10258 - protein, 149 aa, Panicum virgatum
  misc_feature: Ceres CLONE 1722032
  misc_feature (72)..(149): Pfam Name: Skp1 Pfam Description: Skp1 family, dimerisation domain
  misc_feature (1)..(41): Pfam Name: Skp1_POZ Pfam Description: Skp1 family, tetramerisation domain
MDSHTIRHMMNDDCADYCIPLPNVNSKILSKVIDYCNKYLHAAAAAASASKVGSDDAGAAVTNSNAASGEDLKNWDADFVKVDQATLFYLILAANYLSIKGLLDLTCQTVADMIKGKTPEEIRKTFNIKNDFTPEEEEEIRRENQWAFE

SEQ ID NO: 10259 - DNA, 908 bp, Panicum virgatum
  misc_feature: Ceres CLONE 1722044
  misc_feature: Encodes the peptide sequence at SEQ ID NO. 10260
ctctctctcctctcctctcctttcctctctctctctctctctctctctctctctctctctacaagcggcgacgacaggggagtggcgccgccttgcccgttcttcgtcggacgcttcgccggccgacaagcatcgttaagcacagtatgtcggagaaaccatctgatgctgcaactggtgatgtgaggcctgaagatattgtttctgatgagaaagtggaaggttctgatcagaatgaaagagatggtatgccttcgccgcaacaagaggaagcagcgatcaagaaaaagtacggaggaataatgcccagaaagacaccacttatttccaaggaccatgagcgaacatactttgattctgctgattgggctttggggaagcaaggaggaaatcatcaaaaacctaaaggaccgctcgaagcgcttcgaccaaaattacagcctactcaacaacaaactcgttcacgtcgatttcttggtgaatctgctgacaacgaagagagtgtccattcacctactgaggatgtcaattcacctactgaggatgcaggccagaaccaggataacgctgaaggcaagggcaaggaatgatgggcggttccaagttttgtctatgattttctgcttaaagcaataagcactcgggtgcatgtaatgatcatgccccgtgaggtcaagctgagtttcgaattgtcaaatgccgtaactacatgttatgttgttccatttgtgacgcctattgccaatcacaatttgggatggaattggggtgattcctggatcacggtgtggtgtcacccgtttgaggctttgagctaacaaaaatgaaacatgagaataccagactattgtggcgacagtatgatcttgcctgaaacaaaaatgaagataccagacatttctcgtgtc

SEQ ID NO: 10260 - protein, 147 aa, Panicum virgatum
  misc_feature: Ceres CLONE 1722044
  misc_feature (46)..(129): Pfam Name: Lg106 Pfam Description: Lg106-like protein
  misc_feature: Functional homolog of the protein sequence given in SEQ ID NO 50181
  misc_feature: Useful for biocontainment applications
MSEKPSDAATGDVRPEDIVSDEKVEGSDQNERDGMPSPQQEEAAIKKKYGGIMPRKTPLISKDHERTYFDSADWALGKQGGNHQKPKGPLEALRPKLQPTQQQTRSRRFLGESADNEESVHSPTEDVNSPTEDAGQNQDNAEGKGKE

SEQ ID NO: 10261 - DNA, 497 bp, Panicum virgatum
  misc_feature: Ceres CLONE 1722072
  misc_feature: Encodes the peptide sequence at SEQ ID NO. 10262
cgtgccgctggcgcacgtggggacgtctgcgaggcgcacgccttctgcatggatcagccggccatggccggccgcttcctctgcgccgccgggtacccaaacatgcgcgacatcctcgaccgcttcgcctccaggttccccgacatcaagatacggctccaacaggtgacaggggagggggtgagggtgcgaggtgacaccaccaagcttgaggacctggggttcaggtacaggtatggcgtggaggagacgatggacggcagcgtcgagtgcaccaagaggttgggggtgctctaggcgttacgttcacatgcttgtgcagatgcgtgccagttcggactcgattgcagctattatcgtacgtgatggtggggtgtgtgtgtatctttcgtgtgtggatttccaccgacgatttgtcccaaatcccgatgagtttttttcttttgacaatacctactttgtatcgagatgaaactcagtacagaaaagaccacgcc

SEQ ID NO: 10262 - protein, 98 aa, Panicum virgatum
  misc_feature: Ceres CLONE 1722072
  misc_feature: SWISSPROT Homolog: EC 1.1.1.219 Dihydrokaempferol 4-reductase
RAAGARGDVCEAHAFCMDQPAMAGRFLCAAGYPNMRDILDRFASRFPDIKIRLQQVTGEGVRVRGDTTKLEDLGFRYRYGVEETMDGSVECTKRLGVL

SEQ ID NO: 10263 - DNA, 470 bp, Panicum virgatum
  misc_feature: Ceres CLONE 1722076
  misc_feature: Encodes the peptide sequence at SEQ ID NO. 10264
tcgccgccgcctcctctcccctaaacccttctcgccccctcctcctcagtttgtaactatggcactgactaataagcttggtggccttctcaagaaagccactagctcaaatccttctatctatcaagcaatcagatgcatgtcatcatctaagctctttgttggagggctttcttatggcactgatgatcagagtctcagagatgcctttgcgaattatggccaggttattgaagctagggttatcatggaccgtgagtctggaagatccagaggttttggctttgtaacttacacatcatctgaggaggcttcagctgccatcacagccatggatggacaggatctccatggaaggaacataagggttaaccatgctactgagaagacaagtggtttccgggctggtggcggcggcggttttggtggtggtggctatggcggcggtggttttggtggcggctacggct

SEQ ID NO: 10264 - protein, 137 aa, Panicum virgatum
  misc_feature: Ceres CLONE 1722076
  misc_feature (33)..(104): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50182
  misc_feature: Useful for making plants with modulated biomass
  misc_feature: Functional homolog of the protein sequence given in SEQ ID NO 50183
  misc_feature: Useful for making plants with altered alkaloid content
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50185
  misc_feature: Useful for making plants with modulated flowering time
MALTNKLGGLLKKATSSNPSIYQAIRCMSSSKLFVGGLSYGTDDQSLRDAFANYGQVIEARVIMDRESGRSRGFGFVTYTSSEEASAAITAMDGQDLHGRNIRVNHATEKTSGFRAGGGGGFGGGGYGGGGFGGGYG

SEQ ID NO: 10265 - DNA, 500 bp, Panicum virgatum
  misc_feature: Ceres CLONE 1722076-R
ggtggcagtggtggcggtggttacggtggcagcggagggtacggtgcgggctatggtagcggcggcggcggcgggggctatggtggtggcaactatggcaacagggatggcggcggctatgggggtggtggagttgcaggtggagctggcggcaattttgctgctggaggtggcgacagctttggcagcaacttcggtggtgaaagtgggtttggaaaccctgctggtggattcggtgctcccagtggcacctatggtggtgatgagttccctgctagtggcagcttcagcagcaacaagaatgacgaaatcatgcaagatatgttcaaggatgacgatgagcctgacaactatgccgacaaaagggcctagtttttgtcctccaagctaccctgtctaaataacggaacgagcactttgtgttgaacagactatcgaagtgtgctttattttgacttgctctgtttagtgtttgcgcctctggcaaacattcctgcttt

SEQ ID NO: 10266 - DNA, 942 bp, Panicum virgatum
  misc_feature: Ceres CLONE 1722090
  misc_feature: Encodes the peptide sequence at SEQ ID NO. 10267
agcgactccaccacagaagcggcggcgcggcggagggagaagagggggcgaaggcgagggcgcggggaagggagaggagcaccagcaatggtgcacgtcagcttctaccgtaactatggtaagacattcaagaagccaaggcgtccttatgagaaggagcgtcttgatgctgagctgaagctcgtcggtgagtacgggctgaggtgcaagcgtgagctgtggagggtccagtatgctctgagcaggatccgtaatgctgcaaggcacttgctcacacttgatgagaagaacccccgccgtatctttgagggtgaggcgctgctccgccgcatgaaccgctatgggctgcttgctgagggtcagaacaagcttgattacgtccttgccctcactgctgagaacttcctggcaaggcgccttcagactcttgtcttcaaggctggcatggccaagtccatccaccatgctcgtgtcttgatcaagcaacgccacatcagggttggcaggcaaattgtcaatgtcccgtcattcatggtgagggtggagtctgagaagcacattgacttttcactgtcaagcccattcggcggaggtcccccaggcagggtgaagaggaagaaccagaagaaggcaagcggtggtggcggcgacggcggcgatgaggacgaggagtgaggatgaaccagtagccgttacctgatttaatattatctagttgtcataaacatgttggtatcttgagctcttagctgtgtggcctgatgctcagtcccttgtgttgactgggcatcacggatgtttatcgttttgccttgcagtgttattagcctatacttagctgctatgtttgaagatgtttaatcatgttgcgtttcaacttctgttgtcatcaaagctgtacctgttttctctgcacctatgatttgccaagtcagttcacat

SEQ ID NO: 10267 - protein, 195 aa, Panicum virgatum
  misc_feature: Ceres CLONE 1722090
  misc_feature (7)..(108): Pfam Name: Ribosomal_S4 Pfam Description: Ribosomal protein S4/S9 N-terminal domain
  misc_feature (109)..(156): Pfam Name: S4 Pfam Description: S4 domain
MVHVSFYRNYGKTFKKPRRPYEKERLDAELKLVGEYGLRCKRELWRVQYALSRIRNAARHLLTLDEKNPRRIFEGEALLRRMNRYGLLAEGQNKLDYVLALTAENFLARRLQTLVFKAGMAKSIHHARVLIKQRHIRVGRQIVNVPSFMVRVESEKHIDFSLSSPFGGGPPGRVKRKNQKKASGGGGDGGDEDEE

SEQ ID NO: 10268 - DNA, 902 bp, Panicum virgatum
  misc_feature: Ceres CLONE 1722096
  misc_feature: Encodes the peptide sequence at SEQ ID NO. 10269
aacaaaaagaaaccaggcagcctccgctcgagagagatcgcatctgcctgcctgcccaccttcccttcctccccaccccggcgacgcggccgccccgagaccgagcaaccccacggcgagaggaacaggtagggcaagaagatgtcgtcggcgttcagcggcgatgagacggcccccttcttcggcttcctcggcgccgccgccgccctcatcttctcatgcatgggcgcggcgtacgggacggcgaagagcggcgtcggcgtggcgtccatgggcgtgatgcggccggagctcgtgatgaagtccatcgtgcccgtggtcatggctggtgtgctcggtatctacggcctcatcatcgccgtcatcatcagtaccgggatcaaccccaaggccaagccctactacctcttcgatgggtacgcccacctctcgtccgggcttgcctgtggcctcgcggggcttgctgctggcatggccattggcatcgttggtgatgctggtgtcagggcaaatgcacaacagccgaagctctttgtgggcatgattctcattctcatttttgcagaagcgctagctctctacggtctcattgtgggcatcattctctcatcccgtgccggccaatcccgtgcggattaggcgcttgctgctaccattctataattactgctgtgtttattatatgctcttttgagagaaacttgaactcgaggttcttgtctagtttgttcatgttaccatgtatcaatgaaacagttgtagctgaaggaaggtggcacttccagtcatgttcgatttggtggtgtcaagaggttattttttgggttaaggctggatggatgctcctgggctaagtggatttaattttatccatggtgaataaagaacacggaattgtagcc

SEQ ID NO: 10269 - protein, 165 aa, Panicum virgatum
  misc_feature: Ceres CLONE 1722096
  misc_feature (93)..(158): Pfam Name: ATP-synt_C Pfam Description: ATP synthase subunit C
  misc_feature (14)..(79): Pfam Name: ATP-synt_C Pfam Description: ATP synthase subunit C
  misc_feature: SWISSPROT Homolog: EC 3.6.3.14 H(+)-transporting two-sector ATPase
MSSAFSGDETAPFFGFLGAAAALIFSCMGAAYGTAKSGVGVASMGVMRPELVMKSIVPVVMAGVLGIYGLIIAVIISTGINPKAKPYYLFDGYAHLSSGLACGLAGLAAGMAIGIVGDAGVRANAQQPKLFVGMILILIFAEALALYGLIVGIILSSRAGQSRAD

SEQ ID NO: 10270 - DNA, 825 bp, Panicum virgatum
  misc_feature: Ceres CLONE 1722098
  misc_feature: Encodes the peptide sequence at SEQ ID NO. 10271
atcacctcacgctcgcaccaaaaagcaaaaggagaacaaaaaaaagcgacgcgtcggagctcgctgccacaccagccaatcgcccctctcgctccctccctcttatcccctctcctcggctccgccagctccgcctcgtcgtcattgccccgctgctgtgttgccgccgccgccgccttcttcctcgtcgtcccctggcagccggcagctagcagcgatggccctgcaggctccggcgtcgtccctggcgcgcgcgccggcggcgccgctccggtcgtcgttctcggcgccgtggccggcgctgcggctgccggcgcccgcgcggcggcgggcgggcgccgcggccgcgcggatcaccatgcgggtcgcgtccaagcaggcctacatctgccgcgactgcgggtacatctacaacgacaggaccccgtttgagaagctggccgacaactacttctgccccgtttgtggagctccaaagaggaggttcagaccataccagccggcggtgtccaagaacgcgaatgctaccgatgcccgcaaggcgaggaaggagcagctgaagaaggacgaagcaatcgggcaggccttgccgatcgccattgtcgccgggatcatcgctctggccggcctctacttctacctcaacaacgcctacaactagaggaacaaacacgcttcagagacgaccaatccatttggtgccagggacaggattctttacattttgccctttgtttttgtggctgtacatgtgtgcgtcatgctacatgcatactactagggatccaacctccaagactgttatacaactcgtcgttaatcttg

SEQ ID NO: 10271 - protein, 147 aa, Panicum virgatum
  misc_feature: Ceres CLONE 1722098
  misc_feature (55)..(90): Pfam Name: Rubredoxin Pfam Description: Rubredoxin
MALQAPASSLARAPAAPLRSSFSAPWPALRLPAPARRRAGAAAARITMRVASKQAYICRDCGYIYNDRTPFEKLADNYFCPVCGAPKRRFRPYQPAVSKNANATDARKARKEQLKKDEAIGQALPIAIVAGIIALAGLYFYLNNAYN

SEQ ID NO: 10272 - DNA, 976 bp, Panicum virgatum
  misc_feature: Ceres CLONE 1722114
  misc_feature: Encodes the peptide sequence at SEQ ID NO. 10273
gccgcggccctccctatccaaagtcgctcgcccattcagccagggcacgccgaagcatggcgctctccgtctcctccctcgccgccgccctttcccacctctccctcccctccacctccacctccaagccccatcaggcctccctcctgcgcctccacccctccacctcccgccgcgccgtcagcctcgcactccgcgcctccgcggccgaggccgcggagccggccgaggcagacatgcccgcggaggaggtggtggcagtcgaggaggaggcggaggaggatgcggtgtcgggcttcgcgctgcggaagtacgtcaagcagcggctgccgggcggcttcgcggcgcagcggatcaccgccacgggccgccgcaagacggccatcgcccgcgtcgtgctccaggagggcaccggcaaggtcttcgtcaacttccgcgacgctaaggagtatctgcagggaaacccaatgtggatggagtactgcaaggtccccttggtgactctcggatttgagaacaattacgacgtctttgtcaaatttcatgggggtggtttgtcaggccaggcccaggcaatttgccttggcgtcgcccgtgcgctagtgaagatcagcactgccagcaaggttcctcttagatcagaaggtttgctgatgagagacacccgtattgttgaaaggaagaaggctggtctcaagaaggcacgcaagcgcccacagttctcaaagcgttgagggtgctcagttgttcttacagttttttcatttccatctcgtcaccactcagaaagccctcctgtatcatttgctgtgcaaattctgtaatagacgccgcgtatctgtaatagtttattcttgaaagcagttttgctgaaatcattctccaagcttcataagctcagctaactatatccttgcactggacaaatcgtagtgaacttataatgaataaatatatgaccctcatgagttgtctt

SEQ ID NO: 10273 - protein, 225 aa, Panicum virgatum
  misc_feature: Ceres CLONE 1722114
  misc_feature (104)..(225): Pfam Name: Ribosomal_S9 Pfam Description: Ribosomal protein S9/S16
MALSVSSLAAALSHLSLPSTSTSKPHQASLLRLHPSTSRRAVSLALRASAAEAAEPAEADMPAEEVVAVEEEAEEDAVSGFALRKYVKQRLPGGFAAQRITATGRRKTAIARVVLQEGTGKVFVNFRDAKEYLQGNPMWMEYCKVPLVTLGFENNYDVFVKFHGGGLSGQAQAICLGVARALVKISTASKVPLRSEGLLMRDTRIVERKKAGLKKARKRPQFSKR

SEQ ID NO: 10274 - DNA, 793 bp, Panicum virgatum
  misc_feature: Ceres CLONE 1722150
  misc_feature: Encodes the peptide sequence at SEQ ID NO. 10275
aaatcgatcggagcacaacagaagccacacgctcccaagtcccaacacacaagcaagcaagcaatctgaggagaagccggccgccgatttccccagcccgtgcattgttcccgatggcgaccatggtgatggcctccgccgcgagctccctcgccttcgccgccaccggcgcgagcgccggccgcttccccgcccggcttccggcggcggcggggctcgcgccgcgccggcgcgcaccgctcgtcagggcgcaggctaataagggtcctgaaaagccggcagcgagcccgggactctgggacgcgctggcgttcagcggcccggcccctgagcgcatcaacgggcggctcgccatggtcggcttcgtgtccgcgctcgccgtcgaagcgtcccgcggcgggggcctcctctcgcaggccggcagcgggtctgggctggcctggttcgcggccacggccgccgtgctctccgtggcgtcgctggtgccggtcctcaagggggagagcgccgaggcccgcagcggcggcgtcatgagcgccgacgccgagctctggaacggccgcttcgccatgctcgggctcgtcgcgctcgccgtcaccgagtacatcaccggcgcgcccttcgtcaacgtgtaaaatataacggcctacgttgttgtacgggcacgtgtagctgtgtaatagaggaggtagtgtaaaccttggctaggacactctggacatgactccttcgtaaaactcttccgctaaacggtcatgtaaaattgttgatttgaaatgactttctttgcgac

SEQ ID NO: 10275 - protein, 173 aa, Panicum virgatum
  misc_feature: Ceres CLONE 1722150
  misc_feature: SWISSPROT Homolog: EC 4.99.1.1 Ferrochelatase
MATMVMASAASSLAFAATGASAGRFPARLPAAAGLAPRRRAPLVRAQANKGPEKPAASPGLWDALAFSGPAPERINGRLAMVGFVSALAVEASRGGGLLSQAGSGSGLAWFAATAAVLSVASLVPVLKGESAEARSGGVMSADAELWNGRFAMLGLVALAVTEYITGAPFVNV

SEQ ID NO: 10276 - DNA, 878 bp, Panicum virgatum
  misc_feature: Ceres CLONE 1722163
  misc_feature: Encodes the peptide sequence at SEQ ID NO. 10277
agagagaggagagcagcagccaagcgccacacgccgacgcgaaccaaccggctggtggtgggttagtaggttaggtaggcagcttagcttacgatggcgccgcgccgcgccgccctcttcgccgccgcgctcctcctggcctccgccgcggcggtctccgggttccacctcggcggggacgagagcgggctcgtgcggggcgtgctcgccgcgctccgcgagcggggcgaggccgaggacgccgcgcgcttcgccgtcgcccaccacaacaagaaccagggtgctgctttggagtttacacgggtgctgaaatcgaagcggcaggtggtgaccgggacactgcatgacctggtattggaggctgctgatgctggaaaaaagagtctgtacagagcaaaggtttgggtgaagccatgggaagatttcaagtcagttgtcgagtttcgccttgttggagactctgaggttgaacccgagccttctgttgcttctgatggtacctctggtcaagccattgccaaggtctctcttgaagcagacatcatacaagaagaggctctcctgcacaccgttgagaatgaaggactttccagcgacttcacatcgtcctcctagacatacttggtgtgactagaattccaggaggggatggaaggtgtgaaggtagtaactgaagtctaaggtatttatagatagtaggtcgctgtcaagctgaaatgctttgactcttctaccggaatatgtatattttgtttggaacgtgggaacatagatctgtatatttcagttttcacactgtccatttccatgtctgtacataaggtggccagttcttctgtctttgtggcagtagtacttcaactgcataaatgttatgc

SEQ ID NO: 10277 - protein, 173 aa, Panicum virgatum
  misc_feature: Ceres CLONE 1722163
  misc_feature (36)..(121): Pfam Name: Cystatin Pfam Description: Cystatin domain
MAPRRAALFAAALLLASAAAVSGFHLGGDESGLVRGVLAALRERGEAEDAARFAVAHHNKNQGAALEFTRVLKSKRQVVTGTLHDLVLEAADAGKKSLYRAKVWVKPWEDFKSVVEFRLVGDSEVEPEPSVASDGTSGQAIAKVSLEADIIQEEALLHTVENEGLSSDFTSSS

SEQ ID NO: 10278 - DNA, 877 bp, Panicum virgatum
  misc_feature: Ceres CLONE 1722166
  misc_feature: Encodes the peptide sequence at SEQ ID NO. 10279
cttcgcccgccgccgccccaagcccccgagccgaagccgcgcctcgcaccgccccgatccaatggcgccgtcgtcgaagctgtcgcagggaatcaagcgggcgtcccggtcgcacgcgtaccaccgccgggggctgtgggccatcaaggccaagcacggcggctcgttccccaaggccgagaagcccgccgccgccgcggagcccaagttctaccctgccgacgatgtcaagccccgcgttcccagcacccgcaagcctaagcctaccaaactcaggtccaccatcacccccgggacggtgctgatcctgctcgctgggcgcttcatgggcaagagagtggtgttcctcaagcagctcaagtccggcctcctcctcatctctgggcctttcaagatcaatggagtaccgatccgccgtgtgaaccagacctacgtcattgctacatccaccaaggtcgacatctctggtgttgatgctgcgaagtttgatgacaagtactttgcccgggaaaagaagcagaaggcgaaaaagactgagggcgagctttttgagacagagaaggaggcgtcaaagtctctgcctgacttcaagaaggatgaccagaaggctgtggatgctgctctgatcaaggctattgaggctgtcccagacctgaaaacctaccttggtgcccggttctctctcagggatggtgacaagccccatgagatggtcttctaaatttagttttggagttctgaagaagtcgttttgcctagtgtgctcctgtacttctaagttttgtacctcgggtagcggacctttgatccctgattgaagtctgcctgtcaaatattatgagaagatttaagaaagttttatccatagttgtggttt

SEQ ID NO: 10279 - protein, 219 aa, Panicum virgatum
  misc_feature: Ceres CLONE 1722166
  misc_feature (112)..(219): Pfam Name: Ribosomal_L6e Pfam Description: Ribosomal protein L6e
  misc_feature (1)..(49): Pfam Name: Ribosomal_L6e_N Pfam Description: Ribosomal protein L6, N-terminal domain
  misc_feature: Functional homolog of the protein sequence given in SEQ ID NO 50169
  misc_feature: Useful for making plants with modulated nitrogen use efficiency
MAPSSKLSQGIKRASRSHAYHRRGLWAIKAKHGGSFPKAEKPAAAAEPKFYPADDVKPRVPSTRKPKPTKLRSTITPGTVLILLAGRFMGKRVVFLKQLKSGLLLISGPFKINGVPIRRVNQTYVIATSTKVDISGVDAAKFDDKYFAREKKQKAKKTEGELFETEKEASKSLPDFKKDDQKAVDAALIKAIEAVPDLKTYLGARFSLRDGDKPHEMVF

SEQ ID NO: 10280 - DNA, 878 bp, Panicum virgatum
  misc_feature: Ceres CLONE 1722169
  misc_feature: Encodes the peptide sequence at SEQ ID NO. 10281
attcctcgccccctccggacgcttataacaagttcagcgccggagctccgccaacggcggcgccgccggcagcgtaccagcagcacggggccgtgaacatgaacccctcacgccccggcgccgcgctgcggacatggtccaccggcctcttccactgcatggacgacccggggaactgtctcatcacttgcctgtgcccctgcatcacgttcgggcagatcgctgacatcgtggacaaaggcacctgctcttgtattgcgagtggactgatctatgggctcatctgcgcctcgacggggatgggttgcctctactcgtgcctctaccggtccaggctgagggccgagtacgacctgcaagaaggggaatgccccgacttcctggtccactgctgctgcgagcacctggcgctctgccaggagtaccgcgagctcaagaaccgcggctacgacctggggatcggttgggatgccaacatggaccggcagaggcgaggcgttgccagcggcacggtaatgggggcgccggccacgccgctgggcatgattagataggcgatgatggttgtgaaatggcgatgctttgctcccgtggtccttcgtgttgctatgctgttaatattttttttctcgtcttgcgagtggagatcagaacgcatgtatttaagattttaagctggttgtgtattgctacttggtagtatctgtacggtaatctgaagtgtggacaatgtccggacctttggctgtgtacctaaagttccctttgtgtttgttgtaattcgtaatccgctcgtacgaggggtactagctgttggaattatggacttggttcatttattctaatcaatgtaataaaagaatttaaactccactatt

SEQ ID NO: 10281 - protein, 183 aa, Panicum virgatum
  misc_feature: Ceres CLONE 1722169
  misc_feature (45)..(144): Pfam Name: PLAC8 Pfam Description: PLAC8 family
SSPPPDAYNKFSAGAPPTAAPPAAYQQHGAVNMNPSRPGAALRTWSTGLFHCMDDPGNCLITCLCPCITFGQIADIVDKGTCSCIASGLIYGLICASTGMGCLYSCLYRSRLRAEYDLQEGECPDFLVHCCCEHLALCQEYRELKNRGYDLGIGWDANMDRQRRGVASGTVMGAPATPLGMIR

SEQ ID NO: 10282 - DNA, 826 bp, Panicum virgatum
  misc_feature: Ceres CLONE 1722170
  misc_feature: Encodes the peptide sequence at SEQ ID NO. 10283
gttcctcccactcgccgccgccgccgcctcccgagcctcaggcgctccagctcccggacctcgccccccacccccccccccgcccccgcccaccatgatcatccccaagaagaaccgcaatgagatctgcaagtacctcttcaaagagggcgtgctgtacgccaagaaggactacaacctggcgaagcacccgcagatcgacgtgcccaacctgcaggtgatcaagctcatgcagagcttcaagtccaaggagtacgtcagggagaccttctcctggcagtactactactggtacctcaccaacgatggcattgagcacctccgcaactacctcaacctgccatctgagatcgtgcctgccacgctcaagaagtctgccaggccgcctggccgcccgtttggctctggtcctcctggtgaccgcccaaggggcccacctcgctttgaaggggacaggccaaggtttggtgacagggaagggtaccgtggtgctcctcgtggtgctcctggtgactttggtggtgagaagggtggagctcctgctgagttccagccatctttcaggagttctggtagcagacctggcttcggccgtggtggtggcagcggctttggcgctggcccgacctcttcttccatggagtgaagttgcccctagtttggacatggtgttttccttcgcatgaggcgtttaattttgaaggacagttatgtactagtattgttatccggatcggcagagtgctgacatatgcagaaaattgtgctatcttgataccgcggttccagtatattgtgcaaacggattcatgtcgttacttgttcg

SEQ ID NO: 10283 - protein, 183 aa, Panicum virgatum
  misc_feature: Ceres CLONE 1722170
  misc_feature (3)..(98): Pfam Name: S10_plectin Pfam Description: Plectin/S10 domain
  misc_feature: Functional homolog of the protein sequence given in SEQ ID NO 50186
  misc_feature: Useful for making plants with modulated nitrogen use efficiency
MIIPKKNRNEICKYLFKEGVLYAKKDYNLAKHPQIDVPNLQVIKLMQSFKSKEYVRETFSWQYYYWYLTNDGIEHLRNYLNLPSEIVPATLKKSARPPGRPFGSGPPGDRPRGPPRFEGDRPRFGDREGYRGAPRGAPGDFGGEKGGAPAEFQPSFRSSGSRPGFGRGGGSGFGAGPTSSSME

SEQ ID NO: 10284 - DNA, 732 bp, Panicum virgatum
  misc_feature: Ceres CLONE 1722221
  misc_feature: Encodes the peptide sequence at SEQ ID NO. 10285
actacgcgcagcaacttgttgagagagatggcgagcccgatggtggccacccgggtccagctccgcaccagcaccggccgcctcagcttctcctcctcccccagcgcagcagccaggcggcgattcgcggcggtgagggcgtcggcggaggcgatggcgacggagaagctgggcatcagggtggagcgcaacccgcccgagtcccgcctctccgagctcggcgtccgccagtggcccaagtggggatgcgagaagagcaagttcccgtggacctactcggccaaggagacgtgctacctgctgcaggggaaggtgaaggtgtacccggagggccacggggaggacttcgtggagatcgccgcgggggacctagtcgtcttccccaagggcatgagctgcacctgggacgtcgccgaggccgtcgacaagcactacaacttcgagtagcctccgccgctgccgcccatgccgaactagcctggtatggcacgcagtagcagtaatttggtgaccgcctagtgggaatgtttgaactgctcctgcttttccattcctgcctgcctgtagacgttctgtgctctgaaccagtgatgctccagtccagtgttaaacatcatgataaagctctggattagcaaactacgatacttgtgtttcgttttgtgcttcacttcttcctcactagctgtttgatgaatggaggcagcgaaatgcgcttatttatattgacat

SEQ ID NO: 10285 - protein, 139 aa, Panicum virgatum
  misc_feature: Ceres CLONE 1722221
  misc_feature (61)..(136): Pfam Name: Cupin_3 Pfam Description: Protein of unknown function (DUF861)
  misc_feature: Functional homolog of the protein sequence given in SEQ ID NO 50187
  misc_feature: Useful for making plants with modulated cold sensitivity
MASPMVATRVQLRTSTGRLSFSSSPSAAARRRFAAVRASAEAMATEKLGIRVERNPPESRLSELGVRQWPKWGCEKSKFPWTYSAKETCYLLQGKVKVYPEGHGEDFVEIAAGDLVVFPKGMSCTWDVAEAVDKHYNFE

SEQ ID NO: 10286 - DNA, 677 bp, Panicum virgatum
  misc_feature: Ceres CLONE 1722243
  misc_feature: Encodes the peptide sequence at SEQ ID NO. 10287
aaagaaagaaacgagcagcagcagcggaacgagagagaagcagcagcagcagcagcggaacgagagagaagcagcagcagcgacgatggcgagcggcggcatgaagagggagatcagcgagacccacgacgccctccgcttcggcatcaacgccggcgtcaaggccgacctcgcgccgccgcatcctctccagtccaccatccaatcggaggccaagttctgggcggacaagaagaggttcgggacggaggctatctacggatccgccttcaacatccgcaaggatctcgatgcccaaatcctctccaggttccaaaggccccctggtgctttgccatcatctatgcttggatatgaggcactgacaggttccttggatgattttggatttgaagattatcttaacatgcctcaagattctgacagtttccgtcaacctgacatgcaccatggaatggaagttcgccttggcttgtccaaaggacctatctgccctagcttcaattgatccatccatgtagttctgcagtacgttgtgcaccacacagtccagtacatcggtcaatagaccatattatcatggtgaaaagtgaaaaccgatgagccttgccacctgttcagtgttcagtgtaatgtttcagtcaacgccgaatttagttcttatcctatttgaactt

SEQ ID NO: 10287 - protein, 140 aa, Panicum virgatum
  misc_feature: Ceres CLONE 1722243
  misc_feature (2)..(131): Pfam Name: UMP1 Pfam Description: Proteasome maturation factor UMP1
MASGGMKREISETHDALRFGINAGVKADLAPPHPLQSTIQSEAKFWADKKRFGTEAIYGSAFNIRKDLDAQILSRFQRPPGALPSSMLGYEALTGSLDDFGFEDYLNMPQDSDSFRQPDMHHGMEVRLGLSKGPICPSFN

SEQ ID NO: 10288 - DNA, 877 bp, Panicum virgatum
  misc_feature: Ceres CLONE 1722245
  misc_feature: Encodes the peptide sequence at SEQ ID NO. 10289
gttccccatccgcgcaggccaaccaacagtgacgcgatcacgggcacccctccccctctcctctccttccgcgtcgcgtgccctcgccgcagcccatcctcatggcggatcagctcaccgacgagcagatcgcggagttcaaggaggcgttcagcctcttcgacaaggacggcgacggttgcatcactaccaaggagcttggaactgtgatgcgctcccttggccagaaccctactgaagcagagctgcaggacatgatcaacgaggttgatgctgatggcaacgggaccatcgacttcccagagttcctgaacctgatggcaaggaagatgaaggacactgactctgaggaggaactcaaggaggctttccgtgtcttcgacaaggaccagaacggtttcatctcggctgctgagctccgccatgtcatgaccaaccttggtgagaagctgaccgatgaggaagtcgacgagatgatccgcgaggctgacgtggacggcgatgggcagatcaactatgaggagtttgtcaaggtcatgatggccaagtgaggagcggtcccccataaataagtctgtcaggagcaaaccgaattatcaggctcacaagctgtactttgtcatgtcccattgatgagtacgtatcagtatcatgcaggtggtaatgttgagtagtggtcgggttaggtggtgtagtcatgggaacgcgacatcagatacctgtttcttttgattgcgatgttatcttgcattattgcgcctgttggagctttaggatttgctgaagttcatattttcgtgtgtattgtttttcttttttgcgcaagccctggctttcattttcaatcgatctgcatggtattgttagttttgcgtgc

SEQ ID NO: 10289 - protein, 149 aa, Panicum virgatum; identical to SEQ ID NO: 9768
  misc_feature: Ceres CLONE 1722245
  misc_feature (121)..(149): Pfam Name: efhand Pfam Description: EF hand
  misc_feature (85)..(113): Pfam Name: efhand Pfam Description: EF hand
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
  misc_feature: Functional homolog of the protein sequence given in SEQ ID NO 50110
  misc_feature: Useful for making plants with modulated salt sensitivity

SEQ ID NO: 10290 - DNA, 648 bp, Panicum virgatum
  misc_feature: Ceres CLONE 1722247
  misc_feature: Encodes the peptide sequence at SEQ ID NO. 10291
attccgctttgagcttgcttgcagctccagctcccctcgtctcttggtggctacgccatggccaccgtagtcctgatgagctgcagcctccgcgcgccggcctgcagcggcttatctggcgtccgcgccgccccggcaccggccatcgtcgccatgcccgccgccaagcagcaggttgttggccgcggcgccaggctgcgcgcgcaggccacctacaacgtgaagctcatcacgcccgacggcgaggtagagctgcaggtgcccgacgacgtgtacatcctggaccaggccgaggaggaagggatcgacctgccctactcgtgccgcgcggggtcctgctcctcctgcgccggcaaggtcgtctccggcagcgtcgaccagtccgaccagagcttcctcgaagacgaccaggtcgccggcggctgggtgctcacctgcgccgcctaccccacctccgacgtcgtcatcgagacgcacaaggaggaggagctcacctcctcttcgtaatccgatccagtatatgcggctttcattgcttattaattatctcagctcccttgattatatatatatatatatatatatacatatatatatatatatatacatatatatatatatataaattaactttacatgagaaaacac

SEQ ID NO: 10291 - protein, 149 aa, Panicum virgatum; identical to SEQ ID NO: 10105
  misc_feature: Ceres CLONE 1722247
  misc_feature (58)..(133): Pfam Name: Fer2 Pfam Description: 2Fe-2S iron-sulfur cluster binding domain

SEQ ID NO: 10292 - DNA, 250 bp, Panicum virgatum
  misc_feature: Ceres CLONE 1722247-R
ttgtatatatatatatatatatatatatatatatatatatatatatatatatatatatatatatataattaaaccctacgtcgtgcgtgctatagctatagctatagctatactatacttaattggtttgcaattcagctatatgcataatgcatgctagctgtggctatttatatctggtttatttgcaattgatcgagctattttttttgtgttaatgtttcagctccatataaataatgtaatgttt

SEQ ID NO: 10293 - DNA, 557 bp, Panicum virgatum
  misc_feature: Ceres CLONE 1722256-R
  misc_feature: Encodes the peptide sequence at SEQ ID NO. 10294
aggagcgcatgcacaagcagcaccttggccagcccggcgccattgccgccggcgcatgtgctctcgaggagaagcgtgagcccaggacggatccggtgcccggggaccggcccaagatcatggaggagatcgcggtcgaggcggccgtcggcgccgccgggtatgccttccaagagctccgagagcagaagaaggaccgcaaggacgccgagggggccagcggcgtcaggaagcaccaccacctcttgggctgagccgcaggagatcgagctccggcccggccgccgcgcacccacgtgcaaggtccaaaaagagcggccggggattcgcaacaagtccgattccggacccttgagcgagttcggcactgtgggcaagagaggcagggcccgcgagtatgaggaatgttccgcccaggacggaaggaaatgttgaagtgaagaagtgactatgtaagatggcgagtaggcacgaagcttcggattccctctgcgtgtattatcgggcaagtgagtatcttgagggtcaaaaagtggaagcatatacacccaattttc

SEQ ID NO: 10294 - protein, 83 aa, Panicum virgatum
  misc_feature: Ceres CLONE 1722256-R
  misc_feature (1)..(72): Pfam Name: ABA_WDS Pfam Description: ABA/WDS induced protein
ERMHKQHLGQPGAIAAGACALEEKREPRTDPVPGDRPKIMEEIAVEAAVGAAGYAFQELREQKKDRKDAEGASGVRKHHHLLG

SEQ ID NO: 10295 - DNA, 354 bp, Panicum virgatum
  misc_feature: Ceres CLONE 1722256
catcaacgcctcatacagtttcttctggactgctagtaaaaaccataccaaaactaccacacagaaaagtttttgtaacatctatctgttgcaaatggcgtccactgtggcaagcacacacccccccggttaccttcccggccgccgacgggttaccaagaacaaacgtcctccccggactcgtatggctcgccctggcacgccgcggccgcttcccagaaataatgccaaacgggccgacgacagccgaaggagatctcccacaaggtgtcccacagcaacgccagcgccgacgacacctgcgcctacgagatcgcctacagggagtacgcgaagaaggacccacgagcagga

SEQ ID NO: 10296 - DNA, 678 bp, Panicum virgatum
  misc_feature: Ceres CLONE 1722270
  misc_feature: Encodes the peptide sequence at SEQ ID NO. 10297
acaactcacatctcgaccagtcggagttcatccccgagcagacctcgcaagtcgcacatcttcttctcctcctgctccagatctcaggcgaaagcttgtccaccatccaccgccaccgcatcccaatggctcgcttcgccgtcgtcgccgccatcgtcgcgctcctcgccgtcaccgcggccgcgcaggccccggccgcgacgcccaccccggcgcccaggatggccccgctgccgcctcctccggcgcggtccccggccaccgccccggccccggccccggccgcgaagccgcccaccgcctcggcgccgtccccgctgtcctctcccccggccccgcccgccgagggcccctccgcgatgaccccgaccacctccgtctccgccgcccccgccggcgcccccaccgccacgcccaccgggaacggcgccgcctcctccgccgtcagcttcgtcgccgtcgccgccgcggtcgccgccgccgtcgtgttctagatggggacgcgttgcgacgatgggatctcgagctgtttatactgccatatgctttttttttgcgatgcttttttactgtattagatacatttgaggggggattcacccagtgctgctagttacacatcatgcatgattcatgatgatatgattattaatggaattctttcatttgttacatcat

SEQ ID NO: 10297 - protein, 122 aa, Panicum virgatum
  misc_feature: Ceres CLONE 1722270
  misc_feature: Functional homolog of the protein sequence given in SEQ ID NO 50188
  misc_feature: Useful for making plants with altered carbohydrate content
MARFAVVAAIVALLAVTAAAQAPAATPTPAPRMAPLPPPPARSPATAPAPAPAAKPPTASAPSPLSSPPAPPAEGPSAMTPTTSVSAAPAGAPTATPTGNGAASSAVSFVAVAAAVAAAVVF

SEQ ID NO: 10298 - DNA, 611 bp, Panicum virgatum
  misc_feature: Ceres CLONE 1722287
  misc_feature: Encodes the peptide sequence at SEQ ID NO. 10299
acgtttccgtgttgagagagagacagagaggacacgcgagaggctgccgtgtgggggccggagagtcagcgacagcgagggggagagaaggcgatggcggggatcgggccgatcaggcaggactgggagccggtggtggtgcggaagaaggcgcccaccgccgccgccaagaaggatgagaaggccgtcaacgccgcgcgccgctccggcgccgagatcgagaccatgaagaagtacaacgctgggacgaacaaggccgcgtccagcggcacatcgctcaacaccaagcgactcgatgacgacactgaaaatctagcccgtaagcaactaatagtcctgcattacgttattatccatttattgtgacgcttgttttctcatacgttaggggtctcgtcaccccaatgataaattcggatttctggttcccccagatgtgtgatatgaaaaattaattaggatctaggttcagttatctccatgtacttcgcttgttattgcaatctcagtggtctagagatgcaagttatctccttgttattttgttggcctcttgttctgatgaaaataatgttttccctcacaataaaatacatatgcattgagcttcg

SEQ ID NO: 10299 - protein, 90 aa, Panicum virgatum
  misc_feature: Ceres CLONE 1722287
  misc_feature (9)..(79): Pfam Name: MBF1 Pfam Description: Multiprotein bridging factor 1
  misc_feature: The sequence is a functional homolog of SEQ ID NO 1 in US patent 7238857
  misc_feature: Functional homolog of the protein sequence given in SEQ ID NO 50189
  misc_feature: Useful for making plants with altered lignin content
  misc_feature: Functional homolog of the protein sequence given in SEQ ID NO 50190
  misc_feature: Useful for making plants with modulated heat sensitivity
MAGIGPIRQDWEPVVVRKKAPTAAAKKDEKAVNAARRSGAEIETMKKYNAGTNKAASSGTSLNTKRLDDDTENLARKQLIVLHYVIIHLL

SEQ ID NO: 10300 - DNA, 713 bp, Panicum virgatum
  misc_feature: Ceres CLONE 1722300
  misc_feature: Encodes the peptide sequence at SEQ ID NO. 10301
aattagggttctggggttctcgacgcggcgacggcggctacccctttctgtctcagcaagcaagggttagggtttggtggttggacggagaagcctgtagtagatccttcgttagggagtcgccatgagtcggtcggggcagcctccggatcttaagaagtacatggacaagaagctccaaatcaagctgaacgcaaaccgtgttgtcattggcactctgcgtggatttgatcagttcatgaatctggtcgtggacaacacagtggaggtcaatggaaacgacaagaatgacattgggatggtggttatcagggggaatagtgttgtcatgatcgaaacccttgaaccggttgccaaagctcagtgaactgtcagcctgttttagtagttaataagctggtagtgttaaattgaaactgatgtatgccatggggcaccgatgtatcctgagttcctgaatcctgacccttattcatgtgcaagctttaagcacctttgtatagtttagcctgtgtttcgactttccagttgcacagcctgcttattgttattctgctgggatttgtgctatcatggtagagagcgtgttaggctgaccacagcggagggagcaaaaagcaaatttgctccctcctcgtttcccacgccctctctgtttacagtgtcaaacagtgtatttgctctttcatttgctccttccactgtggatggtc

SEQ ID NO: 10301 - protein, 80 aa, Panicum virgatum
  misc_feature: Ceres CLONE 1722300
  misc_feature (8)..(72): Pfam Name: LSM Pfam Description: LSM domain
MSRSGQPPDLKKYMDKKLQIKLNANRVVIGTLRGFDQFMNLVVDNTVEVNGNDKNDIGMVVIRGNSVVMIETLEPVAKAQ

SEQ ID NO: 10302 - DNA, 648 bp, Panicum virgatum
  misc_feature: Ceres CLONE 1722307
  misc_feature: Encodes the peptide sequence at SEQ ID NO. 10303
tagctagctgcaggatcggaaaccaaaggccctcctccatccagatccagctgcatgctcaattgctcatccaatccagcacatcatcttgatccacggtagattggtagatggggtctctgagaggaggaggaggcggcggcatggacgatgaggaggcgaggaatccgcagctggtggatgcggacgaggcatgcgccctcctcagcatggccacgcaccagtatctcgatgtcaggatgtgggaggactttgacaagggccatgtcgccggtgctcggaatgttccctactacctctccgtcactccacatgggaaggagaagaatccccactttgtggagcaggtgtccgcgctctatcccaaggaccaacacctgattgtgggctgccgctccggcattcggtccaagctcgccgctgcagacctcctcagcgcgggcttcaagaatgtgaggaacctagaaggcgggtatctctccttggtccgaagcgccaaccagcagcaccaccaccagcaggctgctgcttaacccatccattaattatcctagtagtattatttaaccatccatggactacaaaatactactactctgtatgtataagacgatgggcatacatacatacaacagtatatattttcct

SEQ ID NO: 10303 - protein, 140 aa, Panicum virgatum
  misc_feature: Ceres CLONE 1722307
  misc_feature (24)..(128): Pfam Name: Rhodanese Pfam Description: Rhodanese-like domain
  misc_feature: SWISSPROT Homolog: EC 2.8.1.1 Thiosulfate sulfurtransferase
MGSLRGGGGGGMDDEEARNPQLVDADEACALLSMATHQYLDVRMWEDFDKGHVAGARNVPYYLSVTPHGKEKNPHFVEQVSALYPKDQHLIVGCRSGIRSKLAAADLLSAGFKNVRNLEGGYLSLVRSANQQHHHQQAAA

SEQ ID NO: 10304 - DNA, 618 bp, Panicum virgatum
  misc_feature: Ceres CLONE 1722311
  misc_feature: Encodes the peptide sequence at SEQ ID NO. 10305
ctcgcgcctccctcggtccctcctgcaatctctctccaccagctccacgccgcgctgctaatcctattcctagctcgccggctaagatggacggcagcagcctcaagtccgcgcagctcctggatcagatgcgcctgcacttggccaccgacgccggcaaggagctcaccaagaaggtcggcctcgtctaccagctcaacatcgcccccaagaagctcggcgttgacgaggagatcttcgtggtcgacctcaagaagggcgaggtcaccaaagggccgtaccaggggaagccggatgctaccttctccttcactgacaacgatttccttggaatcgccaccggcaagactaacccgcagattgcgttcatccgaggggcgattaagatcaaggggagcataagcgccgcgcagaagttcacccctgacatcttccccaagccagcgaagctgtagaaggttagaatgcattatttgggtgcggatggataataaagtttccaagcttcaaccactatgtacctgataggatgaggggaatacatgaacacacgatgatctgtttttatcaatggaatatggataatgctttggttaatctatcacttaaattgaggtc

SEQ ID NO: 10305 - protein, 122 aa, Panicum virgatum
  misc_feature: Ceres CLONE 1722311
  misc_feature (9)..(117): Pfam Name: SCP2 Pfam Description: SCP-2 sterol transfer family
  misc_feature: SWISSPROT Homolog: EC 2.3.1.176 Propanoyl-CoA C-acyltransferase
MDGSSLKSAQLLDQMRLHLATDAGKELTKKVGLVYQLNIAPKKLGVDEEIFVVDLKKGEVTKGPYQGKPDATFSFTDNDFLGIATGKTNPQIAFIRGAIKIKGSISAAQKFTPDIFPKPAKL

SEQ ID NO: 10306 - DNA, 945 bp, Panicum virgatum
  misc_feature: Ceres CLONE 1722325
  misc_feature: Encodes the peptide sequence at SEQ ID NO. 10307
atccgtagttcccatctgttatactgtgttgtgacttgtgaagtgtgttcctatctatatcatcttcgccttgccacctttttcctagttcattcatacaaatggattattctaatttgcgacgccaagctgcatccatgaaaaagtctctctttgatcaggggtacctagatgagcaattttgtcaggtggaagacttgcaggatgaagctagtcctaattttgctgaagaggtcgttactttgtttttcaaggactctgccaggctaatatccaacattgagcaagcactggaaaaatatcccaaagatttcaacaagtgggatgcatacatgcaacaactaaaaggcagctgctccagcattggtgcttcaaggatgaagagtgagtgcatgtcattcagggattattgtgggcaaggaaatgttgaaggttgtatgaaatcgttccagaaagtgaagagggagcatggtgtcctgaggcagaaactagaatcctattttcagctgctacaacaagctggccccactggagctgccaccaggcctgctatgtaagaacggagccttggcccttgccattctaccagttgcaataaatggagtatggcgcaagaagattgcctggacataagtttccggccgccacaactatatggccctgctgctcagcgactaggggccagcgtatatgaaaggaaaaccaaacaagaagagatgctacgcatgtggtataccgaaataagaatagattggcatttccaaaaaaaaaaagacagacgaaaagaacagacagggacggaggctaagagatgagaaacctgtgtaagtagatacacgaaagatgatactaacatataacggtggaataagactacaaagagtattgcgctctctttttttttcctctatagttcctgcaaatttttgtctgcccccatttgtc

SEQ ID NO: 10307 - protein, 151 aa, Panicum virgatum
  misc_feature: Ceres CLONE 1722325
  misc_feature (44)..(129): Pfam Name: Hpt Pfam Description: Hpt domain
MDYSNLRRQAASMKKSLFDQGYLDEQFCQVEDLQDEASPNFAEEVVTLFFKDSARLISNIEQALEKYPKDFNKWDAYMQQLKGSCSSIGASRMKSECMSFRDYCGQGNVEGCMKSFQKVKREHGVLRQKLESYFQLLQQAGPTGAATRPAM

SEQ ID NO: 10308 - DNA, 707 bp, Panicum virgatum
  misc_feature: Ceres CLONE 1722358
  misc_feature: Encodes the peptide sequence at SEQ ID NO. 10309
gctgccaatcaaccaagaaacacgcgcagccaccaccgcacaccaagtcaggaagaagctaggccatggccggtgtgaactcaaccagcgtcgtcgggctcaagcccgccgccgcggtgccgcaggccgccgccgcctcgccggcggcgaagcgggtgcaggtcgcgcccaaagaccgggcggccgagggccggcgcgcggcgctcctcggcctggcggccgtcttcgccgtcaccgccaccaccgggtcggccaaggccgggatcatcgacgagtacctcgagaagagcaaggccaacaaggagctgaacgacaagaagaggctggccaccagcggcgccaacttcgcgcgcgcctacaccgtagagttcggcagctgccagttcccctacaacttcaccggctgccaggacctcgccaagcagaagaaagttcccttcatcagcgacgacctcgagatcgagtgcgaggggaaggagaagtacaagtgcggctccaacgtcttctggaaatggtgaagcgcacgcttgattgcccaggaacgggagggagcgctggtggtgtaacgtgtgtacctagatgcccaaactgcaggaaaaaattggatgtgtaatttaccgtcattgtatctgtgccatctcatcaatcgtcggaacgtgaacctcttgcattggggagtgtgaaattgtagtattggttgttggctg

SEQ ID NO: 10309 - protein, 150 aa, Panicum virgatum
  misc_feature: Ceres CLONE 1722358
  misc_feature (9)..(150): Pfam Name: PsaN Pfam Description: Photosystem I reaction centre subunit N (PSAN or PSI-N)
MAGVNSTSVVGLKPAAAVPQAAAASPAAKRVQVAPKDRAAEGRRAALLGLAAVFAVTATTGSAKAGIIDEYLEKSKANKELNDKKRLATSGANFARAYTVEFGSCQFPYNFTGCQDLAKQKKVPFISDDLEIECEGKEKYKCGSNVFWKW

SEQ ID NO: 10310 - DNA, 693 bp, Panicum virgatum
  misc_feature: Ceres CLONE 1722368
  misc_feature: Encodes the peptide sequence at SEQ ID NO. 10311
actctccctcactctactctttccatccatgcgcgagaggcaggtcggcagcagagcgagagcgcgtgccatcccatggcgagcaccaacatggcgtccgccacctcgcggttcatgctggccgcgggcgtgcccgcggggggcagcggccgcgtcggcttcgcgtcggtgcccggcaagccgcagggcaggaggctcgaggtgcgcgccgaggaggaggccgccgcggcggccgaaccggcgccggaaggggagggcgccgtggccaccaagcctaaggacgagaagccgccgccgatcgggcccaagaggggcgccaaggtcaagatcctgaggagggagtcctactggtacaacgggattggcaacgtcgtcacagttgatcaggaccccaacacccgctacccggtggtggtgcggttcaactaggtgaactactccggcgtatccaccaacaactacgccttggacgagatccaggaggtgaaatgaacagcgaggctggctggatggctgtgaaatgagggtcacaacatctagtgtgtaatatcttaatctctgtaatcattatagtaattgcttgctgtgcttcaccgtggacacaataatctcctgctcttaagttgttataaaaaaaaaaaaagaaatactttgtggggggcccggaactcgactccgcccatgtttatagca

SEQ ID NO: 10311 - protein, 117 aa, Panicum virgatum
  misc_feature: Ceres CLONE 1722368
  misc_feature (77)..(117): Pfam Name: PSI_PsaE Pfam Description: Photosystem I reaction centre subunit IV / PsaE
MASTNMASATSRFMLAAGVPAGGSGRVGFASVPGKPQGRRLEVRAEEEAAAAAEPAPEGEGAVATKPKDEKPPPIGPKRGAKVKILRRESYWYNGIGNVVTVDQDPNTRYPVVVRFN

SEQ ID NO: 10312 - DNA, 671 bp, Panicum virgatum
  misc_feature: Ceres CLONE 1722368-R
gccccgggaggcgagcacgggcgattcccaatctccgaaacaagagaaggcgccgttcgggtacatgaggaaggacgtgctgctgatgggcgccggcgtcacggccttcggcgtcggactcaagtacgggctggagctcgtcggcgtcgaccccctgcaggccggcaacgtggtgcagctgctggtggtgctcgggatgacggtggggtggatctccacctacatgttccgggtggccaacaaggacatgacctacgcgcagcagctcagggactacgagaagcaagtcatggagaaacggctggagagcttgccggaggctgagctgcaagcactgctggagcaagtggaggaagagaagcagcgcctaccgcagatcccggaagagcctaacgccatcacgttcaagaagaaataaagagcacgtgccatactccgtgccagacggtcaagtggacgccgttcatgtttatagcaaagcttcaggagctagctccatcgatccgctcagatctgtacatcacgcccactaggccactagtgcggtcaaacgtgaaatcgttcatttcggtcctcgcggaagaacagcaatatgcaacaataaccagtatccaatgattcaagatatatacagaagatgtccgcagtaactaccgcgatgtagcaagctt

SEQ ID NO: 10313 - DNA, 777 bp, Panicum virgatum
  misc_feature: Ceres CLONE 1722369
  misc_feature: Encodes the peptide sequence at SEQ ID NO. 10314
gcaccactcaagctgagctcggttcggttgtagcctgtagcttagctaggtccccgcgcgcgccatggcgaagaaccaccaccgcattgtgacgctcctgctcttcgcggccacgctgctggtcgcgcagctcgcgccggccgtggcctgcccgtcctgcccggcgcctaagccgccgccgcccccgcccccgacgcccgtgccgtgcccgccgccgccgtcgtccgcgccgccgtccacgccgaagggcaagtgccccctgaacacgctcaagctgctggcgtgcgtggacgcgctcaacgggctggtgcacgccgtggtcagcgccaaggccagcgagaagtgctgcccgctgctgcaaggcgtggccgacctcgacgccgcgctctgcctctgcaccaccatcaaggccaaggcgctcagcatcaacctcgtgctccccatcgccatcgaagtgctcgtcaacgagtgccacaagaacgtgcccgccagcttccagtgcccgtaatcaaactcaactcagcttccatgcatgctgggttaaggttatatggtatttgattgatgataaaccagtcaagcatttacatgcatatatataatttgtttttataattgtgtatcaatattgtaacatgaaccagtgtgagagttgtggccttggggcttgtagtgactaaaaagatttatatatgaataaagcgtgtgtgtcatatatatacgaagtttacggtgtaaagttcacgaaaatttgttacagtaataatttttgtaccg

SEQ ID NO: 10314 - protein, 147 aa, Panicum virgatum
  misc_feature: Ceres CLONE 1722369
  misc_feature (64)..(146): Pfam Name: Tryp_alpha_amyl Pfam Description: Protease inhibitor/seed storage/LTP family
  misc_feature: Functional homolog of the protein sequence given in SEQ ID NO 50191
  misc_feature: Useful for making plants with modulated salt sensitivity
MAKNHHRIVTLLLFAATLLVAQLAPAVACPSCPAPKPPPPPPPTPVPCPPPPSSAPPSTPKGKCPLNTLKLLACVDALNGLVHAVVSAKASEKCCPLLQGVADLDAALCLCTTIKAKALSINLVLPIAIEVLVNECHKNVPASFQCP

SEQ ID NO: 10315 - DNA, 887 bp, Panicum virgatum
  misc_feature: Ceres CLONE 1722379
  misc_feature: Encodes the peptide sequence at SEQ ID NO. 10316
atttttgcaggaaggaagagctgctagctccttgtgtgtgggagataggaagagggtcgagatggctacggcgtacgctcccatggcgagccaggtgatgaagagcagcttgatgcactccaggccgagaggcctctctggcgctgcgctgacgaggcggccccgcttcaccgtgaaggccatccagcccgagaagccaacgtaccaggtggtgcagcccatcaacggcgaccccttcatcggcagcctggagacgcccgtcacctccagcccgctcgtcgcctggtacctctccaacctcccggcctaccgcaccgccgtgagcccgctgctccgtggcatcgaggtcggcctcgcgcacggctacctcctcgtcggccccttcgccctcaccggcccgctccgcaacacgcccgtgcacggccaggccggcgccctgggcgccgccgggctcgtcaccatcctcagcgtctgcctcaccatgtacggcgtcgcctcgttcaacgagggggacccgtccacggcgcccacgctcacgctcacgggacgcaagaaggaggccgacaagctgcagaccgctgacgggtgggccaagttcaccggaggcttcttcttcggcggcatctccggcgtgctctgggcctacttcctcctctacgtgctcgacctcccctactacttcaagtagacgggatccataagcaaattccctcctctctacgtgtgggtaggtgatgtgtttgtggttcttgattgagcagtgagcacatgtataaatgtattactttctctggacatgcatgggtggatggatgggttgtaacttggaacggttaatttcttacttggatggagttaattacttgggtgaatgagaatgctttcag

SEQ ID NO: 10316 - protein, 208 aa, Panicum virgatum
  misc_feature: Ceres CLONE 1722379
  misc_feature (48)..(206): Pfam Name: PsaL Pfam Description: Photosystem I reaction centre subunit XI
MATAYAPMASQVMKSSLMHSRPRGLSGAALTRRPRFTVKAIQPEKPTYQVVQPINGDPFIGSLETPVTSSPLVAWYLSNLPAYRTAVSPLLRGIEVGLAHGYLLVGPFALTGPLRNTPVHGQAGALGAAGLVTILSVCLTMYGVASFNEGDPSTAPTLTLTGRKKEADKLQTADGWAKFTGGFFFGGISGVLWAYFLLYVLDLPYYFK

SEQ ID NO: 10317 - DNA, 1282 bp, Panicum virgatum
  misc_feature: Ceres CLONE 1723968
  misc_feature: Encodes the peptide sequence at SEQ ID NO. 10318
agaagaaccaatccatccccgctctccccaccgaaacgtccgcagccatggcgacgaggacgctggagctgacgctgatctcggccaaggatctcaaggaggtgaacctgctctccaagatggaggtctacgccgtcgtctccctctccggcgacccccgctcgcggcagcggatccaggccgaccgcaccggcggccgcaaccccacctggaacgccacgctccgattcaacgtcccggccggcggcgccggatccctccacgtcctcctccgcgccgagcgcgccctcggcgaccgcgacgtcggcgaggtccacatcccgctctccgagctcctctccggcgcccccgacggccccgtccccgccaagttcgtcgcctaccaggtccgcaagatctcctccggcaagccacagggagtcctcaacttctcctacaagctcggcgaggtcacccaatcggccgccggctacgcccccgcccccgcccagtccgcctacacccagcctccctccgcctacccgccggcaggcaaggccgacgcgtacccgcctccctccgcctacccgcctgcagccaaggccgacgcgtacccgcctcccaccgcctacccgccggcggccaaggccgacgcgtaccctcctcccaccgcctatccacccgccggcaagaccgacgcgccagcgaccgcttacccgcccccatccggctacccgccagcctcgggcaagccggctaaggccggcgagccggtgactgcgtaccctgccgctggccccagcaccgcggcgccctacgccgcttctcagccgcagtacgggtacggttacccaccgcagcagcccgccgggtacgggtaccctcccccgccgccgcaagccggctacgggttcggtgggtacccgccgcaggccgggtacgggtaccagcagcaggccgtgaagccgcagaagaagaagaacaacttcgggatggggctcggggccgggctgctcggaggcgccgtcggcgggctcctgatcggcgatatgatgtcggacgcgtcggcgtacgatgccgggttcgacgacggcggcggcttcgacggtggcttcgatttctagagccttctggcttgatgctacagcagaggcctctgttttgcattcgactttgtgatgtgtttcgtttgtagtactacctaattgtctcaggaccaaatcaaattatgcatcttgcctgatgcgatggtaatgtaaatatgatgctgcagagacagtatatgtattgcaatttcgttttt

SEQ ID NO: 10318 - protein, 351 aa, Panicum virgatum
  misc_feature: Ceres CLONE 1723968
  misc_feature (6)..(90): Pfam Name: C2 Pfam Description: C2 domain
MATRTLELTLISAKDLKEVNLLSKMEVYAVVSLSGDPRSRQRIQADRTGGRNPTWNATLRFNVPAGGAGSLHVLLRAERALGDRDVGEVHIPLSELLSGAPDGPVPAKFVAYQVRKISSGKPQGVLNFSYKLGEVTQSAAGYAPAPAQSAYTQPPSAYPPAGKADAYPPPSAYPPAAKADAYPPPTAYPPAAKADAYPPPTAYPPAGKTDAPATAYPPPSGYPPASGKPAKAGEPVTAYPAAGPSTAAPYAASQPQYGYGYPPQQPAGYGYPPPPPQAGYGFGGYPPQAGYGYQQQAVKPQKKKNNFGMGLGAGLLGGAVGGLLIGDMMSDASAYDAGFDDGGGFDGGFDF

SEQ ID NO: 10319 - DNA, 947 bp, Panicum virgatum
  misc_feature: Ceres CLONE 1723974
  misc_feature: Encodes the peptide sequence at SEQ ID NO. 10320
agggactggaaaccctacccttgcctctcatctcctccttaccgccgccattctgcgctgcgcctccacgctctcccgctgctctcaccaccgtctcgcgcgaagctgctgagctcaagctagagaagatgtttactgcaaggaggaagatccagaaggacaagggtgtggagccaactgagtttgaggacacaattgcccaggcattctttgacctcgagattgggaatcaggagcttaagagtgacttgaaggacctttacatcaatggagcagtgcagatggatgtgcctggcaacaggaaggctgttatcatccatgttccatacaggctacaaaagtcttacaagaagattcatgtgaggcttattcgggagcttgagaagaagttcagtgggaaggatgttgttctggttgcaactagaagaattgtgcggtccccaaagaagggttcagctgttgtccgtccccgtagccgcactcttactgctgttcatgatggcattttggaagacgttgtgtatccagctgagattgttgggaagcgtattaggtaccacttggacggtgcaaaagtcttgaaggtcttccttgatccaaaggagcgtaccaacactgagtataagcttgacactttcagctcagtctaccggaggctttgtgggaaggaggttgtgtttgactaccccatggctgagagcgcttgagcccccttgtcctttagtcagctggctattacaatatgtttcgtctatctgaaacagatttcattaccatatatttcatgcgggaaatagtgttcaacatcctgaaacatgccaatctcgtttcttctgtcttggattctgcaaatgttttgcaatgcagtgcatgatatatctgctgataaaagaaggaattgacatttgcgggactagagtatcagttcgtaatttttccccctgcct

SEQ ID NO: 10320 - protein, 192 aa, Panicum virgatum
  misc_feature: Ceres CLONE 1723974
  misc_feature (6)..(191): Pfam Name: Ribosomal_S7e Pfam Description: Ribosomal protein S7e
  misc_feature: Functional homolog of the protein sequence given in SEQ ID NO 50192
  misc_feature: Useful for making plants with modulated biomass
MFTARRKIQKDKGVEPTEFEDTIAQAFFDLEIGNQELKSDLKDLYINGAVQMDVPGNRKAVIIHVPYRLQKSYKKIHVRLIRELEKKFSGKDVVLVATRRIVRSPKKGSAVVRPRSRTLTAVHDGILEDVVYPAEIVGKRIRYHLDGAKVLKVFLDPKERTNTEYKLDTFSSVYRRLCGKEVVFDYPMAESA

SEQ ID NO: 10321 - DNA, 1008 bp, Panicum virgatum
  misc_feature: Ceres CLONE 1723983
  misc_feature: Encodes the peptide sequence at SEQ ID NO. 10322
aaggtagcaaacactacttagggttctctctctctagcatcttctctctctgcccccctagcgcgcggagcacgagcccttggtagatcccgatggcctcgcgacggcgcacgctcctcaaggtcatcatcctcggcgacagcggggtcgggaagacttcgctgatgaaccaatatgtgaacaagaagttcagcaatcagtacaaggctacgatcggcgccgatttcctcaccaaggaggtccagttcgaggacaggctcttcactcttcagatatgggatactgctggacaggaaaggtttcagagtcttggtgttgcattctatcgtggagctgattgttgtgttctagtttatgatgttaactctatgaagtcatttgataatctgaacaactggcgtgaagaatttctaattcaggctagcccatctgatcccgataacttcccttttgttctgcttggaaacaaagttgatattgatggtggcaacagccgtgtggtctctgagaaaaaggcaaaggcttggtgtgcctcaaaaggcaacataccttactttgagacatctgcaaaagaaggaactaatgtggaagatgcttttcaatgcatggtaaaaaatgccctaaagaatgaacctgaagaagaattgtacgtgcctgacactgtcgatgtggtgggtggcaatcggacccaaaggtcatcaggctgctgttagttgatggtcttcggaggccacatcaattattcaatatccagtccttagctcctgtataatgtcatggttctgtatttcatttgtgaccttaatcgatcaccccttatgtatgaaatcaagaattcatgcatctgttctcgaattgtcacattacttgctgtgcagtttatcagtgtatttatcatgcatgtgaatacactgcgaataatattgttacataccagtctgggcagtttatcagtgtatttgtcttgtgaatacactatggttaatattgccaaataacagttttctg

SEQ ID NO: 10322 - protein, 206 aa, Panicum virgatum
  misc_feature: Ceres CLONE 1723983
  misc_feature (10)..(178): Pfam Name: Ras Pfam Description: Ras family
  misc_feature (10)..(128): Pfam Name: Miro Pfam Description: Miro-like protein
  misc_feature: SWISSPROT Homolog: EC 2.7.11.1 Non-specific serine/threonine protein kinase
  misc_feature: Functional homolog of the protein sequence given in SEQ ID NO 50193
  misc_feature: Useful for making plants with modulated water use efficiency
MASRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLNNWREEFLIQASPSDPDNFPFVLLGNKVDIDGGNSRVVSEKKAKAWCASKGNIPYFETSAKEGTNVEDAFQCMVKNALKNEPEEELYVPDTVDVVGGNRTQRSSGCC

SEQ ID NO: 10323 - DNA, 1347 bp, Panicum virgatum
  misc_feature: Ceres CLONE 1723986
  misc_feature: Encodes the peptide sequence at SEQ ID NO. 10324
acagtcacagcactgctctgcgctgctcaggtcagaacacgcagaggcgcggcaacagagaggaaagctcgtgtgccgagcaagaagacacgaaggagttgaaaggcgaacgagttcgagagggagccggccgggcaacaatggctctgctcccgctcttcctctcgctcctcctcgtgtcctgcgcggcgcagtcgccggcctcgtcgccgtccgcgtccaaggctcctccggtcagcgcctcggcgccacaggcctccgtcgcgccaccgaccacggcagcctcggcgccgcaggcctccgtcgcgccaccgacaacggcagcctcggcgccgcagttctcgatcgcgccaccgacaaaggcagcctccgcgccgcgggcctctgccgcaccaccgacaacggcagcctcagcgccaaaggcctcagcgcaaccaccagcaacagtatccgcgtcggcgccgcaggcatcggcgcagccgccaacaacggtagccgtgtcggctccgaaggcctctgccgcgccgccaaccacagccgcctccccaccgccgaccaccgctgccttgccgcctcaggtctccgccgcacctaccaccgccacctcgccgccactagcctccgccgcaccgccgaccacggccgcctcgccgcagctggctgccacgtcaccccccgttgccactccgccactactagccgccgccgcgcctcctgtctctgcgacccctccagccaccttacctccgctcgcatcgccacctgcggccacggcgcctaccgtggccgcgccagcacccgcgatgccggctccagtggcctccccgcccctggcaatgccaccggcggcgcttcctccgtccaccctccctccagcaatggcgccgacgcctcttctcgctgccccgataatgccgccgacctccacgcccgtcacggctcccgttccagcccccgtgtcgccggctccgagcgtcgccccgacaccgtcacccacagaggccccgaccccgtcgccggctctggcgccggagctggcgcccgcgctagcaccttcgctggcgccgctcagctcggtgtcggtgagcccgtcgctggcgccgggtcccgcgctcgctacggaggacgagtcggcggcgccgagcgcgcgcaccgttggcggcgccgcgctggcggccttggcggccgccgggctcgtggtcttgttctaagtagagctgcgtttaccgtcgcttccgtactgctcgtcgcacgatctcgttctcttgttcgcgttttatggttgcatgtatgattcttgctgtaaaacacattgataatttatttctatttacgcatggatgatgg

SEQ ID NO: 10324 - protein, 356 aa, Panicum virgatum
  misc_feature: Ceres CLONE 1723986
  misc_feature: Functional homolog of the protein sequence given in SEQ ID NO 50194
  misc_feature: Useful for making plants with altered cell wall content and/or composition
MALLPLFLSLLLVSCAAQSPASSPSASKAPPVSASAPQASVAPPTTAASAPQASVAPPTTAASAPQFSIAPPTKAASAPRASAAPPTTAASAPKASAQPPATVSASAPQASAQPPTTVAVSAPKASAAPPTTAASPPPTTAALPPQVSAAPTTATSPPLASAAPPTTAASPQLAATSPPVATPPLLAAAAPPVSATPPATLPPLASPPAATAPTVAAPAPAMPAPVASPPLAMPPAALPPSTLPPAMAPTPLLAAPIMPPTSTPVTAPVPAPVSPAPSVAPTPSPTEAPTPSPALAPELAPALAPSLAPLSSVSVSPSLAPGPALATEDESAAPSARTVGGAALAALAAAGLVVLF

SEQ ID NO: 10325 - DNA, 1307 bp, Panicum virgatum
  misc_feature: Ceres CLONE 1723994
  misc_feature: Encodes the peptide sequence at SEQ ID NO. 10326
ttttccctctcggcacggccctgcccctccctcctcctcccgtcccacccccacccgcgcccgtcaaagcgagtggccgtatcaccggcctttcctcgcgtccccctccgatccgcgccccaaagataccttttttccccccgcgccgccgttttgctgcgaccatggcggcggagggggaggccaagaacccgtcgggcggcggcggaggaggaggggataacccccaggtagaggctgcgccgtcggcgccggcgccggccgagggggaggcggtggtggcggcggcgcaagggacggggcaagggccggagggggagaaggcggatcgagagggggagaaggacgacagagcgtgcagagatctggtcctggtcgaggatccggaggtggtcgccgtggaggatccggaggaagctgcagcaacagcagcacttcaggaagaaatgaaagcgcttgtggcatcgatccctgatggtgctggtgcagcattcacagcgatgcaacttcaggagctagagcagcagtcccgggtatatcaatacatggctgcccgagtacctgtgcctactcatctcgtctttccaatatggaagagtgtaactggtgcatcctctgaaggtgcccagaagtaccctaccttgatgggcttggcaacactgtgcttggactttgggaagaaccccgagccggaacctgggagatgccggcgaacagatggtaaaaagtggcgatgctggagaagtactatcccaaacgaaaaatactgtgagcgtcatatgcatcgtggtcgcaagcgtcctgtacagcttgttgtcgaggacgacgagcctgattctgcatcaggatcaaaatccactcctggcaaggctaccgaaggtgccaagaaggctgatgacaagagcccaagtaacaagaaacttgcagtggcagcacctgctgctgtgcagtctacataattgatgcagcattagtagtcgcagaaagagcataacagcactggcaactagcgcccgcttcttattgcatgtaatccccaaaagactgtagtgtggtcttagctataacctcattaagcaagcacagtgtctgtgcgaggaagatgcaagaacttcccttagctgttactgaaaatttcactcttaggtgtatagtttgatttagcgttgtcgtgccttcggccttcaggtaggcgatgcggcatgatctgataaatcctccttgaactgacaatatcgcattgtgacccaagaagccgatggaagaacttgggagactggatactgtgctttttgatgtttaccttt

SEQ ID NO: 10326 - protein, 264 aa, Panicum virgatum
  misc_feature: Ceres CLONE 1723994
  misc_feature (175)..(220): Pfam Name: WRC Pfam Description: WRC
  misc_feature (108)..(144): Pfam Name: QLQ Pfam Description: QLQ
MAAEGEAKNPSGGGGGGGDNPQVEAAPSAPAPAEGEAVVAAAQGTGQGPEGEKADREGEKDDRACRDLVLVEDPEVVAVEDPEEAAATAALQEEMKALVASIPDGAGAAFTAMQLQELEQQSRVYQYMAARVPVPTHLVFPIWKSVTGASSEGAQKYPTLMGLATLCLDFGKNPEPEPGRCRRTDGKKWRCWRSTIPNEKYCERHMHRGRKRPVQLVVEDDEPDSASGSKSTPGKATEGAKKADDKSPSNKKLAVAAPAAVQST

SEQ ID NO: 10327 - DNA, 1306 bp, Panicum virgatum
  misc_feature: Ceres CLONE 1723995
  misc_feature: Encodes the peptide sequence at SEQ ID NO. 10328
aaagcacaagcacacaaacggccgccgcagcaacgacacacacaaccttccaactccgtcgaggagcgacacggcccgccgcagatccgtggtcgccgccagggttcaggcgagatggacgtggtgaaggcggcgcagctgtcgggccggacgctggagaaggtggttgtgcaccccctggtgctgctcagcatcgtcgaccactacaaccgcgtcgcccgcgacacccgcaagcgcgtcgtcggcgtcctcctcggcacctcctcccgcggctccgtcgacgtcaccaactcctacgccgtgccgttcgaggaggatgacaaggatcctaggatctggttccttgaccacaattatcacgagtcaatgttctccatgttcaagaggattaacgccaaggagcatgttgttggctggtacagcactggtccaaaattgagggagaacgacttggatgtccatgccttgttcaacagttatgttcctaatcctgtcctggtgattatcgatgtgcaacccaaggagttggggatacccactaaggcgtactacgctgtggaagaggttaaagagaatgctactcaaaaaagtcagaaggtgtttgtccatgttccttcaaaaattgctgctcatgaagttgaggaaattggagttgagcaccttctaagggatgtaaaggacacgacaataagcacacttgcaacagaggtcactagcaagcttgcagccttgaaaggactggatgcaaggctaagggagatcagaagctatttggaccttgtaattgaagggaagctcccattgaatcatgagattctgtatcatttgcaggatgtatttaacttgcttccaaatctgaacgtaaatgagctgatcaaagcctttgcagtgaaaacaaatgacatgatgttggtgatatacctgtcttctcttatcaggagtgtcattgcactccacaacttgattaacaacaagatgctaaacaaggagcacgagaaggctgaggattcaaaaccaactgccattccgactgctgccgggagctaaatggccccagaaaagggatgaaacgtgtggcatcttagcacggttgcgcttgaaccaattgtcttgaccttgaatggacattttgatgtttatttcatgtatgataaggtcaatggcaagagaaaccaattacattgtatgagctttagatcatacctcagtttttccgtagatctcgatgcaatttcatttgaagcatcatgtttcgtgatgtagactttcgtttcttatgattttgatctatagcaacctgtacgtc

SEQ ID NO: 10328 - protein, 310 aa, Panicum virgatum
  misc_feature: Ceres CLONE 1723995
  misc_feature (12)..(125): Pfam Name: Mov34 Pfam Description: Mov34/MPN/PAD-1 family
MDVVKAAQLSGRTLEKVVVHPLVLLSIVDHYNRVARDTRKRVVGVLLGTSSRGSVDVTNSYAVPFEEDDKDPRIWFLDHNYHESMFSMFKRINAKEHVVGWYSTGPKLRENDLDVHALFNSYVPNPVLVIIDVQPKELGIPTKAYYAVEEVKENATQKSQKVFVHVPSKIAAHEVEEIGVEHLLRDVKDTTISTLATEVTSKLAALKGLDARLREIRSYLDLVIEGKLPLNHEILYHLQDVFNLLPNLNVNELIKAFAVKTNDMMLVIYLSSLIRSVIALHNLINNKMLNKEHEKAEDSKPTAIPTAAGS

SEQ ID NO: 10329 - DNA, 1219 bp, Panicum virgatum
  misc_feature: Ceres CLONE 1724003
  misc_feature: Encodes the peptide sequence at SEQ ID NO. 10330
cgccaacgatggccctggagacgtgcttcagagcgtgggcgctgcacgccgcccccgccggcggcaaggacaggctcgccgtcggcagcagcttcgcgccgtccaagcgggccgccgccgcgccgctgtccgtcggccgcgtcgccacgcggcggccgcggcacgtctgccagtccaagaacgccgtcgacgaagtgctggtggcggacgagaagaactgggacgggatggtgatggcgtgcgagacgccggtgctggtggagttctgggcgccgtggtgcgggccgtgccggatgatcgcgccggtgatcgacgagctggccaaggactacgccggccagatcaagtgctgcaaggtgaacacggacgactgccccaacgtggcctccacctacggcatccgcagcatccccaccgtgctcatcttcaagggcggcgagaagaaggagagcgtcatcggcgccgtgcccaagaccacgctcaccaccatcgtcgacaagtacatcggcagctcgtgagccagacaactataaatacatacgtgtccgtgctcgcgcgtacacaccatgtatgtgtatctcttgtttcgtagcaaggatgatgatgcgataaaaaaaaaatctctggctctgggggaggggaaagtgtcggctagggtttcgtccgatccgactccaaggaccaaggcagaggcagagccggcgcggcgcggcgcggcgatgaacaactccgcctcgccggcggtggactggggggaccactccgcgggggagatggactccgaggacaccgctgccgccgcctccatgggcatggtcggcatcgccagcatgatggaggtcgacgccgacgaccgccacccaccgtctgccgccccatccctccccatcgacgccgacttcttcaacgccttccaagacgacttcgacgaccaagacctcgactgaccgaccgaccgtagctcaatcagaggcagaggcagagttgtatatgaacctaccacaccaacatataacacatggacatgtcgtctcgctgccgaggaagcacaagtcaacgatcaccttctagtgctgtgttgtcagcttatgtttgtataccattcggattttctatacctgccctggttactgccagccgtatgtacgagaataagaatatgtgtctgttgttgtgtggtacccaagttaatgcaaatgttcttgttgttgggtggatc

SEQ ID NO: 10330 - protein, 169 aa, Panicum virgatum
  misc_feature: Ceres CLONE 1724003
  misc_feature (62)..(165): Pfam Name: Thioredoxin Pfam Description: Thioredoxin
  misc_feature: SWISSPROT Homolog: EC 1.8.1.8 Protein-disulfide reductase
MALETCFRAWALHAAPAGGKDRLAVGSSFAPSKRAAAAPLSVGRVATRRPRHVCQSKNAVDEVLVADEKNWDGMVMACETPVLVEFWAPWCGPCRMIAPVIDELAKDYAGQIKCCKVNTDDCPNVASTYGIRSIPTVLIFKGGEKKESVIGAVPKTTLTTIVDKYIGSS

SEQ ID NO: 10331 - DNA, 1107 bp, Panicum virgatum
  misc_feature: Ceres CLONE 1724010
  misc_feature: Encodes the peptide sequence at SEQ ID NO. 10332
agcacgagagagaaatctacagggtatagctcgtcgggcatggcggccgccgtggcgctgacgccggcctttcctgcgctcctccccttcttcggcggccgccgcgatggccgggtgcgcctctccccccgccgcccccgcccccgctactcagggagctgcagggccatggcgcagaccttccagggggggccagccgccagctacgcccgcgagatggagcgcctctccgccaaggagtcgctcctcctagcctttaaagatgctgggggattcgaggccttggttaacggtaagaccacagagatgcagaggatcgatgtcaacgagcggattgttggacttgaacgtctgaaccccacaccacgccccacaacatcgcccttcctggaaggtcgatggaactttgaatggtttggtgacagcagtcctggagcatttgcagcccggcttttgtttgagagatcacctacaactgttgcacactttatgggacttgacgtgttgatcaaggatggatacaccaaactctcatctaacctcaagttcttaaatacgatacaaagcaaattccttcttaccacaaaattatccgtcgagggccctgtcaggatgaaagaggaatatgttgagggccttatagagattcccaaaattagcgaagaaacattgcctgagcaattaaagggcttgcttgggcagactgcaggagctctgcaacaactgcctacccctataagggatgctgtttcagaggggcttaaattgccacttagtggaacgttccagcgcttattcatgatctcttacttggatgaagaaatactgattatcagagatgctgctggagcacctgatgtcttaaccagactggagggcccacaaccaaatccagttgatggcgcaacagatgcagtgatatcagaatatgaaagctaatgcctcagcactaaccgatctgcatccatagctcttgtttatggtttctttcttcttcttttttggttattttctgtcttgcatatacaagctctagtgcacgttgacgaacatttgaatattctttactcacgttcctttcagctattctaagtgcaatcaacctct

SEQ ID NO: 10332 - protein, 299 aa, Panicum virgatum
  misc_feature: Ceres CLONE 1724010
  misc_feature (63)..(276): Pfam Name: PAP_fibrillin Pfam Description: PAP_fibrillin
MAAAVALTPAFPALLPFFGGRRDGRVRLSPRRPRPRYSGSCRAMAQTFQGGPAASYAREMERLSAKESLLLAFKDAGGFEALVNGKTTEMQRIDVNERIVGLERLNPTPRPTTSPFLEGRWNFEWFGDSSPGAFAARLLFERSPTTVAHFMGLDVLIKDGYTKLSSNLKFLNTIQSKFLLTTKLSVEGPVRMKEEYVEGLIEIPKISEETLPEQLKGLLGQTAGALQQLPTPIRDAVSEGLKLPLSGTFQRLFMISYLDEEILIIRDAAGAPDVLTRLEGPQPNPVDGATDAVISEYES

SEQ ID NO: 10333 - DNA, 1584 bp, Panicum virgatum
  misc_feature: Ceres CLONE 1724018
  misc_feature: Encodes the peptide sequence at SEQ ID NO. 10334
gtctcaatctcaactccaaaacctcgcaacaaagcccgtgagcgaccaacccccaccccccatccatcctctccttcctcgcagatcccaccaaccccggcggcgatgaccggcacagtgtccaagctggcggcgccccggccggcggcggcgctgctcccgccggcgtccctccgctccgccgccctcgccttcgccccctccccgcgccggttccgcgtctccatcgccggccgcgccaggagccccgtcattgcgatggcttctgccaaggaagggaatggtgctccgaccaagaagaccgcacttcacgatctctatgagctccagggcctgtcaccatggtacgacaacctctgcaggcctgtcactgacttgctgccccttatcgccagtggtgttcgcggagtcaccagcaaccctacgattttccagaaagccatttcatcatcaagcgcatatgatgatcaattcaagcagctcattacagctggaaaggatgcagagagtgcttactgggaactcgttataaaggatatccaagatgcgtgcaaactttttgagcctatctacaacgagacagatggtgctgatgggtatgtctctgtggaggtgtctcctaggttggcaaatgacactcaaggaacagttgaggctgcaaagtggttgcacaaagtggtcaaccgccccaatgtctacataaagatccctgctactgcagaatgtgttccttctatccgggaagtcatctctgatggcattagcgtcaacgtcacacttattttctctattgtaagatatgaggctgtgattgatgcttaccttgatgggctggaggcatcgggtttgagtgacttatctcgagttaccagtgttgcgtccttctttgtcagccgagttgacacccttgttgacaaaatgctcgaaaagattggaacacctgaggcgcttgcccttagaggaaaggctgctgtagcacaggcaaaattagcaaatcagctctaccagaagaaattctctggcccaagatgggaagctttggctaagaaaggtgccaagaaacagaggttgttgtgggcatcaactggcgtcaagaaccctgcttatcctgacaccctttatgtggacagtctgattggacctgacacggtcaacacgatgcccgaccaagcgttgcatgcattcatagaccacggcactgtttcaaggacagttgatgcgaatgtgtcggaggcagaaggtgtatacagtgccctggagaagcttggcatcgactgggatgaggtggggaagcagcttgagctggaaggagtagactcgttcaagaagagctttgacagcctacttgtgagtcttcaggagaagggcaacagcctcaagacggcaagtgtgtaaaactgaaatgttttggtacctgcaggtgaacgattactaaataaaatgctagctcgctggctctcctcttagttttgtgactgtgcgggtgctcttgattctgtgaatcagctttgtattctagtcttgcctggcttgtgtaacgaggcttgtaactgctatgcgctatccaataaataatttttgagc

SEQ ID NO: 10334 - protein, 429 aa, Panicum virgatum
  misc_feature: Ceres CLONE 1724018
  misc_feature (78)..(417): Pfam Name: Transaldolase Pfam Description: Transaldolase
  misc_feature: SWISSPROT Homolog: EC 2.2.1.2 Transaldolase
MTGTVSKLAAPRPAAALLPPASLRSAALAFAPSPRRFRVSIAGRARSPVIAMASAKEGNGAPTKKTALHDLYELQGLSPWYDNLCRPVTDLLPLIASGVRGVTSNPTIFQKAISSSSAYDDQFKQLITAGKDAESAYWELVIKDIQDACKLFEPIYNETDGADGYVSVEVSPRLANDTQGTVEAAKWLHKVVNRPNVYIKIPATAECVPSIREVISDGISVNVTLIFSIVRYEAVIDAYLDGLEASGLSDLSRVTSVASFFVSRVDTLVDKMLEKIGTPEALALRGKAAVAQAKLANQLYQKKFSGPRWEALAKKGAKKQRLLWASTGVKNPAYPDTLYVDSLIGPDTVNTMPDQALHAFIDHGTVSRTVDANVSEAEGVYSALEKLGIDWDEVGKQLELEGVDSFKKSFDSLLVSLQEKGNSLKTASV

SEQ ID NO: 10335 - DNA, 1328 bp, Panicum virgatum
  misc_feature: Ceres CLONE 1724022
  misc_feature: Encodes the peptide sequence at SEQ ID NO. 10336
agaagctgagccagggtagcgagccgaggagggcacgcggcgatggcggcggcagcggccgtggcgaccgtgtcctccccatcccccgcctccaggcggctgctcccctcgtcctcctcctccgcggtcccgtccctcctccggctcccgcggccgggcaggcggcaccggcgcgcgctgcggatcgtctcggcggcggggggcgaggcggacgtgctgccggggccgggggccgaggcggaggcagcggtgccggggaggcttgaggagccgctgggggggagccagctcgacatcggcgggctcgccttccagggcgacgtgggcgggggcttcgccagcggcggcggcggggcgggctccggggcctccggcggcggggacgggaacaagacgctggaccgcgggatcaacacggccatcgtgctcggggccagcacctacgcgctcaccaagctcctcaccgtcgaccaggactactggcatgggtggacgatctttgagatcctccggtacatgcccgagcacaactggtcggcatacgaggaggctctccaggccaacccggttctggccaagatgatgatcagtggcgtagtctactccctcggtgattggatcgcgcagtgctacgaaggcaagccaatctttgatttcgaccgtgctcggatgttccgatctgggcttgttgggttcactcttcatgggtcactttctcattactattaccatatctgtgaggcactgttcccattcaaggattggtgggttgtccctgcaaaggttgcattcgatcagacgatctggtctgcaatttggaacagcatctactttgtggtcttgggttttcttcggttggaatcacctaccactatctacaaagagctcaagtccacattctggcccatgcttacggctgggtggaagttatggccttttgcgcacttgattacatatggtgtgattcctgttgagcaaaggcttctatgggttgactgtgtggagctagtctgggtcacgatactgtcaacatactcaaatgagaagtcggaggcaaggaattccgatggtacgtccacaccagatacttcgaaggacaactctagatagcaactagagacaccatggaagcagctttgccgttacatcgtttcagggttgatgtaaattgtacaagttctgctgcagcagctctgcaggtgtaaccattttcgttcttttatggatatacatgaaacacaaattgtgcagcatgtgccatagacaattagaaagaaattagcttgttccagaactgcagatgaaattgagttggacggaaatgcagt

SEQ ID NO: 10336 - protein, 355 aa, Panicum virgatum
  misc_feature: Ceres CLONE 1724022
  misc_feature (267)..(338): Pfam Name: Mpv17_PMP22 Pfam Description: Mpv17 / PMP22 family
MAAAAAVATVSSPSPASRRLLPSSSSSAVPSLLRLPRPGRRHRRALRIVSAAGGEADVLPGPGAEAEAAVPGRLEEPLGGSQLDIGGLAFQGDVGGGFASGGGGAGSGASGGGDGNKTLDRGINTAIVLGASTYALTKLLTVDQDYWHGWTIFEILRYMPEHNWSAYEEALQANPVLAKMMISGVVYSLGDWIAQCYEGKPIFDFDRARMFRSGLVGFTLHGSLSHYYYHICEALFPFKDWWVVPAKVAFDQTIWSAIWNSIYFVVLGFLRLESPTTIYKELKSTFWPMLTAGWKLWPFAHLITYGVIPVEQRLLWVDCVELVWVTILSTYSNEKSEARNSDGTSTPDTSKDNSR

SEQ ID NO: 10337 - DNA, 1190 bp, Panicum virgatum
  misc_feature: Ceres CLONE 1724030
  misc_feature: Encodes the peptide sequence at SEQ ID NO. 10338
aaaacgggggggagccgcgccgcgccacacgtccgccgctgccgcctcacctggaccggcttctcctggcaggccttctccggcctccccagcttcttcaagctctccatcgcgtccgccgtcatgctctgcctcgagacctggtacttccagatactcgtgctcatcgccggcctgctcaaggaccccgagcttgcattgtcgtcactctctgtctgcatgacgatttcagggtgggttttcatgatctcgattgggttcaatgcagctgccagtgtccgggtgagcaacgagcttggcgccggcaaccccaagtcggcggcgttctccgtcgtggtggtgacggtgctgtccttcatcctgtcggtgctcatctcggtggtcatcctcctctgccgggactacatcagctacatcttcaccgagggcgaggacgtgtcgcaggccgtgtcccagctgacgccgctgctggcgttcaccctcatcctcaacggcatccagcccgtcctctcaggggtggctgtggggtgcggatggcaagccttcgtcgcctacgtcaatgtcggctgctactacatcgtcggcatccccctcgggtgcctcctcgggttctacttcgacctcggagcggcgggtatttggagcggcatgatcgggggcacactgatgcagaccttgatcctggtgtgggtgacattcaggaccaactgggagaaagaggtggaagaagcgcagaaaagactgaacaaatgggaagacaaatctgctcctcagttgttggagtaagctagagtggaataaatcttcctcatcgatctactgccaaccgaagaatgggacatggatgcggtcctctacgtactactggaccaacggttgaacgaagccgggaaagaactgtaaggttgcgccattcatctgctcagcgaagaaggaatttttatgcgagctccaggcgtcgaggacctcgtggccagcgattctgctgcgtcgaatgttcaatggaagtacctgttcctcttaagaaagtcagtgttaagtaccagagaattctgtagcgctcatttcgctttatttgtgttcccatctgttgtttagcgatgtgattgtgtatgaaccagtattagttttcttgtcgagctttcctcagacaaacttgttgagaaatggttatatgcgattgcttggcc

SEQ ID NO: 10338 - protein, 261 aa, Panicum virgatum
  misc_feature: Ceres CLONE 1724030
  misc_feature (38)..(201): Pfam Name: MatE Pfam Description: MatE
KTGGSRAAPHVRRCRLTWTGFSWQAFSGLPSFFKLSIASAVMLCLETWYFQILVLIAGLLKDPELALSSLSVCMTISGWVFMISIGFNAAASVRVSNELGAGNPKSAAFSVVVVTVLSFILSVLISVVILLCRDYISYIFTEGEDVSQAVSQLTPLLAFTLILNGIQPVLSGVAVGCGWQAFVAYVNVGCYYIVGIPLGCLLGFYFDLGAAGIWSGMIGGTLMQTLILVWVTFRTNWEKEVEEAQKRLNKWEDKSAPQLLE

SEQ ID NO: 10339 - DNA, 1209 bp, Panicum virgatum
  misc_feature: Ceres CLONE 1724042
  misc_feature: Encodes the peptide sequence at SEQ ID NO. 10340
accaacctcctccgtgcgcagtgtctctggaccagtcctggagtcccctcccccgtggccccgtcctgcctccgccgtctggactcctcgcgttcgccgcggcgtcaacgcggcttccttcccgcggcctctccgcctccgcctcccagatccggcgcccatggcgcggaacccgggctgcaccgtcttcataggtaacttggatgacagggttcctgagagggttctgtatgagattcttgttcaggtaggtcgagttgtagacctacacatacctcgtgacaaggaaactagtcggcaaaaaggttatgcttttgctgagtatgaatcagaggagattgcccagtatgctgttaagctattttctggccttgttcgacttcataataaaacgcttagatttgcgatctctgggcaagacaaaccctcatcaaatgccaatatgcctgtaactcctaggttaaaccctgtaccaacaccaaagcctcctcatcttatgaggtctagtgatactcccgcatcacagcaaacagtagtgaatggcaggattgcagggtatggtatctcaccaagtcattcatatgacacacattctcaagccccatcaagtgggttaccaagtggaggactaagcaatggtacgtatgagtatagtagacgtgtattgggttctgttctgaatgacgctagccgtcgaggtaccagggaaccagttccatacccatcctactagcatgttgagagccagtgacgataacttgatatgctgacggaataggccgctgaagccattgtctgttgtctcagccatctataaggttatctctgtactcaccattccatgcctgtaaatatgggttatggtggtagggcatatgcttatcttttgggttgttctgttatgctttacattgtagtgagagttgtcgctgctgaggttaggttccatctcatgccctagtgatcaaggtcttgcctccgcgaatgcgattgtacttggacttaccatgtctagttacatgaatgggtggcaaaactttgcaattgctgtttacattgaaagtcgctagctgttcctcgtgttataggagcgtgtttgtgtttaagatatgagtatttggtggattttgtttatcacccctgttgaatctgtattatgttggacatgagaaggggaaatgttgtttaaaagaaaagaaatcttccctc

SEQ ID NO: 10340 - protein, 190 aa, Panicum virgatum
  misc_feature: Ceres CLONE 1724042
  misc_feature (9)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MARNPGCTVFIGNLDDRVPERVLYEILVQVGRVVDLHIPRDKETSRQKGYAFAEYESEEIAQYAVKLFSGLVRLHNKTLRFAISGQDKPSSNANMPVTPRLNPVPTPKPPHLMRSSDTPASQQTVVNGRIAGYGISPSHSYDTHSQAPSSGLPSGGLSNGTYEYSRRVLGSVLNDASRRGTREPVPYPSY

SEQ ID NO: 10341 - DNA, 974 bp, Panicum virgatum
  misc_feature: Ceres CLONE 1724051
  misc_feature: Encodes the peptide sequence at SEQ ID NO. 10342
gagagagctcctcgctccgagtccgactccgcctcgtcgcccgccaccctcgcttctcccccatcccgatccacctcgcaaggccagcccgcgccgcactggcatggcctcctcgtcctgcctcgcctcgccggccggcgccgcggcgctgatctgccgcgcgcggcggccgaggcgccgcgtggcgtgctcggcgagcgagaagagcgccgagccggcgtggctcgcggccgggggcaggagcgccggcggccgcctcgcgtgcggcgtgctggcggcctgggccgtcgcgtccgcgtccagcccggtcattgccgcgagccagagattgcctccactctcaactgagccaaacagatgtgagcgtgcattcgtggggaacacaattggtcaggcaaatggggtgtatgacaagccccttgatctccggttttgtgattacacgaacgagaaaactaatctgaaaggcaagtctctagctgcggcgttgatgtccgatgcaaagtttgatggtgccgacatgtctgaagttgtcatgtccaaagcttatgctgttggcgcaagcttcaaaggaaccgacttcacgaatgcagtgatagaccgtgtcaatttcgagaaggctgatctcacaggggcaatcttcaagaatacagtcttgtcaggatcgaccttccatgatgctaagatggaagatgttgtgttcgaggacacaatcatcggctacattgaccttcagaagctgtgcacaaacaccagtatcagcgcagacaatagattagagctggggtgtaggtgattcagcagattccatctaatcatctgcaatcgttcatgttaatatgctggtatcgttcgatgagtgttcatgcctgtctatagagcctccatgacaagatgcgacgatttttctccatgtctatgtacaaacatctctgtgtacctcaaatatcagcagcaatgcaaccatgtttctt

SEQ ID NO: 10342 - protein, 230 aa, Panicum virgatum
  misc_feature: Ceres CLONE 1724051
  misc_feature (163)..(202): Pfam Name: Pentapeptide Pfam Description: Pentapeptide repeats (8 copies)
  misc_feature (118)..(157): Pfam Name: Pentapeptide Pfam Description: Pentapeptide repeats (8 copies)
MASSSCLASPAGAAALICRARRPRRRVACSASEKSAEPAWLAAGGRSAGGRLACGVLAAWAVASASSPVIAASQRLPPLSTEPNRCERAFVGNTIGQANGVYDKPLDLRFCDYTNEKTNLKGKSLAAALMSDAKFDGADMSEVVMSKAYAVGASFKGTDFTNAVIDRVNFEKADLTGAIFKNTVLSGSTFHDAKMEDVVFEDTIIGYIDLQKLCTNTSISADNRLELGCR

SEQ ID NO: 10343 - DNA, 1321 bp, Panicum virgatum
  misc_feature: Ceres CLONE 1724056
  misc_feature: Encodes the peptide sequence at SEQ ID NO. 10344
atccgaaagccaaagcgagtctcaccagtcaagagcgagttctagtagatctgttctgctgtttttagtttggaaagccttttagttccggcgctcatggaggacgagaggaacacccagcaccaccaggtcggcgaggccgccgatcaggtggaggtgaaggacaggggcatcctggacacccttctcggcaggaagaagcccgaggaccaggagaagaagcagcaggaggaggagctggcgaccggcatggcgaaggtcacggtggccgagcctgagaagcacgagcacaagaaggaggagcacgaggccggggagaaggagagcctcctcgccaagctgcaccgcaccagctccagctccagctcgtcgagcgacgaggaagaggaggtgatcgacgagaacggagagattgtcaagaggaagaagaagaagggcctcaaggagaagatcaaggagaagctgcctggccacaaggaccacgccgagggcgagcaccatgcggccgtgccggcccctgcgccgcccgcgcccgtggggacgacgcacgcttacaaggaggacgagcacaagccatacgtgccggcgcccgcgcccgtgggcccgcacggttacaaggaggaggagcacaggccgtacgtgccggccccagctcccccgccggcggtggagacgctcgtccaccaccacgaccacgccgtcgtcgtccagaagatcgaggacgacgccccgccggcgccggaggaggagaagaagggcctcctcgacaagatcaaggagaagctccccggcggccacaagaagccggaggacgccgccgcgcccgccgtccacgcgccggcgccggcgccgcacgccgaagacgtgggcagcccggacggcaaggagaagaagggcttgctgggcaagatcatggacaagataccggggtacaacaagggctccggcgaggaggaccacaaggccgccgccggcgagcacaagaccagctcttcttaaggtcgcccgcgcgtcgtgaccggggcccttgatcggaagcgttagtttggcgtgcgtttggtttggttctgctttactttattaagtttgtttcaagatggggattgcgcggtcaaggcccggtgtgtcgaggcccggccagtactggtagtgagagtgttgctgcttgcgttcgctctggtacgggctctagtttggttccgagtcagggtctgggaagttgttgggtttgttgaattatcagcagcagttgcgtattgtaattcggctgggctgcctgggcattatgccttaatatttattactttggtttctgcccagc

SEQ ID NO: 10344 - protein, 300 aa, Panicum virgatum
  misc_feature: Ceres CLONE 1724056
  misc_feature (42)..(295): Pfam Name: Dehydrin Pfam Description: Dehydrin
MEDERNTQHHQVGEAADQVEVKDRGILDTLLGRKKPEDQEKKQQEEELATGMAKVTVAEPEKHEHKKEEHEAGEKESLLAKLHRTSSSSSSSSDEEEEVIDENGEIVKRKKKKGLKEKIKEKLPGHKDHAEGEHHAAVPAPAPPAPVGTTHAYKEDEHKPYVPAPAPVGPHGYKEEEHRPYVPAPAPPPAVETLVHHHDHAVVVQKIEDDAPPAPEEEKKGLLDKIKEKLPGGHKKPEDAAAPAVHAPAPAPHAEDVGSPDGKEKKGLLGKIMDKIPGYNKGSGEEDHKAAAGEHKTSSS

SEQ ID NO: 10345 - DNA, 1376 bp, Panicum virgatum
  misc_feature: Ceres CLONE 1724058
  misc_feature: Encodes the peptide sequence at SEQ ID NO. 10346
actcactctccgcactacctgtccagtccagctctcgagcttccaagctcccttcccccttgcctgcctttataatcccccacaaaccacaccactgccagagacacacaccgctgcttgaagaaaccaccgaggccaagcgcgcaagggagagagggagagagagagaggccaaggagaagagatggagggcaaggaggaggacgttcgcctgggcgccaacaagttctcggagcggcagcccatcgggacggcggcgcagggcgccggggatgacaaggactacaaggagcccccgccggcgccgctgttcgagcccggggagctcaagtcctggtcgttctaccgcgcgggtatcgccgagttcgtcgccaccttcctcttcctctacatcaccatcctcaccgtcatgggcgtctccaagtccaactccaagtgcgccaccgtcggcatccagggcatcgcctggtccttcggaggaatgatcttcgcgctcgtctactgcaccgccggcatctccggagggcacatcaacccggcagtgacgttcgggctgttcttggccaggaagctgtccctgactagggccgtcttctacataatcatgcaatgcctcggtgctatctgtggagctggagtggtgaagggcttccagcagggactttacatgggcaacggtggtggtgccaacgctgtcgcccccggctacaccaagggatcaggccttggtgctgagatcattggcaccttcgtcctggtctacaccgtcttctcagccacagatgccaagaggaacgccagggactcccatgttcctatccttgccccattgccaattgggttcgcggtgttcctggtccaccttgccaccatccccattactggcactggcatcaacccagctaggagccttggcgctgccatcatctacaacagggagcacgcctggagccaccattggatcttctgggtcggccccttcattggcgctgccctggctgccatctaccaccaggtgatcatcagggccatcccgttcaagagcaggtcttaagctgccgcggcccagccgagacatgccggtccgtcgaagaaccgagcagtcctcatctctgatgtcttgtgtgcccacgcctagcatctccgtcgattcctctcgcctgtcttcaggactgctgcgctgttctgttatctgaacccagaacctgtgtattcatgtaccagctgtgtatgctttttctatcgtggagatctaagttatgagcatctgttgcaagtttccatccagctgctccgatccgtttatgtgcccggatcgaatgggcagatatcatgtgaaaatgcgagcctatctagtgaaatttccatgaaagacg

SEQ ID NO: 10346 - protein, 289 aa, Panicum virgatum
  misc_feature: Ceres CLONE 1724058
  misc_feature (47)..(276): Pfam Name: MIP Pfam Description: Major intrinsic protein
  misc_feature: Functional homolog of the protein sequence given in SEQ ID NO 50195
  misc_feature: Useful for making plants with modulated water use efficiency
  misc_feature: Functional homolog of the protein sequence given in SEQ ID NO 50196
  misc_feature: Useful for making plants with modulated drought sensitivity
  misc_feature: Functional homolog of the protein sequence given in SEQ ID NO 50197
  misc_feature: Useful for making plants with modulated cold sensitivity
MEGKEEDVRLGANKFSERQPIGTAAQGAGDDKDYKEPPPAPLFEPGELKSWSFYRAGIAEFVATFLFLYITILTVMGVSKSNSKCATVGIQGIAWSFGGMIFALVYCTAGISGGHINPAVTFGLFLARKLSLTRAVFYIIMQCLGAICGAGVVKGFQQGLYMGNGGGANAVAPGYTKGSGLGAEIIGTFVLVYTVFSATDAKRNARDSHVPILAPLPIGFAVFLVHLATIPITGTGINPARSLGAAIIYNREHAWSHHWIFWVGPFIGAALAAIYHQVIIRAIPFKSRS

SEQ ID NO: 10347 - DNA, 858 bp, Panicum virgatum
  misc_feature: Ceres CLONE 1724064
  misc_feature: Encodes the peptide sequence at SEQ ID NO. 10348
aacactcactcgaacaacaagccttccagttccaggggagaagagagccagcaggaagacggctatggcggcggcggcccagtgggcgatggtggtggccgtggcggcggcggcgacgctggcgggcggcgacatgaacgcggacaagacggagtgcgcggaccagctggtggggctggcgccgtgcctgcagtacgtgcaggggcaggcgcgcgcgccgccgcccgactgctgcggcgggctccggcaggtgctcgggaagagccccaagtgcctctgcgtgctcgtcaaggacaaggacgaccccaacctgggcatcaagatcaacgctaccctcgccctcgccctcccctccgcctgcggcgccacccgcgccaacgcctcccactgcgcccagctcctgcatattcctccgggatcgaaagacgccgccgtcttcagccccggcggcgacaaggggtccgctgctgccccagccaaggacaactcaacggccacgaccgactcgcgcgggctgcaggcgacaaatggaggcggccgcgtctcctcggtgacgaccgccggcgttgcgctcatggcgctgctcgcaggctaccttctgctcgtgccggagctgtccccttgctcattctagacctctgtcaagtgctcccccaagaaatcaccgggacgtgtcatgctgtagtaattcgtgacaggataatctgtatgctcgtgttggtgttatgctgctttactgtaatactgttgtatgctactggtgtgtaagccaagctagacgatgggtgtaagccaagctagacgatgggtttcgctggcttgaatttattataccagtgcctctggtttctgatcctt

SEQ ID NO: 10348 - protein, 189 aa, Panicum virgatum
  misc_feature: Ceres CLONE 1724064
  misc_feature (31)..(109): Pfam Name: Tryp_alpha_amyl Pfam Description: Protease inhibitor/seed storage/LTP family
MAAAAQWAMVVAVAAAATLAGGDMNADKTECADQLVGLAPCLQYVQGQARAPPPDCCGGLRQVLGKSPKCLCVLVKDKDDPNLGIKINATLALALPSACGATRANASHCAQLLHIPPGSKDAAVFSPGGDKGSAAAPAKDNSTATTDSRGLQATNGGGRVSSVTTAGVALMALLAGYLLLVPELSPCSF

SEQ ID NO: 10349 - DNA, 1267 bp, Panicum virgatum
  misc_feature: Ceres CLONE 1724065
  misc_feature: Encodes the peptide sequence at SEQ ID NO. 10350
aggttaaagcgacgccgccgccgcaagccgtccgccttgcccttcttcttccttgaaggcttggtcctcctccttgtatctccaccccacagatccgccgccgccacctctagctagggttgttaggtttcctctgcagcgatggcgatcaagcggaccaaggcggagaagaagcaggcgtacgaccgcaagctgtgcagcctgctcgatgagtacaccaaggtgctcatcgccctcgccgacaacgtcggctccaagcagctccaggacatccgccgcgggctgaggggcgactccgtggtgctcatggggaagaacacgctcatcaggcgctgcatcaaggcctacgccgacaagactgggaaccacaccttcgacccgctcatggacctgctcgtcggcaacgtcggcctcatcttcaccaagggagacctcaaggaggtccgcgaggaggtggccaagtacaaggttggtgctcctgctcgtgttgggctggttgctccagttgatgtcgttgtcccccctggcaacactggcctggatccctcccagacctctttcttccaggtgctcaacatccccacaaagattaacaagggtactgtggaaattattacccctgtggagctgatcaagaagggtgacaaagtgggctcatctgagtctgctcttctcgccaagctgggtatccgcccgttctcatatggtctccagatcaccaatgtctatgaggatgggtcagtctttagccctgaggttcttgacctgactgaggaagaccttattgagaagtttgccactggtgtctccatggttgcctctctgtccctggcgctctcgtaccccacccttgctgctgcgccccacatgtttatcaatgggtacaagaatgtgcttgctgttgctgtggagacggactactcgtacccgcatgctgacaagatcaaggagtacctcaaggacccaagcaagtttgctgttgctgcaccggttgctgctgcggactctggtgctgcagctgctcccaaggaagaagagaagaaggcggaagagcctgctgaggagtcggacgacgacatgggtttcagcctgttcgactagagctgctcagatcgtcaagaagctgcaagttttggcatttgtttatgaatcaccaaatgtactgtttaccttattatttagcctgtcagatgaagaactatttgttcctagtgtaactgacgatatggtattttgtgctaagcatttgtgatgtttctattgctat

SEQ ID NO: 10350 - protein, 319 aa, Panicum virgatum
  misc_feature: Ceres CLONE 1724065
  misc_feature: SWISSPROT Homolog: EC 4.2.99.18 DNA-(apurinic or apyrimidinic site) lyase
MAIKRTKAEKKQAYDRKLCSLLDEYTKVLIALADNVGSKQLQDIRRGLRGDSVVLMGKNTLIRRCIKAYADKTGNHTFDPLMDLLVGNVGLIFTKGDLKEVREEVAKYKVGAPARVGLVAPVDVVVPPGNTGLDPSQTSFFQVLNIPTKINKGTVEIITPVELIKKGDKVGSSESALLAKLGIRPFSYGLQITNVYEDGSVFSPEVLDLTEEDLIEKFATGVSMVASLSLALSYPTLAAAPHMFINGYKNVLAVAVETDYSYPHADKIKEYLKDPSKFAVAAPVAAADSGAAAAPKEEEKKAEEPAEESDDDMGFSLFD

SEQ ID NO: 10351 - DNA, 582 bp, Panicum virgatum
  misc_feature: Ceres CLONE 1724072-R
  misc_feature: Encodes the peptide sequence at SEQ ID NO. 10352
gggtatggcggcggttcgggagcaggaggcggctatggcggaggagctggtggaggcagtggcggtggatatggcggaggtgcaggctcaggaggcggcgcgggtgcaggaggcggctacggtggaggagctggcggtggctacggcggtggtgcaggcggtggtgcaggtggaggctacggtggcggtgctggcactggtggcggctttggctctggcggcggtggaggctatggcggtggtgccgggggtggcatcggcggccgtgtctgattcagcctctgacatgcatggcgagcgcatgcaccagtgttgtacgcggtcaggtgtggagtcaagcatgtcgtcgctgctatacgttagtctatactctataccgatcacactctctgcgagatgacggtaataaatagaaaaataacgttgcaacttgtttagtcgatggtaattgtacaacggtttatacggtatacacacacacactgttagcggcaaggtgaacggatcgcatgatcgcatcgcatttgtactgtcctctttgtattgtatttcgtcggaataaacaaattaccatgagctagt

SEQ ID NO: 10352 - protein, 90 aa, Panicum virgatum
  misc_feature: Ceres CLONE 1724072-R
  misc_feature: Functional homolog of the protein sequence given in SEQ ID NO 50178
  misc_feature: Useful for making plants with modulated nitrogen use efficiency
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: Functional homolog of the protein sequence given in SEQ ID NO 50142
  misc_feature: Useful for making plants with altered lignin content
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: Functional homolog of the protein sequence given in SEQ ID NO 50180
  misc_feature: Useful for making plants with altered alkaloid content
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: Functional homolog of the protein sequence given in SEQ ID NO 50198
  misc_feature: Useful for making plants with altered terpenoid content
GYGGGSGAGGGYGGGAGGGSGGGYGGGAGSGGGAGAGGGYGGGAGGGYGGGAGGGAGGGYGGGAGTGGGFGSGGGGGYGGGAGGGIGGRV

SEQ ID NO: 10353 - DNA, 377 bp, Panicum virgatum
  misc_feature: Ceres CLONE 1724072
gtccagctccaaagcagcagcagcatcaccactacttgactatagttaggtgagctctctgcttggcccgacatggggagggcgccgaggggtgtgtggaacatggcgcttctggggctggccgtcgcggtggttctcgcggtggccgccgaggcacggtccttggagaagcaaagcttgtgcggtggcgggtgtgggcttggtggcggaggagggtacggcggcggcggcggtgttgggcttggtggtggccttgggcacggtggagggcttggagttgggttcggaggagggaaaggtggtgggttcggcgggggtgcaggcggtggaagcggcctcgggggtgggggtggtttaggtcctgccccccttcgccc

SEQ ID NO: 10354 - DNA, 953 bp, Panicum virgatum
  misc_feature: Ceres CLONE 1724075
  misc_feature: Encodes the peptide sequence at SEQ ID NO. 10355
tcccccgcatcccgtccggccatcatcatcctcgtcgacgccccccatggccacggccgtctccctcccgctccctcgccgcgcatcctcctccgctcccgtggccgccgcccgccgccccgggtccccgtcgctgcgcaggcggcggcattgcgccgtcgtcacgcccgtcgccgcagcctgcagacctgacgcagacgaggatggctccgggcccgggcggcggcaggtgctcgtggcgggtgctgccgcggccgccgcgtttgtttcccgtcccaatccggcggcattcgcagcagagtctaagaaagggttcctgcctgtcgtcgacaagaaggctggttactccttcctctacccgttcggctggcaggaagtggcagtgcaaggccaagataaggtgtacaaagatgtcatagaacctctggagagtgtgagcgtcaactctattcccacgagcaaggaggacatccgtgaccttggtcctccggataaggttgctgaggccttgataaagaaggtcctagcgccaccaacgcagaagacgaagttaatcgaggcaaaagagaatgatgttgatgggagagcttactatacttttgagttcacagctcaggctccaaactacaccagacatgcacttggtgccatcgtaattgcaaatggcaaattttacacattgactactggagcaaatgagagaagatgggaaaagatgaaggataggctgcacacagttgtcgattccttcaaaattgaaaatagaatatgaggaatgtctgggttcttgtgctgatttttcttttttgtattgttctcttttggagctgcaatggtgagatctaaatagtaaatgtcgggaatgtgaattgcactgatcagtttttatttttgaatgttttgttcttgaaacacttgtttgtacttggcatgtatatgttttcactttctgc

SEQ ID NO: 10355 - protein, 241 aa, Panicum virgatum
  misc_feature: Ceres CLONE 1724075
  misc_feature (63)..(238): Pfam Name: PsbP Pfam Description: PsbP
MATAVSLPLPRRASSSAPVAAARRPGSPSLRRRRHCAVVTPVAAACRPDADEDGSGPGRRQVLVAGAAAAAAFVSRPNPAAFAAESKKGFLPVVDKKAGYSFLYPFGWQEVAVQGQDKVYKDVIEPLESVSVNSIPTSKEDIRDLGPPDKVAEALIKKVLAPPTQKTKLIEAKENDVDGRAYYTFEFTAQAPNYTRHALGAIVIANGKFYTLTTGANERRWEKMKDRLHTVVDSFKIENRI

SEQ ID NO: 10356 - DNA, 1489 bp, Panicum virgatum
  misc_feature: Ceres CLONE 1724077
  misc_feature: Encodes the peptide sequence at SEQ ID NO. 10357
acaggagtcccaatcaacaaggtgagctccaatctctggcttgatggcggctcgctgcagctgagaagctgagttatctgccctcttttgattctcatccttggaggctatcccctagcgagcttctttttctagctaatccagtccggcgacctcggctcgccagcaggtcggccatggcgcaggatgattcggttgtttctgctcagtggctgcaccagcacctaggagcgcctgacgttaaggttttggatgcttcctggtacatgccggtagagaacagggatccatgggaagaataccaggtggcacatatccctggtgcgttgttcttcgacatagatggcatagtcgatcagacaactgacttaccacacatgttgccatcagaagaggcttttgcagcagcagtttctgcgctggatataaaaaaccaggataaagttattgtttatgatggaaaaggattcttcagtgcacctcgtgtttggtggatgtttagagtttttgggcacaataaagtttgggtgttagatggaggtttacctcagtggcgagcttcggggtttgatcttggaagtgccaaccctgatgatgcagttgttaaatccaaaactgccaataaggctgttgaaagggtttataatggtgaactgacaaatacaatcacattcaagactgaatttcaccctcatctatattggacactggaaaaggtcgcgcataatgttgctgctaagaattmccaacaagtagatgccagatcaaagggcagatttgatggtgtagcaccagaaccacgggaaggagtgagaagtggacatataccaggaagcagatgtgttccgttcccagagatgtttgatggtgcaccaaggcttctgtccgctgatgagctgaggaaaaagtttcagcaagcaggaatttctcttgaccaccccattgttgtcagttgcggatctggcgtgactgcctgcatacttgctctggggctctatagaattgggaagcatgatgttccagtttatgatggatcttggacagaatgggaagcgcaatcagattctgattacccaaaagctaccgccactgctgcttaaaatccccaactataaagagaagtgaaacagtccatccatcctggagcattcagtttagaatgtcagcaaagatgacatttccatgttacaagctttgcacttaaacaaaggcaaagcttataagggtaagaaatgcccaaagagatgaagagaacatgaagcagggacagaaagtgcaccttgtcaattcttgtgaccctattgtcagcatcgaacttatggttgacatctactagcgtcattgtatttacccatgctcacgatattgcagctaaatgagttaagaatggcaaattcttgtttttggatcaaaatatgaggattaatgtatgagagtttcaactctcacaacattttttattttgcaaagtcgattaaattggatatag

SEQ ID NO: 10357 - protein, 307 aa, Panicum virgatum
  misc_feature: Ceres CLONE 1724077
  misc_feature (9)..(129): Pfam Name: Rhodanese Pfam Description: Rhodanese-like domain
  misc_feature (177)..(294): Pfam Name: Rhodanese Pfam Description: Rhodanese-like domain
  misc_feature: SWISSPROT Homolog: EC 2.8.1.2 3-mercaptopyruvate sulfurtransferase
  misc_feature (190)..(190): Xaa is any aa, unknown, or other
MAQDDSVVSAQWLHQHLGAPDVKVLDASWYMPVENRDPWEEYQVAHIPGALFFDIDGIVDQTTDLPHMLPSEEAFAAAVSALDIKNQDKVIVYDGKGFFSAPRVWWMFRVFGHNKVWVLDGGLPQWRASGFDLGSANPDDAVVKSKTANKAVERVYNGELTNTITFKTEFHPHLYWTLEKVAHNVAAKNXQQVDARSKGRFDGVAPEPREGVRSGHIPGSRCVPFPEMFDGAPRLLSADELRKKFQQAGISLDHPIVVSCGSGVTACILALGLYRIGKHDVPVYDGSWTEWEAQSDSDYPKATATAA

SEQ ID NO: 10358 - DNA, 1165 bp, Panicum virgatum
  misc_feature: Ceres CLONE 1724086
  misc_feature: Encodes the peptide sequence at SEQ ID NO. 10359
gctgcggtcactcgggagggccggtggagagcagcggcggacacatccagctagtcaacgccccgctctgtctccgtgtctcatctcgaatccacatctcctctgcgttctggctcttcttgctccacttccctctccgtatccgcggtcgcccgtgggcggaggctacctgccagccctcggctgccatcggccccgggcattccaaaggcttctattgtagacgcacgaggggttacagacaatatgggcaaaagagttcaagttattttcgttgccagtcttgtgctttcatgcacaataagcttggctttggatgatgctgctactataaaggctcctaatgtcagcaaagtatctctggcaatgaaggaaaactcgcaattatgccaactttgtgagcagttcaccacagaagccctcttctatcttaatgaaaatgagaccaagaccgaaatcattgatacactgcaccaagcttgttcaaagtttccttcttttaagctggagtgcacaaggttggtggattattatgcccctcttttcttcacaaaaattgcttctttaagccctgaagacttttgcgtatcaataagtttttgtgcggaagcaaaattcattcgtctcccaatacatgaggatgcttgcaccctttgccatgaggttgtcgatgagattgttactaatcttgaagatccagacatggagcttaagataatcgagatacttctgaaaggatgcaacaatgcagagaatttcgtacaaaagtgcaagaggttaatcatccaaaatgcaccaatcatcatggaacatatcaagaagttcctcgagaagagggatttctgcgattctattcatgtctgtggaagtaaaactgttcatgctggagcacaagtcctcagaagcctttcttcagcctgaagtcctgagcttttctgaacggattggttcacgcagcaaatgagtggtctacatgtaaaaagatgttcgagcactgtaaatcctgggcaataaagacactacagaattggttttgtacatcagtacatgtaaaaagggaaaccaatcttctgtgtaaacatagaaacctccgcgtgatagttgtgccacatatttagtacatggatcatgagcaggattgtatatttatgttgcttatcattgt

SEQ ID NO: 10359 - protein, 224 aa, Panicum virgatum
  misc_feature: Ceres CLONE 1724086
  misc_feature (45)..(83): Pfam Name: SapB_1 Pfam Description: Saposin-like type B, region 1
  misc_feature (131)..(169): Pfam Name: SapB_1 Pfam Description: Saposin-like type B, region 1
MGKRVQVIFVASLVLSCTISLALDDAATIKAPNVSKVSLAMKENSQLCQLCEQFTTEALFYLNENETKTEIIDTLHQACSKFPSFKLECTRLVDYYAPLFFTKIASLSPEDFCVSISFCAEAKFIRLPIHEDACTLCHEVVDEIVTNLEDPDMELKIIEILLKGCNNAENFVQKCKRLIIQNAPIIMEHIKKFLEKRDFCDSIHVCGSKTVHAGAQVLRSLSSA

SEQ ID NO: 10360 - DNA, 1256 bp, Panicum virgatum
  misc_feature: Ceres CLONE 1724095
  misc_feature: Encodes the peptide sequence at SEQ ID NO. 10361
atctcccccatttctcctccactttggcatcacgcacgctcctccggctttcccgtgtcccccggagcagcgcgagggtttcgaacatggcggagcagccgcacgcggaaggcggcgcgagccccaagcacgagaccctgatggagaagctcgccgacaagctccacgtcggcggcaaggactcctcctcctcctcggactccgacaacgacgagcggccgcgcccctccgcgccgcccgcgcccgccgccgaggtcaagccctccttctccgactccgccgccacggcagccgccgaggccaaggccaaggtgttccgcctcttcggccgcgagcagccgatccacaaggccctcggtggaggcaaacctgctgatgtgttcctgtggaggaacaggaatatctctgctggagtgcttggtggtgccactgcaatctggatcctctttgaattgcttggctaccatcttctgaccttcgtttgccatggtctcatattctctttgggtgttctgtttctctggtctaacgcctcctcgttcatcaacaaatcgcccccacggatcccagaggtgatcattcctgaagatctggttgtcaacattgcactgtctactcgttatgagatcaacagggccttcgccaatcttcgccagattgctcttggccgggacataaagaagttccttatggtgattgctgggctttggttgctttctgttcttgggagctgctgcaacttcttgaccttggtttacattgtctttgtggtgctgcacacagtccctgtcctctacgagaagtatgaggatcagattgactcgtatggcgagaaggggtgggttgaaatcaagaagcagtacgccgtgtttgatgagaaggttctgagcaaagtaccaaggggccccgccaaagacaagaagcactagaaacacaagtgatttggtctttactctgggtagggaatgctagcaagtggttcgagtttgtcaggaggcatcaagactccctttttgttgtacgagcaccaatatgccacatatcgccttgtgttattacggctgcctgtttggtcttttgatgggggttagccggatagctttgccctacaacagtgatgctgatgcagcatacgattttcttgtactgctgtttgattttgatctgtgttgtaagatgtagtgcccgtactgtacccatgacgctgttttttggagtttgcttatatttatggatatttgctgggtttagatacc

SEQ ID NO: 10361 - protein, 280 aa, Panicum virgatum
  misc_feature: Ceres CLONE 1724095
  misc_feature (95)..(278): Pfam Name: Reticulon Pfam Description: Reticulon
MAEQPHAEGGASPKHETLMEKLADKLHVGGKDSSSSSDSDNDERPRPSAPPAPAAEVKPSFSDSAATAAAEAKAKVFRLFGREQPIHKALGGGKPADVFLWRNRNISAGVLGGATAIWILFELLGYHLLTFVCHGLIFSLGVLFLWSNASSFINKSPPRIPEVIIPEDLVVNIALSTRYEINRAFANLRQIALGRDIKKFLMVIAGLWLLSVLGSCCNFLTLVYIVFVVLHTVPVLYEKYEDQIDSYGEKGWVEIKKQYAVFDEKVLSKVPRGPAKDKKH

SEQ ID NO: 10362 - DNA, 1091 bp, Panicum virgatum
  misc_feature: Ceres CLONE 1724105
  misc_feature: Encodes the peptide sequence at SEQ ID NO. 10363
ctacgccgctctcccctcccaaaccccgcgcgcccagatcctagggtttcccgatctcctcccccccttccgccgccgggccgccgacgtggagagcgccgccgcgatgttggagctacggttggtgcagggaagcctcctcaagaaggtcctggaggcgatccgcgacctggttaacgaggccaacttcgactgctccgggaccgggttctctctgcaggccatggactccagccacgtcgcgctcgtcgccctgctcctccgcgccgaggggtttgagcactaccgctgcgaccgcaacctctccatgggcatgaacctcaacaacatggccaagatgctccgctgcgccggcaacgaagacatcatcactatcaaggctgacgatggatccgacaccgtcaccttcatgttcgagtcgcccaagcaagataagattgccgacttcgagatgaagctcatggacatcgatagcgagcaccttggcatcccggattccgagtaccaggccatcgtccgcatgccgtctgctgagtttatgaggatctgcaaggacctcagcagcatcggggacacagttgtcatctcggtgactaaagagggcgtcaagttctcaacctcaggagaaattgggagtgcaaacattgtctgcaggcagaaccaaactgttgacaagccagaagaagctaccattatagagatgcaagaaccagtttccctgacgtttgccctgaggtacatgaactccttcaccaaggcatctacactgtctgaccaagtgactatcagcctttcatccgagctaccggtggtggttgagtacaagatcgcagagatgggctacattagattctatctggcgccaaagattgaggaagatgaggagatgaagccttgatgacaacaatatgaatcttatgttgcctacgtttccttgtctatcaaccatcgtttgcttggctattgtttgcaagcaaaaaaggatgttatgtgttatctcttaggccagactgctagctacttgtatttgtgactgccctgtgaatccatggatttacggtgaatctagattagtgggctttgttttgcgc

SEQ ID NO: 10363 - protein, 263 aa, Panicum virgatum
  misc_feature: Ceres CLONE 1724105
  misc_feature (1)..(125): Pfam Name: PCNA_N Pfam Description: Proliferating cell nuclear antigen, N-terminal domain
  misc_feature (127)..(254): Pfam Name: PCNA_C Pfam Description: Proliferating cell nuclear antigen, C-terminal domain
MLELRLVQGSLLKKVLEAIRDLVNEANFDCSGTGFSLQAMDSSHVALVALLLRAEGFEHYRCDRNLSMGMNLNNMAKMLRCAGNEDIITIKADDGSDTVTFMFESPKQDKIADFEMKLMDIDSEHLGIPDSEYQAIVRMPSAEFMRICKDLSSIGDTVVISVTKEGVKFSTSGEIGSANIVCRQNQTVDKPEEATIIEMQEPVSLTFALRYMNSFTKASTLSDQVTISLSSELPVVVEYKIAEMGYIRFYLAPKIEEDEEMKP

SEQ ID NO: 10364 - DNA, 981 bp, Panicum virgatum
  misc_feature: Ceres CLONE 1724106
  misc_feature: Encodes the peptide sequence at SEQ ID NO. 10365
acaaccaaaccacacctatcctctcctctctatctccttcacgggccactgctcggctgctccctcgctcgcttcgctccccccccccttcgcccccaagccgctccatggccatggcgacctccaccttctccccgcgccccgcctccctcaggcccctgcgggccggcgccaagcctcacctccacctcctccccttcccccgcctccgcgccggccgccgggggagccgcctcgagcgcgccgccgcgggggaggcgcccgtcgaggtcgcgccgcccaaggagcccgaggcgaagccggcacccgccgcggcttccaacgggtccgccgtcaaggccgtcgaggcgcccgcggaggccgcgccggcgccggctttccgggacgcgaggtgggtgaacgggacctgggacctcagcaagttcgagaagggcggcgccgtcgactgggacgccgtcatcgacgccgaggcaaggagaaggaaatggcttgaagattatccagaggccacaaatacagatgaggctgttgtctttgatacttcagttattccatggtgggcatggatgaagaggttccaccttcctgaagctgagaagctgaatggtcgtgctgccatgatcggcttcttcatggcttactttgtcgatagcttgacgggtgtggggcttgtcgaccaaatgggcaacttcttctgcaaaaccctgctgtttgttgctgtggctggcattctgcttatcaggaagaatgaggaccttgactcactgaagaagataatcgatgagacaacgttctacgacaagcaatggcaggcaacctggcaagatgagaccactggggggccgaagaactagatcagcgttggggtctgaatgcagaatccttttcttgtgttgtgttttgttttacggccctttttgtttccccatctagtgagacttgcaggaacattttgacaatataataatctacgtatcttgc

SEQ ID NO: 10365 - protein, 248 aa, Panicum virgatum
  misc_feature: Ceres CLONE 1724106
  misc_feature: Functional homolog of the protein sequence given in SEQ ID NO 50199
  misc_feature: Useful for biocontainment applications
  misc_feature: Useful for making plants with modulated biomass
MAMATSTFSPRPASLRPLRAGAKPHLHLLPFPRLRAGRRGSRLERAAAGEAPVEVAPPKEPEAKPAPAAASNGSAVKAVEAPAEAAPAPAFRDARWVNGTWDLSKFEKGGAVDWDAVIDAEARRRKWLEDYPEATNTDEAVVFDTSVIPWWAWMKRFHLPEAEKLNGRAAMIGFFMAYFVDSLTGVGLVDQMGNFFCKTLLFVAVAGILLIRKNEDLDSLKKIIDETTFYDKQWQATWQDETTGGPKN

SEQ ID NO: 10366 - DNA, 1274 bp, Panicum virgatum
  misc_feature: Ceres CLONE 1724121
  misc_feature: Encodes the peptide sequence at SEQ ID NO. 10367
cgcccaccgccccactcccccacgcctctcgcgcacgccgccagggggacggggtttgggtcgcctgcacctgcaggcggaaggcacgcgccgccgctgccgcgcgagcgtctcctccgccccggccgccgcgcggatggagatggacccgtccgaggtgaagggcctgtacgcgcaggtcgagccatacgacaccgggttcctcaaggtctccgacgtccacaccatctactacgagcagtccgggaatccccagggccatccggtggtgttcctccacgggggtcccggcgccggcacgtcgcctggcaacaggaggttcttcgacccggagttctacaggatcgttctgttcgaccagaggggcgcaggcagaagtactccccatgcttgcttggagcagaacactacttgggacttggtagctgacattgagaagctcagggaacatcttgacatccctgaatggcaggtgtttggtggttcatggggaagcaccttggctcttgcttacagtcagacacaccctgataaggtcactggcattgttctaagaggaattttcttgcttaggaaaaaggagcttgattggttctatgagggtggtgcagcagccattttcccagatgcatgggaaccatttagagattttattcctgaggaggaaaggaattgtttcatagctgcatatagcaaaaggctaacttcatctgatcctaccgttcagattgaagctgcgaagcgatggacaatgtgggagatgatgactgcgcatcttatccaaaataatgataacattaaacgaggggaagatgacaagttttcactggcatttgcaaggattgaaaatcactattttgtgaataagggatttttaccctcggactcatatctattagacaatgttgacaagattcgacatattaaagcttttattgtacaggggcgttatgatgtttgttgccccatgatgtgtgcttgggatcttcataaagcttggcctgaagcagaattcaaggtggtcccagatgcaggccactcggccaatgaagtaggtattgctgctgaactgaggtcagccacagaaaaactgagagacatgttgcgaaaatgaacaggccaaaggcatacatgtgcattacccgtctgatgatgaaatttataggcgcgaaataaagccatggctgtagtggttagcagagcttgattggaatgtgttttttttataaatgtcaccatcaaatatccctttgccaatcagagcattcttctcg

SEQ ID NO: 10367 - protein, 323 aa, Panicum virgatum
  misc_feature: Ceres CLONE 1724121
  misc_feature (66)..(312): Pfam Name: Abhydrolase_1 Pfam Description: alpha/beta hydrolase fold
  misc_feature: SWISSPROT Homolog: EC 3.4.11.5 Prolyl aminopeptidase
MDPSEVKGLYAQVEPYDTGFLKVSDVHTIYYEQSGNPQGHPVVFLHGGPGAGTSPGNRRFFDPEFYRIVLFDQRGAGRSTPHACLEQNTTWDLVADIEKLREHLDIPEWQVFGGSWGSTLALAYSQTHPDKVTGIVLRGIFLLRKKELDWFYEGGAAAIFPDAWEPFRDFIPEEERNCFIAAYSKRLTSSDPTVQIEAAKRWTMWEMMTAHLIQNNDNIKRGEDDKFSLAFARIENHYFVNKGFLPSDSYLLDNVDKIRHIKAFIVQGRYDVCCPMMCAWDLHKAWPEAEFKVVPDAGHSANEVGIAAELRSATEKLRDMLRK

SEQ ID NO: 10368 - DNA, 957 bp, Panicum virgatum
  misc_feature: Ceres CLONE 1724125
  misc_feature: Encodes the peptide sequence at SEQ ID NO. 10369
acagaccgtcagacccacctccctccccgcggtggaaccaacgcccagcgcgcgcgcgcaagagaacccccacccaccgcgcatggaagttgctgcggcgaagcaactcctccccatggcgcggggccccaactccccatcctcctccacctcctcctcctccccgtcctccgccgcctccccgccgccgcgccagccgcagtcccagtcccagcccgtgccaccgtcgcccaagcccgtgccgcacatcatcgacaccacgccgttcccgaccaccttcgtgcaggccgacaccgccaacttcaagcaggttgtgcagaggctcaccggctccgacacgccgtcgtcggtccagaacaagcccgccaagaaccaccaccaccaccaccacaaccacggcggcgccagcggcctcgccggcgggcccaagaagccggccttcaagctctacgagcgccggatcggcaagaacaacctcaagatgatcgcgccgctggcgatggccgcggccgcggccgcgggggcgtcgccgcggaaggcgggccccgaggtgctgtcgcccagcgtgctcgacttcccgtccctggcgctcgggagccccgtcacgccgctggtgtcggaccccttcaaccggtcgccggcgtccgcgtcaccgggcgtggaggaggccgccgagcgcgcggccatcgcgcggaagggcttcttcctgcacccgtccccgaggggcgccgagccgccgcggctgctgccgctgttccccgtcacgtcccccaggatggcgccctccgccgccgcggcgccgtcgtcgcagtgaccgggcaccgcactgccggagaattcctagtacccgcgtgagatgcttgctgtttaactactccttccgtgatgtaatttttgctcatagtcctgaaccgatcgcgaagaaacggaaagaagaatcacactcttgagcttctc

SEQ ID NO: 10369 - protein, 243 aa, Panicum virgatum
  misc_feature: Ceres CLONE 1724125
  misc_feature (60)..(90): Pfam Name: VQ Pfam Description: VQ motif
MEVAAAKQLLPMARGPNSPSSSTSSSSPSSAASPPPRQPQSQSQPVPPSPKPVPHIIDTTPFPTTFVQADTANFKQVVQRLTGSDTPSSVQNKPAKNHHHHHHNHGGASGLAGGPKKPAFKLYERRIGKNNLKMIAPLAMAAAAAAGASPRKAGPEVLSPSVLDFPSLALGSPVTPLVSDPFNRSPASASPGVEEAAERAAIARKGFFLHPSPRGAEPPRLLPLFPVTSPRMAPSAAAAPSSQ

SEQ ID NO: 10370 - DNA, 1370 bp, Panicum virgatum
  misc_feature: Ceres CLONE 1724135
  misc_feature: Encodes the peptide sequence at SEQ ID NO. 10371
actcgaactctcgaagcaagcagtgccatcccgaaggcgccgccgccgccgccgccccatcccgccgggcccgtttgccgccggccgccgcggcaccggtactgtgccggaggatggcgtcgaggtgcccggcgagggtaccttctccgcggtgcccgccgcggcacggctgggcgggctcgtgggtttcggcccgcctctcgaaatgcggcgcgtcgggagggcgttcggtcatttgcgccgctgttagcttcaggccatgcattgacatacacaaggggaaagttaaacagattgttggttctactcttcgggattcatcaaatgatggcacagaacttgtgacaaactttgaatcagacaaatctgctgcagaattcgcaaaactctataaagaagatgaacttgttggtggacatgttataatgctaggcgcagatcctgcaagccaagcttcatcactggaggcgttacattcatatcctggtggtttgcaagttggaggtggaataaatttggagaatgcaatatcgtaccttaatgaaggggcaagtcacgtgatagtaacctcttatgtgtttagcgatggcaagatgaacattgaaaggctaaggaaacttgttgagctggttgggaaacagaggcttgtgttggaccttagttgtcgaaaaaaggatggcaaatataccattgtaactgaaaggtggcagaagttcagtgatgtctttgtggatgaaccgacattagaatatcttgctgcttatgcagatgagtttttggttcatggtgttgacgtggagggcaaaaggttgggaattgatgaggaccttgtggaactattagggcgccattcaccaatcccagtaacttacgctggaggtgtgtcaacaatgcatgacctagagagaataaagaaagcaggcagaagtcgagtggatgttactgttgggagtgctctagatatatttggaggagatttgccctacaaagatgttgtcctttggcacaagaagcaaagtatggttggccaactgtgaagaaacatgaggtatggcttgatcaatactatcagctcatataggtcaaccttcgacagaagcaaactttctgaacattctattggaattcagtggtcagtgatgtaattgaaagctgaggaatatgatttgttcttgtctcggcattaaaatttcatttgttgataaccttcacaagttatcaacaataggggttgattcatgattaagatattgttgctaaaccgtttcttaccagtattggtctgttgtaactatgagtaagcacagctgatgccggcaaatattaagcacagctgatgccggcaaatattaagcacagatgatgctggg

SEQ ID NO: 10371 - protein, 307 aa, Panicum virgatum
  misc_feature: Ceres CLONE 1724135
  misc_feature (49)..(290): Pfam Name: His_biosynth Pfam Description: Histidine biosynthesis protein
  misc_feature: SWISSPROT Homolog: EC 5.3.1.16 1-(5-phosphoribosyl)-5-((5- phosphoribosylamino)methylideneamino)imidazole-4-carboxamide isomerase
MASRCPARVPSPRCPPRHGWAGSWVSARLSKCGASGGRSVICAAVSFRPCIDIHKGKVKQIVGSTLRDSSNDGTELVTNFESDKSAAEFAKLYKEDELVGGHVIMLGADPASQASSLEALHSYPGGLQVGGGINLENAISYLNEGASHVIVTSYVFSDGKMNIERLRKLVELVGKQRLVLDLSCRKKDGKYTIVTERWQKFSDVFVDEPTLEYLAAYADEFLVHGVDVEGKRLGIDEDLVELLGRHSPIPVTYAGGVSTMHDLERIKKAGRSRVDVTVGSALDIFGGDLPYKDVVLWHKKQSMVGQL

SEQ ID NO: 10372 - DNA, 1174 bp, Panicum virgatum
  misc_feature: Ceres CLONE 1724144
  misc_feature: Encodes the peptide sequence at SEQ ID NO. 10373
atcgccgcgaggccccatcggtcgcgttcccgtcggcgagagcgagcgcagcatccgcaccgcgccagcagcatggccgcgccgccgctgctccggcattggccccgcctcgctgtgatcggcgccgtcctcgcgctccacctcgccgccgccgccgcgcagtcgccagcgacgcctgccgcgcccacgaccccggcggcgcccacgaccccggcggcgcccacgacaccggccgcgccgacgacccctgcttcgccgacgacaccggctgcacccacgacccccgctgcgccgaccacccctgctgcacccacgacaccggctgcacccacgacaccggctgcgcccacgacaccggctgcaccgacgacgccggcaacgaccgcgcccaccgcgaccccggccgcgccagcaaacccgccgccgaccccagcggcgcccgcgcccgccgccaccccggtcccgccgtcgaagccgccgccggccgcgcccgcggtcgcgccggccaagcccccgccggtggtgacgcctccccccgcagcgacgccgcctccctcgacgccgccgcccgccacgccgcccgcggtgctcccgccggcggccgcgcctccgccgacggccactcccccggcagaggcgcccgcgacgctgccccccgccgcgaccccgcccgtggccgaggcccccgcgacgctgccgccggccgaggcgccgtccaagggcaagaacaagcacaagaggaggaagaagcagcacggcaagaaggaggcccccgcggaggcgccgcagccgctgagcccgccggcgcccgccgcgccgtcgcccgccgatctcgaggacgtgtccggccccgcgccgtcggcgttcgatgtgaacgcgagcagccggcagcaccagcactggggcgtcctcgtcctgcagaccgccatggctgcgcttttgctatcgctagcgtggtaaatcccagagagattcttcatacatatatcagtgtaccagatgatgatttgattctttccgctgttgctgttcgtgttgtggcatcatagaccggtgagactaccagcgggatctgtcataggaaccattggattctggcttgtgataaatttttgacatgttttgtatccattttttttcgtttatcttggaataaaggctcacatttggtcag

SEQ ID NO: 10373 - protein, 295 aa, Panicum virgatum
  misc_feature: Ceres CLONE 1724144
  misc_feature: Functional homolog of the protein sequence given in SEQ ID NO 50194
  misc_feature: Useful for making plants with altered cell wall content and/or composition
MAAPPLLRHWPRLAVIGAVLALHLAAAAAQSPATPAAPTTPAAPTTPAAPTTPAAPTTPASPTTPAAPTTPAAPTTPAAPTTPAAPTTPAAPTTPAAPTTPATTAPTATPAAPANPPPTPAAPAPAATPVPPSKPPPAAPAVAPAKPPPVVTPPPAATPPPSTPPPATPPAVLPPAAAPPPTATPPAEAPATLPPAATPPVAEAPATLPPAEAPSKGKNKHKRRKKQHGKKEAPAEAPQPLSPPAPAAPSPADLEDVSGPAPSAFDVNASSRQHQHWGVLVLQTAMAALLLSLAW

SEQ ID NO: 10374 - DNA, 1018 bp, Panicum virgatum
  misc_feature: Ceres CLONE 1724148
  misc_feature: Encodes the peptide sequence at SEQ ID NO. 10375
ccaatccaagcgagcgaacagaggagtcagcaagcaaggggaggcctggaggcaggcgtggcaatggcggcgaagctccggccagtgctgccctgcttcctcctcctgctgctcggcgccgcgggggcggggcgccacgccggcggccggacgctggtcttcatcctggcggggcagtccaatatgagcggccgcggcggcgccaccagcggcacctgggacggcgtcgtgccgcccgagtgcgcgccgtcgccgcgcatcctccgcctctcccccgcgctccgctgggaggtggcgcgcgagccgctgcacgccggcatcgacgtcggcaacgtcctcggcgtcgggcccggcatgcccttcgcccacgccgtcctcgccgcctgcggcaacgccgtcccggcggtggggctcgtcccctgcgcgcagggcggcacgccgctcgccaactggacgcggggcacggagctgtacgaccggatggtgacgcgcgccagggcggccatgggcgggggcggcgagctggccgccgtgctgtggtaccagggggagaccgacgccatgagcaaagaggacgccgagctctaccaggggcgcatggaggcgctcgtgcgcgacgtccggcgcgacctcggccgcgccgacctcctcgtcgtccaggtcgggatcgcgacagcgcagtatggcggcaagttcctcgaccgcgtcagggaagcccagaaggccgtcacgctctcgctcccgaatgtcaagtacgtcgacgccatggggctgcccatcgcgagtgacaagacgcatcttaccaccgaggctcaggttcaactcggcaacatgctagccaagtcctacttagaaactctgtaaactctaattggttaatcgaaccaacacatagtttctaccaacatgtgcctgtgcaaataagtcatgccattgatgattgggaaacggatagagcaggacatgtgtgtatcctttaattctgatgaggttttaatagtagaatttacatccgctt

SEQ ID NO: 10375 - protein, 266 aa, Panicum virgatum
  misc_feature: Ceres CLONE 1724148
  misc_feature: Functional homolog of the protein sequence given in SEQ ID NO 50200
  misc_feature: Useful for making plants with altered cell wall content and/or composition
MAAKLRPVLPCFLLLLLGAAGAGRHAGGRTLVFILAGQSNMSGRGGATSGTWDGVVPPECAPSPRILRLSPALRWEVAREPLHAGIDVGNVLGVGPGMPFAHAVLAACGNAVPAVGLVPCAQGGTPLANWTRGTELYDRMVTRARAAMGGGGELAAVLWYQGETDAMSKEDAELYQGRMEALVRDVRRDLGRADLLVVQVGIATAQYGGKFLDRVREAQKAVTLSLPNVKYVDAMGLPIASDKTHLTTEAQVQLGNMLAKSYLETL

SEQ ID NO: 10376 - DNA, 1109 bp, Panicum virgatum
  misc_feature: Ceres CLONE 1724151
  misc_feature: Encodes the peptide sequence at SEQ ID NO. 10377
ttgttgcactctgtgtgctgctctggtggccctcatttgatgtcatattggttgaccaagtttctgttgtgattccgctgctcaaactaaagtcatcatccaagatagtgttttattgtcatttccctgatcttttgcttgcacaacattctaccatgctttggaggttataccgcaagccaattgacatgattgaggaagccactactggtatggcaaatttaattttggtcaacagcaagttcactgcagcaacctttgcgagaacctttcggggcttacatgctagaggaattgagcctgctgttctatatccagctgtatctgttgagcagtttcatgaacctcatgcttataagttgaatttcctatcaatcaatcgttttgagaggaaaaagaatcttgatctagccatttcagcatttgctttgctccgttctgttgcttctacactacctggtgatgctctgcaagatgcaactttaacagtagcaggtggctatgataagcgtctcaaggaaaatgttgattaccttgaggagctcaaaagattggcagtgactgaaggggtgtccgggcaggttaaatttgtaacgtcgtgctcaacatctgaaagaaatgagcttctctccaactgcctttgtgttttgtacactccaaaggatgagcatttcggtattgtccctcttgaagccatggcagcccataagcccgtaattgcatgcaacagtggtggcccagttgaaacagttgtgaatgaagttacagggtttctgtgtgatccatcccccacagaattctcaaaagccatgctgaaacttgtgaatgaccatgatctaacggtcaggatgggtaaacaagcacgggaccatgtggtgcaaaaattctccacgaagacatttggtgacctcctcaacagctatatcctgaatgcctaccatgagaggatggagtgatctataatatcggaaaagtttgaacaatacaacacagggtttttttttttcatttttacaactcatctcacatgatgctaatgccctttggcagactagagtgatttgctgatctgtttattgtgtttaattaatggcgaatcaaattcgact

SEQ ID NO: 10377 - protein, 317 aa, Panicum virgatum
  misc_feature: Ceres CLONE 1724151
  misc_feature (106)..(290): Pfam Name: Glycos_transf_1 Pfam Description: Glycosyl transferases group 1
  misc_feature: SWISSPROT Homolog: EC 2.4.1.13 Sucrose synthase
VALCVLLWWPSFDVILVDQVSVVIPLLKLKSSSKIVFYCHFPDLLLAQHSTMLWRLYRKPIDMIEEATTGMANLILVNSKFTAATFARTFRGLHARGIEPAVLYPAVSVEQFHEPHAYKLNFLSINRFERKKNLDLAISAFALLRSVASTLPGDALQDATLTVAGGYDKRLKENVDYLEELKRLAVTEGVSGQVKFVTSCSTSERNELLSNCLCVLYTPKDEHFGIVPLEAMAAHKPVIACNSGGPVETVVNEVTGFLCDPSPTEFSKAMLKLVNDHDLTVRMGKQARDHVVQKFSTKTFGDLLNSYILNAYHERME

SEQ ID NO: 10378 - DNA, 1114 bp, Panicum virgatum
  misc_feature: Ceres CLONE 1724157
  misc_feature: Encodes the peptide sequence at SEQ ID NO. 10379
cccccaacccatttccttcctgcccgcaacccagcccaggcccggcggtccctcgatcctctcggctccggatcggcaagagcccagccgccgccgccgcccgtagccgcctcgctgccggattcacacgacacctcgtcggcgtctctttctctctctctctcgaggcccatggcgcagcgcgacaagaaggtggaggagccgacggagctgcacgcgccggagctcacgctctgcgccaacagctgcggcttcccgggcaacccggccaccaagaacctctgccagaactgcttcctggccgcctccgcctccgtctcgccgccgtcgccctcctcctcgccggcggtgttcgacaagtcgcggacggcggcggcggcggccgcccctcccgcgctctggccgccgttctccccggccgccaaccggcccccggcgggccccgcggagtccccctccaaggcgccccggacgtcgtcgtcgatcaaccggtgccacagctgccggaagcgggtcgggctgacggggttccggtgccgctgcggcgagctcttctgcggcgcgcaccggtactcggaccgccacgattgcggctacgactacaagggcgtcgcccgggacgccatcgcccgggagaaccccgtcgtgcgcgccgccaagatcgtcaggttctgagagagctggggagcaccggaggaccacgcacagctcagctccacgccgatcgtcgatccatcatctcccgcgctccggaatcccctctcttttttctctttttctttcctcttttgttacaaaatttaaaggtgattggtcgagggtgctgtcatcacgctgttctcgagaatcccacaaacaagaagaagatgatttgattgatgaaggacaaagaaggagcagatcatgggaaccatgaaggcagggaagctgcgagaaaaaggggatcgagagcacagagcgatgataatgttgttgttgtagcggtggttggggtggaggggaagagatagggtcggtttggtgtgttgtcctactacaaatcacaatcttctattaaatttttcttccatctctctgtataaactaaattataattggaatctccctattgccc

SEQ ID NO: 10379 - protein, 167 aa, Panicum virgatum
  misc_feature: Ceres CLONE 1724157
  misc_feature (108)..(148): Pfam Name: zf-AN1 Pfam Description: AN1-like Zinc finger
MAQRDKKVEEPTELHAPELTLCANSCGFPGNPATKNLCQNCFLAASASVSPPSPSSSPAVFDKSRTAAAAAAPPALWPPFSPAANRPPAGPAESPSKAPRTSSSINRCHSCRKRVGLTGFRCRCGELFCGAHRYSDRHDCGYDYKGVARDAIARENPVVRAAKIVRF

SEQ ID NO: 10380 - DNA, 1035 bp, Panicum virgatum
  misc_feature: Ceres CLONE 1724159
  misc_feature: Encodes the peptide sequence at SEQ ID NO. 10381
ggccagcagctgagcctgccaccaccacgccagcggcatggagcagaggaagggcggtgcgcgcgtgccccgggcggtgtccgtcctggcgggcctgctggagcgcgccgccgagcgcggcgacgccgctcccgcgtcgtcagcggcggcggcgttccggggccgggccctgccggcgatccccgtgcggcggtacgcggagcggatataccggtacgcggggtgcagccccgcgtgcttcgtcgtcgcctacgtctacctcgaccgcctcgcgcagcgcccgctggaggacggggatgcgacggcagaggcacccgcagtggtcggcgtcgtcgactcctacagcgtgcaccgcctgctcatcaccgccgtcatggtcgccgccaagttcatggacgacatgcactgcaacaacgcctacttcgcgcgggtggggggcgtggaggtggtggagatgaacgggctggagctggagctcctcttcgcgctgcgcttccgcctcaacgtcacgccggacaccttcgcgcgctactgcgccgcgctcgagggccagatgctcgtgccgatgccgccggcggcggcggcggccaccgacgaggaggaggaggccgagcgccggcgccgcggcgaccaccaggccgcgctgctgctgattaggaaggccaaggacggtgcggccaccgccgttcgtgagcgggccggggtcgggagcagggcagccgccgccgccggagtgcccgtcgtcgtcccgagagtggccgtggagatgatcgcccgatgacgacacgattctttcagttaatttgatttgttggttcctgtgtcctaggaggccttccctccagtttaggtttattttaagaaattgaactgcaaaatgtctggggggattttcgtaaaattggtagattgcgggggttatttggtaaatttggcgtcgacggagtaccggtcgattactgaaaagttcaaggggtttttcataaaattgatggacttcataattattttaataaagtccagggttttttttcc

SEQ ID NO: 10381 - protein, 247 aa, Panicum virgatum
  misc_feature: Ceres CLONE 1724159
  misc_feature (11)..(155): Pfam Name: Cyclin Pfam Description: Cyclin
MEQRKGGARVPRAVSVLAGLLERAAERGDAAPASSAAAAFRGRALPAIPVRRYAERIYRYAGCSPACFVVAYVYLDRLAQRPLEDGDATAEAPAVVGVVDSYSVHRLLITAVMVAAKFMDDMHCNNAYFARVGGVEVVEMNGLELELLFALRFRLNVTPDTFARYCAALEGQMLVPMPPAAAAATDEEEEAERRRRGDHQAALLLIRKAKDGAATAVRERAGVGSRAAAAAGVPVVVPRVAVEMIAR

SEQ ID NO: 10382 - DNA, 1237 bp, Panicum virgatum
  misc_feature: Ceres CLONE 1724162
  misc_feature: Encodes the peptide sequence at SEQ ID NO. 10383
atttctcgggagcaggaggggttaaccttcgtggggggaaacaatgtactttgaaggctatggctaccatggaaacactttcgagcagacatatcgctgctacccagcatctttcattgacaagccacaacttgaggctggtgacaaaattattatgccaccatcagctcttgatcgtctcgcatctctgcatattgagtatcctatgctttttgaagtccacaatgcggcagcagaacggacttcacattgtggtgttctggagttcattgcagaagaaggcatgatctacatgccgtattggatgatgcaaaatcttcttctgcaagagggagatatggtgttcataaaaaatgcgaacctccccaagggcacatatgtcaagttgcagcctcatacaacagactttttggatatctcaaaccccaaagcaatcttggagaaaactttgaggaacttttcttgcctaaccacaggtgacagcattatggtagcatataataacaagaagtactacattgatatagtggagacaaaaccttccaatgctataagtattattgagactgattgtgaggttgactttgctccaccacttgactataaggagcctgagccagtaaaacccgctgttcctgcaaacacagagcctactacagaacctccagccgaagaagaaccaaaattcacccccttcaccggttcaggaaggcgtctggatgggaagccttctaagggtaaagatgcgctggcctcatccccagcaaagcgacaagctaatgcaaccaatggtgtgcagccctcaacagccagctcgtcacagggtggttcgtcgcgtaagaccacaggaaagcttgtctttggttcgggtggaagtcgagctgataaggcgcctgagaaggaagcgaaggaggaaccgaagaatgagccgaaatttgcagcgtttacgggaaagaagtactcactgaagggctgaagaataaataggcagtaatgtatattttttatccttatatccccagcgacaagacctaactagtaggggggagaagagcttgatgatgagctactgttgacttgaattacccttatgtgggatatgggcatctttggttgggttagtggcattcgtcttgaagtcgagtgtttcttcttgtgagaaactgtgatccttcctttgtctggccgcagtggagcaactgatgtataaagcaattcatgcctgtttatggatttc

SEQ ID NO: 10383 - protein, 310 aa, Panicum virgatum
  misc_feature: Ceres CLONE 1724162
  misc_feature (10)..(184): Pfam Name: UFD1 Pfam Description: Ubiquitin fusion degradation protein UFD1
MYFEGYGYHGNTFEQTYRCYPASFIDKPQLEAGDKIIMPPSALDRLASLHIEYPMLFEVHNAAAERTSHCGVLEFIAEEGMIYMPYWMMQNLLLQEGDMVFIKNANLPKGTYVKLQPHTTDFLDISNPKAILEKTLRNFSCLTTGDSIMVAYNNKKYYIDIVETKPSNAISIIETDCEVDFAPPLDYKEPEPVKPAVPANTEPTTEPPAEEEPKFTPFTGSGRRLDGKPSKGKDALASSPAKRQANATNGVQPSTASSSQGGSSRKTTGKLVFGSGGSRADKAPEKEAKEEPKNEPKFAAFTGKKYSLKG

SEQ ID NO: 10384 - DNA, 1162 bp, Panicum virgatum
  misc_feature: Ceres CLONE 1724171
  misc_feature: Encodes the peptide sequence at SEQ ID NO. 10385
atttccatttctgccctttcctcgcttccgcccgccgccgccgccgccgtcgacgcagccatggcgtcgcggcgctgcctcctccgcctcctctcgagccgcctcgtccctcagagatctcagcctcttgcaccggtcttgatcgcaacccgaaccctgacatctttgtccgagcccgtcgcccatccagctcccggggccctcgcctccccgcggctctactacccctcgagctgccacttcgcgacccgctcctccggcgacgaggaggatggcgacgaagaagagcactacgacgacgaggggagcgagggagaatggggcgaggaggatgaggcggtggcggcgaagaaaccgagcgggaagacagaggaggagaaggtagcggaggcggcggagatcgggtacaaggtggtgggaccgcttggggctgacgagaaacccttcaagccctacgaacccgtcttcgccgtcgtacagattggctctcatcaattcaaggtcagcaatggcgattccatcttcacggagaggttgaagttctgcgatgtaaatgacaagctgatcttaaaccgagttctcatgcttggttcacaaactcaaacagttattggaaggccaattcttcctgaagcttctgttcacgctgttgttgaggagcatgccctagatgcaaaagtgatcatattcaagaagaagcggagaaaaaattatcgccgaacaaagggccaccgtcaggaattaacaaaactgagaataaccaacattgaaggaatagataagccagagactgttgccattgccgcctaatttcaggttgaaggaacagtgccttttgtttttgtcggcaatgcccaagcgggttttagaagttaagtcagatcatgatagctgataccagtgcaaagccgcttcttttcttgttaattgcaaaggtgaagtgaaagatgaagctgtctcagcattccaatggcactataccaatgtactgagcaggttgggtactatggcgtggttcggctgttgtagcttgcgtgacactgattgtttttcctcatttttttggtatcttttctgcacacatcctttataaatgtgttctgatacatcagtgccatgttgactgctagaaccatgtaataatgggaccacaatgcttcgt

SEQ ID NO: 10385 - protein, 249 aa, Panicum virgatum
  misc_feature: Ceres CLONE 1724171
  misc_feature (135)..(231): Pfam Name: Ribosomal_L21p Pfam Description: Ribosomal prokaryotic L21 protein
MASRRCLLRLLSSRLVPQRSQPLAPVLIATRTLTSLSEPVAHPAPGALASPRLYYPSSCHFATRSSGDEEDGDEEEHYDDEGSEGEWGEEDEAVAAKKPSGKTEEEKVAEAAEIGYKVVGPLGADEKPFKPYEPVFAVVQIGSHQFKVSNGDSIFTERLKFCDVNDKLILNRVLMLGSQTQTVIGRPILPEASVHAVVEEHALDAKVIIFKKKRRKNYRRTKGHRQELTKLRITNIEGIDKPETVAIAA

SEQ ID NO: 10386 - DNA, 1362 bp, Panicum virgatum
  misc_feature: Ceres CLONE 1724187
  misc_feature: Encodes the peptide sequence at SEQ ID NO. 10387
atagcgccgccgctcccagacgcctctctcctcctagcccgagccctctcctcctcccctttgggtcacctcctagctcttgcatccacatccaccatggcggcggcgggaggcggaggcgcgccgcgtgtgctgtcccagaaggagcaggacatccagatgatgctcgccgccgacgtccagctgggcaccaagaactgcgacttccagatggagcgctacgtcttcaagcgccgcaccgacggcatctacatcatcaaccttgggaagacatgggagaagctccagctggcggcgagggtaatcgttgccatcgagaaccctcaggacatcattgtccagtccgcccgcccctacggccagcgcgccgtcctcaagttcgctcagtacactggtgcccatgctattgctgggaggcacacccctggtaccttcaccaatcagctccaaacatccttcagtgagccccgactgctcatccttaccgacccaaggactgaccaccagccaatcaaggagtctgctctgggaaacatccccaccattgccttctgtgatactgactcccccatgcggtatgtcgatatcggcatcccggccaacaacaagggaaggaacagcattggatgcctgttctggctcttggcaaggatggttctgcagatgaggggcactatcctccctgggcacaagtgggaagtcatggttgatttgttcttctatagagaccctgaggaagcaaaggagcacgaggaggaagctgctgctgcccctgactttgccgctatcactgattatccagcggctgatcagtggggtggagaccagtggacctctgatgttgctgcaccgcctgttgctgttggtggcactggtgcggagtggggtgctgctccagctccagttcctactggcgatggctgggatccagctggggcccctgcacctgtggagggtgctgttcctccggttgttgctgctccggctggttgggacccagcagcacaaccccccgcccaaggctgggagtaggcataggccctccctttgtgatgcatcttgtggcttaaattaattatttttccaaagtatgaatgtccgaaatcaggatgcatcatctacctatgcattggacactttctgttgtagggctttctagctgaacatgtgcccctgttctgttttcaaaattggtgctagaagagagtcttgcgaaaatgtggtataagtagtttttctgtttgtgttgcttatattccatggatccttgcaatgtgatggttctatataacacatcgagtcggtgaaatctgggtgccacggattttgtactcctaaattttaccagttcgcttgaagttc

SEQ ID NO: 10387 - protein, 311 aa, Panicum virgatum
  misc_feature: Ceres CLONE 1724187
  misc_feature (23)..(191): Pfam Name: Ribosomal_S2 Pfam Description: Ribosomal protein S2
MAAAGGGGAPRVLSQKEQDIQMMLAADVQLGTKNCDFQMERYVFKRRTDGIYIINLGKTWEKLQLAARVIVAIENPQDIIVQSARPYGQRAVLKFAQYTGAHAIAGRHTPGTFTNQLQTSFSEPRLLILTDPRTDHQPIKESALGNIPTIAFCDTDSPMRYVDIGIPANNKGRNSIGCLFWLLARMVLQMRGTILPGHKWEVMVDLFFYRDPEEAKEHEEEAAAAPDFAAITDYPAADQWGGDQWTSDVAAPPVAVGGTGAEWGAAPAPVPTGDGWDPAGAPAPVEGAVPPVVAAPAGWDPAAQPPAQGWE

SEQ ID NO: 10388 - DNA, 1048 bp, Panicum virgatum
  misc_feature: Ceres CLONE 1724204
  misc_feature: Encodes the peptide sequence at SEQ ID NO. 10389
aatccgcctcgtcccgcttgagcgccgccgcaccaatggcctcccccaacgccgacccgcctccacaccacgcctccacgccgccactcctcctcgccgtacgccacatccctttccccggcgtccaccggccgcgcgcgctccccgcccccgacgtcctcgcccctctcgcccgccgcctcgaggagctcgcggccgcggccgccgcgcacccgctcctgaagccgctcttcgccgtccactcccacctctcttccttctctgagagcaggaggcggctggtggcggcgcggcgggacacgctgctgtccggggagcactgcttcgcggcggtgctgggggactcggtggccggcatggtggtggccaatggcatcaacaacttcctcagcctctacaacacggtgctcgtcgtccgcctcgtgctcacctggttccccaacacgccacccgccatcgtcgcgcctctcagcacgatctgtgacccctacctgaacatcttccggggcatcatcccgccgctcgggggaacgctggacctgtcgcccatcctcgccttcctggtcctcaacgccttcaccagcaccgccgccgcgcttccggcagagctcccggaccccgctgcagctccacagcaccaccgccagagctgcgcatcgacatccagctgctcggcgccccttgacctgacggccaaccagaggaaatggatgcaaagaatgcagtcccgaaagtcacacggaggagatggtgatcactaagctttgtgttcatcagtgccttgttaccggctggagaatggctctgatcggacgctcgcagaacctgcacccccaagcatcaaacgcagttctgtatgcctgctctgtaaccatcgaatgcaaacctccagcaatgcggcatgcagaactattttggtcgatcacgagtacgcttcaaatgttcttttgttgtattgtgttgcgtactttttgaggtctgtgctttctgcatgtatgtagaggaacctgcttgactgttagtattacagtttcatcttcaggcgccc

SEQ ID NO: 10389 - protein, 241 aa, Panicum virgatum
  misc_feature: Ceres CLONE 1724204
  misc_feature (107)..(188): Pfam Name: YGGT Pfam Description: YGGT family
MASPNADPPPHHASTPPLLLAVRHIPFPGVHRPRALPAPDVLAPLARRLEELAAAAAAHPLLKPLFAVHSHLSSFSESRRRLVAARRDTLLSGEHCFAAVLGDSVAGMVVANGINNFLSLYNTVLVVRLVLTWFPNTPPAIVAPLSTICDPYLNIFRGIIPPLGGTLDLSPILAFLVLNAFTSTAAALPAELPDPAAAPQHHRQSCASTSSCSAPLDLTANQRKWMQRMQSRKSHGGDGDH

SEQ ID NO: 10390 - DNA, 1351 bp, Panicum virgatum
  misc_feature: Ceres CLONE 1724208
  misc_feature: Encodes the peptide sequence at SEQ ID NO. 10391
actttcctcttcctcgacgcatcaaagcatcatggctctgctcgcgtttcagcaagagaaccttgcaagcttgatcgcttccaggatcatcgccgagctacatcggcaatatgctttcgactgcggatttcctgaaatcgagggtagcgcctatgtctatgagaagttagccttctctgctttaacgattgtgtatggagtcggttgtattcctgcaaagccccagtggaagtcatctgaagttgtgaaggcctatgaatcccgtatcatggaaggcgttagcgagatcttcgttgttcgtgaaaaaagagttccatctcaagttcatgaaaaaagtgtggagttaactggaggaataactcttgctgacaagacgcataggttactctgttgtacacaaaaagaaaaccttgatgagcatcacggaattgattggcagacacgctacaaaataattcaggggatttgcgagggtttggcatacctccatacgcaactggaacatcttatttgtcatggtgatgtaaaaccggacaatatattgctggatgcaaatatggtgccgaaaatcgcagattttggcctgtcacggtgcttcggggaagaactagcacgaaacatgacaaattgtataggaacacaggggtacgaagcgccagagatgaacggaaagaaaatctcatatttgtctgacatataccgtttgggtctcatagtccttagtatattgaagattacatggtggtggcaagagatgtggattatgctcgagtcatcttccaaacaaatgaagagattaaaccaaatagctttaagctgtctggaaacaggcaaatccacaaaggttacgagaagcactgcttcttcaacgcaacgggctgcggatgatatcaacgtcccggattctggtgttcgcatcggcgccacagttgacgtccccaaaatgaaaccttccccggattgtattaacatggtcaaggcaccatcaactcctgaagattcagtggtccttgtgcttgactccggaagcagtaaattagctcaaacaccatctatgcatcgacacctcagccatagtaacctgacagatgaacggagcaataaaccactctctaatagagctccagcaaccaattcgtcagacgacacaacacgcgctccagtggaacctaataagcttactgacgatgcagctcacaggtagctttttttactataccttccaacgttttcgatcgttccattccttgccgtctcgagtccaatccgaaggtatacaactgaaacttgcccttgtttcagtaatcttccactaagcttgagaaaagaaggaaacaactttgtgctgatc

SEQ ID NO: 10391 - protein, 390 aa, Panicum virgatum
  misc_feature: Ceres CLONE 1724208
  misc_feature (67)..(287): Pfam Name: Pkinase Pfam Description: Protein kinase domain
  misc_feature: SWISSPROT Homolog: EC 2.7.11.1 Non-specific serine/threonine protein kinase
MALLAFQQENLASLIASRIIAELHRQYAFDCGFPEIEGSAYVYEKLAFSALTIVYGVGCIPAKPQWKSSEVVKAYESRIMEGVSEIFVVREKRVPSQVHEKSVELTGGITLADKTHRLLCCTQKENLDEHHGIDWQTRYKIIQGICEGLAYLHTQLEHLICHGDVKPDNILLDANMVPKIADFGLSRCFGEELARNMTNCIGTQGYEAPEMNGKKISYLSDIYRLGLIVLSILKITWWWQEMWIMLESSSKQMKRLNQIALSCLETGKSTKVTRSTASSTQRAADDINVPDSGVRIGATVDVPKMKPSPDCINMVKAPSTPEDSVVLVLDSGSSKLAQTPSMHRHLSHSNLTDERSNKPLSNRAPATNSSDDTTRAPVEPNKLTDDAAHR

SEQ ID NO: 10392 - DNA, 1025 bp, Panicum virgatum
  misc_feature: Ceres CLONE 1724217
  misc_feature: Encodes the peptide sequence at SEQ ID NO. 10393
atcccaagcacgtttctttctgatcccaaatgaaatctccagcccgcgccgcctgatcccagagctcgtcgcctctttctcctcagctccacacctcgctcgccctcgcgcgcgccggacgcaccagccgcagagatggccgccctcgccgcctcctccacggccgccttcgccgccaagccgcgcctgccccgcgcgcgcctctccgtggcctgctccgcgaccggcggccccggcagcagcagcagcagcagcagcagcagtgtctcgctcgcctcctccgtcaagaccttctcggccgcgctggcgctgtcgtcggtgatcctctcctcggccgccacctcccctccgcccgcggccgccgacatcgccggcctcaccccgtgcaaggagtccaaggccttcgccaagcgcgagaagaactcgatcaagaagctcaccgcctcgctcaacaagtacgcccccgacagcgcccccgcgctcgccatcaacgccaccatcgagaagaccaagcgccgcttcgagaactacggcaagttcggcctgctctgcggcgccgacggcctgccgcacctcatcgtcagcggcgaccagcggcactggggcgagttcatcaccccgggcctgctcttcctctacatcgccgggtggatcgggtgggtcggcaggagctacctcatcgccatcagcggcgagaagaagcccgccatgagggagatcatcatcgacgtcgagctcgccacaaggctcctccccagggggttcatctggcccgtcgcagcctaccgcgagctcatcaacggagacctcgtcgtcgacgacaaggacatcggctactactaagctagcgcacctgcatggctgctggcgaccggcgagttgggcagcgactgcgtcggggaagatggcttgtggtgtaggagctgataggatgatgggggaatggaagctctgctgtacttaagaaactggacgaagccttgtataactgtacctctcgatctcttgtgtgtattcaccttctt

SEQ ID NO: 10393 - protein, 235 aa, Panicum virgatum
  misc_feature: Ceres CLONE 1724217
  misc_feature (52)..(230): Pfam Name: PSI_PsaF Pfam Description: Photosystem I reaction centre subunit III
MAALAASSTAAFAAKPRLPRARLSVACSATGGPGSSSSSSSSSVSLASSVKTFSAALALSSVILSSAATSPPPAAADIAGLTPCKESKAFAKREKNSIKKLTASLNKYAPDSAPALAINATIEKTKRRFENYGKFGLLCGADGLPHLIVSGDQRHWGEFITPGLLFLYIAGWIGWVGRSYLIAISGEKKPAMREIIIDVELATRLLPRGFIWPVAAYRELINGDLVVDDKDIGYY

SEQ ID NO: 10394 - DNA, 776 bp, Panicum virgatum
  misc_feature: Ceres CLONE 1724232
  misc_feature: Encodes the peptide sequence at SEQ ID NO. 10395
ctcgtgtcgcgcaccaacttccaattcctcctcccacctccgccttcgccgtcgagatctcgcgcgcccgagctcgagctcggcctcggccccgcgcccgccgctatggcgacgcggaaccggacgccgctctaccgcaagtaccgcgacgcgctgcgccacgtccgctcgccggccggggcgccgtcgtcgtccggcgcgggcgggggaggaggcggcggcggcggcgggccggtgatcgagatggcctcgctgctgcgctccgaccgcacctacgcgcccctcagcacggacgacccctccgcctccagtagaggtgccgtgacggtcgggctgcccccagcctgggttgatgtttccgaagagatatctgcaaacatgcagcgggcaaggatgaaaatgggggagttggctaaggcacatgccaaagccttgatgccatcattcggcgatggcagagacgaccagcgagcaatcgaggttctcacacatgagataacagatttgctgaagaggtcggagaagaggctgcagaagctgtccatgaaagattcatcggaggattcaaatgtccgaaagaatgtccagcgctctcttgctacagacctgcaaaacctctcaatggagttccgtaaaaaacagtcaacttatctaaagcagcttcgccaacaaaaagagggtcaggatggtgttgacttggaaatgaatataaatgggacaaagtctacatttgaagacgatgagtttgaggatgtgggtttcactgaggttcagat

SEQ ID NO: 10395 - protein, 223 aa, Panicum virgatum
  misc_feature: Ceres CLONE 1724232
  misc_feature (77)..(173): Pfam Name: Syntaxin Pfam Description: Syntaxin
MATRNRTPLYRKYRDALRHVRSPAGAPSSSGAGGGGGGGGGGPVIEMASLLRSDRTYAPLSTDDPSASSRGAVTVGLPPAWVDVSEEISANMQRARMKMGELAKAHAKALMPSFGDGRDDQRAIEVLTHEITDLLKRSEKRLQKLSMKDSSEDSNVRKNVQRSLATDLQNLSMEFRKKQSTYLKQLRQQKEGQDGVDLEMNINGTKSTFEDDEFEDVGFTEVQ

SEQ ID NO: 10396 - DNA, 737 bp, Panicum virgatum
  misc_feature: Ceres CLONE 1724232-R
  misc_feature: Encodes the peptide sequence at SEQ ID NO. 10397
ctgagggtcagatgtcaaaactcaagaaaagcgaagcgttcaccagagaaagggagagagaaatcgaacaggttgtcgaatcagtcaatgagcttgcacagatcatgaaggatctttcagttctcgtgattgatcagggaactatcattgatcggatagactacaatatacagaacgttgcagcttctgttgaggagggttacaaacaattgcaaaaggctgagaggacgcagaagaaagggggcatggtgatgtgtgccactgtccttgtcattctgatcttcatcatgatcgtccttctgattttgaagaagatcattttctgacatacatagctatctctttttttatggttgatggacggcatccaagctcatctactccttattcgagtgaggattacacagtgccctgcatattgggaacgccgcagttcgtttcaatagcgcaatacgacttactgatctgaagatggttcttctgcccatatccataatggctgggtcagcaactgtcctcagtcctcgccacaattttttgcagcgctgcagatgtagagatgtcatattcatacatgcctcattttttgggagaaaaaaaatgtgaagagttgtgtttgacacatttcaccttcctgattgtcttggagcaaccaggttaggtttgtgtacgccctgtatagtgagttgtatcatccagttctcttaaatcaaaaagtagctttagttcctgttcag

SEQ ID NO: 10397 - protein, 107 aa, Panicum virgatum
  misc_feature: Ceres CLONE 1724232-R
  misc_feature (16)..(78): Pfam Name: SNARE Pfam Description: SNARE domain
EGQMSKLKKSEAFTREREREIEQVVESVNELAQIMKDLSVLVIDQGTIIDRIDYNIQNVAASVEEGYKQLQKAERTQKKGGMVMCATVLVILIFIMIVLLILKKIIF

SEQ ID NO: 10398 - DNA, 1057 bp, Panicum virgatum
  misc_feature: Ceres CLONE 1724236
  misc_feature: Encodes the peptide sequence at SEQ ID NO. 10399
gcaagccagaagctgctgcagcatccatccatccttcccatcctgctctcgagctccaagcctcaaacccgtccgcgcctgctcaggctcagctagccggggacgaattaaccgagcagcatccatggcggccgtgttggtggcgaggcaggggcgcgagctgcagcgctacagccagcgcaccggcgggcgcatcgtggtggggtgcatcccgtaccgcgtgcggtgcgacggcgagctggaggtgctggtgatcacgtcgcagaaggggcacggcatgatgttccccaagggcgggtgggaggaggacgagtccatggacgaggccgcccggcgcgaggccctcgaggaggccggcgtcctcggcgacaccgagccggtgctcggcttctggcactacaagagccgccgctacgtcgaccagacctacgagggcttcatgttcccgctccgcgtcgccgacgagctccaccagtggcccgagatggcctcccgcaagcgcacctgggcaacggtgaaccaggtgatggacgggtgcccgcacttgtggatgcgggaggcactcgagaagctcgtcgcccggcacgccatggccatgctgcagtccgctctctgatctggagagaggacctcgcggccggcgtactccctcgagaaaggatcggcagcacgaacccaagctagcacgcgtcgtcacggctcccacggtgcagcggcaggccagccggcgttccggcgctcggatttggtcgccctcaccggagagacggcggcgcggagcgcggggtggatgctggcggcgctttcttgactcctcccgagacgcggagtcgtcgttgcgcggttgcggcagatttaaaaaaataatctcagcgagcaaatcattggaccaaatgtaaacaaaaccaaacaggacacatcatactagcgaacgagcgaacagcagcgcggaacaatccacgattatttggagtcagtgacagaaaaagaaagtgtaaattagtgctaataacttcgtttcttggtgccagaatttgaatgaaacatctgttcaggc

SEQ ID NO: 10399 - protein, 163 aa, Panicum virgatum
  misc_feature: Ceres CLONE 1724236
  misc_feature (22)..(153): Pfam Name: NUDIX Pfam Description: NUDIX domain
  misc_feature: SWISSPROT Homolog: EC 3.6.1.52 Diphosphoinositol-polyphosphate diphosphatase
MAAVLVARQGRELQRYSQRTGGRIVVGCIPYRVRCDGELEVLVITSQKGHGMMFPKGGWEEDESMDEAARREALEEAGVLGDTEPVLGFWHYKSRRYVDQTYEGFMFPLRVADELHQWPEMASRKRTWATVNQVMDGCPHLWMREALEKLVARHAMAMLQSAL

SEQ ID NO: 10400 - DNA, 1042 bp, Panicum virgatum
  misc_feature: Ceres CLONE 1724254
  misc_feature: Encodes the peptide sequence at SEQ ID NO. 10401
gcaatctcccccctccactcattgcgtcgccgttgccgttggcaagcagcagcatcgcaggaaaggaacaaggggggccagggccgcgaggcgaggagggtgggcaggaaggaagaagagggtcggggagcgatggggctgggcgtgcgggcggcgcccttcacgtacgtggcgcacgcgctggccgtcgcggcggcggtcatggtgctggtctgggccatccacttccgcggagggctcgccatcgaggccaccaacaagaacctcatcttcaacgttcatcctgttcttatgctgattggatatattattatcggcagtgaagctataatggtatacaaggtatttccaacgttgaaacatgacacggctaagcttgtccatctcatcctacatggcatcgcacttgtccttggtgcggttggaatatactttgctttcaaaaatcacaatgaaagtgggattgccaacctttacagtctgcattcttggcttgggatcggaacaattactttgtatggtattcagtggatatttggatttgttacattcttcttccctggtgctgcaccaaacttgaggaggagcctccttccttggcacattctgtttgggctattcgtctacatcttagcactggctaatgcagaactcggctttctggagaagctcacttttctcgagagctcaggcctcgacaaatatggcaccgaggcattcttggtaaacttcacagcattggttgtcgtgttatttggtgcttctgttgtggtagctgctgtagctccggctcgcctggaagaaccacagggttatgctccaatcccagaaaactagtacgaatgatgtgtacagcatatacagtcgacaggattggctgttaccatagggagacaagatattcgtatctctttattaaaataaaaaaggtaccgggaatcgtcacaataagaagataatgcatgttcattgtgtgtgtatatacattctgtgatactcaaaatttcagtataatatatgcaagagtgatatcctgcttggc

SEQ ID NO: 10401 - protein, 234 aa, Panicum virgatum
  misc_feature: Ceres CLONE 1724254
  misc_feature (11)..(226): Pfam Name: Cytochrom_B561 Pfam Description: Cytochrome b561
MGLGVRAAPFTYVAHALAVAAAVMVLVWAIHFRGGLAIEATNKNLIFNVHPVLMLIGYIIIGSEAIMVYKVFPTLKHDTAKLVHLILHGIALVLGAVGIYFAFKNHNESGIANLYSLHSWLGIGTITLYGIQWIFGFVTFFFPGAAPNLRRSLLPWHILFGLFVYILALANAELGFLEKLTFLESSGLDKYGTEAFLVNFTALVVVLFGASVVVAAVAPARLEEPQGYAPIPEN

SEQ ID NO: 10402 - DNA, 1137 bp, Panicum virgatum
  misc_feature: Ceres CLONE 1724255
  misc_feature: Encodes the peptide sequence at SEQ ID NO. 10403
agtgcggctcctcccctcttcacattccgccctcgcagacccgcgcctgaaacccttgcgcccaccgccgccgccgcctcccacccgaaatccgcttcgccggtgcgcgcttgtagttgagggaactgctgcttccgtgaacaccggtcgaccatggcgacccgtattcagtttgagaacaattgtgaagttggtgttttttctaagctaacaaatgcctactgcctggtcgcaattggagggtcagagaacttctacagtgcatttgagtctgagcttgcagattccattcccgtggtcaagacctctataagtggcaccagaataatcggccgactctgtgttggaaacaagaatggacttctattgccacataccaccactgaccaagagctgcagcatctgaggaactgcttgcctgatcaagtggttatacagcgtattgatgagaggttatcagcccttggcaattgcatagcctgcaatgatcatgttgcacttacacatcctgacctcgacaaggagacggaggagtttattgcagatgtgcttggagttgaggtattcaggcagactattgctggaaatatcctcgtggggagctactgcgcattctctaacaggggtggcttggttcatcctcacacatccattgaagaccttgatgagctctccacactcttgcaagtcccgctcgtggctggaaccgtgaacagaggcagcgaggtcattgctgcaggaatgactgtgaacgactggacagcattctgtggctcagacacgacggccaccgagctctcggtcattgagagcgtcttcaagctgagagaagggcagcccacagcgattgtcgatgacatgaggaagtctctgatcgacagttatgtgtaggcagatctcaagcattacctgtgccaagatgcactgcgagctatacttgtgttatctgtagtaaaaccaaagcgtaccctctgacaacctacatttggtggtttatccttggcatttgaatctgagactcgaggttttaccatgttcctttaaggctcatggtatgctagtaagaagataatgcttctgttcgttgttatatgatgtttgagcatggagttatgggagtatggacacatttggctc

SEQ ID NO: 10403 - protein, 245 aa, Panicum virgatum
  misc_feature: Ceres CLONE 1724255
  misc_feature (3)..(204): Pfam Name: eIF-6 Pfam Description: eIF-6 family
MATRIQFENNCEVGVFSKLTNAYCLVAIGGSENFYSAFESELADSIPVVKTSISGTRIIGRLCVGNKNGLLLPHTTTDQELQHLRNCLPDQVVIQRIDERLSALGNCIACNDHVALTHPDLDKETEEFIADVLGVEVFRQTIAGNILVGSYCAFSNRGGLVHPHTSIEDLDELSTLLQVPLVAGTVNRGSEVIAAGMTVNDWTAFCGSDTTATELSVIESVFKLREGQPTAIVDDMRKSLIDSYV

SEQ ID NO: 10404 - DNA, 1221 bp, Panicum virgatum
  misc_feature: Ceres CLONE 1724260
  misc_feature: Encodes the peptide sequence at SEQ ID NO. 10405
acagagcaccagaccatctcagctttgcttctcagctagctagctttaggctccggttgcagcgagaagcaggcaggcaggcatggaggggaaggaggaggacgtccgcctgggcgccaacaagttctccgagcgccagcccatcggcacggcggcgcagggcaccgatgacaaggactacaaggagcccccgccggcgccgctcttcgagcccggggagctcaagtcctggtccttctaccgcgccggcatcgctgagttcgtcgccaccttcctcttcctctacatcagcatcctcaccgtcatgggcgtcagcaattcccaatccaagtgcgccaccgtcggcatccagggcatcgcctggtccttcggcggcatgatcttcgccctcgtctactgcaccgccggcatctccggcggccacatcaacccggcggtgaccttcggcctgttcctggcgaggaagctgtcgctcaccagggccatcttctacatcgtcatgcagtgcctgggcgccatctgcggcgccggcgtcgtcaagggcttccagaagggactgtacatgggcaacggcggcggcgccaacgtcgtcgcccccggctacaccaagggcgacggcctcggcgctgagatcgtcggcaccttcatcctcgtctacaccgtcttctccgccaccgacgccaagaggaacgccagggactcccacgtcccgatccttgctcccctcccaattgggttcgccgtgttcctggtccacctggccaccatccccatcaccggcaccggcatcaacccggcaaggagccttggcgctgccatcatctacaacagggaccatgcctggaatgaccactggatcttctgggtcggccccttcatcggcgctgccctggccgccatctaccaccaggtgatcatcagggcgatcccgttcaagagcaggtcctaagctgctgctgctgtgagatgccagtcctgacaggcaagcttgcttcggatggggtggtcgtctccaatccctaccgtgcgctgtggagttccatttctcttcaagtttgatgtactgttcctgcaaacttattcaaaaaaaagttcgatgtactgcactatgtttatctgaacccggacttgtaatttcagtacccaattgtgtaatacgccgctagtgtcatgtgaagatttaagttaatgagacggccaagagttccatgttccaagttc

SEQ ID NO: 10405 - protein, 288 aa, Panicum virgatum
  misc_feature: Ceres CLONE 1724260
  misc_feature (46)..(275): Pfam Name: MIP Pfam Description: Major intrinsic protein
  misc_feature: Functional homolog of the protein sequence given in SEQ ID NO 50195
  misc_feature: Useful for making plants with modulated water use efficiency
  misc_feature: Functional homolog of the protein sequence given in SEQ ID NO 50196
  misc_feature: Useful for making plants with modulated drought sensitivity
  misc_feature: Functional homolog of the protein sequence given in SEQ ID NO 50197
  misc_feature: Useful for making plants with modulated cold sensitivity
MEGKEEDVRLGANKFSERQPIGTAAQGTDDKDYKEPPPAPLFEPGELKSWSFYRAGIAEFVATFLFLYISILTVMGVSNSQSKCATVGIQGIAWSFGGMIFALVYCTAGISGGHINPAVTFGLFLARKLSLTRAIFYIVMQCLGAICGAGVVKGFQKGLYMGNGGGANVVAPGYTKGDGLGAEIVGTFILVYTVFSATDAKRNARDSHVPILAPLPIGFAVFLVHLATIPITGTGINPARSLGAAIIYNRDHAWNDHWIFWVGPFIGAALAAIYHQVIIRAIPFKSRS

SEQ ID NO: 10406 - DNA, 975 bp, Panicum virgatum
  misc_feature: Ceres CLONE 1724291
  misc_feature: Encodes the peptide sequence at SEQ ID NO. 10407
atttttcaaaaaaaagagtgcccagtgccctgcagacttcatgttttccgtgtttatttttgcgtgcagatgatccggacaacaagcccaaaagcggtagtccatgtacgctgcggaattgggggtagctcaaggtacctggccaagaaatacggagcacagtgcaagggcatcacgctgagccccgttcaagctgaaagaggaaacgctctcgccgctgcgcaggggttgtcggatcaggtttctctgcaagttgctgatgctctggagcaaccgtttcctgatggacagttcgatcttgtgtggtccatggagagtggcgagcacatgccagacaagagcaagtttgttagtgagctggcacgcgtggcggctcctggagggacaataatcatcatgacatggwgccatcggaacctggagccatctgaaacctccctgaaaccggatgaactgaacctcctcaagaggatttgcgatgcgtactaccttcctgactggwgctcaccctcakactatgtgagcatyrscaagggtstgtctcttgaggatgtcaaaacagccgattggtcggagaacgtggccccattctggccggctgggattaaatcggctctgacatggaagggcatcacctctctcctaacgagcggatggaagaggatcagaggggcgatggtgatgccgctgatgatccaggggtacaagaaggggctcatcaagttcaccatcatcacctgtcgcaagccgggagcagcgtaggaggtcaagtgatcgtcgcggtgcctaatgtaatatgttccgggcaataacgtagaaccaaatacctatcaatggcgaggtagaagacgccccgtcgccgtcttctctctgcacgcgcacgtttggccatgtgccccgttccaaataattttctctaccactcgtcgagatggcagatttcaaattgacgcctccacgagcctgtcgtttgct

SEQ ID NO: 10407 - protein, 253 aa, Panicum virgatum
  misc_feature: Ceres CLONE 1724291
  misc_feature (34)..(132): Pfam Name: Methyltransf_11 Pfam Description: Methyltransferase domain
  misc_feature: SWISSPROT Homolog: EC 2.1.1.95 Tocopherol O-methyltransferase
  misc_feature: The sequence is a functional homolog of SEQ ID NO 22 in US patent 7226745
  misc_feature: The sequence is a functional homolog of SEQ ID NO 36 in US patent 7244877
  misc_feature: Functional homolog of the protein sequence given in SEQ ID NO 50201
  misc_feature: Useful for making plants with modulated nitrogen use efficiency
  misc_feature (136)..(136): Xaa is any aa, unknown, or other
  misc_feature (168)..(168): Xaa is any aa, unknown, or other
  misc_feature (172)..(172): Xaa is any aa, unknown, or other
  misc_feature (177)..(177): Xaa is any aa, unknown, or other
  misc_feature (180)..(180): Xaa is any aa, unknown, or other
IFQKKECPVPCRLHVFRVYFCVQMIRTTSPKAVVHVRCGIGGSSRYLAKKYGAQCKGITLSPVQAERGNALAAAQGLSDQVSLQVADALEQPFPDGQFDLVWSMESGEHMPDKSKFVSELARVAAPGGTIIIMTWXHRNLEPSETSLKPDELNLLKRICDAYYLPDWXSPSXYVSIXKGXSLEDVKTADWSENVAPFWPAGIKSALTWKGITSLLTSGWKRIRGAMVMPLMIQGYKKGLIKFTIITCRKPGAA

SEQ ID NO: 10408 - DNA, 1128 bp, Panicum virgatum
  misc_feature: Ceres CLONE 1724295
  misc_feature: Encodes the peptide sequence at SEQ ID NO. 10409
gcggagagggagagagaggcgaaaagcaggcaggagcttgttgctggtgttgctcgtacgcgtccggagagcgaagggaagggtgcgagcgagcgagcgagcggtggccatggcggagcagcacaaggaggagtcggtgctggagaagatctcggacaagctccacggccgcgggggcggcggctcgtcgtcgtcggactcggacgacgatcgctcgtcggcgacggccgcggtgaaagccaagatctaccgcctcttcggccgcgagaagcccgtccactccgtcctcggcggcggcaagcctgccgatctgtttctatggaggaacaagaagatttctggtggtgtgcttgctggcgcaactgccatctggctgctgtttgaggtcatggactaccacctgctcaccctgttatgccactgcctcatcctcaccctggccatcctgttcctctggtcgaatgccaccactttcatcaacaagtctcctcctaacatccctgtggtgaagatcccagaggacctggcagtgaatgttgcacgttcactgagatacgagatcaacaggggctttgctaccttgagggagatcggtcagggccatgacctgaagaagtttctgattgtaattgcaggactgtggatcctttccgttcttgggacctgctgcaatttcctcaccttgttctacatagtctttatggttttgtacactgtgccggtcctgtatgagaagtatgaggataaggttgatgcttttggagagaaggccatggtcgagctgaagaagtactacgccatcttcgacgagaaatgcctatcaaagattccgaagggtccgtcaaaagacaagaagctgcattagaagagtagaatcagaggatggtctgtgcactgatttatcatctgtcaatcactacatgtcggttttgaagtatggttgtaattccatgtctccatgtaatggtaaatatttagagatgaacgcacgtgttccagtgtggtcagtagttgcgttgtgcgaaattattccaatctggaacttaatgttttaacatcccgcctctccaagtggctggttccgttacatggccagacttagggttatgatgaaatttttatttggtt

SEQ ID NO: 10409 - protein, 251 aa, Panicum virgatum
  misc_feature: Ceres CLONE 1724295
  misc_feature (65)..(248): Pfam Name: Reticulon Pfam Description: Reticulon
MAEQHKEESVLEKISDKLHGRGGGGSSSSDSDDDRSSATAAVKAKIYRLFGREKPVHSVLGGGKPADLFLWRNKKISGGVLAGATAIWLLFEVMDYHLLTLLCHCLILTLAILFLWSNATTFINKSPPNIPVVKIPEDLAVNVARSLRYEINRGFATLREIGQGHDLKKFLIVIAGLWILSVLGTCCNFLTLFYIVFMVLYTVPVLYEKYEDKVDAFGEKAMVELKKYYAIFDEKCLSKIPKGPSKDKKLH

SEQ ID NO: 10410 - DNA, 1245 bp, Panicum virgatum
  misc_feature: Ceres CLONE 1724305
  misc_feature: Encodes the peptide sequence at SEQ ID NO. 10411
atatttgaaaaagaaagtgttcagatcatgcatgatgggttcttcctctctgcttggacaggaagtacaagctgggcgtcatcatcgacctgcacgcagctcccgggtcccagaacccctgggagcacagctcctccagagacggtacgcaggagtggggaacaaccgacgccaacatcgcacagaccgtgcaagtcatcgaattcctcgcatccaggtacgcgacgagcccgagcctgttcgcggtggagctgatgaacgagccgctggcgccccgggcgacgctggacagcctgaccaggtactaccgcgacggctacgacgccgtgaggaggcactcgccggcggcgtacgtggtgatgtcgaaccggctgtcgtcggggaacgcgacggagctcctccagttcgccggcgggctccggggggcggtcatcgacgtgcactactacaccatgttcaacagcatgttcagcaacttcaccgtgcagcagaacatcgacttcgtcaggaccaacttctccggcgagctcgccgccatcaccacccagaacgggccgctcaccttcgtaggtaagcgaggagcacctccggatccttctacctagtaccactttttttaaaaaaaaaaagtacgaaaagattgttgggggagctggcttcttgttctctgtgaaattcatgcgttttgtttggtaaattaaggagaatgggttgcagagtggaaggtgccgaacgcgaccaaggaagagtaccagaagtacgcggcggcgcagatgagtgtgtacgggcaggccacgtttggatggtcctactggactgtcaagaacgccaacaaccactgggatctggagtggatgatcaaaaatggatacatctcgttgaaaggctagggctgaaaccaatgctaggaaagtgatgattgatctataagtaagtgtgaaggcgagtcagttcgtgttagattggggaatcccgtccctgttgacatcagaacagctgaacaggcttggatggtttggagggcaaaagttcagtgcccatggctttgtaaaattgataccatgataggattatgtatctaagacctcgcggcaacatttaaccgcccatagaaaccatcgtatctgcattcgttaaaaaaaagagtaaattgcaccgaccatacaacttgtcaggtgggtgcaaattggtccaacaacttgtaaaatgctcaatttagtacaataacttgacaggtgggtgcag

SEQ ID NO: 10411 - protein, 116 aa, Panicum virgatum
  misc_feature: Ceres CLONE 1724305
  misc_feature: SWISSPROT Homolog: EC 3.2.1.58 Glucan 1,3-beta-glucosidase
MNEPLAPRATLDSLTRYYRDGYDAVRRHSPAAYVVMSNRLSSGNATELLQFAGGLRGAVIDVHYYTMFNSMFSNFTVQQNIDFVRTNFSGELAAITTQNGPLTFVGKRGAPPDPST

SEQ ID NO: 10412 - DNA, 1123 bp, Panicum virgatum
  misc_feature: Ceres CLONE 1724307
  misc_feature: Encodes the peptide sequence at SEQ ID NO. 10413
tgttcccagcgcatcgggagaaaaaattcttctcgtctcttcttcccgcagtccggattcccaaccaggttccagagaaaccccccgtccgattcgcgagatggcggagcagcccaacccccagccccaagtggaggagaaggaggtggtggtggagcagcaggaggaggagccgaagaggggccccaagctgaggtacctggatttcgtccatgtggcggcggcgcaggccgcggtgtgcctcgcggggctctacgggctcgccaagggccacgccggcccgctccgccccggcgtcgacgccgtcgagtccgcggtgaagggcctcgtcggccccgtctacgaccgcttccacagcgtgcccctcgacatcctcgccttcgtcgaccgcaaggtggacgacaccgtgcacgggctggacaagcacctccctggcgcgttgaaggcctcgtcggcgcaggcctacgcggtggcccgcggcattccggaggtggcccgcgagctggccgccgaggcgcagcagtccggcgtgaagagcgcggcccgcgcggcgctggccaaggtggagcccgtggccaaggacgtgtacgggcgcgttgagccggtggccacggacctgtacgtgcgctacgagcccgcggcggagcacctcgccgtctccacctggcgctcgctcaacggcctcccggtgttcccgcaggtcgcgcagatcgtcgtgcccaccgccgcgtactgggccgagaagtacaacaaggttatcgccgccgcggccaaccagggctacaccggagccaagtacctcccggccatccccaccgagcgcatcgccaaggtgttctcttcgtcgacgccggagtcggagccgttggccgagacccagtagtgagtagtgtgttggtgccttcagcgcgttagcattaccccctggttttccctccaactgaactgaataagacagtgagaatccggggggctaaagatggtggtaatgttgtgctagatatggtgatggggcgctgtctcagggaccatgatgatgttgctgtactccagtagtccactagctctgctttgtgtggtgcactgcgtcttgctttttgtataaaatttcgttcgatgtcgc

SEQ ID NO: 10413 - protein, 260 aa, Panicum virgatum
  misc_feature: Ceres CLONE 1724307
  misc_feature (17)..(250): Pfam Name: REF Pfam Description: Rubber elongation factor protein (REF)
MAEQPNPQPQVEEKEVVVEQQEEEPKRGPKLRYLDFVHVAAAQAAVCLAGLYGLAKGHAGPLRPGVDAVESAVKGLVGPVYDRFHSVPLDILAFVDRKVDDTVHGLDKHLPGALKASSAQAYAVARGIPEVARELAAEAQQSGVKSAARAALAKVEPVAKDVYGRVEPVATDLYVRYEPAAEHLAVSTWRSLNGLPVFPQVAQIVVPTAAYWAEKYNKVIAAAANQGYTGAKYLPAIPTERIAKVFSSSTPESEPLAETQ

SEQ ID NO: 10414 - DNA, 1179 bp, Panicum virgatum
  misc_feature: Ceres CLONE 1724322
  misc_feature: Encodes the peptide sequence at SEQ ID NO. 10415
ctctcgcccgccagcagaagcagccgccgccgccgcttcgacagccaccgcagggtaccgagatgggtggttttgtcaagacccagaagaccagtgcgtactccaagcgtttccaagtgaagttcaagagaaggcgtgctggcaagacggactacagggcaaggatcaggttgatcaaccaagacaagaacaagtacaatacgcccaaatacagatttgttgtgcgatttaccaacaaggacatcactgcacaaatcgtatctgcaagtattgcgggtgatatggtacttgctgctgcctactcccatgagcttccacgatatggtcttgaagttggtctgaccaactatgctgcagcctactgcactgggcttcttttggcccgtcgtgtgctcaagcttcgtgatttggatcaggagtatgagggcaacgttgaggccactggtgaggacttctctgttgagccagatgatgagaggaggcctttccgtgctcttttggatgttggccttgttaggactaccactggaaaccgtgtctttggtgccctgaagggagctttggatggtggtctagatattcctcatagtgacaagaggtttgctggtttcaagaaggatgaaaagcagctggatgctgaggtccaccgcaagtacatctatggtggccatgttgcagagtacatgaggactctggctgaggaggagccggagaagtaccaggctcacttcagtgactacatcaagaaggggattgaggctgatgacatggaagctttgtacaagaaggtccatgctgccatccgtgctgatcctaccatggccaagtcaaccaagcagccaccgaaggagcacaagaggtacaaccccaagaagctgacctatgagcagaggaaggccagccttgtcgaaaggcttaacgccctcaactcgtctggtggtgctgatgatgatgacgatgaggacgacgagtgaagtgtagtcccttcgtagtagtgctatcttatggggcgatcagaacttctgccatggcacttatcgttacctgtagtcctgcaacaggcatttttgtttaagtttgtcgtcgtgaacaaagctgttctattagttttgagctggagttatagatatttactcttatctaaaattaagatgctgccgtttgaacgtggttcttccg

SEQ ID NO: 10415 - protein, 303 aa, Panicum virgatum
  misc_feature: Ceres CLONE 1724322
  misc_feature (27)..(173): Pfam Name: Ribosomal_L18p Pfam Description: Ribosomal L18p/L5e family
MGGFVKTQKTSAYSKRFQVKFKRRRAGKTDYRARIRLINQDKNKYNTPKYRFVVRFTNKDITAQIVSASIAGDMVLAAAYSHELPRYGLEVGLTNYAAAYCTGLLLARRVLKLRDLDQEYEGNVEATGEDFSVEPDDERRPFRALLDVGLVRTTTGNRVFGALKGALDGGLDIPHSDKRFAGFKKDEKQLDAEVHRKYIYGGHVAEYMRTLAEEEPEKYQAHFSDYIKKGIEADDMEALYKKVHAAIRADPTMAKSTKQPPKEHKRYNPKKLTYEQRKASLVERLNALNSSGGADDDDDEDDE

SEQ ID NO: 10416 - DNA, 877 bp, Panicum virgatum
  misc_feature: Ceres CLONE 1724325
  misc_feature: Encodes the peptide sequence at SEQ ID NO. 10417
aatcctcctcccccgatccagccccgcagcgacgccgaggcagagcgagcgagaggagagaccgagatcgcgcgcggagatgtcgtcggactcgtcgtcgtgggcgcgcgccctggtgcagatctcgccctacaccttctccgccatcggcatcgccgtctccatcggcgtctccgtcctcggcgcggcatggggcatcttcatcacggggagcagcctcatcggggccgccatcaaggcgcccaggatcacatctaagaacctcatcagtgtcatcttctgtgaggctgtcgcaatttatggtgtaattgtggcaatcatcctccagacaaaacttgaaagtgtgccatcatctcaaatgcatgctccggagtctcttcgagctggctatgcaatctttgcatctggccttattgttggctttgctaatcttgtgtgcggggtttgcgtgggcataattggaagtagctgtgcactgtctgatgctcagaactcgtcgctctttgtaaagatcttggtaattgagatcttcggcagtgctctggggctgtttggagtcattgtgggcatcatcatgtcatctcaagcgacatggccggccaaagcttgattttccccactcaccactctgtaaattatttcgaatgaaatgtatccgaatgtcaagatgtggtcctactgcctttacctgtctctccctctctctctgttttttttcttttgcacctttttggaaaaatacttaattcggtgccctcagcgcaaccgattgtagagttaatattcctactgccgagactccatgtgtgctggatatcttgtaggtgctattgctgttgcaagacacttggcttattgaataaatgcattggaacgg

SEQ ID NO: 10417 - protein, 176 aa, Panicum virgatum
  misc_feature: Ceres CLONE 1724325
  misc_feature (20)..(85): Pfam Name: ATP-synt_C Pfam Description: ATP synthase subunit C
  misc_feature (104)..(169): Pfam Name: ATP-synt_C Pfam Description: ATP synthase subunit C
  misc_feature: SWISSPROT Homolog: EC 3.6.3.14 H(+)-transporting two-sector ATPase
MSSDSSSWARALVQISPYTFSAIGIAVSIGVSVLGAAWGIFITGSSLIGAAIKAPRITSKNLISVIFCEAVAIYGVIVAIILQTKLESVPSSQMHAPESLRAGYAIFASGLIVGFANLVCGVCVGIIGSSCALSDAQNSSLFVKILVIEIFGSALGLFGVIVGIIMSSQATWPAKA

SEQ ID NO: 10418 - DNA, 1317 bp, Panicum virgatum
  misc_feature: Ceres CLONE 1724326
  misc_feature: Encodes the peptide sequence at SEQ ID NO. 10419
acccctccgtcacccgccaccgcctcgcgtttgccaccggcgaccgagcgaggaggagactgcaatggcggccaccaccgcttcccgcctctcgccccctcgcttccacgtccgcccccggtctcctcatcctccacctcgccgctcgcgctactgccccgtccgcgccgccaagttggaagccgtgttgtctattggtactcatctaatcccacacccaagaaaggctgctagtggtggagaagatgctttctttaccaatagcgatgctggcggagtatttgcaattgctgatggtgtttcaggatgggcacaaaaggatgtcaatccagctctgttttctcgagagctcatgagaaacagctctagttttctcaaagatgaggaggtcaatggtgatcctcagatacttctcatgaaagctcatgctgcaacttcttcaattggatccgcaacagtaatcattgcggtgcttgagaagactgggactctaaaaattgcaagtgtgggagattgtggtttgaaagttattcgcaaaggccaagtaatgttttcaataccccctcaagaacactactttgactgtccataccagataagctccgaggcagctggtcagacatatcaggatgcactggtttgcagtgtaaatctcatggatggtgatatgattgtgagtggttcagatggactttttgacaatatctttgatcaagagattatttccataatttctgagtcatcaggagtagatgaagctgcgaaagcattggcagagcttgcaagaaaacattcagttgatgtcacatttgattcaccctacgcaatggaggcccggagtaggggttttgacgtcccatggtggaagaaggttcttggagcaaaactaataggcacacatcagctctttacaagatgccatgctctatattctacatagcaagatcaattagctcattggtgccaaaattttattactgtaggtggcaagatggatgacatcacagttgtcgtcgcccaagtgaagactgtagctgtcccagaagatgagggtggtgacatagaagaacagaaagggaacgagcaaagcattgctatttcagtttcgtctgctgaacaaaatgaagaatgatcaagagctagcttgagttctcaacctgccggcattttcactcaaatttctttttttccctgtgatggaccgatggtgtattgtacagttttgtgtgattgtgtggagaaattgggcatgtatgtacacctcccactcccagattgggtttaatatgaatgaaaatatgaagtcaatttcaattc

SEQ ID NO: 10419 - protein, 291 aa, Panicum virgatum
  misc_feature: Ceres CLONE 1724326
  misc_feature: SWISSPROT Homolog: EC 3.1.3.16 Phosphoprotein phosphatase
MAATTASRLSPPRFHVRPRSPHPPPRRSRYCPVRAAKLEAVLSIGTHLIPHPRKAASGGEDAFFTNSDAGGVFAIADGVSGWAQKDVNPALFSRELMRNSSSFLKDEEVNGDPQILLMKAHAATSSIGSATVIIAVLEKTGTLKIASVGDCGLKVIRKGQVMFSIPPQEHYFDCPYQISSEAAGQTYQDALVCSVNLMDGDMIVSGSDGLFDNIFDQEIISIISESSGVDEAAKALAELARKHSVDVTFDSPYAMEARSRGFDVPWWKKVLGAKLIGTHQLFTRCHALYST

SEQ ID NO: 10420 - DNA, 1414 bp, Panicum virgatum
  misc_feature: Ceres CLONE 1724333
  misc_feature: Encodes the peptide sequence at SEQ ID NO. 10421
accaccaggcaccactcgcctcctcatcgtcaagcgatccccgatccgcgacccgatcgccagcaagctcacactcggcgcttcctgcggcaacggtttcccctccggcgccgacgaacggcgagcctcggttcttgcagtgcagcggcggcttgcagcaatggcggaggcaggggagagcggcgggcgggcgcagctggtctcggagctggtccgcgtgcaggacctggtgcaccggctggagctgcagctgcgcgcgcccgcggacgccgcgtccgtcgacctctgccgccaactcatccaccagatcgtcgcgctcaccgaccgctccatcgggatggcccgctgctccccgaacctcgccgccgccgccgcgcactgcttgctccccgccgccgcgcagcagcagcagcagccgctgtccggcgcgcccagccccctgagcgacgccggctccgaccaccaccagccgttcctccgggccagccccaagaagcgcaaggccacggcgcgctggaccagccagcaggtgcgcgtcagcgccgccggcgccggcgccgagggccccgccgacgacggccacagctggcgcaagtacggccagaaggacatcctcggcgccaagcacccgcgcgcctactaccgctgcacccaccgcaactcgcagaactgcccggccaccaagcaggtgcagcgaaccgacgacgatcccagcctcttcgacgtcgtctaccacggcgaccacacctgccggccctccgccgcgcccaccaggaggacgccgcacaacccgcacgcgcaggccgcgctgcagggcctcgccgcccgcctcacggtgaccacggacgccgcgatcgccgccgccgccgcgctcccgccgatgacgcccgagcccgacagctgcccgccgcggggcgcgtcgtcgccgtggtcgctggcctcgccagtcggctccgactccaacggctgcgcgcaggccgtgtcgccgtgccccgtgcccgggtacgcggactggggctcccacggcgacctccaggaggtggtctcggcgtgcgccgccgtgtccgacctacagggactgccggcgctggacagcgagttcatgccgctcgagtgcttcgcgttcgaccagagcttcgacatgggcggcgtaatgccgagcctcttctatccatgaggagaacaagactagagccctgtccatgtctccatgacaggagggaagagcagaggagcctcctcttcctaacaactgtgcagtagcagaaaagcagcagagcttttagagtatctgaatagcatctctttgtttttgtttcactccccttcgttttgttttcactatcctccacttgttgggttggatttgttgatttcagtcagcaagagaaaaggaatcagaatttacttatgg

SEQ ID NO: 10421 - protein, 338 aa, Panicum virgatum
  misc_feature: Ceres CLONE 1724333
  misc_feature (137)..(199): Pfam Name: WRKY Pfam Description: WRKY DNA -binding domain
MAEAGESGGRAQLVSELVRVQDLVHRLELQLRAPADAASVDLCRQLIHQIVALTDRSIGMARCSPNLAAAAAHCLLPAAAQQQQQPLSGAPSPLSDAGSDHHQPFLRASPKKRKATARWTSQQVRVSAAGAGAEGPADDGHSWRKYGQKDILGAKHPRAYYRCTHRNSQNCPATKQVQRTDDDPSLFDVVYHGDHTCRPSAAPTRRTPHNPHAQAALQGLAARLTVTTDAAIAAAAALPPMTPEPDSCPPRGASSPWSLASPVGSDSNGCAQAVSPCPVPGYADWGSHGDLQEVVSACAAVSDLQGLPALDSEFMPLECFAFDQSFDMGGVMPSLFYP

SEQ ID NO: 10422 - DNA, 889 bp, Panicum virgatum
  misc_feature: Ceres CLONE 1724335
  misc_feature: Encodes the peptide sequence at SEQ ID NO. 10423
gaatgttcagaccgggacaggcaggcaggccgcttcactagcctgacggacggataggacacgagccgcgccgctggctgcgagcaatggaagctgcggcagggtcggagaagggtgccagcccgaggaatccggcggatgcagccgccgccgcggagaagggtgccagcccgaggaatccggcggatgcagccgccgccgccgccgccgccgccttcggcgaggagcaagaggcgctcgtgctcagcgcgtggaacgccatgaagggcgactcggcgttgcttgcgctcaagttcttcctgaggatctttgagatcgcgccgggcgccaagcagatgttccccttcctgcgcgacgccggcgacgcgcccctggagaaccaccccaagctcaaggcgcacgccgtggccgtcttcgtcatggcttgcgagtccgcgacgcagctgaggaacaccggcgacgtgaaggtgagggaggcggcgctgaagcggctgggcgcgacgcacgtcaaagccggcgtcgccgacgcgcacttcgaggtggtgaagacggcgctgctggacaccatccgggacgcggtcccggacatgtggacgccggagatgaaggcggcgtgggaggaggcctacgaccagctcgccgccgccatcaaggaggagatgaagaacgccgccgccgcctgagttcgtcgtgaagaccttaacactctgtcacacgcatcccctgctgctgcgaagaacgcgcgttgctggggagagcttggagctgccactgctgctggctgctgctactccacgaagatgtcgctactactagagtactagtccactactgtgttctgttttgtcaagtgccagccacgtcattgatgaataaaacttaattgtac

SEQ ID NO: 10423 - protein, 198 aa, Panicum virgatum
  misc_feature: Ceres CLONE 1724335
  misc_feature (48)..(158): Pfam Name: Globin Pfam Description: Globin
  misc_feature: SWISSPROT Homolog: EC 1.14.12.17 Nitric oxide dioxygenase
  misc_feature: Functional homolog of the protein sequence given in SEQ ID NO 50202
  misc_feature: Useful for making plants with modulated cold sensitivity
  misc_feature: Useful for making plants with modulated salt sensitivity
MEAAAGSEKGASPRNPADAAAAAEKGASPRNPADAAAAAAAAAFGEEQEALVLSAWNAMKGDSALLALKFFLRIFEIAPGAKQMFPFLRDAGDAPLENHPKLKAHAVAVFVMACESATQLRNTGDVKVREAALKRLGATHVKAGVADAHFEVVKTALLDTIRDAVPDMWTPEMKAAWEEAYDQLAAAIKEEMKNAAAA

SEQ ID NO: 10424 - DNA, 963 bp, Panicum virgatum
  misc_feature: Ceres CLONE 1724359
  misc_feature: Encodes the peptide sequence at SEQ ID NO. 10425
atcacaattattcatttctcgcatttgcagcccccacaaacccccgaaggaaggaagagaagagctcccgatggagaacgccgccgcgaagccgtcgctgtccaagaagccctcgccgtcattccgcctccggaacggcagcctcaacgcgctgcggctgcgccgcgtgttcgacctcttcgaccgcaacggggacggcgagatcaccctcgacgagatggcctcggcgctcgacgcgctcggcctcggcgccgaccgctccggcctggaggccgccgtcggggggtacatcccggccggcgctgcggggctccgcttcgacgacttcgagtccctccaccgcgcgctcggggacgcgctgttcggccccatcccggaggcggtgcccgaggaggaggacgaggagggggacatgaaggaggcgttccgcgtgttcgacgaggacggcgacggctacatctcggccgccgagctccaggccgtgctcaagaagctcggcctgcccgaggcgcggaacctcgccacggtgcaggagatgatctgcaacgtcgacagcgaccgcgacggccgcgtcgacttcggcgagttcaagaacatgatgcaggggatcaccgtgtggggcgcctagctgcagcgtccctgcgttgccaaccttctacagcgtgttgacatgttctgaagcatctaaagactggaggaggagcaaccacaagatcagtacttgtgcctcgttttaaagtactacgggttgtgttagtttggtagcttgggaattagtcatggtgtgcgtcgtctgaatgcagttgatgacttgtgatttcagtgtgttctaagctctaactgtggtgtttgcgtcctccactgatgtaggtactgtgcttctgtcgtgtctgatgtctcccttgctctaataagccatctgaacattagacatccagtttatttatcaactgaactattatg

SEQ ID NO: 10425 - protein, 185 aa, Panicum virgatum
  misc_feature: Ceres CLONE 1724359
  misc_feature (114)..(142): Pfam Name: efhand Pfam Description: EF hand
  misc_feature (29)..(57): Pfam Name: efhand Pfam Description: EF hand
  misc_feature (152)..(180): Pfam Name: efhand Pfam Description: EF hand
  misc_feature: SWISSPROT Homolog: EC 2.7.11.1 Non-specific serine/threonine protein kinase
MENAAAKPSLSKKPSPSFRLRNGSLNALRLRRVFDLFDRNGDGEITLDEMASALDALGLGADRSGLEAAVGGYIPAGAAGLRFDDFESLHRALGDALFGPIPEAVPEEEDEEGDMKEAFRVFDEDGDGYISAAELQAVLKKLGLPEARNLATVQEMICNVDSDRDGRVDFGEFKNMMQGITVWGA

SEQ ID NO: 10426 - DNA, 1241 bp, Panicum virgatum
  misc_feature: Ceres CLONE 1724361
  misc_feature: Encodes the peptide sequence at SEQ ID NO. 10427
atcgcccgctgctctcctcctcttcgtcctcctcgtctgttcactccggccgggctctgtcctcgatcctgcgcccatctccatctgaatcccagctagcgtgccaccagaggagaggagaggagggagatggccggaggcggtgacagctcccagacgaacggagctcgcgaccagagggccatggaggaggggaggaaggacgagttcgccggcgaccggggctgcggcgccgccatctccattcccttcgttcagaagatcatcgcggagatcttcggcacctacttcctcatcttcgcggggtgcggcgcggtgaccatcaacgcgagcaagaacggcgccatcacgttcccgggggtggccatcgtgtgggggctggcggtcatggtgatggtgtacgccgtcggccacatctccggcgcgcacttcaaccccgccgtcaccttcgccttcgccacctgcggccgcttcccgtggcggcagctgccggcgtacgtgctggcgcagatgctcggctccacgcttgccgccggcacgctgcgcctcatgttcggcggccgccacgagcacttccccgggacgctccccaccggctccgacgtgcagtcgctcgtcatcgagatcatcaccaccttctacctcatgttcgtcatctccggcgtcgccaccgacaacagagccatcggggagctggcagggctggccgtgggcgcaaccatcctgctccacgtgctcattgccgggcccgtgtccggcgcgtcgatgaacccggctcgtagcgtgggccccgcactggtgagcgggcagtaccggtccatctgggtgtacctggtgggcccggtggtgggggccgtggcgggggcctgggcctacaacctgatccgcttcaccaacaagcccctccgcgagatcaccaagagcacctccttcctcgggagcatgagcaggatgaactccaccgccgtctgatccgccacctcctaatcgtattcatctcaaccgcgaccccaccagccagagctgatgtggcacgtggggcctgggggtatttcagtaatctatccacctgtgagagtgtatatgccgctatatatgtgagtgtgtgacagtgtgtgtggaggacatggggaatgaagggttgatcagaatcaggtggtgactgttgttagctgatgtggcagtggtgtccatgtacgcctgtttcgataactcgaattaatcatcagtgttggtgagac

SEQ ID NO: 10427 - protein, 280 aa, Panicum virgatum
  misc_feature: Ceres CLONE 1724361
  misc_feature (35)..(249): Pfam Name: MIP Pfam Description: Major intrinsic protein
MAGGGDSSQTNGARDQRAMEEGRKDEFAGDRGCGAAISIPFVQKIIAEIFGTYFLIFAGCGAVTINASKNGAITFPGVAIVWGLAVMVMVYAVGHISGAHFNPAVTFAFATCGRFPWRQLPAYVLAQMLGSTLAAGTLRLMFGGRHEHFPGTLPTGSDVQSLVIEIITTFYLMFVISGVATDNRAIGELAGLAVGATILLHVLIAGPVSGASMNPARSVGPALVSGQYRSIWVYLVGPVVGAVAGAWAYNLIRFTNKPLREITKSTSFLGSMSRMNSTAV

SEQ ID NO: 10428 - DNA, 1102 bp, Panicum virgatum
  misc_feature: Ceres CLONE 1724372
  misc_feature: Encodes the peptide sequence at SEQ ID NO. 10429
agaggcggcagggcacacaagttggcgaggcgcagcgagccgagccctttaccccgaatccccgcagccaaatcgaatccaatcgccgccgcattccgcaccggatcgagtcgcgggaaccggcagcggcggcggcgatggcggcggagaagccggctccggtgctcgtgctctactgcggcgtctgcggcctccccgcggagtactgcgagttcggccccgatttcgagcgctgcaagccctggctgcgcgcccacgcgcccggcgtctacccggacgagctcatcgcctcttcctcatccggcggcggcggcggcggcgacaaggacgtggacaaggtcggagagcgcctccagggcgtggagatctcggacggctccaccagcagcgctgcaggggatgcttctgcatctaagccggaagaggtgaaacgcctgcctggtggtaaggtcaagaaaaaggacaagcaggaggttgtaattgagaagattgtccgcaacaagcgcaaatgcgtcactgtggtgaaaggacttgaattgtttggtgtaaagctgagtgatgcttcaaagaagcttgggaagaagtttgcaactggagcttctgttgttaagggcccaactgagaaggagcagattgatgttcaaggggacatatcatatgatattgtggagtttattacagatacgtggcctgatgtacctgagtctgccattttcttcattgaagatggaaggaaggttcctgctgcttgatgtcatatgatttacaaggcacgagaccagtgggtttacaaatataatacagatacaaggcaagagcatgtctgttaaggcatgcagcacccgtttgagttgatctcttgtgcgaagtcattgtctgttatttcagtttctaggctaagttcacaagtggtattttgatatatatatatatatatatatatatatatatatatatatatatatatataaatatatatatatatakakrtrtakmtatatctctatatatatatatatctatctcgcgctctctctctctctctctgtgtgcgtgcgtgaaagaaagcgagagtgcaaaaacactggcgttcccatactca

SEQ ID NO: 10429 - protein, 204 aa, Panicum virgatum
  misc_feature: Ceres CLONE 1724372
  misc_feature (107)..(189): Pfam Name: SUI1 Pfam Description: Translation initiation factor SUI1
MAAEKPAPVLVLYCGVCGLPAEYCEFGPDFERCKPWLRAHAPGVYPDELIASSSSGGGGGGDKDVDKVGERLQGVEISDGSTSSAAGDASASKPEEVKRLPGGKVKKKDKQEVVIEKIVRNKRKCVTVVKGLELFGVKLSDASKKLGKKFATGASVVKGPTEKEQIDVQGDISYDIVEFITDTWPDVPESAIFFIEDGRKVPAA

SEQ ID NO: 10430 - DNA, 562 bp, Panicum virgatum
  misc_feature: Ceres CLONE 1724372-R
cagtctatgtgtgtatatttaaaaggctttccgggtcgagcgcgcatgcgtgagtgcgggcaaaagcccgaaattgtgtgggttgtaggtaacaggcgcaactgcgtcggtgtgggggagggactggaatgggttggtgtatatttgagtgtcgcttcagagaaggcggggaggaggtttgggggaggagttttagttgtttggggcgtgtgtgagagagagcaggcggaagttcaaggagacatacattatgatattgaggaatttattacagatacgtggccagatgtacctgagtctgcctctttctccatcccagtcggtatcaagatacatggcgctcgctctcccgctctctctctgtctcgagaccaagcgctctatatatataattttaagtcaaaaaaaaagcatgtgtgtttcggtatgtagccccagttcgcgagggtgattttgatgtagtcatagtcagttatttatgtttatagatatagatctcaagagatatatatatatatatatatatatatatatatatatatatatagattttgcaatttcc

SEQ ID NO: 10431 - DNA, 1050 bp, Panicum virgatum
  misc_feature: Ceres CLONE 1724378
  misc_feature: Encodes the peptide sequence at SEQ ID NO. 10432
atccgcctcgtcccgctcgagcgccgccgcaccaatggcctcccccaacgccgacccgccccaacaccacgcctccacgccgccactcctcctcgccgtacgccacatccctttccccggggtccaccggccgcgcgcgctccccgcgcccgacgtcctcgcccctctcgcccgccgcctcgcggagctcgcggccgcggccgcggccgccgcgcacccgctcctgaagccgctcttcgccgtccactcccacctctcttccttctctcagagccggaggcggctggtggcggcgcggcgggacacgctgctgtccggggagccctgcttcgcggcggtgctggggggctcggtggccggcatggtggtggcaaatggcatcaacaacttcctcagcctctacaacacggtgctcgtcgtccggctcgtgctcacctggttccccaacacgccacccgccatcgtcgcacctctcagcacgatctgtgacccgtacctgaacatcttccggggcatcatcccgccgctcgggggatcgctggacctgtcgcccatcctcgccttcctggtcctcaacgccttcaccagcaccgccgccgcgcttccggcggagctcccggaccccgctgcagctccacagcaccatcgccagagctgcgcatcgacatccagctgctcggcgccccttgacctgacggccaaccagaggaaatggatgcagagaatgcagttccgaaagtcacagggaagagatggtgatcactaagctttgtgttcgtcagtgccttgctaccggctgaagaatatggctcggatcggacgctcgcagaacctgcacccccaagcatcaaacgcagttctgcatgcctgctctgtaaccatcgaatgcaaacctctagcaatgcggcatgcagaactattttggtccatcacgagtacgctcttcaaatgttcttttgttgtattgcgttgcgtcctttttgaggtctgtgctttctgcatgtatgtagaggaacctgcttgactgttagtattacagtttcgtatttc

SEQ ID NO: 10432 - protein, 243 aa, Panicum virgatum
  misc_feature: Ceres CLONE 1724378
  misc_feature (109)..(190): Pfam Name: YGGT Pfam Description: YGGT family
MASPNADPPQHHASTPPLLLAVRHIPFPGVHRPRALPAPDVLAPLARRLAELAAAAAAAAHPLLKPLFAVHSHLSSFSQSRRRLVAARRDTLLSGEPCFAAVLGGSVAGMVVANGINNFLSLYNTVLVVRLVLTWFPNTPPAIVAPLSTICDPYLNIFRGIIPPLGGSLDLSPILAFLVLNAFTSTAAALPAELPDPAAAPQHHRQSCASTSSCSAPLDLTANQRKWMQRMQFRKSQGRDGDH

SEQ ID NO: 10433 - DNA, 1171 bp, Panicum virgatum
  misc_feature: Ceres CLONE 1724380
  misc_feature: Encodes the peptide sequence at SEQ ID NO. 10434
acacgcaccgcgcccgcccacacgcacgccgcgcgcgcagagctggggaacggcacggggacgccaccgccgcccgcggctgccaccgggccccgccacccgaggcgcacgccgctctcctcaccaccaccactaccacctcgcgagcaatggcggtggcgcggctgcgctcggcggccgccagggtccggcccgcgctcgctggcgccatcggcgagaggcggctgctaggcacggcggcggccgcggcggaggtcaccacggatgcggcggccgctgtggccgccggggtctcgaggtgggagcccatgggcgcgcgggagtattacgactaccggcgggccatctacggcgacatcacgcacaaggccatcctcgtcgacgccgccggcacgctcctcgcccccaccgagcccatggcgcaggtatacagaacgatcggccagaagtatggagtggagtactcagaggatgaaatcctgatgaggtatcggcgggcttatgcgcaaccatggggtagatcgcgcctgaggtatgtcaatgatggaaggcccttttggcaacacatagttagttcctctacaggctgctcagatctgcagtactttgaggaagtatatcagtactatacgactgaaaaggcttggcatctctgtgatccagacgcaggacgcgttttccaggcattgagaagggctggtgtaaaaactgctgttgtgtccaactttgacactcgtcttcggccacttttacaagccctgaaatgtgatcaatggtttgatgcagttgctgtatctgctgaggttgcagcagaaaagccaaacccaacaatattcttgaaggcctgtgatctgctgggcgtgaaacctgaagaaactgtgcatattggggatgaccgtaggaatgatgtttggggagctagggatgcaggctgtgatgcctggctttggggcagtgatgtctactccttcaaggaggtcgcggagaggatcggggttgaggtatagcgacctgatggcagagtcaactcaacatgagctgcaatacaaagaagaagaaaaaggctgtgtggtgttgcctccttgtacatagtgtcaatccttgttgccccggcaccttgtacatactttccactttttccagggaataacagagaacagtttgtcctgcg

SEQ ID NO: 10434 - protein, 285 aa, Panicum virgatum
  misc_feature: Ceres CLONE 1724380
  misc_feature (72)..(270): Pfam Name: Hydrolase Pfam Description: haloacid dehalogenase-like hydrolase
  misc_feature: SWISSPROT Homolog: EC 3.1.3.29 N-acylneuraminate-9-phosphatase
MAVARLRSAAARVRPALAGAIGERRLLGTAAAAAEVTTDAAAAVAAGVSRWEPMGAREYYDYRRAIYGDITHKAILVDAAGTLLAPTEPMAQVYRTIGQKYGVEYSEDEILMRYRRAYAQPWGRSRLRYVNDGRPFWQHIVSSSTGCSDLQYFEEVYQYYTTEKAWHLCDPDAGRVFQALRRAGVKTAVVSNFDTRLRPLLQALKCDQWFDAVAVSAEVAAEKPNPTIFLKACDLLGVKPEETVHIGDDRRNDVWGARDAGCDAWLWGSDVYSFKEVAERIGVEV

SEQ ID NO: 10435 - DNA, 1360 bp, Panicum virgatum
  misc_feature: Ceres CLONE 1724383
  misc_feature: Encodes the peptide sequence at SEQ ID NO. 10436
acagtcacagcactgctctgcgctgctcaggtcaggtcagaacacacagaggcacggcaacagagaggaaagctcgcgtgccgagcaagaagacgcgaaggagctgaaaggagaacgagttcgagagggagccggccgggtaacaatggctctgctcccgctcgtcctctcgctcctcctcgtgtcctgcgcggcgcagtcgccggcctcgtcgccgtccgcgtccaaggctcctccggtcagcgcctcggcgccgcaggccacctccgtcgcgccaccgaccatggcagcctccgcgccgcaggcctctgtcacgccaccgacaacggcggcctcgacgccgcagttctcgatcgcgccaccgacaaaggcagcctccgcgccgcaggcctctgccgcgccaccgacaacggcagcctcagcgccaaaggcctctgcgcagccaccagcaacagtatccgcgtcggcgccgcgggcctctgcgcagccgccaacaacagtagccgtctcggctcccaaggcctccgctgcgccgccaactgcagctgcctcagcgccacaggtctctgccacggcgccaactacagccgcgtccccgccgcaggtctctgccgcacctcctaccaccgccacctcgccgccactagcctccgccgcaccgccgaccacggccgcctccccgcagctggctgccacgtcacctcccgttgcctctccgccactactagccgccgcgcctcccgtctctgcaacccctccagccaccttacctccactcgcatcgccacctgcggccacgccgcctaccgtggccgcgccagcacccgcggcgccggcaccagtggcctccccaccgctggcgatgccaccggcggcgcttcctccatccaccctccctccagcaatggcaccgacgccacttctcgctgccccgataatgccgcccaccgccgcgcccgtcacggctcccgctccagcccccgtgtcgccggctccgagcgtcgccccgacaccgtcgcccacagaggccccggccccgtcgcccgctctggcgccggagctggcgcccgcgctagcaccttcgctggcgccgttcagctcggtgtcggtgagcccgtcactggcgccgggtcccgcgctcgctcaggaagacgagtcggcggcgccgagcgcgcgcaccggtggcggcgccgcgctggtggccttggcggccgccgggctcgtggtcttgttctaagtagagctgcgtttaccgttgcttccgtactactcgtcgcacgatctcgttctcctgttcaagttttatggttgcatgtatgattcttggtgtacaacattgataatttatttctatttacgc

SEQ ID NO: 10436 - protein, 363 aa, Panicum virgatum
  misc_feature: Ceres CLONE 1724383
  misc_feature: Functional homolog of the protein sequence given in SEQ ID NO 50194
  misc_feature: Useful for making plants with altered cell wall content and/or composition
MALLPLVLSLLLVSCAAQSPASSPSASKAPPVSASAPQATSVAPPTMAASAPQASVTPPTTAASTPQFSIAPPTKAASAPQASAAPPTTAASAPKASAQPPATVSASAPRASAQPPTTVAVSAPKASAAPPTAAASAPQVSATAPTTAASPPQVSAAPPTTATSPPLASAAPPTTAASPQLAATSPPVASPPLLAAAPPVSATPPATLPPLASPPAATPPTVAAPAPAAPAPVASPPLAMPPAALPPSTLPPAMAPTPLLAAPIMPPTAAPVTAPAPAPVSPAPSVAPTPSPTEAPAPSPALAPELAPALAPSLAPFSSVSVSPSLAPGPALAQEDESAAPSARTGGGAALVALAAAGLVVLF

SEQ ID NO: 10437 - DNA, 1427 bp, Panicum virgatum
  misc_feature: Ceres CLONE 1724390
  misc_feature: Encodes the peptide sequence at SEQ ID NO. 10438
taccaaagccccgatcacctcttcctccatccatcacccttttttttcccgaaccttctcgaagcgaaggtcgctcgtccttcggcgcgatggcggtggatctgacccccaggcagccgaagaaggcgtacggcggcgagggcggcgcctactacgagtggagccccgccgacctgcccatgctcggcgtcgcctccattggcgcggccaagctctcgctcgccgccggcggcctctcgctccccagctactccgactccgccaaggtcgcctacgtgcttcaaggcacgggtacctgcggcattgtcctgcccgaggccaccaaggagaaggtcgtcggcgtgaaggagggcgacgccttggcactacccttcggcgtggtgacctggtggcacaacgcccccgacgccaccacggagctcatcgtcctcttccttggcgacacctccaagggccacaaggccggccagttcaccaacttccagctgacgggcgccaacggcatcttcaccggcttctccaccgagttcgtgggccgcgcctgggacctcacacaggatgacgccgccaagctcgtctccagccagcccgcctcgggcatcgtcaagctcggcgccgggcagaagctccccgccccctctgcggaggaccgcaagggcatggccctcaactgcctggaggcgccgctggacgtggacatcaagaacggcgggcgcgtggtggtgctcaacacccagaacctgccgctggtgaaggaggtcgggcttggcgccgacctggtccgcatcgacgcccactccatgtgctccccagggttctcgtgcgactcggcgtaccaggtgacgtacatcgtccgcggcagcgggcgcgtgcaggtcgttggcaccgacggcaagcgcgtgctggagacccacgtcgagggcggctacctcttcatcgtgccccgcttcttcgtcgtctccaagattgctgacgcctccggcttggagtggttctccatcatcaccacccccaaccccatcttcagccacctggcggggagaacgtcggtgtggaaggcgatctcgccggaggtgctggaggcctcgttcaacacgacgccggagatgaagaagctgttccggtccaagaggctggactccgagatcttcttcgcccccaactgaggagcccccgccaccatttgccgcccgatccaccagcgatcttggtgtcgtcgtcggtcgtcgttagcttagctcgataagaataatagagagctgcggttgggtctgtctgtggcggcttccttcgtgagtcagtgtcagtcagtcggcagacttagggtcgtggaagagagctttgagcgctctgcgtcatggtcttgtcgtgcgtgtccggttggtgaaacttgcgagatgaatacaaatctcaagcttctttcgttt

SEQ ID NO: 10438 - protein, 358 aa, Panicum virgatum
  misc_feature: Ceres CLONE 1724390
  misc_feature (193)..(342): Pfam Name: Cupin_1 Pfam Description: Cupin
  misc_feature (5)..(160): Pfam Name: Cupin_1 Pfam Description: Cupin
MAVDLTPRQPKKAYGGEGGAYYEWSPADLPMLGVASIGAAKLSLAAGGLSLPSYSDSAKVAYVLQGTGTCGIVLPEATKEKVVGVKEGDALALPFGVVTWWHNAPDATTELIVLFLGDTSKGHKAGQFTNFQLTGANGIFTGFSTEFVGRAWDLTQDDAAKLVSSQPASGIVKLGAGQKLPAPSAEDRKGMALNCLEAPLDVDIKNGGRVVVLNTQNLPLVKEVGLGADLVRIDAHSMCSPGFSCDSAYQVTYIVRGSGRVQVVGTDGKRVLETHVEGGYLFIVPRFFVVSKIADASGLEWFSIITTPNPIFSHLAGRTSVWKAISPEVLEASFNTTPEMKKLFRSKRLDSEIFFAPN

SEQ ID NO: 10439 - DNA, 1419 bp, Panicum virgatum
  misc_feature: Ceres CLONE 1724391
  misc_feature: Encodes the peptide sequence at SEQ ID NO. 10440
acagtcacagtactgctctgcgctgctcaggtcagaacacgcagaggcgcggcaacagagaggtaagctcgtgccgagcaagaagacacgaaggagctgaaaggagaacgagttcgagagggagccggccgggcaacaatggctctgctcccgctcttcctctcgctcctcctcgtgtcctgcgcggcgcagtcgccggcctcgtcgccgtccgcgtccaaggctcttccggtcagcgcctcggcgccacaggcctccatcgcgccaccgaccacggcagcctcggcgccgcaggcctccgtcgcgccaccgacaacggcaggctcggcgccgcagttctcgatcgcgccaccgacaaaggcagcctccgcgccgcgggcctctgccgcaccaccgacaacggcagcctcagcgccaaaggcctcggcgcaaccaccagcaacagtatccgcgtcggcgccgcaggcatcggcgcagccgccaacaacggtagccgtgtcggctccgaaggcctctgccgcgccgccaaccacagcggcctcagcgccgcaggtctctgccacggcgccaaccacagccgcctccccaccgccgaccaccgctgccttgccgcctcaggtctccgccgcacctaccaccgccacctcgccgccactagcctccgccgcaccgccgaccacggccgcctcgccgcagctggctgccacgtcacctcccgttgcctctccgccactactagccgccgccgcgcctcctgtctctgcgacccctccagccaccttacctccgctcgcatcgccacccgcggccacgccgcctaccgtggccgcgccagcacccgcgatgccggctccagtggcctccccgcccctggcaatgccaccggcggcgcttcctccgtccaccctccctccagcaatggcgccgacgcctcttctcgctgccccgataatgccgcccaccgccacgcccgtcacggctcccgctccagcccccgtgtcgccggctccgagcgtcgccccgacaccgtcgcccacagaggccccgaccccgtcgccggctctggccggagctggcgcccgcgctagcaccttcgctggcgccgctcagctcggtgtcggtgagcccgtcgctggcgccgggtcccgcgctcgctacggaggacgagtcggcggcgccgagcgcgcgcaccgttggcggcgccgcgctggcggccttggcggccgccgggctcgtggtcttgttctaagtagagctgcgtttaccgtcgcttccgtactgctcgtcgcacgatctcgttctcttgttcgcgttttatggttgcatgtatgattcttgctgtaaaacacattgataatttatttctatttacgcatggatgatggacggactgctccctttgggcatctctgatttgcc

SEQ ID NO: 10440 - protein, 397 aa, Panicum virgatum
  misc_feature: Ceres CLONE 1724391
  misc_feature: Functional homolog of the protein sequence given in SEQ ID NO 50194
  misc_feature: Useful for making plants with altered cell wall content and/or composition
MALLPLFLSLLLVSCAAQSPASSPSASKALPVSASAPQASIAPPTTAASAPQASVAPPTTAGSAPQFSIAPPTKAASAPRASAAPPTTAASAPKASAQPPATVSASAPQASAQPPTTVAVSAPKASAAPPTTAASAPQVSATAPTTAASPPPTTAALPPQVSAAPTTATSPPLASAAPPTTAASPQLAATSPPVASPPLLAAAAPPVSATPPATLPPLASPPAATPPTVAAPAPAMPAPVASPPLAMPPAALPPSTLPPAMAPTPLLAAPIMPPTATPVTAPAPAPVSPAPSVAPTPSPTEAPTPSPALAGAGARASTFAGAAQLGVGEPVAGAGSRARYGGRVGGAERAHRWRRRAGGLGGRRARGLVLSRAAFTVASVLLVARSRSLVRVLWLHV

SEQ ID NO: 10441 - DNA, 1073 bp, Panicum virgatum
  misc_feature: Ceres CLONE 1724398
  misc_feature: Encodes the peptide sequence at SEQ ID NO. 10442
aaaacgagcgtgctcgacctcccccacctcgccactgctcctattttcttctcctgaacgctgcggaaagcatggcgtccgtcaccgcccgcgccccggtcgcggccctccgcccgtcgtcggcgtcgctcaggtcatccttcctcggccactctagccgcctcggccgcggcgccgcggcgccgacgaggcggagcctcaaggccgaggccaagggcgagtggctccccggcctcccctcacccgcctacctcgacggcagcctgccgggcgacaatgggttcgacccgctgggcctggcggaggacccggagaacctgcggtggttcgtgcaggcggagctggtgaacgggcggtgggcgatgctgggcgtggccgggatgctgatcccggaggtgctgaccaaggccgggctcatcagcgcgccgcagtggtacgacgccggcaagtcggagtacttcgcgtcgtcgtccacgctcttcgtcatcgagttcatcctcttccactacgtcgagatccggcggtggcaggacatcaagaaccccggcagcgtcaaccaggaccccatcttcaagagctacagcctgccgccccacgagtgcggataccccggcagcgtcttcaaccccctcaacttcgcccccacgctcgaggccaaggagaaggagctcgccaacgggaggctggcgatgctggcgttcctggggttcctgatccagcacaacgtcaccggcaaggggcccttcgacaacctgctgcagcacctgtccgacccatggcacaacaccatcatccagaacctctccggttgagtcgacgacggtgagcgatcgccaatttggcggcggtggtgctgatgggggatcgattgggagacaaacattgagacgacgcggtcgagtcgatcgatgtgagttccttcctgtggatcgatcatcagcgtgtgatgtgtgttcagtctggaggggagaattcagggcgtgtttgtaattgtcatgctggtgtgcatggtgaggaggagagtatgaggagtgattgtggtatgtacattaatgacaggggaggttaagggt

SEQ ID NO: 10442 - protein, 246 aa, Panicum virgatum
  misc_feature: Ceres CLONE 1724398
  misc_feature (56)..(218): Pfam Name: Chloroa_b-bind Pfam Description: Chlorophyll A-B binding protein
  misc_feature: Functional homolog of the protein sequence given in SEQ ID NO 50109
  misc_feature: Useful for making plants with modulated nitrogen use efficiency
  misc_feature: Functional homolog of the protein sequence given in SEQ ID NO 50113
  misc_feature: Useful for making plants with modulated oxidative stress sensitivity
MASVTARAPVAALRPSSASLRSSFLGHSSRLGRGAAAPTRRSLKAEAKGEWLPGLPSPAYLDGSLPGDNGFDPLGLAEDPENLRWFVQAELVNGRWAMLGVAGMLIPEVLTKAGLISAPQWYDAGKSEYFASSSTLFVIEFILFHYVEIRRWQDIKNPGSVNQDPIFKSYSLPPHECGYPGSVFNPLNFAPTLEAKEKELANGRLAMLAFLGFLIQHNVTGKGPFDNLLQHLSDPWHNTIIQNLSG

SEQ ID NO: 10443 - DNA, 1105 bp, Panicum virgatum
  misc_feature: Ceres CLONE 1724399
  misc_feature: Encodes the peptide sequence at SEQ ID NO. 10444
atggccagtctccgcacgccaccgcggacgcagggagcagccactcacgaacagggcaagtctgttcaaacaatccgacgcatgtcagcatgtggagcaggctctttcgctatttccaggagttttctaggagcagggacaccatgacttgctacctgctcaagcgagtgcccagtttatttcaaaaaaaaaaagagtgcccagtgccctgcagtctgcagacttcatgttttccgtgtttatttttgcgtgcagatgatccggagaagaagcccaaaacggtagtcgatgtaggctgcggaattgggggtagctcaaggtacctggccaagaaatacggagcacagtgcaagggcatcacgctgagccccgttcaagctgaaagaggaaacgctctcgccgctgcgcaggggttgtcggatcaggtttctctgcaagttgctgatgctctggagcaaccgtttcctgatggacagttcgatcttgtgtggtccatggagagtggcgagcacatgccagacaagagcaagtttgttagtgagctggcacgcgtggcggctcctggagggacaataatcatcgtgacatggtgccatcggaacctggagccatctgaaacctccctgaaaccggatgaactgaacctcctctagaggatttgcgatgcgtactaccttcctgactggtgctcaccctcagactatgtgagcatcgccaagggtctgtctcttgaggatgtcaaaacagccgattggtcggagaacgtggccccattctggccggccgtgataaaatccgcactgacatggaagggcatcacctctctcctaacgagcggatggaagacgatcagaggggcgatggtgatgccgctgatgatccagggctacaagaaggggctcatcaagttcaccatcatcacctgtcgcaagcccggagcagcgtaggaggtcaagttactgtcgcggtgcctctgtaatctgttccgcgcaataacgtagaaccaaatacctatcaatggcgaggtagaagacgccccgtcgccgtcttctcactgtacgcgcacgtttggccatgtgccccgttccaaataattttctctacc

SEQ ID NO: 10444 - protein, 187 aa, Panicum virgatum
  misc_feature: Ceres CLONE 1724399
  misc_feature (66)..(164): Pfam Name: Methyltransf_11 Pfam Description: Methyltransferase domain
  misc_feature: SWISSPROT Homolog: EC 2.1.1.95 Tocopherol O-methyltransferase
  misc_feature: The sequence is a functional homolog of SEQ ID NO 22 in US patent 7226745
  misc_feature: The sequence is a functional homolog of SEQ ID NO 36 in US patent 7244877
  misc_feature: Functional homolog of the protein sequence given in SEQ ID NO 50201
  misc_feature: Useful for making plants with modulated nitrogen use efficiency
MWSRLFRYFQEFSRSRDTMTCYLLKRVPSLFQKKKECPVPCSLQTSCFPCLFLRADDPEKKPKTVVDVGCGIGGSSRYLAKKYGAQCKGITLSPVQAERGNALAAAQGLSDQVSLQVADALEQPFPDGQFDLVWSMESGEHMPDKSKFVSELARVAAPGGTIIIVTWCHRNLEPSETSLKPDELNLL

SEQ ID NO: 10445 - DNA, 686 bp, Panicum virgatum
  misc_feature: Ceres CLONE 1724403
  misc_feature: Encodes the peptide sequence at SEQ ID NO. 10446
gcggcgacacatcctgcttatccggcggaggtggagcagctgagcagcaacaagatgttcggcggccgcaacctccgcctccgccaccagagcgccaccctcggctgccccatgaccttctccgtctacctgccgccgtccccggcgtccaatgtccccgtgctgtactggctctcgggcctcacctgcactgacgagaacttcattatcaagaccggagctcagcgcgccgccgccgcccacggcatcgccctcgtcgcgcccgacacctccccacgtggattaaatattgaaggagagtcagacagctatgattttggtgttggtgctgggttttatttgaacgccacaaatgaaaaatggaaaaactggcgcatgtatgactatgttgtgaaagaacttccaaaagttttgaatgagcactttgtactgctcaacactaaacaggcatccatttttgggcactctatgggaggccatggtgcactgacaatttacttgaaaaacaccaataaatacaagtcagtatcagcatttgctccaattgtcaatccgataaactgcccgtggggtcagaaagcgttctcaaattacctgggctcatctaaatcagattgggaggaatatgatgctacctgcctgattaaaaagaacaacaaagtttctactcctatcctaattgacca

SEQ ID NO: 10446 - protein, 228 aa, Panicum virgatum
  misc_feature: Ceres CLONE 1724403
  misc_feature (23)..(228): Pfam Name: Esterase Pfam Description: Putative esterase
  misc_feature: SWISSPROT Homolog: EC 3.1.2.12 S-formylglutathione hydrolase
  misc_feature: Functional homolog of the protein sequence given in SEQ ID NO 50203
  misc_feature: Useful for making plants with altered cell wall content and/or composition
  misc_feature: Useful for making plants with modulated biomass
AATHPAYPAEVEQLSSNKMFGGRNLRLRHQSATLGCPMTFSVYLPPSPASNVPVLYWLSGLTCTDENFIIKTGAQRAAAAHGIALVAPDTSPRGLNIEGESDSYDFGVGAGFYLNATNEKWKNWRMYDYVVKELPKVLNEHFVLLNTKQASIFGHSMGGHGALTIYLKNTNKYKSVSAFAPIVNPINCPWGQKAFSNYLGSSKSDWEEYDATCLIKKNNKVSTPILID

SEQ ID NO: 10447 - DNA, 781 bp, Panicum virgatum
  misc_feature: Ceres CLONE 1724413
  misc_feature: Encodes the peptide sequence at SEQ ID NO. 10448
acttgtcattctccgtcctcgccagctcaggcaacctgaagcctcatcaagaacttccttcacctgctaccccccctgtaacgcaatcgttcgcgctccgattgcaacgcgccattcctctcgctcgccctctgtttcttaaacctttcccttctctcggagcctctcctcccttgttcttccttccctggcggcgacgactgggcgagcggcggcgccatttgtcctgtcatcgcccagccctttgccggcgacgagcgcatcctccagtcgacccatttttctacataaagggcaatgggagcatccgtgacaactggtatgcagatgctggccatgcgcccatgcatcccagcctgcaaacaagtgcttggttcgacatcagtgctatctgcatttggaagggcacttagtaccagaactgggtttggcagctgttccaaacccacatcagtggggccaatgacttcttcaaattgtaagggggttattgtgaggacaatgtctcagagaggttctcaagggcttcccattgatctcacaggaaaaagagcatttattgctggagttgctgatgataatggttatggttggtcaattgctaaggctcttgctgcagctggtgctgagattcttgttggtacatgggtgcctgcgttgaacatatttgagacaagcttgagacgtggaaagtttgacgaatcacggaagctgcctgatggatcccttatggagatcgctaaagtatatccactggatgcagtttatgacattcctgaag

SEQ ID NO: 10448 - protein, 161 aa, Panicum virgatum
  misc_feature: Ceres CLONE 1724413
  misc_feature: SWISSPROT Homolog: EC 1.3.1.9 Enoyl-[acyl-carrier-protein] reductase (NADH)
  misc_feature: The sequence is a functional homolog of SEQ ID NO 2 in US patent 7141721
MGASVTTGMQMLAMRPCIPACKQVLGSTSVLSAFGRALSTRTGFGSCSKPTSVGPMTSSNCKGVIVRTMSQRGSQGLPIDLTGKRAFIAGVADDNGYGWSIAKALAAAGAEILVGTWVPALNIFETSLRRGKFDESRKLPDGSLMEIAKVYPLDAVYDIPE

SEQ ID NO: 10449 - DNA, 722 bp, Panicum virgatum
  misc_feature: Ceres CLONE 1724413-R
  misc_feature: Encodes the peptide sequence at SEQ ID NO. 10450
gcaatttcagcatctagttattcctttgtttcctactttcaacacttccctcccataatgaatccaggagctgctagtatctctttgacctacatagcttctgagaggataattccgggctatggtggtggtatgagttcagcaaaagcagcactagagagtgatacaagagttcttgcgtacgaagcaggtcgaaaaggcaaaatcagagtaaacacaatatcagcaggtccactgggaagccgggctgcgaaagctatcggattcattgagaagatgatagagtattcctatgtcaatgcaccactgcaaaaggagctattggcagatgaagttgggaacacagcagcattcctcgtgtccccgttggcgtctgcagtcactggctcgactatctacgttgacaatgggctcaacacaatgggacttgcacttgacagccctactttatccacataagaggctctcgactttggaattagctcagagggcggtagatttagcaggaaattgagtttattgtttgcattaatttgatctatcagttgccaccgggaatagaattgtaggatgcagtttccatgtaatgctagtattttgcttttataggcaactgaggtccctttgctgtcttcagcttctgttcgtgtaagtaaatcgtccaaggtctggaccttttgtggtaaatgttttcttttataaagaatcacaaaatgtgttgg

SEQ ID NO: 10450 - protein, 152 aa, Panicum virgatum
  misc_feature: Ceres CLONE 1724413-R
  misc_feature: SWISSPROT Homolog: EC 1.3.1.9 Enoyl-[acyl-carrier-protein] reductase (NADH)
  misc_feature: The sequence is a functional homolog of SEQ ID NO 2 in US patent 7141721
AISASSYSFVSYFQHFPPIMNPGAASISLTYIASERIIPGYGGGMSSAKAALESDTRVLAYEAGRKGKIRVNTISAGPLGSRAAKAIGFIEKMIEYSYVNAPLQKELLADEVGNTAAFLVSPLASAVTGSTIYVDNGLNTMGLALDSPTLST

SEQ ID NO: 10451 - DNA, 964 bp, Panicum virgatum
  misc_feature: Ceres CLONE 1724415
  misc_feature: Encodes the peptide sequence at SEQ ID NO. 10452
gacaacgaactccggcctcatctagcttgccgtctctctgcctcgtctccaacggggagggaaaaaaaatcagcggggattcagatgaggctctatctccggcaagcggcggccgcggccacggccaccagctcccccctggcggccaccatccgcaagagttctccaagctccctcacccatggccggctcggcttcagccacgcccacacgtcgctgcagacgacgccgacgccaacgccgacgccgacgccgaaccaccgcggaaaccgaccagggtgggcggtgcgcgtgcttcccctgactgaggagaacgtggagagggtgctggacgaggtgcggccgagcctgatggcggacggcggcaacgtggcgctgcacgagatcgacggcctcgtcgtcgtgctcaagctgcagggcgcctgcggctcctgccccagctccaccatgacgctcaagatgggcatcgagacgcgcctccgcgacaagatccccgacatcctcgaggtcgagcagatcgtcgacaccgagaccggcctcgagctcaccactgacaacgtcgagaaggtacttgatgagatcaggccatacctctccggcaccggaggtggaagcctcgagctggtccagatcgatggatatgtcgtcaagattcgaatcggtggccctgcagctggtgtaatgacagttcgtgtagctgtgacacaaaaactgagggaaaagataccttcaatcatggctgttcagctcatagagtagaaagcataagttcatctgtgcatcaatcaacagaacgaaatgtggttttctgctgaatgttcgatgtcggtcttatacttttgagtcattagtctttatacactgaaatacagaacccatagccaaaggtaaactcgcaatggctaaaacgattgacatgtaccaagaaacctttgacttaaaaggaatatcactgatttggacg

SEQ ID NO: 10452 - protein, 224 aa, Panicum virgatum
  misc_feature: Ceres CLONE 1724415
  misc_feature (78)..(145): Pfam Name: NifU Pfam Description: NifU-like domain
  misc_feature (159)..(223): Pfam Name: NifU Pfam Description: NifU-like domain
MRLYLRQAAAAATATSSPLAATIRKSSPSSLTHGRLGFSHAHTSLQTTPTPTPTPTPNHRGNRPGWAVRVLPLTEENVERVLDEVRPSLMADGGNVALHEIDGLVVVLKLQGACGSCPSSTMTLKMGIETRLRDKIPDILEVEQIVDTETGLELTTDNVEKVLDEIRPYLSGTGGGSLELVQIDGYVVKIRIGGPAAGVMTVRVAVTQKLREKIPSIMAVQLIE

SEQ ID NO: 10453 - DNA, 1312 bp, Panicum virgatum
  misc_feature: Ceres CLONE 1724418
  misc_feature: Encodes the peptide sequence at SEQ ID NO. 10454
aaaaaacgaccccgcgcgcagccaccacaccgcggcgacggaatcccgcccgcacgccaccgccaagccatgggcaagatgaggatgcccgtgccctccctgttccgcctcggccgccgctccaagtctccgccgccgccgccgcagcagcagcaggcccaagccgccgagtccccgccgcggacggcggaggaggagatggcgcgggtgttccgcaagttcgacgccaacggcgacggccggatctcgcggtccgagctcgcggccctgttcgagagcctgggccacgccgcctccgacgacgagctggcgcgcatgatggccgaggcggacgccgacggcgacggcttcatcagcctcgacgagttcgccgccctcaacgccaccgtcgcgggcgacgccgccgccgtcgaggaggacctgcgccacgccttccgcgtcttcgacgccgacggcaacggcaccatctccgccgccgagctcgcgcgcgtgctccgggggctcggcgagtccgcctccgtcgcccagtgcaggcgcatgatcgagggcgtcgaccagaacggcgacggcctcatctccttcgaggagttcaaggtcatgatggccggggccggatgcttcgccaagatcgcataggtgcttggttctccgcsgaatccgctccaccggctcttcatccctatctctctttttcttctgttcccccccctttgactatccgagcgtgccgtgtgggggtttatgaagtgtatatagaagcaacgattattgctagcggttagattctttctactaataattgggaatcgcgaatttctagtacctactctatataggttgggatgggaatcggaggctgcaaagcagtggttcagagctaatttctgttcatgtctctgatccgcttattgtcccttcagttaacgatgaaaagagcaaacgattgggacctatggatatccatccaactcgtgtttccttccattccattccattccattccattccatccactgttcggaatctgctccataacctgaacttcatgcatctaaagcctgctttcgtcagttgctatatttttcagagttgttatttgatattggttggatccaatgtgaatcgcagcgcagtagatgtgcacttcttttgattactagctggatattcatcaatgagggaaaaaaatggaatcctctactctgcttagctggatttagctaaactatcttctgattatcttagtgtgtaaactttttgctcagaattcctctgcatatggaggcaagtataactgactgaagttaactcg

SEQ ID NO: 10454 - protein, 188 aa, Panicum virgatum
  misc_feature: Ceres CLONE 1724418
  misc_feature (117)..(145): Pfam Name: efhand Pfam Description: EF hand
  misc_feature (43)..(71): Pfam Name: efhand Pfam Description: EF hand
  misc_feature (153)..(181): Pfam Name: efhand Pfam Description: EF hand
  misc_feature (79)..(107): Pfam Name: efhand Pfam Description: EF hand
  misc_feature: SWISSPROT Homolog: EC 2.7.11.1 Non-specific serine/threonine protein kinase
MGKMRMPVPSLFRLGRRSKSPPPPPQQQQAQAAESPPRTAEEEMARVFRKFDANGDGRISRSELAALFESLGHAASDDELARMMAEADADGDGFISLDEFAALNATVAGDAAAVEEDLRHAFRVFDADGNGTISAAELARVLRGLGESASVAQCRRMIEGVDQNGDGLISFEEFKVMMAGAGCFAKIA

SEQ ID NO: 10455 - DNA, 1143 bp, Panicum virgatum
  misc_feature: Ceres CLONE 1724428
  misc_feature: Encodes the peptide sequence at SEQ ID NO. 10456
cttcacctccaacgctccaagccccggaaccttatctccatccaaatcctcatcccgtcccaatcccgagcgagcgtcatggcctccgcgctcttctccgcctccctctcaacctgcttcctcgccctaccctccccgaagcccgccgcaaccgcctccgccttcctccccttcaggctgccgctgcgcgctgtgtcggcgccggggaggcgggtgttcgagcccgtggccgtcgcggtgtcgtcggagtacgagaccgagggcgcggagcaggaggagggagccgaggagttctccgaggacctcaagctgttcgtcggaaacctgccgttcagcgtcgacagcgcgcagctcgccgggctctttgagcaggccggctccgtcgagatggtcgaggttgtatatgatagaatgactggacgaagccgtggatttggattcgtgacaatgtccacagctgatgaagctggagccgctgttgagcaattcaatggttatacatttcaaggaagaccactgagggtgaactccgggccaccaccgcctagagatgactccgcaccaagagcaccaagaggtggtggtggcggtggaagctttgcagattcagcaaacaaggtctatgtggggaatctcgcatggggtgtcgacaactcgacgcttgagaacctgttcaatgagcaagggcaggtggttgatgctaaggtcatctacgatagggagagcggcaggtcaaggggatttggttttgtcacctatcgtaccatggaggaggtcaacaatgccatatcaaacctcgatggcatcgacttggatggcagacagatccgagtcacggttgcggaatcaaagccgagacgccaattttgaaatttcatgatggtgatttagagcttaatagtgtgtttcgccaagtgttagttcctagcttctattcttgccaccatattacaagtaaaatgaagattcggttgatgggggctggaagtgaaattgttgtatacggggagaatttcccatactgcaatgaacacaaacgctcttatgctcattgcgctttcaaagagtagaaatatttgtccccgcatgcgtacatagcagcggtcaagaacatatatgagctatgatctaacattttttcag

SEQ ID NO: 10456 - protein, 263 aa, Panicum virgatum
  misc_feature: Ceres CLONE 1724428
  misc_feature (181)..(252): Pfam Name: RRM_1 Pfam Description: RNA recognition motif. (a.k.a. RRM, RBD, or RNP domain)
  misc_feature (78)..(149): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: The sequence is a functional homolog of SEQ ID NO 22 in US patent 7244875
MASALFSASLSTCFLALPSPKPAATASAFLPFRLPLRAVSAPGRRVFEPVAVAVSSEYETEGAEQEEGAEEFSEDLKLFVGNLPFSVDSAQLAGLFEQAGSVEMVEVVYDRMTGRSRGFGFVTMSTADEAGAAVEQFNGYTFQGRPLRVNSGPPPPRDDSAPRAPRGGGGGGSFADSANKVYVGNLAWGVDNSTLENLFNEQGQVVDAKVIYDRESGRSRGFGFVTYRTMEEVNNAISNLDGIDLDGRQIRVTVAESKPRRQF

SEQ ID NO: 10457 - DNA, 1157 bp, Panicum virgatum
  misc_feature: Ceres CLONE 1724444
  misc_feature: Encodes the peptide sequence at SEQ ID NO. 10458
aaatctccagcccgcgcagcctgatcccagagctcgtcacctcttcctcctcagctccacgcctcgctcgcgcgcgcgccccggacgcaccaccaccagcagagatggccgccctcgccgcctcctccactgccgccttcgccgccaagccgcgcctgccccgcgcgcgcctctccgtggcctgctccgccaccggcggcggggacagcagcagcagcggcagcggcgtctcgcttgcctcctccgtcaagaccttctcggccgcgctggcgctgtcgtcggtgctcctctcctcggccgccacctcccctccgcccgccgccgccgacatcgccggcctcaccccgtgcaaggagtccaaggcgttcgccaagcgcgagaagaactcgatcaagaagctgaccgcctcgctcaacaagtacgcccccgacagcgcccccgcgctcgccatcaacgccaccatcgagaagaccaagcgccgcttcgagaactacggcaagttcggcctgctctgcggcgccgacggcctgccgcacctcatcgtcagcggcgaccagcggcactggggcgagttcatcaccccgggcctgctcttcctctacatcgccggctggatcgggtgggtcggcaggagctacctcatcgccatcagcggcgagaagaagcccgccatgagggagatcatcatcgacgtcgagctcgccacgaggctcctccccagggggttcatctggcccgtcgcagcctaccgcgagctcatcaacggagagctcgtcgtcgacgacaaggacatcggctactactaagcgcacctgcatggctggtggcgaccggcgagttgggcagcgactgtgttggggaagattcatggcttgtggtgtaggagctaataggatgatggaggaatggaagctctgttgtacttaagaaactggatgaagccttgtataactgtacctctctcttgtgtgtattcaccttcttgaaaattcttgagaacgatttcattttgcattgcgtttccggttccactttgcatgttgtagccgtcgtcattggtcattgcagagcgaggtatataagttctccgttattggagcatataaaagcattgaagctcgagagctcaactagagggaaacatcgagatgttggat

SEQ ID NO: 10458 - protein, 233 aa, Panicum virgatum
  misc_feature: Ceres CLONE 1724444
  misc_feature (50)..(228): Pfam Name: PSI_PsaF Pfam Description: Photosystem I reaction centre subunit III
MAALAASSTAAFAAKPRLPRARLSVACSATGGGDSSSSGSGVSLASSVKTFSAALALSSVLLSSAATSPPPAAADIAGLTPCKESKAFAKREKNSIKKLTASLNKYAPDSAPALAINATIEKTKRRFENYGKFGLLCGADGLPHLIVSGDQRHWGEFITPGLLFLYIAGWIGWVGRSYLIAISGEKKPAMREIIIDVELATRLLPRGFIWPVAAYRELINGELVVDDKDIGYY

SEQ ID NO: 10459 - DNA, 808 bp, Panicum virgatum
  misc_feature: Ceres CLONE 1724445
  misc_feature: Encodes the peptide sequence at SEQ ID NO. 10460
actctccctcactctactctttccatccagcgcgagaggcaggtcggcagcagagcgagagcgcgtgccagcccatggcgagcaccaacatggcgtcggccacctcgcggttcatgctggccgcgggcgtgcccgcggcgggcagcggccgcatcggcttcgcgtcggtgcccggcaggccgcagggcaggaggctcgtggtgcgcgccgaggaggaggccgccgcggcggccgagccggcgccggaaggggagggcgccgtggccaccaagcctaaggccgagaagccgccgccgatcgggcccaagaggggcgccaaggtcaagatcctgaggagggagtcctactggtacaacgggattggcaacgtcgtcacagttgatcaggaccccaacacccgctacccggtggtggtgcggttcaacaaggtgaactacgccggcgtatccaccaacaactacgccttggacgagatccaggaggtgaaatgagcagagaggctggctggctggctgtgaaatgagggtcacaacatcttgtgtgtaatagcttaatctctgtaatcattatgtaactgcttgcttgcttcaccgtggacacaataatctcctgcacttaagttgttgtattcttttcttgtgattttgtacatgcacataaacctcttttcctgccaccgtttgcgcgatgctggaaacttgatcgatactagctactggagttcatacagcttagattaatatgtagctgcagcaactaccaagttcatgttactacaaattaagcaacagaccaatattacagcgtc

SEQ ID NO: 10460 - protein, 138 aa, Panicum virgatum
  misc_feature: Ceres CLONE 1724445
  misc_feature (77)..(138): Pfam Name: PSI_PsaE Pfam Description: Photosystem I reaction centre subunit IV / PsaE
MASTNMASATSRFMLAAGVPAAGSGRIGFASVPGRPQGRRLVVRAEEEAAAAAEPAPEGEGAVATKPKAEKPPPIGPKRGAKVKILRRESYWYNGIGNVVTVDQDPNTRYPVVVRFNKVNYAGVSTNNYALDEIQEVK

SEQ ID NO: 10461 - DNA, 1045 bp, Panicum virgatum
  misc_feature: Ceres CLONE 1724448
  misc_feature: Encodes the peptide sequence at SEQ ID NO. 10462
agttcgccaccccacagagacacgtcgctttaactagcgctcggcacccccaggccctcccctcgcacgtaactagtgtccttcctccgtcttcctcctctcgctctcatccactctccacgcccagcgccccccctcgccactgcggtgcggagcttcggcggctcggctcgagcagaagaaaatgcaacgggcagtgcaagccatcaggtcgcatggcagtgtgcttaaatatgctgttcaacaacacatcagcgctcccaaaccagcaatacttcctgctgccttttctcgcttcatgtcagcttcatctgctcgcctagaggatagtggatttgaaactgccactgtagcagatatcttgaagtctaaaggtaagagtgctgatggatcttggctctggtgcaccacagaggacagtgtctatgatgctgtcaaatcgatgacgcaacacaatgtgggagctttggtggtggtcaaacctggacaggaaaaatcacttgctggcattgtcacagagagagattatctccggaaaatcatagtgcaaggacgatcttccaagtcaactaaggttggagacatcatgactgaagagaacaagctgatcaccgtgaagcctggaaccaaggtcctgcaagccatgcagctgatgacagagaaccgcatcagacacatcccggtgatcgaaggcacagggatgctggggatggtctccatcggcgacgtcgtccgtgcggtggtcaacgagcacagggaggagctgaaccggctcaacgcctacatccagggaggctactaggacgacgcccctacctcccagcgaagtccgcctttgatatccaataactcggaccagtgatgatgacgaaataggccgtgtgttcgcggacaatgttgttgaattgcgcaaggtgttttcccccgcgtttactatatgtgtatattgccaaaaggcgggcgtgacagtgcgcctggtgctggggcgcagactatctgacggtggaaacaccggaaataaaaagcgtgccgccgtgtgcttgct

SEQ ID NO: 10462 - protein, 205 aa, Panicum virgatum
  misc_feature: Ceres CLONE 1724448
  misc_feature (65)..(187): Pfam Name: CBS Pfam Description: CBS domain pair
  misc_feature: SWISSPROT Homolog: EC 1.1.1.205 IMP dehydrogenase
MQRAVQAIRSHGSVLKYAVQQHISAPKPAILPAAFSRFMSASSARLEDSGFETATVADILKSKGKSADGSWLWCTTEDSVYDAVKSMTQHNVGALVVVKPGQEKSLAGIVTERDYLRKIIVQGRSSKSTKVGDIMTEENKLITVKPGTKVLQAMQLMTENRIRHIPVIEGTGMLGMVSIGDVVRAVVNEHREELNRLNAYIQGGY

SEQ ID NO: 10463 - DNA, 986 bp, Panicum virgatum
  misc_feature: Ceres CLONE 1724464
  misc_feature: Encodes the peptide sequence at SEQ ID NO. 10464
atccacactcgcaagtcccaagccgctccaacggcagccatggcttccacaatcaccttcctttccctctctcccaccgccaccttcctccacatcccggcctccacctcctcctccttcgtcgccgctcccggaatcctcaccagccgccggcgggcagcgccccgcgccctcccgctccgcgcccgcccgctgcgccgcgtcaccgtcgtctgcagcggcgccgctgcggcagccgaggcgtcagatgcggcggcgcccgccgagaagtttcggctcgacaaccttggcccgcagaaggggtcccggcggcggcccaagcgtaaggggcgcggtatcgcggcgggtcagggcgcgagctgcgggttcggaatgcgtgggcagaaatcgcgctcggggcccggcgtccggcgcgggttcgagggagggcagatgccgctctaccgccggattcccaagctacgcggcattgccggcggaatgcacattgggttgccgaagtatgtgccattcaatttaaaagatatagtgcgtggtggattcaaagatggtgacgagttatcactggagaccctgaaatcacggggcttgatcaatccatcaggcagggaaaggaagttgccactgaagattttaggggatggtgatgtatcagtcaagttgaacatcaaggctggagcattctcagcatcggctaaagagaagctcgaggcagctggttgtaacctgactctattgcctaaacggaagaaatggctttcacagaattatctgaagaaccaagcccgtgcagaagagtactttgccaagaaaaaagccggtgctggcgaatccgatggcacctctgcatagaattccaatatgatgtactcctcttcttccctttcctttagcatatgcttatttctccctttttgctcttagttattcatgtatcatgaattttgtatctatgtgatatgcaattattttatgccccttcttgc

SEQ ID NO: 10464 - protein, 270 aa, Panicum virgatum
  misc_feature: Ceres CLONE 1724464
  misc_feature (78)..(185): Pfam Name: Ribosomal_L15 Pfam Description: Ribosomal protein L15 amino terminal region
  misc_feature (197)..(228): Pfam Name: L15 Pfam Description: Ribosomal protein L15
MASTITFLSLSPTATFLHIPASTSSSFVAAPGILTSRRRAAPRALPLRARPLRRVTVVCSGAAAAAEASDAAAPAEKFRLDNLGPQKGSRRRPKRKGRGIAAGQGASCGFGMRGQKSRSGPGVRRGFEGGQMPLYRRIPKLRGIAGGMHIGLPKYVPFNLKDIVRGGFKDGDELSLETLKSRGLINPSGRERKLPLKILGDGDVSVKLNIKAGAFSASAKEKLEAAGCNLTLLPKRKKWLSQNYLKNQARAEEYFAKKKAGAGESDGTSA

SEQ ID NO: 10465 - DNA, 1469 bp, Panicum virgatum
  misc_feature: Ceres CLONE 1724469
  misc_feature: Encodes the peptide sequence at SEQ ID NO. 10466
aaaaaaaatccaaaccggcaaacccaacacagcaagctggtcagacaagaaacctgggctacttcccctgctccccgttccttgcgatcctatccgccccacgcgtcgttcaccgccaccgcgccgcgtgccatggcgaccggcgacgaccagcgctgcccggcggcgttcgctgggaacgccgccggcgacgcggagagcgcgacggccatcgaggacctgcccgtggacgtcctggccctcgtgctccgccgcctcgacggcgcgtctctggccgcgttcggctgcgcgtgcgccgccttccgcggcctcgccgccgacccggacgcctggcgcgcgctctgcctcgcgcgctggccctcgctccgcgacgtgccctccgctcaccacaagggccaccggcggctcttcgccgacgcgttcccgttcccggccgcgcctgcgccgtcgtccgccgtcccggcgcgccgcctccccgcgcggctcgtctcggccgtcgacctccatcacgggggcgcctgcatcctgtcgcgcgtcgtggacaccgacgccgcgtcggagtggttcctgggcgcgccgttccgcgtcgacgcgctcgtgcaggagggcttctcggcgccggcgcccatcactcccgccgacctgtcgctcagctgggtcctcatcgacccggccaccgggcgcgccgtgaacgcgtcgagccggcgaccggtgtccgtggaccggcggtggcccacgggggagacggtggtgcggttcgccgtggtgctcggcgggggcgtcgcgctggacgccgccgtcacgtgcgacgatcgcttcgggcatgttagggaggtgagcctctgcatcgaggacggcgagggcggcttcttgagcgggcgggacgggctggccgtggtggccgcggccatggcgggcgccaggcaggggcgcggcgcggaggctgcggccaggctgcggtacgaggagttcgtcaaggggagggcggccaggaaggagcggaaggccaggcgggaaggcatcgtcgacctctgctgctccggcgtcggagcggcggcgttcctaggcttcctagtgatgttgacattccggtgacatttcgacgaccgccacgcaaatgtacagctcggctgacgagcaatgtgaatagtaggaaaaagatgagctatatatataacttgacgcttgacacgcacgctgcacgcaagagctgtaattacgtacatggtgcaggttacaggttttaacaacactagaaatttagacaagggccatctcagcgtattgaagatatgactcgtcttactaatgatcaaatgtgtatggtcccttacccaattgatacaggttcggacttttacgaaaggaagcatttgtttgctccatgacagacaaacagacacccatgttaaatgctttaccctggctccaaaaataaatcagtccagcgtaggcacttgctttgttcg

SEQ ID NO: 10466 - protein, 320 aa, Panicum virgatum
  misc_feature: Ceres CLONE 1724469
  misc_feature (25)..(72): Pfam Name: F-box Pfam Description: F-box domain
MATGDDQRCPAAFAGNAAGDAESATAIEDLPVDVLALVLRRLDGASLAAFGCACAAFRGLAADPDAWRALCLARWPSLRDVPSAHHKGHRRLFADAFPFPAAPAPSSAVPARRLPARLVSAVDLHHGGACILSRVVDTDAASEWFLGAPFRVDALVQEGFSAPAPITPADLSLSWVLIDPATGRAVNASSRRPVSVDRRWPTGETVVRFAVVLGGGVALDAAVTCDDRFGHVREVSLCIEDGEGGFLSGRDGLAVVAAAMAGARQGRGAEAAARLRYEEFVKGRAARKERKARREGIVDLCCSGVGAAAFLGFLVMLTFR

SEQ ID NO: 10467 - DNA, 1389 bp, Panicum virgatum
  misc_feature: Ceres CLONE 1724483
  misc_feature: Encodes the peptide sequence at SEQ ID NO. 10468
aggatgagcaaatggctcaccagatgctcctcggtaccctgcgcaccaacgtgctcatcaatcccacctgcgtcaccggcggccgcgcagcgttaccaaggtcgtccgcaagaatatgcagacggaaatttgcagtcgcagccatctcaggcgattatctcccgatgcgaagtactgaagcgaaaaatcggacatcaaaaagtgacatcagaagcctcagactaatgacagcagtcaaaacaccttatttaccagatgggagatttgatctcgaagcgtatgattatttgatcaatatgcagatagagggtggtgctgaaggtgtaatagttggaggaacaacaggagagggtcaccttatgagctgggatgagcacatcatgctcattgggcatactgtcaattgcttcggcactagaattaaagtgatagggaacacaggaagtaactcaactggagaggccgttcatgcgaccgagcagggatttgccgtcggcatgcatgcagctcttcacatcaatccttactatgggaagacttcaactgaaggaatgatcgctcatttcaaggctgtcctcccaatgggtccaaccatcatttacaatgctccatcaaggactggacaggatatcccccctccagtcattgaggcactttcaagtcatccaaacattgcaggtgtgaaagaatgtgtcggacatgagagggtcaagtgctacacagacaaaggtatttcagtatggagtggcaatgatgatgaatgccatgattcaaggtggaaatatggtgccattggagttatctctgtgactagcaaccttgttcctggtctcatgcacagtctcatgcatgaaggggagaacgtgaccctaaatgagaaactgttgcctctgataaaatggttattttgcgaaccaaatccaattcctctggacactgctctggctcagctcggggttgcaaggcctgttttgagattgccatacaaggctcttcctattgagaagagggttgagtttgtccggattgttgatgctattggacgggaacactttattggaaatagagaggcaagggttcttgatgacgaagatttcatctcgatctgtcggtaaacatgggatctggacagctaagatggatcctgtggatacggcaaggtcgactagatggctcccatgttctacatttatgtttcagtggtcatgtactgtaagcacttggttcagtagcagtgaagctaatacgtagggcttaatattgtttttgtacctcttgctgggtaaacttgcaccgtttctaaaaagattgtaaaccttacctgcagtatagcatgtaaaacatatggttatttgttaagcaaaatagttatacgattctatgttgctg

SEQ ID NO: 10468 - protein, 367 aa, Panicum virgatum
  misc_feature: Ceres CLONE 1724483
  misc_feature (67)..(344): Pfam Name: DHDPS Pfam Description: Dihydrodipicolinate synthetase family
  misc_feature: SWISSPROT Homolog: EC 4.2.1.52 Dihydrodipicolinate synthase
MAHQMLLGTLRTNVLINPTCVTGGRAALPRSSARICRRKFAVAAISGDYLPMRSTEAKNRTSKSDIRSLRLMTAVKTPYLPDGRFDLEAYDYLINMQIEGGAEGVIVGGTTGEGHLMSWDEHIMLIGHTVNCFGTRIKVIGNTGSNSTGEAVHATEQGFAVGMHAALHINPYYGKTSTEGMIAHFKAVLPMGPTIIYNAPSRTGQDIPPPVIEALSSHPNIAGVKECVGHERVKCYTDKGISVWSGNDDECHDSRWKYGAIGVISVTSNLVPGLMHSLMHEGENVTLNEKLLPLIKWLFCEPNPIPLDTALAQLGVARPVLRLPYKALPIEKRVEFVRIVDAIGREHFIGNREARVLDDEDFISICR

SEQ ID NO: 10469 - DNA, 800 bp, Panicum virgatum
  misc_feature: Ceres CLONE 1724485
  misc_feature: Encodes the peptide sequence at SEQ ID NO. 10470
aagccgcaaaagccctagcgccgccgccgctgccgctgcgatcccagcagccgccaccgcaaccatggctaccgtgctcacccgcccggccgcgggcaccgtccagtgcttcggccgcaagaagacggccgtggccgtggcctacaccaagcccgggcgcgggctgatcaaggtgaacggtgtccccatcgagctgatccgcccggagatcctccgcctcaaggccttcgagcccatcatgctcgccggccgctcccggttcaaggacatcgacatgaggatccgcgtccgcggcggaggcaagacgtcgcagatctacgccatccgccaggccgtcgctaagggtctcgtcgcctacttccagaagtacgtcgatgaggccgccaagaaggaggtcaaggacatcttcagccgctacgaccgcaccctcctcgtcgccgaccccaggcgctgcgagcccaagaagttcggtggtcgcggtgcccgcgccaggttccaaaagtcgtaccgttgagcgattgcttcgcgcatcacaatctgccaggtcactgcgggtgttcttggcttcgtgttctatcaatggagcaacttatctggttctatatctagctgccgctttaccttcatgtttagatttttaagcctagtgtcgaacctttttttgacattgtgatatgaaatgtgagacagatattcaagactattctgtagtctcttatgtatggttttgcttgttacctatgtccaggagttatgatatggtttccttctgtttatgctaagagtagtatttctatttt

SEQ ID NO: 10470 - protein, 149 aa, Panicum virgatum
  misc_feature: Ceres CLONE 1724485
  misc_feature (17)..(149): Pfam Name: Ribosomal_S9 Pfam Description: Ribosomal protein S9/S16
MATVLTRPAAGTVQCFGRKKTAVAVAYTKPGRGLIKVNGVPIELIRPEILRLKAFEPIMLAGRSRFKDIDMRIRVRGGGKTSQIYAIRQAVAKGLVAYFQKYVDEAAKKEVKDIFSRYDRTLLVADPRRCEPKKFGGRGARARFQKSYR

SEQ ID NO: 10471 - DNA, 1133 bp, Panicum virgatum
  misc_feature: Ceres CLONE 1724490
  misc_feature: Encodes the peptide sequence at SEQ ID NO. 10472
gagcgtcagtgcgtcgcggacgggagaggcgccatggcgatgcgagcagctacggcggcggccacaggcttcttttcttcgccctcctccgtctccccgaggcgtttctcgtcctcctcgccgccggcgtcgctctccgccgggcgctgcatccgtcgccatcgtctccgcgcctttccgagttcggaattgcctctggaggaactcaacccatccgttgatctactgagaaaaactgctgaggccgtcggtgatttcaggaaaactccaatctatatcgttggcacggactgcacagccaagcgcaacattggcaagctccttgccaattctataatataccgctacctctgtagcgaggaactgctcgaggatgttcttggtggcaaggatgcccttagagccttcaaggaatcagatgagaagggctatcttgaagtcgagaccgaagggttaaagcagctcacgtccatgggtagccttgtgctttgctgtggggatggcgctgtcatgaactcaactaatctgggcttactgaggcatggtgtctccatttggatcgacgttcctctcgagatggcagcgaacgatatgctgaagagcacgggaacacaagctactacagatccagactctttctcacaggcaatgagcaagctccgtcagcagtatgatgaactgaaagaacgctatggaatttctgatattactgtttcagtacaaaaagtggcttctcagctgggctacagcagtgttgactctgtgacccttgaggacatggttcttgaaattgtgaggcaaattgagagactgatccgagcaaaagcgatgatggaagctgcagggaagcccttctagacaataggtgtggcattccgctccggcatttacatattatctccagttgccagagcaggcatttggctcttccatggagctgattacagttaacccacgaatcaagcacaagcattttcaaatccgaggagcagaatcacactgttgtgcttgaatatgcttatttcgtattgtaaaatcgcatgtcatttgatagcccattgtgtaaatctgccatggtgcagcaactttcagattgtatttactgtcaatggaaatgacagatctgcctgtcc

SEQ ID NO: 10472 - protein, 274 aa, Panicum virgatum
  misc_feature: Ceres CLONE 1724490
  misc_feature (90)..(258): Pfam Name: SKI Pfam Description: Shikimate kinase
  misc_feature: SWISSPROT Homolog: EC 2.7.1.71 Shikimate kinase
MAMRAATAAATGFFSSPSSVSPRRFSSSSPPASLSAGRCIRRHRLRAFPSSELPLEELNPSVDLLRKTAEAVGDFRKTPIYIVGTDCTAKRNIGKLLANSIIYRYLCSEELLEDVLGGKDALRAFKESDEKGYLEVETEGLKQLTSMGSLVLCCGDGAVMNSTNLGLLRHGVSIWIDVPLEMAANDMLKSTGTQATTDPDSFSQAMSKLRQQYDELKERYGISDITVSVQKVASQLGYSSVDSVTLEDMVLEIVRQIERLIRAKAMMEAAGKPF

SEQ ID NO: 10473 - DNA, 646 bp, Panicum virgatum
  misc_feature: Ceres CLONE 1724505-R
  misc_feature: Encodes the peptide sequence at SEQ ID NO. 10474
tgcagctcgcctggtccacgctcgcctcgaacgtgccccgcctcgaggtgccggaggaggtgttcgccgacgctggcagggccgccggcgcgcaggtgaaccgggccctgggcgcgctccaggacatctcctgcgggagggacctgaggcggttcctcatcgtgatcgccgtgttcttcgcggccgcggtcgtcgggagcttctgcaacttgctgacggtcatctacatcgggttcgtgtgcgcgcacacgctgccggtgctatacgagaagtaccaggaccaggtggacgagttcctgtgcagcatgctgggcctgctgcagaagcagtaccagaagctcggcagcaagggcgtcctcggcaaagggaaggccaggaagagcgactagctggttggttcgatctgctctgccgtgtaacataatctgctggggcggacggctggtccactgatacgcctgtctgcatgtacgcagccagctgcggtttcctgaaaccaactcgatgtcctgtacagtgctgaaagtacttgcttgtgtaatgcactacagtaatgctttagtagcttcgaaaacagcgcattaaacgaggttcttcttgggagctgtagcgacctcaaaatgcaagtgtgtggcttttatgtttc

SEQ ID NO: 10474 - protein, 128 aa, Panicum virgatum
  misc_feature: Ceres CLONE 1724505-R
  misc_feature (2)..(127): Pfam Name: Reticulon Pfam Description: Reticulon
QLAWSTLASNVPRLEVPEEVFADAGRAAGAQVNRALGALQDISCGRDLRRFLIVIAVFFAAAVVGSFCNLLTVIYIGFVCAHTLPVLYEKYQDQVDEFLCSMLGLLQKQYQKLGSKGVLGKGKARKSD

SEQ ID NO: 10475 - DNA, 124 bp, Panicum virgatum
  misc_feature: Ceres CLONE 1724505
tgtcaccgaggcacgctgcacccagcgtatagaccggccgagcgtcccgaaaagaaggcgggggacatgatcagcaacatcttggacgccatcgccaagaacctccagaacatgaagtcgcgcc

SEQ ID NO: 10476 - DNA, 1049 bp, Panicum virgatum
  misc_feature: Ceres CLONE 1724507
  misc_feature: Encodes the peptide sequence at SEQ ID NO. 10477
aaccagcagcatccggccggcgaccaccgtccgcccgtgagtgagcgagcggaggcgcactaccgtacaatggcccgggcttcctctccccatcagttccttggagcggcggtcacggtggcgcttgtagtccttgccgccgcgccgtccgcgctcgccggcgacccggactacctccaggatctctgcgtcgccgacctcaactccgagctgaaggtgaacgggttcccgtgcaaggcgaacgccaccgccgccgacttcttctcgagcgtgctggccaagccgggcaacaccaccaacgccgtgggctccgtggtcactggcgccaacgtcgagaaggtcccggggctcaacaccctgggcgtctcgctctcccgcatcgactacgcccccggcgggctcaacccgccgcacacgcacccgcgcgccaccgagctcgtcttcgtcctctacggcaccctcgacgtgggcttcgtcaccaccgccaacaagctcgtcgccaggaccatatcccagggcgacgtcttcgcgttcccgcgggggctcgtgcacttccagaggaacgccggcgacgagcccgccgccgtcatctcggccttcaacagccagctccccggcacgcagtccatcgccatgacgctcttcggggcctcgcccgaggtgcccgacgaggtgctcgccaaggcgttccagatcggcgccgaggaggtggacaagatcaaggccgaattcgcgcccaagaagagctgaggacccaggtggaactgattttggtctggccatcagtcgctgatgatgatattggtatgcattggttggttcgaagttcgattattctgctgttgcttcgtttgcttcattgcttgtgattgagcgtgcaatgcaatcgtacgcgtcgttgggtttgtgttgtgtgtgatgatcgtcggttaagtgtgagtgtgtgacctgcagaatgagttggtaggtccctctctctgtcttgtaatacagctgcaggcctgatggagaccagtctgttcatctcatactcttcagcaccccaatcc

SEQ ID NO: 10477 - protein, 226 aa, Panicum virgatum
  misc_feature: Ceres CLONE 1724507
  misc_feature (67)..(215): Pfam Name: Cupin_1 Pfam Description: Cupin
  misc_feature (102)..(177): Pfam Name: Cupin_2 Pfam Description: Cupin domain
  misc_feature: SWISSPROT Homolog: EC 1.15.1.1 Superoxide dismutase
  misc_feature: Functional homolog of the protein sequence given in SEQ ID NO 50204
  misc_feature: Useful for making plants with modulated nitrogen use efficiency
MARASSPHQFLGAAVTVALVVLAAAPSALAGDPDYLQDLCVADLNSELKVNGFPCKANATAADFFSSVLAKPGNTTNAVGSVVTGANVEKVPGLNTLGVSLSRIDYAPGGLNPPHTHPRATELVFVLYGTLDVGFVTTANKLVARTISQGDVFAFPRGLVHFQRNAGDEPAAVISAFNSQLPGTQSIAMTLFGASPEVPDEVLAKAFQIGAEEVDKIKAEFAPKKS

SEQ ID NO: 10478 - DNA, 1166 bp, Panicum virgatum
  misc_feature: Ceres CLONE 1724511
  misc_feature: Encodes the peptide sequence at SEQ ID NO. 10479
agttgcgttgttcttgctagctagcatcatccatctcctcttgaattccccccaaacatcatccgtcagagaaagagattgaagaagccatggcggccgccgccgcgattcccgctgccgccatcagtcgccccaaccagcgcatctcgctcgctcccagtcccaggccgccttgcccttccctttccctccgctcgggctttgtggggcgcgcgctggccaccgggcagccggtggccgttgttgtcccgcgccgccgcgtgtcggtgcggatggcgtgggacgggccgctgtcctcggtgcgcctcatcgtgcagggcaggaacgtcaaggtgtcggacaaggtgaaagagcacatcgaggacaaggtcgggcgggccgtgtccaagcactgccacctcgtccgcgaggtagacgtccggctctcggcccgcggcggcgacctcggcaggggccccaagacctcccgctgcgagatcacgctcttcagcaagcgccacggcgtcctccgcgccgaggaggacgccgagtccacctacgccagcatcgacatggccgccgccatcattaagcgcaagctccgcaagatcaaggagaaggagacggagctgcgcgcgcgccacatcaaggacgactgggacctccttccggatgccattattgccggcgatgacgaccaacaacaagaaggcgccgatgccgagcaggacctgacggaggccttgggagctgaggacgaggacacggtgctcaccaaggtcgtgcgcaccaaggtgttcgagatgccgccgctgggcgtggacgaggcgctggaccagctggagagcgtcgaccacgacttctacgccttcaggaacgaggaaaccggcgaggtcaacatcctctacaagaggaaggagggcggctacggcctcatcatccccaaggacgacggccacgtccacaaggaggccattactggtgctggtgctgctactgctgcacctccaccagcagcagagccctcctacgccgccgccgtgcgccggggcgacaacaactagccaagccatgccaccagttgcctcgcaaactcgtcgacgatccaaagccatgtcatcgatctcgatcacttgtcctgtgctgtctcacatttttaactctgttcgcgattatcatgcctgctg

SEQ ID NO: 10479 - protein, 317 aa, Panicum virgatum
  misc_feature: Ceres CLONE 1724511
  misc_feature (72)..(174): Pfam Name: Ribosomal_S30AE Pfam Description: Sigma 54 modulation protein / S30EA ribosomal protein
MAAAAAIPAAAISRPNQRISLAPSPRPPCPSLSLRSGFVGRALATGQPVAVVVPRRRVSVRMAWDGPLSSVRLIVQGRNVKVSDKVKEHIEDKVGRAVSKHCHLVREVDVRLSARGGDLGRGPKTSRCEITLFSKRHGVLRAEEDAESTYASIDMAAAIIKRKLRKIKEKETELRARHIKDDWDLLPDAIIAGDDDQQQEGADAEQDLTEALGAEDEDTVLTKVVRTKVFEMPPLGVDEALDQLESVDHDFYAFRNEETGEVNILYKRKEGGYGLIIPKDDGHVHKEAITGAGAATAAPPPAAEPSYAAAVRRGDNN

SEQ ID NO: 10480 - DNA, 1362 bp, Panicum virgatum
  misc_feature: Ceres CLONE 1724519
  misc_feature: Encodes the peptide sequence at SEQ ID NO. 10481
gcatccggaggcgcacggacctgcctctccttcctcccatggcgccgcccctcgccgccgtatcctcctcgtcgcccctcttctcgccctcctcattccgccccctcatccgccgccatgcgcctccgagctatgtctccttgcggacgcgtggccgttcgcagcccgcggcggcggcggcggccgcggccgagtcctccggcagcccgcttctcgaggtgcgaggtctcaccgcatccgtgaaggagaccgggcatcagatcctcgccggcgtcgacctcaccatccgcgagggcgagattcatgcgatcatggggaagaacggctccggcaagagcaccctcacaaaggttcttgttggccatccacattatgaggtaactggtggcaccattctcttcaagggtgaggacttggttgacatggagccagaggaaagatctctcgcaggcctttttatgagtttccaagcacctattgagattcctggcgtgagcaattttgattttctgctcatggcagtcaatgctcgcagagaaaagagtgatctaccagcattgggaccccttgagttttattcggttgtatcatccaaagttgatgccttgaagatggacccgaagttccttgatcgcaatgtgaatgaaggttttagtggtggtgaaaggaagcgcaatgagatactgcaactttcagtcattggagcagatttagctcttcttgatgagatagattcaggattagatgttgatgcaattgaagatgtagctattgcggtgaatgggcttttgacaccccaaaactctgttctgatgattacgcattaccaacgtcttttggatctcatcaaacccagctatgttcatatcatggaaaatggcaagataatcaagactggtgacagttctattgccactcaaattaatgaaggtggcttcaaatcaatcgcccttgtatagctttaaagtcaaacacttgaaatagcttgctgggagcctatttgtcagaagtactgcctggggtttgcaacttaattactagacgtactatgcatgctggggtagcatctactgaatgaactcaacaaaacttttgagtttgtgtaccccattcaaccaggcatgttatcttttgaaggtggagagttggttattgatacaagtagtggtacccagggaaagcatcttactacaagattcacaaattttgtatatttgagtatgactcgttgccttgggcatctacttatcaagattgttttgcatgtacctttttgtaaacattttaaacacttataactaatgtgcaggcctagaaaattagtagatgtctccgcacgggagaagttttggtgcgatcatc

SEQ ID NO: 10481 - protein, 306 aa, Panicum virgatum
  misc_feature: Ceres CLONE 1724519
  misc_feature (86)..(281): Pfam Name: ABC_tran Pfam Description: ABC transporter
  misc_feature: SWISSPROT Homolog: EC 3.6.3.31 Polyamine-transporting ATPase
MAPPLAAVSSSSPLFSPSSFRPLIRRHAPPSYVSLRTRGRSQPAAAAAAAAESSGSPLLEVRGLTASVKETGHQILAGVDLTIREGEIHAIMGKNGSGKSTLTKVLVGHPHYEVTGGTILFKGEDLVDMEPEERSLAGLFMSFQAPIEIPGVSNFDFLLMAVNARREKSDLPALGPLEFYSVVSSKVDALKMDPKFLDRNVNEGFSGGERKRNEILQLSVIGADLALLDEIDSGLDVDAIEDVAIAVNGLLTPQNSVLMITHYQRLLDLIKPSYVHIMENGKIIKTGDSSIATQINEGGFKSIALV

SEQ ID NO: 10482 - DNA, 1328 bp, Panicum virgatum
  misc_feature: Ceres CLONE 1724525
  misc_feature: Encodes the peptide sequence at SEQ ID NO. 10483
aaccgcatcaggagttcaggacttggggggacgcgcggcgttggagttcgccggcggcgaggagccgaggagaaggccggatccggaggatgggctgctccatatctgggctcaacgccctctacgagtccgcaacgggcggcggcgacgtctggatcaacgagcgccgcttccgcgtcctccgccagatcggcgagggcggcttcgccttcgtctacctcgtcagggagcagcagcccgcctccgacgccgcgcccgcaaggcaccacgaccacgcttcccacgtctcagaggatggaacatatgccatgaagaaggtgctgatacagagtaaggagcagttggatctggtgagggaggagatccgtgtgtcgtcattgttcaatcaccccaacctgttgccacttcttgatcatgctataatagctgtccagggagattggagccatgaagcgtacctgctctttccagtccatttggatggtacattatttgacaacgctaatatcatgctgtccaaaaaagaattctattcaacagctgacgttctgcaaatattccatcagatgtgtgaaggactgaagcacatgcacagctttgatcctccatatgctcataatgatgtgaagcctggtaatgttcttataacccgtcgtaaaggacaagcacctgttgcaactttgatggattttggaagtgcaaggcctgcaagaaagcaaatccgttctcgttctgaggcgttacagctgcaggagtgggctgctgagcattgctctgcaccttatcgtgcccctgaattatgggactgcccaagccatactgatattgatgagaggacagacatctggtctttaggatgcaccctttacgcaatcatgtttaatgtttcaccgtttgagtatgctcttggtgaatctggaggaagtttgcaacttgctattgtcaatgggcagttgaagtggccagcaggacctaaccctccttatcctgatgaacttcgtcagtttgttatctggatgcttcagcctcaacctgcgatgcgccctcacattggcgatgtagttcttcatgttgacaagctcatcgcaaaatacttgtcctaaaccagctcgtacttgccattctgtctcatttctttgttacacaaagtgaacatagtgtaaaatgggttcatgattgacatcattcaatcgttagataagtgcaatattgatattcttcgtagaactttcagattgttattgacatccatcaaatgttttactcagtcatgtacaaatatgtcaagtgaacatcagaagtttctatataatatatgtaatagcatc

SEQ ID NO: 10483 - protein, 337 aa, Panicum virgatum
  misc_feature: Ceres CLONE 1724525
  misc_feature (28)..(328): Pfam Name: Pkinase Pfam Description: Protein kinase domain
  misc_feature: SWISSPROT Homolog: EC 2.7.11.1 Non-specific serine/threonine protein kinase
MGCSISGLNALYESATGGGDVWINERRFRVLRQIGEGGFAFVYLVREQQPASDAAPARHHDHASHVSEDGTYAMKKVLIQSKEQLDLVREEIRVSSLFNHPNLLPLLDHAIIAVQGDWSHEAYLLFPVHLDGTLFDNANIMLSKKEFYSTADVLQIFHQMCEGLKHMHSFDPPYAHNDVKPGNVLITRRKGQAPVATLMDFGSARPARKQIRSRSEALQLQEWAAEHCSAPYRAPELWDCPSHTDIDERTDIWSLGCTLYAIMFNVSPFEYALGESGGSLQLAIVNGQLKWPAGPNPPYPDELRQFVIWMLQPQPAMRPHIGDVVLHVDKLIAKYLS

SEQ ID NO: 10484 - DNA, 1259 bp, Panicum virgatum
  misc_feature: Ceres CLONE 1724539
  misc_feature: Encodes the peptide sequence at SEQ ID NO. 10485
aatcttcgattcgcttctcttctcctctcgagcgctgtggtttctccccatcgcgagctctctcttctctctccgccccccctcccttcctcgagcgcggtttcggccatggcggcggcggcggcggtcgcgaaggggagcgtggtgtcgccgagcggcaaccgggccgcgccggggctcctgggccggcggaggggcgccgtggcggcgcggatggcgccatcggcggtgcggatcggggcgccctggaggaagaccgcgttcctcggcggcgggaggctggcggtcgggcccatgagatccaggtccgcgtcccggactctcgtcgcgtcgccggtgcagatgaacatgaaccttgcgattgggaaatccatgaggtggtgggagaaggggctgcagcccaacatgcgggaggtcgagtccgctcaggacctcgccgattcattggccaacgccggcgacaggctcgtcatcgtagacttcttctcccctggctgcggaggttgccgtgctcttcacccaaagatttgccagtttgcggagcagaatccggatgtgctgttcttgcaagtgaactatgaggagcacaagtctatgtgctacagcctccatgtccatgtcctacctttcttcaggttctacaggggagctcagggacgtctctgcagcttcagctgcaccaacgcaactatcaagaagttcaaggatgcccttggaaagcacaaaccagatagatgtagcattggcccgactagggggctggaggaatcagagttattagcactggccgcaaacaaggacctgcagttcacctacaccaagaagccagaactgatccccagtggagatgctgctgcagaagtcattgctcccgagcctgtagagttcccagcggcaacaaagccgttggtcaggctggggtccgaggagaggtccttggtctcatcaggaagataagatgcagggttatctttaggatgatcagatccttccattctgtacagttccgtggttgttcttgatgtgtacaggttgtagcatctcatgctagtagagcgcaggccatgatttttacatgtgaagcctgcccgcccgcctgtcctccggactccagtagtttagcaagtttgtatcagcactttagcagtagcagactagcagagtggtgttgtggagcttctgcctcctgtttgggtgtatttcgcgaagctcaataatcaatcatgtcttatgttgtggcagaccttgtatgctgcccg

SEQ ID NO: 10485 - protein, 282 aa, Panicum virgatum
  misc_feature: Ceres CLONE 1724539
  misc_feature (102)..(205): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MAAAAAVAKGSVVSPSGNRAAPGLLGRRRGAVAARMAPSAVRIGAPWRKTAFLGGGRLAVGPMRSRSASRTLVASPVQMNMNLAIGKSMRWWEKGLQPNMREVESAQDLADSLANAGDRLVIVDFFSPGCGGCRALHPKICQFAEQNPDVLFLQVNYEEHKSMCYSLHVHVLPFFRFYRGAQGRLCSFSCTNATIKKFKDALGKHKPDRCSIGPTRGLEESELLALAANKDLQFTYTKKPELIPSGDAAAEVIAPEPVEFPAATKPLVRLGSEERSLVSSGR

SEQ ID NO: 10486 - DNA, 1318 bp, Panicum virgatum
  misc_feature: Ceres CLONE 1724541
  misc_feature: Encodes the peptide sequence at SEQ ID NO. 10487
gtctatcattgcgctgcctggaagacgagttcgcagttcacttcgatcgcggcaacggcggcggcgcagacgaaaaggccgggcaaagggagccgatcaatccgcgccgcaaccgtcttgatctgtggggtgtagtgtcgcgtcctagcccttctgttccttccacatccccatccatcaaaggcatggagccgggagccaaatcagaagcgaagcaaggtgaggcgggatccggcgcggcgggaggcggcggcggcagcagcggcagcaaggtgtatcacgagaggcagaggctgcagttctgcctgctccacgccctaaacaacctgatgcaggaaaaggaatgttttacccgagctgagttggacaggattgctggaaatcttgttcttagtgatccaaacaaggaccaatggactcctttatctttcatttttagacctcaccacaatgtgctaactgggaactatgatgtaaatgttctcattacggcgttagaagctagaaaaaagaaggtggtttggcatgatcgtcgaaaaggggcatcatcaatcgatttggatggagaagcgttggtgggtcttataatcaatttgccaatcaggaggttcggtggcctctggactggcaggcatcgggtagcgattcgaagcattgatggtgtctggtttaatttggatagtgatctttctgaacctaagaagtttaaggacaaagaaaatgtgattgcattccttgatagctcacttaatcaaggtggagaactcatggttgtgctgcaagatgaataaccgttctgcctgtaatctcgaaagcctactgaattagcctatgtgacagcccatatttctgaattgcgatcgcgatgggatcgcaggcatctgcagcagaaattgcattaaaccttgaagtttaataatggagcataatggacagatcggtaaatggaagcttcaatgtgctaaaaatatacttgtttctgatgttggtatgggacctctgtttgattgttgtgtccgtctctgtcatactggattgccaaccaggtatctgaagtggtcaaaacataaggttgctaaatgatggaaagaaacagcttgtacatgtagttgtgaggcctaaaaaaagagaaagaaacaacttcagttctcagcaagaatggagttctgcagaacttaagtggaggatgggtatctgctgctgctgtagttataaatgctgtggagaaccaaagttgtcctcgcatgctcttagaatttgtcaatgggctttgtaaggatatgtacattatacagtaactatttagtagttgataccc

SEQ ID NO: 10487 - protein, 201 aa, Panicum virgatum
  misc_feature: Ceres CLONE 1724541
  misc_feature (27)..(201): Pfam Name: Josephin Pfam Description: Josephin
MEPGAKSEAKQGEAGSGAAGGGGGSSGSKVYHERQRLQFCLLHALNNLMQEKECFTRAELDRIAGNLVLSDPNKDQWTPLSFIFRPHHNVLTGNYDVNVLITALEARKKKVVWHDRRKGASSIDLDGEALVGLIINLPIRRFGGLWTGRHRVAIRSIDGVWFNLDSDLSEPKKFKDKENVIAFLDSSLNQGGELMVVLQDE

SEQ ID NO: 10488 - DNA, 1098 bp, Panicum virgatum
  misc_feature: Ceres CLONE 1724546
  misc_feature: Encodes the peptide sequence at SEQ ID NO. 10489
gctgaattcttcttcatgaatccatttcggcgttttgataaactgaaattttctttcgtttcttcttgcgttggccggagagcagagactggtcctttaatttgaagcaacaaggagagaaagatgtccagtgtttggaagaccaaagttctgcctggcctcaacaagttctttgacaaggatggcaagaaggcggcggcggctgagttcttgaagtccttcaacaaggaggagattggcaaggagattgaggacaagaagacagagctggagcccaaggttgtggaggcttatgaagcatctcctcctgaagttaaggctcttttcaaggacaagaaaccagtcaagatcaccaagaagaactcggctgcagcaaccaagttcctcgacgagctggctaagattgagttccctggagccaagctggtgagcgacgcggtggccaagtccggcaccacgcccctctccccggcgatcaccttcatcttggacaaggttgcgccgttcatccccaaggaggagcccaaggccgagccggaggccacctcccgggaagtcgccgtggaggagaagaaggaggaggccgagacggcggccgctgcggctccggaggaggctgctgcgccggtggaggcggtagaggagaagaaggctgaggaggagaagccagcggaagccgaagccgaggccgcggcggcgccaccagctgaggaggagaagaagtgatctgatcgccggtggacattagtgaagaattgctaagcaagcaaattaagctactaccaagctccgatcctgcacaaattaagtgattaagtaagtcgttacatgtacacacagttgccatgcatgctgcttcaattgatttgcttgcatatatgggtgcgtggtggatgcatgaacatttgttattcttttgtgtcacctggaccggatcgatgaatggaccttcattctgtaaatttgtaatgtggggttagtgagtttttctctttcttgtttttgatttggggtgattaaacatgcatgcatgcgcgtgtaattatttgtattgatatgtttgttggtggtcatatttaagaaaacaactcgacgatc

SEQ ID NO: 10489 - protein, 200 aa, Panicum virgatum
  misc_feature: Ceres CLONE 1724546
  misc_feature (2)..(200): Pfam Name: DREPP Pfam Description: DREPP plasma membrane polypeptide
MSSVWKTKVLPGLNKFFDKDGKKAAAAEFLKSFNKEEIGKEIEDKKTELEPKVVEAYEASPPEVKALFKDKKPVKITKKNSAAATKFLDELAKIEFPGAKLVSDAVAKSGTTPLSPAITFILDKVAPFIPKEEPKAEPEATSREVAVEEKKEEAETAAAAAPEEAAAPVEAVEEKKAEEEKPAEAEAEAAAAPPAEEEKK

SEQ ID NO: 10490 - DNA, 992 bp, Panicum virgatum
  misc_feature: Ceres CLONE 1724549
  misc_feature: Encodes the peptide sequence at SEQ ID NO. 10491
ccgcaagatgctttacagcaaacaggtccggtgggcgccgcagcacctccacccaaaaaacgtgagcgcatccgccgccgaagccgccgcccgccgccagtgcgtgcttgctgcgaccgggcgttcgattggtcgggttgctagggtttagagggttttgggcgcggacaggcaggagattaggcggaggcgatggcgtcagcggaggaggagatcgcggtgaaggagccgctggatctgatacggctcagcctcgacgagcgcatctacgtcaagctccggtccgaccgcgagctccgcggcaagctccatgcatacgatcaacacttaaacatgatccttggtgatgttgaggaggttgtaacaactgttgagatagatgatgaaacatatgaagaaattgtgcgcgtaagtccattggcgtttttgccctaattcttgaaaatgttttgtaaagtcaaacttttggttgtcaaattatcattattcatttgaacttttagactccttgagtttcatggttctgatttctgctgctataaggtggcataattccataatactttgataatgagttaatgactcgtattactggtaacctgatgacacaggacagctatttactttatctattgtcaatcatttaaatgtgtaatgaagatgttgatacactaactctttgctagataatctttgcagacaacgaaacgcactatccccttcctttttgtccgaggtgatggtgtcatattggtttctccacccctgcgaactgcatgatgctagaagttaaatggagctgattgccaactatttactctgtatttggccacttgatggcttggagtgtatgccatgtgctgcactgttactgttttctgatggattgtaggcttaacgagtgatacgatcatgtaactactacctggtgtttgaatcttcagtcgaattattcttatgtgctgttctcagctaattcaacgcgcttgcat

SEQ ID NO: 10491 - protein, 80 aa, Panicum virgatum
  misc_feature: Ceres CLONE 1724549
  misc_feature (15)..(75): Pfam Name: LSM Pfam Description: LSM domain
MASAEEEIAVKEPLDLIRLSLDERIYVKLRSDRELRGKLHAYDQHLNMILGDVEEVVTTVEIDDETYEEIVRVSPLAFLP

SEQ ID NO: 10492 - DNA, 889 bp, Panicum virgatum
  misc_feature: Ceres CLONE 1724564
  misc_feature: Encodes the peptide sequence at SEQ ID NO. 10493
acttgtttttgatacccacgccacgccggagagcctgggagaaatttctcagagcctggaggccggaggatcgaagatggagaacgcggtggtgctccgggagtggttcgaccgcgtggacgccggccgcaccgggaacatcaccgctcctcagctccagagcgctctcgccgtgggcaaccttgacttccctctctccgtcgtgcagcagatgataaggatgtatgactttgatcggaacggaaccatgagcttcgaagagtttctggctcttaacaagttccttcagaaggtgcaaggtgtcttctccaccctagaaaggggtcgtggatttctcagtcttgaggaggtgtatgagggattaatcaaacttggtttctcattggattcacctgctttctacacagtttgtgagagctttgacaagagcaagaaggggatggttcatttggatgaatttatatcactttgcatttttgtgcaatcagctcgtaacttgttcaactcattcgatacaagcaagcaaggaagagtgagtttggactttaaccaatttgtttactgcacggcaaactgcaggatatagcttctacttgacacctgcacatggaaacacagacaaaaagtctgcagtgtgaagcaagaacctttcaccaatcaaacctcagcatcggcagctggttggtattgcaatttgcgaaacaaggcttctttcagttcgttgtttgcgaaacaaggcttcttgtaccgccattttacttgaatttcttcaaggttggctgtccgtcattttgtgtcaaatttacaataatcctgggctgtatatatagaataagacatggcaatctgtggctgtatttgtagcaatatcatttaatctaggcattac

SEQ ID NO: 10493 - protein, 169 aa, Panicum virgatum
  misc_feature: Ceres CLONE 1724564
  misc_feature (42)..(70): Pfam Name: efhand Pfam Description: EF hand
  misc_feature: SWISSPROT Homolog: EC 2.7.11.1 Non-specific serine/threonine protein kinase
MENAVVLREWFDRVDAGRTGNITAPQLQSALAVGNLDFPLSVVQQMIRMYDFDRNGTMSFEEFLALNKFLQKVQGVFSTLERGRGFLSLEEVYEGLIKLGFSLDSPAFYTVCESFDKSKKGMVHLDEFISLCIFVQSARNLFNSFDTSKQGRVSLDFNQFVYCTANCRI

SEQ ID NO: 10494 - DNA, 1050 bp, Panicum virgatum
  misc_feature: Ceres CLONE 1724565
  misc_feature: Encodes the peptide sequence at SEQ ID NO. 10495
actgctcgagcgagctccagctctcaagaaaccacgccggatcatggccatggcgcctttccttcgcccgctcgtcctcgcgctcctgatcgcgtcctgcgccgcgcagcaggcgccgccggcgcagcccccgcagacgccgaacgccccgccgcaggcgcctccggcgggcaacccgccgccggctccccaggcgcctctggccggcaacccgcctcccgcacccaccactcctcctccggctccgacgaccacgccgcccccggcaccgaccacccctcctccggcccccaccacgccgcccccggccccggtgactcccccgccagcccccaccacgccgccgccgtcgccgccggcctctcccccgcccgctcccaccaccccgccacccgctcccgccaccccgcccccgtccccgcccatggcgccgcctccggccacgcctcctccccccgccaccccgcctccggccgcgcccacgccagccccgagcaccgccccgacgctcccgcccgtggcgacacccgccgcgtccccgaagagccccaagaccccgagccccgccgccgcgacgtccccggcgcccgcgctctcgcccgtgggcacgccgacgaccgaagactcgggtgcgagcgcgcgcgcggccggcttcgccactgtcgtggcgttggcgggcgcgggcctcgccctcctgctttgagtagtagatctcctcctcctcctcctccgatcccgtgcctcgacgacgacgctgctcctccgtttccatttcatctctctttttctttcgttctttttctaccgtgttgttatatttaattttaccggcatgctcgggccgaccgattcttgatgtacgatgatgacgatggtgatgcattggtttctatggttccgcgggcggattggtggtggttagtgctccgccccgcgggtgtcgcactgtacttttaccgcactacattttggttctatagagaggattttgtgtatattcttggtgcattatttctgtggcagttgaataaattctctatgcggattatt

SEQ ID NO: 10495 - protein, 217 aa, Panicum virgatum
  misc_feature: Ceres CLONE 1724565
  misc_feature: Functional homolog of the protein sequence given in SEQ ID NO 50205
  misc_feature: Useful for making plants with altered cell wall content and/or composition
  misc_feature: Functional homolog of the protein sequence given in SEQ ID NO 50206
  misc_feature: Useful for making plants with altered carbohydrate content
MAPFLRPLVLALLIASCAAQQAPPAQPPQTPNAPPQAPPAGNPPPAPQAPLAGNPPPAPTTPPPAPTTTPPPAPTTPPPAPTTPPPAPVTPPPAPTTPPPSPPASPPPAPTTPPPAPATPPPSPPMAPPPATPPPPATPPPAAPTPAPSTAPTLPPVATPAASPKSPKTPSPAAATSPAPALSPVGTPTTEDSGASARAAGFATVVALAGAGLALLL

SEQ ID NO: 10496 - DNA, 1030 bp, Panicum virgatum
  misc_feature: Ceres CLONE 1724574
  misc_feature: Encodes the peptide sequence at SEQ ID NO. 10497
tcgacagccctcccgctgagggcctcaggttcatctcgtccctctgttaacctttcccttctcttggtctcggactctctcctctcttgctcttgcttgcccggcggcgacgactgagcgagcagcgtcgacatttgtcacgtcttcgccccaccctttgccggcgacgagcatccaccagtaagatgattaatcttttcaaaataaagggtcaaaagaaagaagaggcggcaagtgctgctggaaaggcccctgttaagaagcagtctgctggggagctccgcctccataaagatattagtgagctcaacttaccgaagactacatcaatttcttttcctaatggcaaggatgatctaatgaattttgagatcatcatccgacctgatgaaggatattatatgggaggcactttcattttcacctttcaagtgtccccatcttatcctcatgaacctccaaaggtcaagtgcaagaccaaggtgtaccatccaaatattgatttggaaggcaatgtatgtctgaacattctgcgtgaagattggaagcctgttcttaacatcaacactgttatttatggcctgaatcttcttttcacgcaaccaaacgacgaggatccattgaaccacgaagttgcagttgtcctccgtgacaacccaaagatgtttgaggcaaatgttaaaagggcgatggctggaggctacgtaggccaaaactatttcccaagatgtgcttgacttggcgctgggtgcgaaacgatttctagtgccgccctgcgcgactgggcccctgtatcccaaccagcacgcccgagtttgctggatttgtgtggttttcagtgcgcggaaactgcttctgggagcaaaattcaaatcgcccgtggtgtgatgtgcatgtttgcccgtcctttgtgatgtgtttaaaacccgtaaattaagtttgatgatggggtggtggtacagatgacaaggatatgtatgccaactgtgtaacttgataaatcctaaatgggaatgggaagtgaattcat

SEQ ID NO: 10497 - protein, 183 aa, Panicum virgatum
  misc_feature: Ceres CLONE 1724574
  misc_feature (33)..(169): Pfam Name: UQ_con Pfam Description: Ubiquitin-conjugating enzyme
  misc_feature: SWISSPROT Homolog: EC 6.3.2.19 Ubiquitin--protein ligase
MINLFKIKGQKKEEAASAAGKAPVKKQSAGELRLHKDISELNLPKTTSISFPNGKDDLMNFEIIIRPDEGYYMGGTFIFTFQVSPSYPHEPPKVKCKTKVYHPNIDLEGNVCLNILREDWKPVLNINTVIYGLNLLFTQPNDEDPLNHEVAVVLRDNPKMFEANVKRAMAGGYVGQNYFPRCA

SEQ ID NO: 10498 - DNA, 527 bp, Panicum virgatum
  misc_feature: Ceres CLONE 1724577-R
  misc_feature: Encodes the peptide sequence at SEQ ID NO. 10499
cccgctcggccaggtgttccagcgcgtcgacgtggtgagccgggacctcgacaacatcgtcgagctcgagctcggcgcgccgtggccgctgccgccactcgaggccacggccacgctggcgcacaagttcgagatcgtcgggacgtcggggatcaagatcagtttcgagaagacgacggtgaagacgagggggagcctgtcgcagctgccgccgctggaggtgccgcggatccccgacaacctgcggccgccgtccgacgccgggagcggcgagttcgaggtgacgtacctcgacggcgacacgcgcgtcacccgcggggacaggggcgagctccgggtgttcgtcatcgcctgagccgatggatggatgaccactggatctgcccatgaatgtcctgagttctgaccaatgttgaagcaatccgttcgtccatcatactacggtaatctggcagtacgtagaactcgagcatccatgaatcgagttgcgcattgcactttgcaagggtgctgccatttgtttatgc

SEQ ID NO: 10499 - protein, 117 aa, Panicum virgatum
  misc_feature: Ceres CLONE 1724577-R
  misc_feature (1)..(115): Pfam Name: PAP_fibrillin Pfam Description: PAP_fibrillin
PLGQVFQRVDVVSRDLDNIVELELGAPWPLPPLEATATLAHKFEIVGTSGIKISFEKTTVKTRGSLSQLPPLEVPRIPDNLRPPSDAGSGEFEVTYLDGDTRVTRGDRGELRVFVIA

SEQ ID NO: 10500 - DNA, 602 bp, Panicum virgatum
  misc_feature: Ceres CLONE 1724577
agcgccactcccctccgcccgccgacccggctcgcccaccacaaaaaatctcatccaccacgaccccttccttcttcaagaacgccatggaaatctcgcgcgctcgctgcgactcctcctcctccttcttcttcttcccgtagcttcccgcgctctaaccgagcccaaggtacgcgacgcgcggcacaccggaacctgttcgctttcgcctattgctctggtcgtgcgacctgtgacctgtcatccatggccatggccgcgccgtggtcgtcgtcgtcctgctgcaccgcgacggcgtcgacgagcgccccgcggccgctgggtctggggagccccaagggcgcgacttggccggccggtgccggcgggtcgagctgcacggggcagcggaggaacaggcggcggcggcgactgtccgtctgtgccacggcggccgcgccgccgcccgtggactacgcggacgccagcgccgccggcgccgacgccgactacgtggcgtcgctcaaggtcaagctgctgagcgcggtgtccgggctaaaccgcggcctggcggcgggccaggaggacctggaccgcgcggacgcggcggcgcgggagcttcg

SEQ ID NO: 10501 - DNA, 650 bp, Panicum virgatum
  misc_feature: Ceres CLONE 1724578-R
  misc_feature: Encodes the peptide sequence at SEQ ID NO. 10502
agtggagttctagtcccagaggttgatgcagttgttgctttctatgggacaccatcttctgaacttgccgacccttctaaggctaaggctcctatccaggcccattttggagagcatgacagttttcttgggttttcggatgtcactgcggccaagtccctggaggagaaggtcaagtcttctggtgtgccatatgaagtccacatatacccgggatgttcgcatgccttcatgaacagttcgcccgaggccctcaagaggaagaagggaatgggtctgagtgatgagaaccaggaagccgtcgacctggcctggtctcgcttctctgcttggatgggccgtttccttggattctgcttgagtcattccccagttcattcgcggtgtgattatgtgcggcgtcagggtcccatgaataaaatgtgttcagatccaggctgctgtatccaaaccctacaaatggactgggttgtaatgcgctctggatttggttgtcgttgggcagttcaaccgtggtgtcttgggatttttttggaccgatacatatagcgcagtaggaggaattcgttgatggtgtttggatggtatcaagcgagaaggcaacttttactactgaactcgaagtataaactagtcaaaattgccggatc

SEQ ID NO: 10502 - protein, 182 aa, Panicum virgatum
  misc_feature: Ceres CLONE 1724578-R
  misc_feature (1)..(116): Pfam Name: DLH Pfam Description: Dienelactone hydrolase family
SGVLVPEVDAVVAFYGTPSSELADPSKAKAPIQAHFGEHDSFLGFSDVTAAKSLEEKVKSSGVPYEVHIYPGCSHAFMNSSPEALKRKKGMGLSDENQEAVDLAWSRFSAWMGRFLGFCLSHSPVHSRCDYVRRQGPMNKMCSDPGCCIQTLQMDWVVMRSGFGCRWAVQPWCLGIFLDRYI

SEQ ID NO: 10503 - DNA, 227 bp, Panicum virgatum
  misc_feature: Ceres CLONE 1724578
gcgggcctgcgccctgctcggggggaaggaataaggaaaaagggatggccacagcgcagctgctccgacgcacctcctcggccttcctatacagcaccaccacagggcctttacgaccgcgcagccctatgctccggcggatcacgtagacacgaacggccataacaacctactcctctggcgcctctttcgataagatcaagatgacgcccgagaacactacaatt

SEQ ID NO: 10504 - DNA, 1188 bp, Panicum virgatum
  misc_feature: Ceres CLONE 1724582
  misc_feature: Encodes the peptide sequence at SEQ ID NO. 10505
aagctaccgtctgcctttctcttgtgttttcagattggttccgaagagatgggcctaaaggtgttccattggctgaatcggaggatgcatcctaacactgagtactgcaccatccatgagaacaaggcagccatggaggataaggaagactctgtgcgtcagagtgttgctgagaaagacactgaagctctgctgctccgtgatgttcttcttaacggtatacttgcaatcggcacacttggacatcatgttgactccctttgtcctgaggcctgcattgaagaagatgatttcctcgtcatggatgaggaggtagtagttgaggaagagaaaaatgaagaggaacccaggaatgagaaggtcaaagaagatgctgcactggcaatagcactaagtgaaccagtagttcctgttgttgagcctgccaagatgcattcatcgtcgatgaaagaagacaatttctcatgtttcgtgacggaagaaatcctaatgcatgaggttgaagatgggggtgccgctaatatccaggaacgaccacttctgatggtagagaaggtggagaaagtaagaactacacttgctgatttatttgcagcagaagcattctcatctagtgctccaggggagaagaattgccaggatatcgtcattgttgctggggcatccacttcgaagcctgcattgtgcactgaaaaggcgcataaaaagaaaccaacgaagccaacaccaaagccactgaaagccacaagaaaattaagtcgggtcatgaggaagatgttggggaagaaaatccacccagagcagctcaatgggcgtagcaatgcagagggccctcttactgcatgatgtacctagtcttgccgacaagtttgcttccctatctggtttcattggatccctacgactgagattccttgcccgagagaagcgtccatgcatatgttgacagtgttgaagtacctttttttttgttgccgtgtttcgtcgccggtgaagcatgaatagcattctgctttccctatacatatattctcgtcgtgcctatctgcatgtaaaaatcaactgctgaggtgtgtatgatcttgtaaggtgtcattctccggcgcgctgtcggcgccgcactgtcccgtcgtcgcggtatgtgtcgtaaaaaaaaagttaataaacctcctctgtttatccgttggc

SEQ ID NO: 10505 - protein, 265 aa, Panicum virgatum
  misc_feature: Ceres CLONE 1724582
  misc_feature: Functional homolog of the protein sequence given in SEQ ID NO 50207
  misc_feature: Useful for making plants with modulated light quality sensitivity
  misc_feature: Useful for making plants with modulated biomass
MGLKVFHWLNRRMHPNTEYCTIHENKAAMEDKEDSVRQSVAEKDTEALLLRDVLLNGILAIGTLGHHVDSLCPEACIEEDDFLVMDEEVVVEEEKNEEEPRNEKVKEDAALAIALSEPVVPVVEPAKMHSSSMKEDNFSCFVTEEILMHEVEDGGAANIQERPLLMVEKVEKVRTTLADLFAAEAFSSSAPGEKNCQDIVIVAGASTSKPALCTEKAHKKKPTKPTPKPLKATRKLSRVMRKMLGKKIHPEQLNGRSNAEGPLTA

SEQ ID NO: 10506 - DNA, 1112 bp, Panicum virgatum
  misc_feature: Ceres CLONE 1724592
  misc_feature: Encodes the peptide sequence at SEQ ID NO. 10507
gcaccaacaaccaaaggagagcacccgcgcatgtttagcttcgccgggcgcgcctccaccgcatcgagcatcgtcgccagcctcgccacccccgcgccgccgtccaagcccatcagccccgccttcgcctccgcccgccgccccaggctcatcatgagcgcgcccgtcttcgccgcccccagcgccgtcgcggagcgaagccaagttgggcttccctggtgcccgtgcactaggagcatggacgccgtggagcgcttgaagagcgggttcgagcagttcaagacccaggtctacgacaagaagccggagctgttcgagccgctcaaggccggccaatgccccaggtacatggtgttcgcctgcgccgactcccgctgctgcccgtcggtgaccctgggcctgcagcccggcgaggccttcaccatccgcaacatcgccgccatggtcccgccctacgacaagaacaagtacgccggcatcggggccgccatcgagtacgccgtctgcgccctcaaggtggaggtcctcaccgtcattggccacagccgctgcggtggcatcagggcgctcctctccctccaggacggcgcagccgacaccttccacttcgtcgaggactgggtcaggatcggctaccaggccaagaagaaggtgcagaaagagcaccccactgttccgttcgacgatcagtgctccatcttggagaaggaggctgtgaacgtgtccctctacaacctcttgacctacccctgggtcaaggaaggtgtggccaacgggaccctcaagttggtcggtgcccgctacgacttcgtgaacggtgtgttcgacacatgggagaaatgagccataaacttctactacgtcatatacatacatacatacctatatgcacctgatcgatgtgaatccgtggagtacttactgcctatttcgaccgccactacaagccggatcgtcatcctatatgcgaatgtaataagcaatagcattttctactgctttactttcaaatgtggagcttatatgtaatatatggtgcgcaatttgaccgcttttgtggtcaaaagacatcagctgtataagcctttttcataatattatctcaatttact

SEQ ID NO: 10507 - protein, 270 aa, Panicum virgatum
  misc_feature: Ceres CLONE 1724592
  misc_feature (99)..(269): Pfam Name: Pro_CA Pfam Description: Carbonic anhydrase
  misc_feature: SWISSPROT Homolog: EC 4.2.1.1 Carbonate dehydratase
MFSFAGRASTASSIVASLATPAPPSKPISPAFASARRPRLIMSAPVFAAPSAVAERSQVGLPWCPCTRSMDAVERLKSGFEQFKTQVYDKKPELFEPLKAGQCPRYMVFACADSRCCPSVTLGLQPGEAFTIRNIAAMVPPYDKNKYAGIGAAIEYAVCALKVEVLTVIGHSRCGGIRALLSLQDGAADTFHFVEDWVRIGYQAKKKVQKEHPTVPFDDQCSILEKEAVNVSLYNLLTYPWVKEGVANGTLKLVGARYDFVNGVFDTWEK

SEQ ID NO: 10508 - DNA, 1044 bp, Panicum virgatum
  misc_feature: Ceres CLONE 1724605
  misc_feature: Encodes the peptide sequence at SEQ ID NO. 10509
gacactgccacactgatcgatcgacgacccacctgcgcttcgttgcgtggcaagccagtcacgactcgcaaggagtagcgagagcgatcgccatgcagctggccatgcggagactcgtgcgcgtcctcgtggcgctcggcgtggtcgccgcggcggcggcgcagcaggccccgacggcggcgccggccacgcccacgcccacgccggcaacccccgcggcgccggcgccggtggccgcgtcgagcaacatcacgggcgtgctggccaagggcgggcagttcaacaccttcatccggctgctcaagtccacgggcgtggcgtcgcaaatcgacaaccaggtctccaacggcggcaacgggatcacggtgttcgcgcccacggacaacgccttcacgtcgctgccctccggcacgctcaactcgctctccgaccaggacaagaacgcgctcgtccagtaccacgtcgtctccaccgccatcccccagtcgcagttcgacaccgtcagcaacccgctccggacgcaggccggcagcagctcgccgggggagtacccgctcaacgtcaccgccgtcggcggccagcaggtgaacatctccaccggggtcgtcaacgccaccgtcgacaacaccctctacaccggcgacaacctcgtcgtctaccaggtcaacaaggtgctgctgccggcgaagctcttcggcactcccgaggcccccgcgcccgcgccgctcgcgccggccaagaagaagggcaagacgccggcgtccgtcgcggactcgcccgaggccgaggcgtccccggacgcgaccacgtcgctcgcagcggcgagggtgacgggaggtggcctcgcggcggctcttgcgctggcagccgtgtggtgggggctgtaatgacggcgatgagagtgtgagatccccgtgacgtcatcagttccatctttttttatactttttttgcaggtcttttttttaaacgtgtttttcgcaggtcttgttggtcttttctttttcactttggccatttttggatgaattattcttcattgcc

SEQ ID NO: 10509 - protein, 264 aa, Panicum virgatum
  misc_feature: Ceres CLONE 1724605
  misc_feature (62)..(197): Pfam Name: Fasciclin Pfam Description: Fasciclin domain
  misc_feature: Functional homolog of the protein sequence given in SEQ ID NO 50208
  misc_feature: Useful for making plants with altered carbohydrate content
  misc_feature: Functional homolog of the protein sequence given in SEQ ID NO 50209
  misc_feature: Useful for making plants with altered cell wall content and/or composition
MQLAMRRLVRVLVALGVVAAAAAQQAPTAAPATPTPTPATPAAPAPVAASSNITGVLAKGGQFNTFIRLLKSTGVASQIDNQVSNGGNGITVFAPTDNAFTSLPSGTLNSLSDQDKNALVQYHVVSTAIPQSQFDTVSNPLRTQAGSSSPGEYPLNVTAVGGQQVNISTGVVNATVDNTLYTGDNLVVYQVNKVLLPAKLFGTPEAPAPAPLAPAKKKGKTPASVADSPEAEASPDATTSLAAARVTGGGLAAALALAAVWWGL

SEQ ID NO: 10510 - DNA, 1322 bp, Panicum virgatum
  misc_feature: Ceres CLONE 1724607
  misc_feature: Encodes the peptide sequence at SEQ ID NO. 10511
gtgctctctcagaggtgggttggcttctccccctcttaccaagtcctcggttctagggttttagttggaaggggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcaaccgagcagtcgatgctcgacgccatcgaagccatgaacggcaaggagctcgacggccgctgttcgcgagcacctggagagccgcggtgctctgcgccgccgccgccgacggcacgtgcgaccaccttgactgccaccgcgggcccttcatcgtggtctacgtcctcgaccatcacagggagggtatcctcacctgcgtgtactcgtcggaggctggcacatggagcaaaccagtctatgatgggcacaggcgcatcctgcgtaactttctcagtggggagcgcggtgcacttgccaagaatgcgctccacttcatgattgggaacgaaaactcaatcctcaggtgtaatttgcgcacattgaaaatgtctgtgatccatctgcctcgcctgcactcggaccgaagattaactccccccgtgccaattatgctgacaactatggaggatggtcggctgggattcgcagtagtggagggctccagattttgcctatggtcgatagacggtggagagttaggatggctactagtcaaagtcattgatcttaagaagctgctcccccttgatgcctcttcgactgccaatcctcgtttgcttggatttgcggaaggtgttggtgtcattttcctaagtgttggaaatgagatcttcactgttgatctaaagtccaccttggtgaacaaggtatatgagggctcaggcgtcactggcatcattccctacatgaccttatgcactccagtaatgggagtgccatctacagatgatggatcaggagctggtggctcaactgatcaatggtcatgtgtggccagtggtcttcgcagtcaaggcaaatagctggtgctgttcctaaaccatacatggattaagccgagtaattgcagagtaaagtacccgtacatagcataccggaatcgtgtgataaacatactgttatcatgcattatgttgtgtgattatgggctctcaaaactggctgaaaatcttactgtgtatgtcatgtgtgattgagctgctccgccaaggtggggtccgtgtttatggagctaaatcggttggtaaccagattc

SEQ ID NO: 10511 - protein, 162 aa, Panicum virgatum
  misc_feature: Ceres CLONE 1724607
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50210
  misc_feature: Useful for making plants with modulated biomass
  misc_feature: Functional homolog of the protein sequence given in SEQ ID NO 50183
  misc_feature: Useful for making plants with altered alkaloid content
MAAADVEYRCFVGGLAWATDNASLQQAFASYGDVLDSKVITDRETGRSRGFGFVTFSTEQSMLDAIEAMNGKELDGRCSRAPGEPRCSAPPPPTARATTLTATAGPSSWSTSSTITGRVSSPACTRRRLAHGANQSMMGTGASCVTFSVGSAVHLPRMRSTS

SEQ ID NO: 10512 - DNA, 1109 bp, Panicum virgatum
  misc_feature: Ceres CLONE 1724627
  misc_feature: Encodes the peptide sequence at SEQ ID NO. 10513
gctcggcttcggctcctcctatcgccttatccactccaccctgcccatctcaccttcccgaagctagaaatggccgcgtcccactgaacccgacccaccctcggacaaccccctccgcctccggctgctgccgctctagctcacggacgccgcaatggccgcggccgtcgccgcatccgcgttcctctcctcctccttcgccccccgccaccaccaccgccgcctggccaggcccgtgacgcgccgcgccgccccggcgggactggccgtgcggtgcgagcagagcgacaagcagaagaggcagccgctcgccgcgctcgtgccccgcgagcagcgcttcatgttcgagggcgacgagctctgcggccccgacatatggaatacaacatggtatcctaaggctgcagatcatgttaccacgaagaagacatggtatgttgttgatgcaacagataagattctaggcaggctagcatccaccattgcagtacatatcaggggaaagaatgaacccacgtacactcccagtgtggacatgggtgcttttgtcattgtggtcaatgcagagaaggttgctgtttctggtaaaaagcggtcacagaagctctacaggaggcactctggacggcctggaggaatgaaagaggaaacttttgaccaacttcagaaaaggattccagagagaatcatcgaacatgcagtgcgtggaatgcttcccaagggcaggctgggaagaagactatttacccacgtcaagatttacaaaggggcagaacatccacacgtggctcagaaacctgtccctctgcctatcagggataaaagaatacaaaagactgattagagaatcatcatcaattggaaaaaaaaaatgcagtgacgaattcctctcctgaaggttttgccattgctgggaatgccatcctcagagccatgcatctgccgagggagtgtaaatctttttgtaatttgaataccaaagaatgatccggcccaaaatctctgttttccatttgaagtttgtaatattgacctgatatgagatggtaggttctttcattgttggacatgaagtttaaatccggaaggtgccatctggaaattctgcc

SEQ ID NO: 10513 - protein, 229 aa, Panicum virgatum
  misc_feature: Ceres CLONE 1724627
  misc_feature (93)..(220): Pfam Name: Ribosomal_L13 Pfam Description: Ribosomal protein L13
MAAAVAASAFLSSSFAPRHHHRRLARPVTRRAAPAGLAVRCEQSDKQKRQPLAALVPREQRFMFEGDELCGPDIWNTTWYPKAADHVTTKKTWYVVDATDKILGRLASTIAVHIRGKNEPTYTPSVDMGAFVIVVNAEKVAVSGKKRSQKLYRRHSGRPGGMKEETFDQLQKRIPERIIEHAVRGMLPKGRLGRRLFTHVKIYKGAEHPHVAQKPVPLPIRDKRIQKTD

SEQ ID NO: 10514 - DNA, 1166 bp, Panicum virgatum
  misc_feature: Ceres CLONE 1724629
  misc_feature: Encodes the peptide sequence at SEQ ID NO. 10515
gttcccagcgcagcaggagaaaagaatcgtctcgtctcgtctattctctccatccccgcagtccggattcccgaccaggttccagaaaaacccccgtccaattcgcgagatggcggagcagcccaacccccagccccaagtggaggagaaggaggtggtggtggagcagcagcagcaggagccgaagagggcccccaagctgaggtacctggatttcgtccatgtggcggcggcgcaggccgtggtgtgcctggcggggctctacgggctcgccaagagccacgccggcccgctccgccccggcgtcgacgccgtcgagtccgcggtgaagggcgtcgtcggccccgtctacgatcgcttccacagcgtgcccctcgacgtcctcgccttcgtcgaccgcaaggtggatgacaccgtgcacgagctggataagcacctccctggcgcgctgaaggccgcgtcggcgcaggcctacgcggtggcccgcggcatcccggaggtggcgcgcgagctggccgccgaggcgcagcagtccggcgtgaagggcgcggcccgcgcggcgctggccaaggtggagcccgtggccaaggacgtgtacgggcgcgtggagccggtggccagggacctgtacgtgcgctacgagcccgcggcggagcacctcgccgtctccacctggcgctcgctcaacggcctcccggtgttcccgcaggtcgcgcagatcgtcgtgcccaccgccgcgtactgggccgagaagtacaacaaggtgatcgccgccgcggccaaccagggctacactggagccaagtacctcccggccatccccaccgagcgcatcgccaaggtgttctcttcgtcgacgccggattcggagcctttggccgagacccagtagtatgttgatgcctggagcgcgttagtattaccctgccctgcctatggccctatgggtacactctggattccccctcccctccaactgatctgaataagacagtgagaatccggggggctaaagatggtggtaatgttgtgctagatatggtgatgaggcgctgtcatggtctcatggaccatgatgatgatgctgtactccagaagtccactagctctgctttgtgtggttctctgcttcttgctttttgtataaaatttcgttcgatgtcgcg

SEQ ID NO: 10515 - protein, 260 aa, Panicum virgatum
  misc_feature: Ceres CLONE 1724629
  misc_feature (19)..(250): Pfam Name: REF Pfam Description: Rubber elongation factor protein (REF)
MAEQPNPQPQVEEKEVVVEQQQQEPKRAPKLRYLDFVHVAAAQAVVCLAGLYGLAKSHAGPLRPGVDAVESAVKGVVGPVYDRFHSVPLDVLAFVDRKVDDTVHELDKHLPGALKAASAQAYAVARGIPEVARELAAEAQQSGVKGAARAALAKVEPVAKDVYGRVEPVARDLYVRYEPAAEHLAVSTWRSLNGLPVFPQVAQIVVPTAAYWAEKYNKVIAAAANQGYTGAKYLPAIPTERIAKVFSSSTPDSEPLAETQ

SEQ ID NO: 10516 - DNA, 1083 bp, Panicum virgatum
  misc_feature: Ceres CLONE 1724645
  misc_feature: Encodes the peptide sequence at SEQ ID NO. 10517
attcataggctggtgttggtgatctcagatcgcagctccattccttctcctcccctgcacagactggtcctttaatttgaagcaacaaggagagaaagatgtccagtgtttggaagaccaaggttctgcctggcctcaacaagttctttgacaaggatggcaagaaggcggcggcggctgagttcttgaagtccttcaacaaggaggagattggcaaggagattgaggacaagaagacagagctggagcccaaggttgtggaggcttatgaagcatctcctcctgaagttaaggctcttttcaaggacaagaaaccagtcaagatcaccaagaagaactcggctgcagcaaccaagttcctcgacgagctggctaagattgagttccctggagccaagctggtgagcgacgcggtggccaagtccggcaccacgcccctctccccggcgatcaccttcatcttggacaaggttgcgccgttcatccccaaggaggagcccaaggccgagccggaggccacctcccgggaagtcgccgtggaggagaagaaggaggaggccgagccggcggccgctgcggctccggaggaggctgctgcgccggcggaggcggtagaggagaagaaggctgaggaggagaagccagcggaagccgaagccgaggccgcggcggcgccaccaactgaggaggagaagaagtgatctgatcgccggtggacattagtgaagaattgctaagcaagcaaattaagctactaccaagctccgatcctgcacaaattaagtgattaagtaagtcgttacatgtacacacagttgccatgcatgctgcttcaattgatttgcttgcatatatgggtgcgtggtggatgcatgaacatttgttattcttttgtgtcacctggaccggatcgatgaatggaccttcattctgtaaatttgtaatgtggggttagtgagtttttctctttcttgtttttgatttggggtgattaaacatgcatgcatgcgcgtgtaattatttgtattgatatgtttgttggtggtcatatttaagaaaacaactcgacgatcgatcttgtgc

SEQ ID NO: 10517 - protein, 200 aa, Panicum virgatum
  misc_feature: Ceres CLONE 1724645
  misc_feature (2)..(200): Pfam Name: DREPP Pfam Description: DREPP plasma membrane polypeptide
MSSVWKTKVLPGLNKFFDKDGKKAAAAEFLKSFNKEEIGKEIEDKKTELEPKVVEAYEASPPEVKALFKDKKPVKITKKNSAAATKFLDELAKIEFPGAKLVSDAVAKSGTTPLSPAITFILDKVAPFIPKEEPKAEPEATSREVAVEEKKEEAEPAAAAAPEEAAAPAEAVEEKKAEEEKPAEAEAEAAAAPPTEEEKK

SEQ ID NO: 10518 - DNA, 993 bp, Panicum virgatum
  misc_feature: Ceres CLONE 1724650
  misc_feature: Encodes the peptide sequence at SEQ ID NO. 10519
tgcctgattgatcctcccggaagatcaaacactccaaggacactgaagaaaagatggcggagcgttcagagaacgcggcgggggaaatgatgagcaacatcatggacgccatcgccgagaacctcccgagcaagaagtccgtcaggttcgacgacggcgagggctccatctccgaccaggcccgaaagctgttgggcggcaagaagtccgtccaccacgtcctgggcggcgggaagtccgccgacgtgctgctgtggcggaacaagaagatctcgtcgagcgtactgggcgtggcgacgctggcctgggtcttcttcgagtggctcgactaccacctgctcaccatcgccagcttcgcgctcgtgctcggcatggccgtgcagctcgcctggtctgccctcgcctcgaacgtgccccgcctcgaggtgccggaggagctgttcgcggacgccggcaaggccgccggcgcgcaggtgaaccgggccctcggcgcgctccaggacatctcctgcgggcgagacctgaggcggttcctcattgtgatcgccgtgttcttcgtggtcgccgtcgtcgggagcttctgcaacctgctgacggtcatctacatcgggttcgtgtgcgcgcacacactgccggtgctgtacgagaagtaccaggaccaggtggaggagttcctgtgcaacatgctgggcctgctccagaaccagtaccagaagctcggcagcaagggcgtcctcagcaaagggaaggccaggaagagcgactagttcgatctctgccggctgctgctggtgtacatagttagcctcattgcgtgtatgcaatcagctgcgattgcctgaacagcgggtgtctccgtttatttctgccaactcggtgtcctgtacagtgctgaaagaactaccattcttgtgtaatgcaaataatgcttagtagcttcgaacagcacattaaacgaggttcagatggttcatctttttttttcttgggatc

SEQ ID NO: 10519 - protein, 237 aa, Panicum virgatum
  misc_feature: Ceres CLONE 1724650
  misc_feature (62)..(236): Pfam Name: Reticulon Pfam Description: Reticulon
MAERSENAAGEMMSNIMDAIAENLPSKKSVRFDDGEGSISDQARKLLGGKKSVHHVLGGGKSADVLLWRNKKISSSVLGVATLAWVFFEWLDYHLLTIASFALVLGMAVQLAWSALASNVPRLEVPEELFADAGKAAGAQVNRALGALQDISCGRDLRRFLIVIAVFFVVAVVGSFCNLLTVIYIGFVCAHTLPVLYEKYQDQVEEFLCNMLGLLQNQYQKLGSKGVLSKGKARKSD

SEQ ID NO: 10520 - DNA, 766 bp, Panicum virgatum
  misc_feature: Ceres CLONE 1724658-R
  misc_feature: Encodes the peptide sequence at SEQ ID NO. 10521
gccctacgacgtcgacagcgagcgcctcgcgcagctcttcgagcaggctggtgtcgtcgaggtctcagaggtcatttacaacagagaaacagatcggagccgtggatttgggtttgtcactatgagtactgtcgaggaggctgagaaggctgtggagatgttccatcgctatgatgtcaatggaaggcttcttactgtaaataaagcagctcctagaggttctcgtgtggaaagacctcccagacaatttggcggtccttccttcaggatttatgtgggcaacctgccatggcaagtggatgactctagattggtgcagttgttcagcgagcatggtaaagtggttgatgccagagttgtctatgaccgagaatctgggcattcgcggggatttggttttgtaactatggcaacacaggaggaattggatgatgctattgctgcccttgatggacagagtttggatggccgtgccctgcgggtgaatgttgcggaggagcgaccgcggcgaggtttctagtgaggatgtgtctgggtggacagcagacttgttccataggagcatcatagcgtggtctgatactggtttagaccctccattctcttttcttgtgttctgggctccctatcatcctgtcttattgtgaagaggaagtgttctctgctatttcattaactgttggttgtgttcatgagttcatgtattgtaggctactgttatggtgcacctagctcaatttgtcgttgcaattcaaaattttgtcgg

SEQ ID NO: 10521 - protein, 172 aa, Panicum virgatum
  misc_feature: Ceres CLONE 1724658-R
  misc_feature (90)..(161): Pfam Name: RRM_1 Pfam Description: RNA recognition motif. (a.k.a. RRM, RBD, or RNP domain)
  misc_feature (1)..(66): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: The sequence is a functional homolog of SEQ ID NO 22 in US patent 7244875
PYDVDSERLAQLFEQAGVVEVSEVIYNRETDRSRGFGFVTMSTVEEAEKAVEMFHRYDVNGRLLTVNKAAPRGSRVERPPRQFGGPSFRIYVGNLPWQVDDSRLVQLFSEHGKVVDARVVYDRESGHSRGFGFVTMATQEELDDAIAALDGQSLDGRALRVNVAEERPRRGF

SEQ ID NO: 10522 - DNA, 354 bp, Panicum virgatum
  misc_feature: Ceres CLONE 1724658
actcgcgcggcgccaccatggcctcctccgtcgcggcggctctccgcgccctcgccgccagcacctccgcctccctcgcgaagcccagcgccaccccgtcccccttcctcgtcctcctcgccccgaccccgccccgccgcccgctcggcctccgctccgcccgccgcctgccgctcgccccgctcgccgcctccgactccttcgagtcctccgtcggcgtcgactacgcggagccggcccccgccgagtccgagcgggagggggaggaggagggaggaggaggcgtgcggggcgggcggtgggcggggggaggcggggaggcaggggggcgggggcgaggaggaggtcgggagg

SEQ ID NO: 10523 - DNA, 757 bp, Panicum virgatum
  misc_feature: Ceres CLONE 1724659
  misc_feature: Encodes the peptide sequence at SEQ ID NO. 10524
cctccccacggcgccaaagccacaaacccgagttcctctgctcccccgagcagccgacacagagtggtctccagagcactccccatggcgacgggagctgcgacggcccccgttcagactgtggtgctgagggtgtccatccactgccatggctgcaagaagaaggtccggaaggtgctcaagagcgtcgaaggtgtgcagagcgtgacggtggacgccgcgcagcacaaggtgacggtgacgggcaccgtcgacgccaacacgctcgtccagaggctgcacaagtccggcaagaagggggtgccgtggcagtactgccacccgcccgccaacaagaccgaggccgcgccggcgccggaggcagctccgccggcgcagcctgccggcgacggcggcaaggatgctgctgcgaaagcggcggacaagaaaccggaggaggcggtgaaggagccgcaggtcgagagctccgagaagaagcagcctaagcaggaggccgcgggcacggagaagaaggcggaagcagagccgaaggcggagaagaaagcggaagcagagccgaaggcggagaagaaagcggaggcgaagaaggacggcggcgacagcgaggcagctgagaccaaggccaagggcgcagagccagcaaaggaagaggcgaaagaagccgccgccgccgccgctaatgccaagaacgaggacgcggcaaagaagaacgacaagcccagggacgccggcaagccggagcccgtcgccgtgacgt

SEQ ID NO: 10524 - protein, 224 aa, Panicum virgatum
  misc_feature: Ceres CLONE 1724659
  misc_feature (14)..(74): Pfam Name: HMA Pfam Description: Heavy-metal-associated domain
MATGAATAPVQTVVLRVSIHCHGCKKKVRKVLKSVEGVQSVTVDAAQHKVTVTGTVDANTLVQRLHKSGKKGVPWQYCHPPANKTEAAPAPEAAPPAQPAGDGGKDAAAKAADKKPEEAVKEPQVESSEKKQPKQEAAGTEKKAEAEPKAEKKAEAEPKAEKKAEAKKDGGDSEAAETKAKGAEPAKEEAKEAAAAAANAKNEDAAKKNDKPRDAGKPEPVAVT

SEQ ID NO: 10525 - DNA, 622 bp, Panicum virgatum
  misc_feature: Ceres CLONE 1724659-R
gccgccggctcccaagtacgcgtacgaggaggagtaccgctacccctactacgcgccggcgccgcagccggtgatgagctaccacgcggcgcagccgagcgcgagcgtctcctacttcgcgccgcagccgcaggcggcgtactccgcgcaccagccgcagccgcagccaatgcggcagtggtcgccgtcgtacctgtacgtcccgtacccgcacgcggcggcggagccgtaccaccaggactactacagcccgcccgggatgcacgcgtcgccgccgccgatgcaggactcgtaccgcatcttcgacgacgagaaccccaactcctgcagcgtcatgtgagggttcgccggcccgccgccgtgccgggcttccgttccgtggcgtgggcaggtagttgggggaggcggcgccgcaaccgcaatagagacggagacctctctgtggttgtaggtagagtaacccgtattactctcttccactaagaggtcaaacctctctccatgacagggcctccattttcttcactatcctttttactgttctaatcaagtaattagagcatgaaaattgtaatgagatacgtacgccttgtagctgatttccactgcgtctgtgccggcc

SEQ ID NO: 10526 - DNA, 954 bp, Panicum virgatum
  misc_feature: Ceres CLONE 1724673
  misc_feature: Encodes the peptide sequence at SEQ ID NO. 10527
atcccaatcgaattcagtcactcccattggaatcagggaatggccatggcggccgtgggcatcgccggcggggcactggcgcccctcctcccccagcagcgccgcggccgctgcgcggtgtcgttcaggtgcgcggcgtcagtggcggtgcgcgcgtcgtacgaggccggggtgggcgtgatggcgaccaaggtggggatgatgacctacttcgacccggctacggggaagccggtgccggtgacggtcgtcgggttccgggagggcgggaacgtggtgacgcaggtgaagacgacggccacggacgggtacgacgccgtgcaggtcgggtaccacggcgtgcgcgaggacaagctcacgcgcccggagctgggccacctgggcaaggccggcgcgccgccgctgaggcacctgcaggagttcaggctcaccgccgtcgacgcgttcgagccaggccaggagctcgacttcgccgagctcttcaaggagggcgacctcgtcgacgtctccggcaactccatcggcaaggggttccaaggtggtatcaagaggcacaacttcaagcgtgggttgatgactcacggttccaagagtcacagacaactgggttccattggtgctggaacaacgccagagcgggtgtacaaggggaagaagatgcctgggaggatgggaggaaccaagaccaagatcaggaagctcaagatcgtcaagatcgacaacgacctccgggtcctcatgatcaagggcgctgtaccagggaagcctggtaacctcctccgcatcgcgcctgccaagatcgtcggcaagaacatccccaagaactagaatctttcactaaactttgagtgttccccaccctgcttcaaactggatgtaatttcttcaccaactaccagtttttgtacacataagatttcagattagtaatcatcagatatgagtgttatcgtc

SEQ ID NO: 10527 - protein, 260 aa, Panicum virgatum
  misc_feature: Ceres CLONE 1724673
  misc_feature (49)..(248): Pfam Name: Ribosomal_L3 Pfam Description: Ribosomal protein L3
MAAVGIAGGALAPLLPQQRRGRCAVSFRCAASVAVRASYEAGVGVMATKVGMMTYFDPATGKPVPVTVVGFREGGNVVTQVKTTATDGYDAVQVGYHGVREDKLTRPELGHLGKAGAPPLRHLQEFRLTAVDAFEPGQELDFAELFKEGDLVDVSGNSIGKGFQGGIKRHNFKRGLMTHGSKSHRQLGSIGAGTTPERVYKGKKMPGRMGGTKTKIRKLKIVKIDNDLRVLMIKGAVPGKPGNLLRIAPAKIVGKNIPKN

SEQ ID NO: 10528 - DNA, 1265 bp, Panicum virgatum
  misc_feature: Ceres CLONE 1724678
  misc_feature: Encodes the peptide sequence at SEQ ID NO. 10529
taaaatctaacaagagggagttaaagtgggggaggccagggacgcgttgccttgccgtgtcccgcggcgagatggacgcgagcgccggctccttcgtcgccgtccgccggctctccggctccgaccgcgccgccgccttccaccactcctcttcggcggaggtgttgacggggtcgtcggcgtggatcgggagggggctctcctgcgtctgcgcgcagaggagggacagcgatgcgcgcctctcgttcgatttgacgcctacgcaggaagaatgcctacagaggctgcagaacagaatagaagttcagtatgatagtgcaaacagagagcatcaggaagcattacgggctctttggtgtgatgcttttcctggaaccgagcttcggggtctaatatcagaacaatggaaagagatgggttggcaagggaaagacccatctacagattttagaggcggaggcttcatctccttggagaatctgttgtactttgcaaggaactatccaaaatcttttcaggaacttcttcgcaagcagaatggtgaccgtgcaatctgggagtatccatttgctgtagctggtgtaaatataaccttcatgctcattcagatgcttgatctccaagcagttaaaccgaggtcattgttcggagcagttttcctaaagcttctttcagaaaatgatgaagcatttgacattctctactgcataaccttcaagctgatggatcagcaatggcttgacatgcatgctacttacatggacttcaatacggtcatgaaatcaacacggcgtcagctagaaagggagcttttgatcgaggatattcagcggattgaggacatgccatcatacaggcttctggcccggtagctagaagaaactgaaaatcttaacatggctacatgttgcaagccttgagttgctgtggattgcaactggcacccacagcctgcgagaatcctggaatgtagatgcatctgtatccctgtgtttaggtactctggtatcctgatctctgaaatttacaaggtagggtttttcttggtgatagaatgccacgtagggtaactgaagtgtctgatcagctgccaaggcaaagtatttgtagggtgtgtttattacaatcgggttgttgcccatcataccacgagaagggagcgttccagttcctagagttttcgatgtaaacaggaggattttgggaaagctgatctgagttgtctcccattcgcataaagagagagactagttctttgagtgcgc

SEQ ID NO: 10529 - protein, 266 aa, Panicum virgatum
  misc_feature: Ceres CLONE 1724678
  misc_feature (85)..(246): Pfam Name: ELMO_CED12 Pfam Description: ELMO/CED-12 family
MDASAGSFVAVRRLSGSDRAAAFHHSSSAEVLTGSSAWIGRGLSCVCAQRRDSDARLSFDLTPTQEECLQRLQNRIEVQYDSANREHQEALRALWCDAFPGTELRGLISEQWKEMGWQGKDPSTDFRGGGFISLENLLYFARNYPKSFQELLRKQNGDRAIWEYPFAVAGVNITFMLIQMLDLQAVKPRSLFGAVFLKLLSENDEAFDILYCITFKLMDQQWLDMHATYMDFNTVMKSTRRQLERELLIEDIQRIEDMPSYRLLAR

SEQ ID NO: 10530 - DNA, 955 bp, Panicum virgatum
  misc_feature: Ceres CLONE 1724683
  misc_feature: Encodes the peptide sequence at SEQ ID NO. 10531
atcaccacacgaaacacacaggagaaacatgtccgcttccgctgcggccgcctcccccgtcctccgcctctcctccgccactcccccacttgctcctctccaccggccgttccgccggcggctcccgtccgtccggtgctccctcgccgctgcccccggtgtccgggcgcccccagagctcgtcgactccatcctctccaaggtgaaaggaactgaccgaggagtgttgctgcctaaagatgggcaccagcaagtggctgatgtggcactgcagctggggaagtactgcatagaggagcccgtcaagtccccacttatatttggagaatgggaggttgtgtattgctcggtgccaacgtctccaggagggctataccggacgcctcttggccgtctgatattcaaaactgatgagatgatccaggtggtggaagcccctgatgttgtcaggaacaaggtgtcattctccgtctttggtctcgagggtgcagtatcgttgaaaggtaagctgaatgtattggacagtaagtggattcaggtcatctttgaggccccagagttgaaggtaggctccttggggttccaatatggcggggacagcgaggtcaagctggagatcacttatgtcgacgagaagatcaggctcggcaaagggtctagaggctcgctgttcgtgttcctcagacgaggatagaacgacatgtgtgcactggggtgtgctcgagacctcaagcacaagggatggcactgatgtggtcgtctgtacaatattgtattcaggatttcacatgtaaaattcagaatccaatttgggtagcagttttcctgcatattgtaacctgaagaacgttgtctggtcgttttggacgacaagtggacaaccgaagatgcatgtagcattcattagtgttgtaacttgtaagatggcgttttgtcaactaagcgatttatttgg

SEQ ID NO: 10531 - protein, 221 aa, Panicum virgatum
  misc_feature: Ceres CLONE 1724683
  misc_feature (49)..(218): Pfam Name: PAP_fibrillin Pfam Description: PAP_fibrillin
MSASAAAASPVLRLSSATPPLAPLHRPFRRRLPSVRCSLAAAPGVRAPPELVDSILSKVKGTDRGVLLPKDGHQQVADVALQLGKYCIEEPVKSPLIFGEWEVVYCSVPTSPGGLYRTPLGRLIFKTDEMIQVVEAPDVVRNKVSFSVFGLEGAVSLKGKLNVLDSKWIQVIFEAPELKVGSLGFQYGGDSEVKLEITYVDEKIRLGKGSRGSLFVFLRRG

SEQ ID NO: 10532 - DNA, 1125 bp, Panicum virgatum
  misc_feature: Ceres CLONE 1724686
  misc_feature: Encodes the peptide sequence at SEQ ID NO. 10533
aacactgccacagcagccgtgtccacctcacgtatgatctgtagccactcatagtcatagacgctagctgcttagcctgtgctgccgtagctgtcctgctgtcctttactctgcctgcctgcctgattgcccctcgcgcctctgagcggccgccatggatatctggaagtccaaggtgctgcccaagatcaagctcgtcttcgccaagtccgccggcaagaaggccgccgccgccgccgagctcgtcaagtccttcgacgagtccaaggaggggatcaatggccagttcgaggagaagaaggcggatctccagcctaaggtcgtcgagatctacgagtctgttcctgccccgctcaaggttctgatcaaggagaggagcaaggtgtccgggatcaagaagaactcggccgccatcaccaagttcttcgaggatctggccaagatcgagttccctggcgccaagcaagtgagcgagggcatctccaaggtcggcccggccctgctgtccggccccatcttcgccacgttcgagaaggtctcctccctgctccctgccgccgccgaggaggcgcccaaggaggctccggtcgccgccgaggaggcagccgagaagaacgccgccgccgccgctgtcgaggagaagaaggaggaagcgccggccggtgagaagaaggaagaggctccggcagccacggaggagaagaaagaggacgcggctcctgcagccgccgaggagacaaccacagccgccgccgccgagactgcgccccctactgccgatgcacctgccgcagagcccgctgcggaggcggccccagccgagccggcggcgaaggccgaggaggagacgcccaaggcctagcctagctagggttcagaacttcagattcatcttgcagcccgcagctaggttgagatcgagatcctgccccgcgtacaaccatgctctatcatgatatcattcaccattcgttgttcttgcatatatgcacaatgtttttgttgctttctcgatcgaccctgttcctacgcagaccggttagacatgtatgtatatgtataagcctataatttttgtatgtacttattattcatttgaagtgtgaggacatgtatattattcgc

SEQ ID NO: 10533 - protein, 235 aa, Panicum virgatum
  misc_feature: Ceres CLONE 1724686
  misc_feature (1)..(235): Pfam Name: DREPP Pfam Description: DREPP plasma membrane polypeptide
MDIWKSKVLPKIKLVFAKSAGKKAAAAAELVKSFDESKEGINGQFEEKKADLQPKVVEIYESVPAPLKVLIKERSKVSGIKKNSAAITKFFEDLAKIEFPGAKQVSEGISKVGPALLSGPIFATFEKVSSLLPAAAEEAPKEAPVAAEEAAEKNAAAAAVEEKKEEAPAGEKKEEAPAATEEKKEDAAPAAAEETTTAAAAETAPPTADAPAAEPAAEAAPAEPAAKAEEETPKA

SEQ ID NO: 10534 - DNA, 1090 bp, Panicum virgatum
  misc_feature: Ceres CLONE 1724687
  misc_feature: Encodes the peptide sequence at SEQ ID NO. 10535
attaacactgccacagcagccgtgtccacctcacgtatgatctgtagccactcatagtcatagacgacgctagctgcttagcctgtgctgccgtagttgtcctgtcctttactctgcctgcctgcctgattgcccctcgcgcctctgagcggccgccatggatatctggaagtccaaggtgctgcccaagatcaagctcgtcttcgccaagtccgccggcaagaaggccgccgccgccgccgagctcgtcaagtccttcgacgagtccaaggaggggatcaatggccagttcgaggagaagaaggcggatctccagcctaaggtcgtcgagatctacgagtctgttcctgccccgctcaaggttctgatcaaggagaggagcaaggtgtccgggatcaagaagaactcggccgccatcaccaagttcttggaggatctggccaagatcgagttccctggcgccaagcaagtgagcgaaggcatctccaaggtcggcccggccctgctgtccggccccatcttcgccacgttcgagaaggtctcctccctgctccctgccgccgccgaggaggcgcccaaggaggctccggtcgccgccgaggaggcagccgagaagaacgctgccgctgtcgaggagaagaaggaggaagcgccggccggtgagaagaaggaagaggctccggcagccacggaggagaagaaagaggacgcggctcctgcagccgccgccgccgagactgcgccccctactgccgatgcacctgccgcagagcccgctgcggaggcggccccagccgagccggcggcgaaggccgaggaggagacgcccaaggcctagcctagctagggttcagaacttcagattcatcttgcagcccgcagctaggttgagatcgagatcctgccccgcgtacaaccatgctctatcatgatatcattcaccattcgttgttcttgcatatatgcacaatgtttttgttgctttctcgatcgaccctgttcctacgcaggccggttagacatgtatgtatatgtataagcctatattttttgtatgtacttattattcatttgaagtgtgaggacatgc

SEQ ID NO: 10535 - protein, 226 aa, Panicum virgatum
  misc_feature: Ceres CLONE 1724687
  misc_feature (1)..(226): Pfam Name: DREPP Pfam Description: DREPP plasma membrane polypeptide
MDIWKSKVLPKIKLVFAKSAGKKAAAAAELVKSFDESKEGINGQFEEKKADLQPKVVEIYESVPAPLKVLIKERSKVSGIKKNSAAITKFLEDLAKIEFPGAKQVSEGISKVGPALLSGPIFATFEKVSSLLPAAAEEAPKEAPVAAEEAAEKNAAAVEEKKEEAPAGEKKEEAPAATEEKKEDAAPAAAAAETAPPTADAPAAEPAAEAAPAEPAAKAEEETPKA

SEQ ID NO: 10536 - DNA, 1054 bp, Panicum virgatum
  misc_feature: Ceres CLONE 1724691
  misc_feature: Encodes the peptide sequence at SEQ ID NO. 10537
acggtccgtccgctctatctcttttcccctatccaacccccgaaaacctccctgccatggcgaccgccgcccaggccgccgccgtcttcctctcgttcctttcttcctcccccagccaccacagcgccccctcctccgtctccctcggggcaacccctgtcctaccagtctccctccgggtcgctgccgcggctggcccacggctgtcttcccccctcaggggccgtcgcatcagcgccgtcatcgcccagctccccaccgcgcatcccgaggtatccaatggggacaagaagatcagatggtcttcaagggcggtgcggtcatttgcgatggcagagctggaggctcggaagatgaggtatcctacaacaggcactgaggggctcctcatgggcattcttgttgaaggaactagcggtgcggcaaaacttttgcgtgctaatggaatcacgcttctcaaagtgcgtgaggaggcagcaaatgtgcttgggaaatcagaaatgttttattttagtcctatgcatccaccattgacaaaagctgcacaacaagctcttgattgggctgtcaatgagaaactgaagtcaggcgaggatggagaagtaactgccaatcatttgctgctggggatatggtcagataaggagtcggctggtcataaaatcctggcttcacttgggtttgatgatgagaaagccatattactcgcgaaaacagctggtgaagaggctgcaatgagtcctaggtagcaaaatgagggcttattctacttctttgaggctgttggtgtgggctcgagtactgtcgacgcatactgggttgggttgcttctgcaaaatttaggacataagatacgttaggctgaatccaatatttgtactctcactattgctgatgcctgtaaaagcgtcgtgatttctttgcaggatgatggcttttgctccttgcacagctggatttatgaactgttaggtcgaatccgatatttgtgctcacaacattgctgatgcctgtaaaaacgttgggatttttttgcacgatgattgcttctgtc

SEQ ID NO: 10537 - protein, 230 aa, Panicum virgatum
  misc_feature: Ceres CLONE 1724691
  misc_feature (93)..(145): Pfam Name: Clp_N Pfam Description: Clp amino terminal domain
MATAAQAAAVFLSFLSSSPSHHSAPSSVSLGATPVLPVSLRVAAAAGPRLSSPLRGRRISAVIAQLPTAHPEVSNGDKKIRWSSRAVRSFAMAELEARKMRYPTTGTEGLLMGILVEGTSGAAKLLRANGITLLKVREEAANVLGKSEMFYFSPMHPPLTKAAQQALDWAVNEKLKSGEDGEVTANHLLLGIWSDKESAGHKILASLGFDDEKAILLAKTAGEEAAMSPR

SEQ ID NO: 10538 - DNA, 1161 bp, Panicum virgatum
  misc_feature: Ceres CLONE 1724693
  misc_feature: Encodes the peptide sequence at SEQ ID NO. 10539
acgcacaccacaatccgagcgacgcctacgctctctgctctcgtcatcctcctcgtcatcctcctcgtcatcctcctcgtcgttcccggtcacgcacgccgccgcgcggcgacggacgagtccggcaaggagttcgtcgacatcatctacgagaaggccgtcaatgagggcatcgccaagatcaccataaaccgcccggataggaggaacgcgttccgcccgttgaccgtgaaggagctcatgcgcgcgttcaacgatgccagagacgacagttcgattggagtcatcattctaacagggaagggaactaaggccttctgtaacggtggtgaccaggcgttaagagattctgatggatatgttgacttcgatagctttggccgcctcaacgttctggacctccaggtgcaaatccgccgtcttccaaagcctgttattgccatggttgctggttatgctgttggtggtgggcatgttttgcatatggtgtgtgacataacaatcgcagcagacaacgcaatatttgggcagacaggacccaaggttggaagctttgatgctggctatggatcttcaataatgtcccgattggttggaccgaagagagcgcgtgagatgtggtttctgtcacggttctacaccgctgatgaagctgacaaaatgggacttgtgaacactgtagtgccgcttgctgaattggagcgagaaaccgtgaaatggtgccggcaaatcttaaggaacagccccatggccattcgagttctgaaatctgcactcaacgcagcggatgacggccatgcaggtcttcaggagcttggcggtaatgccacgctgatattctacggcacggaagaggcaaaggaagggaagaacgcgtacatggagaggcggcgcccggatttctccaagttcccacggaaaccttgaagcttcactttgatgctatcatggtctagtaaatttttttccctgtaaaagaggtacagtcctaaatactaattgtcagccccgcatagcgtacatcactatgtttagtaaatactatgatactatcgacggatgttacccattctttatgaagctatttgcatacgcgagaaagaaatgtaattcatctggacattcagatcgattaataataaatctctgcgcatttgattc

SEQ ID NO: 10539 - protein, 308 aa, Panicum virgatum
  misc_feature: Ceres CLONE 1724693
  misc_feature (59)..(229): Pfam Name: ECH Pfam Description: Enoyl-CoA hydratase/isomerase family
  misc_feature: SWISSPROT Homolog: EC 4.1.3.36 Naphthoate synthase
THTTIRATPTLSALVILLVILLVILLVVPGHARRRAATDESGKEFVDIIYEKAVNEGIAKITINRPDRRNAFRPLTVKELMRAFNDARDDSSIGVIILTGKGTKAFCNGGDQALRDSDGYVDFDSFGRLNVLDLQVQIRRLPKPVIAMVAGYAVGGGHVLHMVCDITIAADNAIFGQTGPKVGSFDAGYGSSIMSRLVGPKRAREMWFLSRFYTADEADKMGLVNTVVPLAELERETVKWCRQILRNSPMAIRVLKSALNAADDGHAGLQELGGNATLIFYGTEEAKEGKNAYMERRRPDFSKFPRKP

SEQ ID NO: 10540 - DNA, 1039 bp, Panicum virgatum
  misc_feature: Ceres CLONE 1724710
  misc_feature: Encodes the peptide sequence at SEQ ID NO. 10541
atagaggaacaggacacaggatacggagcccacatccctcaactggatcaagcaatctgcaaggtggctagagaaaacagcacgtcaggaacaaagagctattgcaggatgacctcagtacccaaatcaacgcttgttctggcttcaggtgcagcaatgctgccacatccttcaaaggtatcgactggtggtgaagatgcatattttatagcttgtgatggctggtttggtgtagctgatggagttggtcagtggtcatttgaagggatcaatgctggactttatgcgagagaactgatggatggttgcaaaaagattataacagaaacccaaggagctacagttatgagaactgaggaggttcttgcaaaggctgcagatgaagcacggtgccctggttcttccactgttttagttgctcactttgatggccaggtgctacatgcatcaaatatcggtgattctggatttcttgtgataagaaatggagaggtctacgaaaaatcaaaaccaatgacttatggtttcaatttcccattgcaaattgaaaagggtgatgaccctttaaaacttgtacagaaatatgccatcgacctacaagaaggtgatgtcattgtaacagcaacagatgggcttttcgacaatgtgtacgaggaagaagtagctggcactgtatccaaatctttagaagccgatctcaagcccacggagatcgccgagctcctggctgctagagcaaaggaggtggggcggcgtggatttggaagtagcccattttcggacgcggccctcgatgctgggtacttgggttactccggaggcaagctggatgatgtaacagtcgttgtatctattgttcggaaatctgaagtttaaactataaaacaagcactcgaaagttcagtgcagccccgagtttttgctacagctgcacgcgctggcaaatgcccatgagcatttcgtgcgccatgagcacagacctggcttacgctaagccaaacgtgtatacagtcatgcatactaaaagactcttgtcagt

SEQ ID NO: 10541 - protein, 291 aa, Panicum virgatum
  misc_feature: Ceres CLONE 1724710
  misc_feature: SWISSPROT Homolog: EC 3.1.3.16 Phosphoprotein phosphatase
IEEQDTGYGAHIPQLDQAICKVARENSTSGTKSYCRMTSVPKSTLVLASGAAMLPHPSKVSTGGEDAYFIACDGWFGVADGVGQWSFEGINAGLYARELMDGCKKIITETQGATVMRTEEVLAKAADEARCPGSSTVLVAHFDGQVLHASNIGDSGFLVIRNGEVYEKSKPMTYGFNFPLQIEKGDDPLKLVQKYAIDLQEGDVIVTATDGLFDNVYEEEVAGTVSKSLEADLKPTEIAELLAARAKEVGRRGFGSSPFSDAALDAGYLGYSGGKLDDVTVVVSIVRKSEV

SEQ ID NO: 10542 - DNA, 882 bp, Panicum virgatum
  misc_feature: Ceres CLONE 1724714
  misc_feature: Encodes the peptide sequence at SEQ ID NO. 10543
gtcgcaggctggctgttagttagttcagcagccggcgagcaacatccccggtggcagccatggcgtccattgtaacagcagcttccagggcgctcactggttggagccggcgcgcgctcgccgtgcccgcacaccgcgtgcggtcgccgagagctcgggtcgtcgtccgggccagcgcccagcgcgcgacctggctgcccggcctggacccgcctgctcacctcgacggcacgctgccgggtgacttcggcttcgatcccctggggctcggcgaggaaccggcagcattgaagtggtacgtgcaggccgagctcgtgcactgccggttcgccatggcaggggtcgccggaatccttgtaaccgacttgctccgcgtatcagggatccgggatctgccggtgtggttcgaggcaggtgcagcgaaatttgacttcgccaacaccacgtcactcttcttcgttcagcttctcctgatgggattcgctgaaaccaagaggtacatggatttcatcaatccagggtcacaagcagaggaaggaaccttcataggtctagaggctgcactcgtgggctcacagccaggctaccctggagatccgctgtttaatccgttaggactcacaaaagatatagagaatgcacatgaagagaagctgaaagagattaagaatgggaggttggcaatggtagccatgcttggcttcattgtgcaagcatccgtaactcatgttggccccatcgacaaccttttgacacatctttcggacccattcaacaaaaatatcattcattcaatctcctcttcctaagaattctgtccccaacgcaaacttttgttttcactgtacagtgctatggcacaaaaggataacaatgtttccc

SEQ ID NO: 10543 - protein, 249 aa, Panicum virgatum
  misc_feature: Ceres CLONE 1724714
  misc_feature (50)..(220): Pfam Name: Chloroa_b-bind Pfam Description: Chlorophyll A-B binding protein
  misc_feature: Functional homolog of the protein sequence given in SEQ ID NO 50109
  misc_feature: Useful for making plants with modulated nitrogen use efficiency
MASIVTAASRALTGWSRRALAVPAHRVRSPRARVVVRASAQRATWLPGLDPPAHLDGTLPGDFGFDPLGLGEEPAALKWYVQAELVHCRFAMAGVAGILVTDLLRVSGIRDLPVWFEAGAAKFDFANTTSLFFVQLLLMGFAETKRYMDFINPGSQAEEGTFIGLEAALVGSQPGYPGDPLFNPLGLTKDIENAHEEKLKEIKNGRLAMVAMLGFIVQASVTHVGPIDNLLTHLSDPFNKNIIHSISSS

SEQ ID NO: 10544 - DNA, 1369 bp, Panicum virgatum
  misc_feature: Ceres CLONE 1724716
  misc_feature: Encodes the peptide sequence at SEQ ID NO. 10545
atccagcagcataccataagctagcacatagtatactagtggtcaaagttgaaggcagcagcaggccggccgggcaggaggcaggagacatcgtctatcggcgttcctacctacctccacgcctcgatcgctagctggaggcgacgatggagttcaccgccggcccgaccggcgaggagcgggcggagcaactggcggcggcggtggagaaggagcacatgttcgacaaggtggtgacgccgagcgacgtggggaagctcaaccggctggtgatcccgaagcagcacgcggagaagttcttccccctggacgcggcggcgaacgagaagggcctcctgctcagcttcgaggaccgcacgggcaagccctggcgcttccgctactcctactggaacagcagccagagctacgtcatgaccaagggctggagccgcttcgtcaaggagaagcgcctcgacgccggggacaccgtctccttcgaccgcggcgtcggggaggcggcgcggggcaggctcttcatcgactggcgccggcgacccgacccgcccgtgcagtaccaccgcctcccgctcccttccatcccctacgcgccgtgggcgctcggtgccaagacgacgacgacggtgctccacctgccgccctcgccctcctcgctctgctacgactacgactcccgccgccgccacgtcgcctacggggccggcagcaggcagctgctcttctaccggccgcaccagcatccgcaggccacggcgatggtgctggactccgtgccggtacggataccgacaacgccagggcagcacgcggagccgccgcctcccgtggcggcgtcggcctcgaagcggatgcggctgttcggggtgaacctcgactgcgccagctccgaggaggagagcggcggagggagggcgccgccgctgcagctgccgtcgccgccgtcatcgtcgtcctcctcctccgggaaagcgaggtgctccttgaatcttgacttgtgaaggcggatcgatcggatatgtagatggaggtcttggtcgtacgatgcccgctacagcagctactacttcccggccgcttcgttctggcaccagtgacgacggcacaaatggtcgtcgtggagaggatcgagcgagaattcgagatccaagtaaacaaaggcggcggtggccgggcggtgcaaggaattggatcggaggaggagcaggggagcacccggcccagcagctacgtacaattaatcctcgtaacccgtatatagctcatctctctcttaatttttctctagcaatttcagtgtgaggggaaaacaagaaaattaagaacaaagcagagcaacaaaaaaatatatttcttgcttcgattcgctgtg

SEQ ID NO: 10545 - protein, 283 aa, Panicum virgatum
  misc_feature: Ceres CLONE 1724716
  misc_feature (25)..(133): Pfam Name: B3 Pfam Description: B3 DNA binding domain
  misc_feature: The sequence is a functional homolog of SEQ ID NO 1181 in the 10/374,780 US patent application
  misc_feature: Functional homolog of the protein sequence given in SEQ ID NO 50211
  misc_feature: Useful for making plants with modulated biomass
  misc_feature: Useful for making plants with modulated flowering time
  misc_feature: The sequence is a functional homolog of SEQ ID NO 14 in the 10/838,616 US patent application
  misc_feature: The sequence is a functional homolog of SEQ ID NO 244 in the 10/225,066 US patent application
  misc_feature: The sequence is a functional homolog of SEQ ID NO 2498 in the 10/374,780 US patent application
  misc_feature: The sequence is a functional homolog of SEQ ID NO 2728 in the 10/374,780 US patent application
  misc_feature: The sequence is a functional homolog of SEQ ID NO 374 in the 10/225,066 US patent application
  misc_feature: Functional homolog of the protein sequence given in SEQ ID NO 50212
  misc_feature: Useful for making plants with altered lignin content
  misc_feature: Useful for making plants with altered terpenoid content
MEFTAGPTGEERAEQLAAAVEKEHMFDKVVTPSDVGKLNRLVIPKQHAEKFFPLDAAANEKGLLLSFEDRTGKPWRFRYSYWNSSQSYVMTKGWSRFVKEKRLDAGDTVSFDRGVGEAARGRLFIDWRRRPDPPVQYHRLPLPSIPYAPWALGAKTTTTVLHLPPSPSSLCYDYDSRRRHVAYGAGSRQLLFYRPHQHPQATAMVLDSVPVRIPTTPGQHAEPPPPVAASASKRMRLFGVNLDCASSEEESGGGRAPPLQLPSPPSSSSSSSGKARCSLNLDL

SEQ ID NO: 10546 - DNA, 1122 bp, Panicum virgatum
  misc_feature: Ceres CLONE 1724718
  misc_feature: Encodes the peptide sequence at SEQ ID NO. 10547
aatcagcttctatccatctggccattgaacagatctccgatatcctgtcaaaaaaaaaaaaaactccgatagctagcagcttgtctgattgatcatcccggaagatcaagcactgaaactccaattgcggttcagttatcaccgaggacactgactgaagtagagatggcggagcgttcagagaacgcggcgggggacatgatgagcaacatcatggacgccatcgccgagaacctcccgaacaagaagtccgtcaggttcgacgacggcgagggctccatctccgaccaggccaggaagctgttcggcggcggcgggcagggcggcaagaagtctgtccaccacgtcctgggcggcggcaagtccgccgacgtgctgctgtggcggaacaagaagatctcgtcgagcgtgctgggcgcaacgacgctggcctgggtcttcttcragtggctcgactaccacttgctcaccatcgccagcttggcgctggtgctcgggatggccgtgcagctcgcctggtccgcgctcgcctcgaaygtgcccsgcctcgaggtgccggaggaggtgttggccgacgctggcagggccgccggcgcgcaggtgaaccgggccctgggcgcgctccaggacatctcctgcgggagggacctgaggcggttcctcatcgtgatcgccgtgttcttcgcggccgcggwcgkcgggagcttctgcaacttgctgacggtcatctacatcgggttggtgtgtgcgcacacgctcccggtgctgtacgagaagtaccaggaccaggtggacgagttcctgtgcagcatgctggccgtgctacagcaccagtcccagaagctcggcagcaagggcgtcctgggcaaagggaaggccaggaagagcgactagctggttggttcgatctgctctgcctgtgtaacataatctgctggggcggacggctggtccactgatacgcctgtctgcatgtacgcagccagctgcggtttcctgaaaccaactcgaggccggtacagtgctgaaagtacttgcttgtgtaatgcactacagtaatgctttagtagcttcgaaaacagcccattaaacgaggttctttttgggaccggtagcgacctc

SEQ ID NO: 10547 - protein, 242 aa, Panicum virgatum
  misc_feature: Ceres CLONE 1724718
  misc_feature (67)..(241): Pfam Name: Reticulon Pfam Description: Reticulon
  misc_feature (94)..(94): Xaa is any aa, unknown, or other
  misc_feature (127)..(127): Xaa is any aa, unknown, or other
  misc_feature (177)..(177): Xaa is any aa, unknown, or other
  misc_feature (178)..(178): Xaa is any aa, unknown, or other
MAERSENAAGDMMSNIMDAIAENLPNKKSVRFDDGEGSISDQARKLFGGGGQGGKKSVHHVLGGGKSADVLLWRNKKISSSVLGATTLAWVFFXWLDYHLLTIASLALVLGMAVQLAWSALASNVPXLEVPEEVLADAGRAAGAQVNRALGALQDISCGRDLRRFLIVIAVFFAAAXXGSFCNLLTVIYIGLVCAHTLPVLYEKYQDQVDEFLCSMLAVLQHQSQKLGSKGVLGKGKARKSD

SEQ ID NO: 10548 - DNA, 319 bp, Panicum virgatum
  misc_feature: Ceres CLONE 1724726
  misc_feature: Encodes the peptide sequence at SEQ ID NO. 10549
accaacaaccaaaggagagcacccgcgcatgtttaccttcgccgagctcaaggtcaaggagctcaagaacggccgcctcgccatgttctccatgttcggcttcttcgtgcaggccatagtcaccggcaagggcccgcttgagaacctcgccgaccatctcgccgaccccgtcaacaacaacgcctgggcctacgccaccaacttcgtgcccggcaagtgaggggtcggttcccgaactgttcgatctgtaggaggtccggatgtgagcgcgcattggtttcagtttgtaccatgatataaattactgggttccaaccga

SEQ ID NO: 10549 - protein, 63 aa, Panicum virgatum
  misc_feature: Ceres CLONE 1724726
  misc_feature: Functional homolog of the protein sequence given in SEQ ID NO 50109
  misc_feature: Useful for making plants with modulated nitrogen use efficiency
  misc_feature: Functional homolog of the protein sequence given in SEQ ID NO 50113
  misc_feature: Useful for making plants with modulated oxidative stress sensitivity
  misc_feature: Functional homolog of the protein sequence given in SEQ ID NO 50114
  misc_feature: Useful for making plants with modulated water use efficiency
  misc_feature: Functional homolog of the protein sequence given in SEQ ID NO 50115
  misc_feature: Useful for making plants with modulated biomass
  misc_feature: Useful for making plants with modulated drought sensitivity
  misc_feature: Useful for making plants with modulated phosphate use efficiency
MFTFAELKVKELKNGRLAMFSMFGFFVQAIVTGKGPLENLADHLADPVNNNAWAYATNFVPGK

SEQ ID NO: 10550 - DNA, 1216 bp, Panicum virgatum
  misc_feature: Ceres CLONE 1724730
  misc_feature: Encodes the peptide sequence at SEQ ID NO. 10551
gtttcacgccgcgcgagcgcgacactccccagcctgccctcccctgctcactccgcgcgccgcccagagctcactctcccctctcctcgccgcctccgcgcgaggcctgcgtccgcgagcgaggtagcagcagccggagccgagaggagtgggggaccagccatggcgatggcaatgcgcgcggtggccgcggccgcggtgctcctcctggcggcggccgggggcgcgtcggcggcgacgctggcgctgtacaaccggtgcggcgaaacagtgtggccgggcatccagccgagcgcggggaaggagctcctcgcccgcggcgggatgcagctggcgcccggccacgcggccaccatccgcctccccgccggctggtcggggcgcgtgtgggggcggcaggggtgccggttcgacgcggcggggcgcgggcggtgcgccacgggcgactgcggcgggacgctctactgcaacggcgccgggggcgcgccgccggccacgctggcggagatcaccctggcgtcggcgcccgcggcgcaggacttctacgacgtgagcctggtggacgggtacaacatccccatcgccatgacgccgttccacgggtcgggcgccaactgcgtgcccgccgggtgcgtgagcgacctcaaccgcgtgtgcccacaggggctcgccgtccgcggcggcgacgggaaccgcgtcgtggggtgccgcagcgcctgcgccgcctacggctcgccgcagtactgctgcacggggcagttcgggagcccccagcagtgcaagcccacggcctactcgcggctcttcaagtcggcgtgccccaaggcctactcctacgcctacgacgacccgacctccatcctcacctgctccgccggcgcctcctacgtcgtcaccttctgcccccaccaccgctgaacctgaaaccccggcggacgaaatcaatggcgttgtgttcaggaggcacctgggtttagctgctgtagtttaggcggctgcgagagtgcgtcgctgttcttggtttcttcctgctaccgttgcattgcatcttggagaattaaatttgtcgtagtgtgctgagagatctggtggtctaccgctggtaagccgagatcgatggtatatcaggagtataatatgggtataatgctatgcatttcgagtctaaagtctgatgaacttgttcccggttttaccactgatctatttgtgcttc

SEQ ID NO: 10551 - protein, 251 aa, Panicum virgatum
  misc_feature: Ceres CLONE 1724730
  misc_feature (31)..(248): Pfam Name: Thaumatin Pfam Description: Thaumatin family
MAMAMRAVAAAAVLLLAAAGGASAATLALYNRCGETVWPGIQPSAGKELLARGGMQLAPGHAATIRLPAGWSGRVWGRQGCRFDAAGRGRCATGDCGGTLYCNGAGGAPPATLAEITLASAPAAQDFYDVSLVDGYNIPIAMTPFHGSGANCVPAGCVSDLNRVCPQGLAVRGGDGNRVVGCRSACAAYGSPQYCCTGQFGSPQQCKPTAYSRLFKSACPKAYSYAYDDPTSILTCSAGASYVVTFCPHHR

SEQ ID NO: 10552 - DNA, 1147 bp, Panicum virgatum
  misc_feature: Ceres CLONE 1724772
  misc_feature: Encodes the peptide sequence at SEQ ID NO. 10553
aaaacccttccgaaagaatccccaaatctcgcacgccccgaagccttcgaggcccgaaaccctagcacctcggccgccccgccgccgcgcccccatggctccaggactccagcgcttctccgacattgccggcgacggagcgccccgcctcgacgccgcctccggcgaggagctggtccgggtggaccgcgccgcctccgtcgccctcggccgccgctcgccggagccgccggggaccctgttcgtcaccaccaggagggtgatttggctcagcgaggaggagaagggcaagggctacgccgtggacttcctcgccatctcgctccacgctgtgtcgcgcgacctggaggcgtatccctcgccctgcctctacgcgcagattgaggcagaagttgccacggatgaggaggctgctgaatcaaatcctgaagcaaatgatgaattagagctatcaagagtctctgaattgcgcattatactgggggaccctggtcaattggatgcactttttgatgtcttctgtcattgcgctgaactgaatcctgatcctaatgctgagcgcaatggggagaatggttggttccatggtgaagatatggttgatggtggctgggttcatggtggtgaagacatggttgatgaaaatggcacccagttttccaatgcgaatccaataggtcaaaatggtggatatgacctcagtcaatcagtatttgagcttcaaatcaacgaccagcgctttgaggatgcagatgaggaacaggagatccatgaaaatggacattagaaacaggaatatgttgctcaaacgcaccatgtgatttattttgttgtagatcactaccgatgcagatttgttgcctactgtttcgtctacattatctgccttcgatgttataagattaacatctctgggcgactttctggagttgcatcgatggttacttttggtgagaaaaggtcttgctgctggtcaagaatgtaacttgtagagcatgatggggaatcgtgtgaattagttcggtacttttgatctaacaaatagaagtgaacttgggaaaagaaatatattatcttttcccttgtatatcatggcataactatatgacatctgtttagaatcgctggtctcagtcaatttgggtgt

SEQ ID NO: 10553 - protein, 230 aa, Panicum virgatum
  misc_feature: Ceres CLONE 1724772
  misc_feature (44)..(121): Pfam Name: ICln_channel Pfam Description: Nucleotide-sensitive chloride conductance regulator (ICln)
MAPGLQRFSDIAGDGAPRLDAASGEELVRVDRAASVALGRRSPEPPGTLFVTTRRVIWLSEEEKGKGYAVDFLAISLHAVSRDLEAYPSPCLYAQIEAEVATDEEAAESNPEANDELELSRVSELRIILGDPGQLDALFDVFCHCAELNPDPNAERNGENGWFHGEDMVDGGWVHGGEDMVDENGTQFSNANPIGQNGGYDLSQSVFELQINDQRFEDADEEQEIHENGH

SEQ ID NO: 10554 - DNA, 1176 bp, Panicum virgatum
  misc_feature: Ceres CLONE 1724774
  misc_feature: Encodes the peptide sequence at SEQ ID NO. 10555
cagagacgcacaccgctgcttcaagaaaccaccgaggccaagcgcgcaagggaagagagaggccaaggagaaaagatggagggcaaggaggaggacgttcgcctgggcgccaacaagttctcggagcggcagcccatcgggacggcggcgcagggcgccggggatgacaaggactacaaggagcccccgccggcgccgctgttcgagcccggggagctcaagtcctggtctttctaccgcgcgggtatcgccgagttcgtcgccaccttcctcttcctctacatcaccatcctcaccgtcatgggcgtctccaagtccaactccaagtgcgccaccgtcggcatccagggcatcgcctggtccttcggaggaatgatcttcgccctcgtctactgcaccgccggcatctccggagggcacatcaacccggcagtgacgttcgggctgttcttggccaggaagctgtcactgactaaggccatcttctacataatcatgcaatgcctcggtgctatctgtggagctggagtggtgaagggcttccagcagggactttacatgggcaacggtggtggtgccaacgttgtcgcccccggctacaccaagggatcaggccttggtgctgagatcattggcaccttcgtcctggtctacaccgtcttctcggccactgatgccaagaggaatgccagggactcccatgttcctatccttgccccactgccaattgggttcgcggtgttcctggtccaccttgccaccatccccattactggcaccggcatcaacccagctaggagccttggcgctgccatcatctacaacagggagcacgcctggagccaccattggatcttctgggtcggccccttcattggcgctgccctggctgccatctaccaccaggtgatcatcagggccatcccgttcaagagcaggtcctaaagctgccgcggccctgccgagacatgccggtccacgaaccaccgagcgtcttcatctctgatgtcttgtgtgcccacgcctagcatctccgtcgattcctctcgtctgtcttcaggactgctgcgctgctctgttatctgaacccagaacctgtgtattcctgtaccagttgtgtatgctttttctatcgtggagatttaagttatgagcatctgttgcaagtttccatcc

SEQ ID NO: 10555 - protein, 289 aa, Panicum virgatum
  misc_feature: Ceres CLONE 1724774
  misc_feature (47)..(276): Pfam Name: MIP Pfam Description: Major intrinsic protein
  misc_feature: Functional homolog of the protein sequence given in SEQ ID NO 50195
  misc_feature: Useful for making plants with modulated water use efficiency
  misc_feature: Functional homolog of the protein sequence given in SEQ ID NO 50196
  misc_feature: Useful for making plants with modulated drought sensitivity
  misc_feature: Functional homolog of the protein sequence given in SEQ ID NO 50197
  misc_feature: Useful for making plants with modulated cold sensitivity
MEGKEEDVRLGANKFSERQPIGTAAQGAGDDKDYKEPPPAPLFEPGELKSWSFYRAGIAEFVATFLFLYITILTVMGVSKSNSKCATVGIQGIAWSFGGMIFALVYCTAGISGGHINPAVTFGLFLARKLSLTKAIFYIIMQCLGAICGAGVVKGFQQGLYMGNGGGANVVAPGYTKGSGLGAEIIGTFVLVYTVFSATDAKRNARDSHVPILAPLPIGFAVFLVHLATIPITGTGINPARSLGAAIIYNREHAWSHHWIFWVGPFIGAALAAIYHQVIIRAIPFKSRS

SEQ ID NO: 10556 - DNA, 992 bp, Panicum virgatum
  misc_feature: Ceres CLONE 1724776
  misc_feature: Encodes the peptide sequence at SEQ ID NO. 10557
atatcctcttagcagctaactgtttcagcccctgtgcgaccattcttcattctgctgcttgccacctcttcacaaagcaggccttcttcttctgtagctctaagcctcttgcaagctcaactgctgcttgtgacaagatccccatccgcttgagttcagcatcgatggcggcggaggaggcaaagaaggtggaggtggaggcgaccaaggacatcgccgaggagaaggcgattgtgccgctgccgactccaccggctgcgcccaaggtcgacaagccggccgacgactccaaggccatcgttgttgtcaaggacgctgctgagaaacctgcagctacaggaggttcaactgaaagagatgcttatctggcgaaaattgtatccgagaagagattgactctgatcactgcatgggaggagagtgagaaggcgagagctgagaacagggctgccaagaagcttgcctacatcacatcttgggagaaggcgaagaaagcaaagatggaggccgagcttaaaaagatggaggagcaactggagaagaagaaggcggcgtacgaagagaagctgaagaacaagctggcgatgctccacaagacgscggaggagaagagggcactgacggaggcgaagcgcggcgaggagatgatcatggcggaggarctggccgccaagtaccgcgccaagggtgaggctcccmccaagctcttcggcctcttgaaagcataacaaacgtcatctcgatcttctatgccgatccatakamatgcatatatatatatgtttggatggatatatattgttacctatatatatatatatatatatatatatatatatatatatatatatatatatatatatatatacttggtgcatggcctggtttgtttgtggtttgtgaatgtgtacttacttgaaggccaccggtgtacgtacgtacgttcttgtatattaattaattaattttgttgttggaagcaggtttgatat

SEQ ID NO: 10557 - protein, 187 aa, Panicum virgatum
  misc_feature: Ceres CLONE 1724776
  misc_feature (73)..(182): Pfam Name: Remorin_C Pfam Description: Remorin, C-terminal region
  misc_feature (15)..(71): Pfam Name: Remorin_N Pfam Description: Remorin, N-terminal region
  misc_feature: The sequence is a functional homolog of SEQ ID NO 1773 in the 11/479,226 US patent application
  misc_feature: The sequence is a functional homolog of SEQ ID NO 20 in the 10/286,264 US patent application
  misc_feature: The sequence is a functional homolog of SEQ ID NO 876 in the 10/412,699 US patent application
  misc_feature: The sequence is a functional homolog of SEQ ID NO 438 in the 10/666,642 US patent application
  misc_feature: The sequence is a functional homolog of SEQ ID NO 496 in the 11/435,388 US patent application
  misc_feature: The sequence is a functional homolog of SEQ ID NO 1492 in the 11/479,226 US patent application
  misc_feature: The sequence is a functional homolog of SEQ ID NO 644 in the 11/435,388 US patent application
  misc_feature: The sequence is a functional homolog of SEQ ID NO 716 in the 10/412,699 US patent application
  misc_feature (146)..(146): Xaa is any aa, unknown, or other
  misc_feature (179)..(179): Xaa is any aa, unknown, or other
MAAEEAKKVEVEATKDIAEEKAIVPLPTPPAAPKVDKPADDSKAIVVVKDAAEKPAATGGSTERDAYLAKIVSEKRLTLITAWEESEKARAENRAAKKLAYITSWEKAKKAKMEAELKKMEEQLEKKKAAYEEKLKNKLAMLHKTXEEKRALTEAKRGEEMIMAEELAAKYRAKGEAPXKLFGLLKA

SEQ ID NO: 10558 - DNA, 1332 bp, Panicum virgatum
  misc_feature: Ceres CLONE 1724780
  misc_feature: Encodes the peptide sequence at SEQ ID NO. 10559
acgacacacacgcaccagaggcgaggtccgaggagagctcaggcgcagcgacggcaatggcagcgtcactccaagcagcggccaccctgatgcagccggccaagatcggcggccgcgcctccgcctcgctgctgtcccgccagccgtcccacgtcgccagggcgttcggcgtcgacaccggcgcggccaggatcacgtgctctctgcagtccgacatcagggaggtcgcgagcaagtgcgtcgacgccgccaagctcgccggcttcgcgctcgccacctcggcgctccttgtctcgggcgcgagcgcggagggcacgcccaggaggctgacctacgacgagatccagagcaagacgtacatggaggtgaaggggaccggcacggcgaaccagtgcccgaccatcgacggcggcgtcgagtccttcccgttcaagcccggcaagtaccagatgaagaagttctgcctggagccgacgtccttcaccgtcaaggccgagggcatcgccaagaacgcgccgcccgagttccagaagaccaagctcatgacccgcctcacctacaccctcgacgagatcgagggcccgctcgaggtcggctccgacggcaccctcaagttcgaggagaaggacggcatcgactacgccgccgtcaccgtgcagctcccgggaggcgagcgcgtgcccttcctcttcaccgtcaagcagctcgtcgccaccggcaagcccgagagcttcggcgggcccttcctcgtgccgagctaccgtggctcctccttcctcgaccccaagggccgtggtggctccaccggatacgacaacgccgtggcgctccccgccggaggcagaggagacgaggaggagctcgtgaaggagaacatcaagaacgccgcatcgtcgacgggcaacatcacattgagcgtgaccaagagcaatccggagaccggcgaggtcatcggcgtcttcgagagcgtgcagccgtcggacaccgatctcggggccaaggcgcccaaggatgtgaagatccaggggatctggtacgcgcagctcgaatcttagacgacgcgaccgtgatccatgggcaggtgtacgatggagaacttttgagagcaaaggaggcggcattctgtacctattaatgcaaatattggctgtttgatttttaattttagcatgcgtttcttctttctcgtgttctcatgaactcccatgtaatgcttgctttgcatttggacaagaggagagaggacggctgcctagtatgtgtgtatatgtgcctaatttgcagtcctgcacacatatccttgtcatgcagtgtctcttttcatcttacagc

SEQ ID NO: 10559 - protein, 332 aa, Panicum virgatum
  misc_feature: Ceres CLONE 1724780
  misc_feature (95)..(331): Pfam Name: MSP Pfam Description: Manganese-stabilising protein / photosystem II polypeptide
MAASLQAAATLMQPAKIGGRASASLLSRQPSHVARAFGVDTGAARITCSLQSDIREVASKCVDAAKLAGFALATSALLVSGASAEGTPRRLTYDEIQSKTYMEVKGTGTANQCPTIDGGVESFPFKPGKYQMKKFCLEPTSFTVKAEGIAKNAPPEFQKTKLMTRLTYTLDEIEGPLEVGSDGTLKFEEKDGIDYAAVTVQLPGGERVPFLFTVKQLVATGKPESFGGPFLVPSYRGSSFLDPKGRGGSTGYDNAVALPAGGRGDEEELVKENIKNAASSTGNITLSVTKSNPETGEVIGVFESVQPSDTDLGAKAPKDVKIQGIWYAQLES

SEQ ID NO: 10560 - DNA, 970 bp, Panicum virgatum
  misc_feature: Ceres CLONE 1724782
  misc_feature: Encodes the peptide sequence at SEQ ID NO. 10561
aaaaacagccgcccgcggacgccgacggggcaggcgcagctccgtccatagcgcgacagcctgcggcatggccgaaacgcgcagaaaaatggacgcggctgctggctagtcaccaataaatgaagccccgcgccgcgccgcgctctactgctgctactagcacagcgctgaaacccgcggcggcgagctagagagaaagagagagagctccccgtcaggtgatggcaactctggtgttcgtgctgctcttgctggccatggcgttcagaggatcaggcggctcgtggtgcgtgtgccggccggacgcgacggacgcggcgctgcagaggacgctggactacgcgtgcgggcacggcgcggactgcgccgccgtgctcccgacgggcccgtgctacagccccccctcggtgcgcgcgcactgctcctacgccgccaacagctacttccagcggaacagacaggccaacggcgccatctgcgacttcggcggcacggccaacctcaccgacacggacccgagctccggaacctgcaagtaccctgcgactccgagcgaggcggggacaagcggcaacgcaaccggcacgggcgcgtcgtcgtctccaggctccgcgagcaacccggcgacgacgcccagcacgggagggagcttcacgacaccggtatccgcgttcggccccgtgcccagcaccgtcagcgccgccgccgcggcggcgttcgctggccgccacgttctcctcctcgccgtcgtctccgtcctggcgttcttggctcgctaagttaacagacttgctggatgacaacacaaggcagccgagcggcgttcttgttccggcgcgcacgaggggctttggtgtcagagtgggggcttttcgctattgttcttgttcgttcttctctttaccatgtttctcgcggttttcttctgcttttggatatgaatatgaaccgaatttgattgcttcactcg

SEQ ID NO: 10561 - protein, 185 aa, Panicum virgatum
  misc_feature: Ceres CLONE 1724782
  misc_feature (21)..(106): Pfam Name: X8 Pfam Description: X8 domain
  misc_feature: SWISSPROT Homolog: EC 3.2.1.39 Glucan endo-1,3-beta-D-glucosidase
MATLVFVLLLLAMAFRGSGGSWCVCRPDATDAALQRTLDYACGHGADCAAVLPTGPCYSPPSVRAHCSYAANSYFQRNRQANGAICDFGGTANLTDTDPSSGTCKYPATPSEAGTSGNATGTGASSSPGSASNPATTPSTGGSFTTPVSAFGPVPSTVSAAAAAAFAGRHVLLLAVVSVLAFLAR

SEQ ID NO: 10562 - DNA, 1141 bp, Panicum virgatum
  misc_feature: Ceres CLONE 1724790
  misc_feature: Encodes the peptide sequence at SEQ ID NO. 10563
atccgaaacattcctccactcccacccgaggtggagggaagggtgagagagggagagggagagataagagaatccagtcctccgataaggaggaattcgtgagggggagggcgagatagagtgagtcctccgcggatgaagttcgggaaggatttccggaaccacctggaggagacgctgccggcgtggagggacaagtacctcgcctacaaggccctcaagaagctcatcaagaacctgcggccccccgagcccgccgtccctcctcttcctcccccgcccgccgccgtgggacccggggatggggccggccaggggaacgtcgcgctcgggaactggtttgccagcatcctcgacatggagctcctcaagctcaacgagttctacatggagagggaggagtggtacgtcatccgcctccaggtgcttaaggagaggattgagcgcgtcaaagctaagaagaatgatgcttttacatccaggagtgaatttacagaagagatgctagagatacgcaaggactttgtgatcatacacggcgaaatgattcttctgcaaacctacagttccctaaattttgctggactagtgaagatattgaagaagtatgacaagagaacaggcggtttgctcagcctgcctttcactcagcgtgctcgtcatcagccttttttcacaaccgaacctttaacaaggcttgttcgagaatgcgaggctaatcttgaactccttttcccggtcgaagcagaagttcttgagcctagttcatcttcaaatctgcaaccgcatgatgtggctaagcgtgacccaacatcgtctggtgacgtggaagcctcagatgtgtaccgaagcacactcgcagcaatgaaagcgatacaaggccttcggagagccagctctacttacaatcccctgtctctgtctaggttcttcaatggtgaggatggcgaagcctgttctggcgccatcacttctgagagttcgttatcagagtcctcaacagactcccagattcaggatgatggaaaggatgataaagaggtgcagtcaaattcaagtgagcagaatgttgctcaaagggaacataatgcaaatggcgagccacggaatgaataatgagtcttttcacgcactgttcaat

SEQ ID NO: 10563 - protein, 326 aa, Panicum virgatum
  misc_feature: Ceres CLONE 1724790
  misc_feature (1)..(175): Pfam Name: SPX Pfam Description: SPX domain
MKFGKDFRNHLEETLPAWRDKYLAYKALKKLIKNLRPPEPAVPPLPPPPAAVGPGDGAGQGNVALGNWFASILDMELLKLNEFYMEREEWYVIRLQVLKERIERVKAKKNDAFTSRSEFTEEMLEIRKDFVIIHGEMILLQTYSSLNFAGLVKILKKYDKRTGGLLSLPFTQRARHQPFFTTEPLTRLVRECEANLELLFPVEAEVLEPSSSSNLQPHDVAKRDPTSSGDVEASDVYRSTLAAMKAIQGLRRASSTYNPLSLSRFFNGEDGEACSGAITSESSLSESSTDSQIQDDGKDDKEVQSNSSEQNVAQREHNANGEPRNE

SEQ ID NO: 10564 - DNA, 933 bp, Panicum virgatum
  misc_feature: Ceres CLONE 1724791
  misc_feature: Encodes the peptide sequence at SEQ ID NO. 10565
ctctctctctctctctctccatcacggcgcagccgcgataaaataaatcttgtgcagcgtgtggggagggcgtacggcgacgcggacgcaccgtcaccgggctgcgcaatcccttttctccctcttcttatcccaaaggcaagagccgcgcgtctccgagagcccagagggaggagaggagggcgcgtcctgctgcggtccttgttcgttgctcgcccccctccgctttccgggatgtcgtcgccgagcaagcgccgcgagatggacctcatgaagctgatgatgagcgactacaaggtggagatgatgaacgacgggatgcaggaattcttcgtcgaattcaaggggccgaccgaaagtatctatcaaggtggtgtctggaaggttagggtggaattgcctgatgcgtacccttacaaatccccgtccataggcttcatcaacaagatttatcacccgaatgttgatgaaatgtctggttccgtctgtttggatgtcataaaccagacatggagcccaatgtttgatctagtaaatgtttttgaagtgttccttccacagcttttactgtatccgaatccttctgatccattaaatggggaggctgctgcattgatgatgcgtgaccgccctgcttatgaacaaaaagtgaaagaatactgtgaaaagtatgccaaaccagaggacgctggaataaccccggaagacaagtccagcgatgaggaacttagcgaggaagaagatgactctgcggacgaagtcatacttggcaatcctgatccttagtctgagttggaagctgcgctcccagctcatctatacaatgttcattgcagcaattgcaattaaacagaaactgaaaaactaaaaaaaaatctggatgtcatgtaaataaggtaccctgtatgttatgcaatgctgtttctttcagtc

SEQ ID NO: 10565 - protein, 183 aa, Panicum virgatum
  misc_feature: Ceres CLONE 1724791
  misc_feature (7)..(143): Pfam Name: UQ_con Pfam Description: Ubiquitin-conjugating enzyme
  misc_feature: SWISSPROT Homolog: EC 6.3.2.19 Ubiquitin--protein ligase
MSSPSKRREMDLMKLMMSDYKVEMMNDGMQEFFVEFKGPTESIYQGGVWKVRVELPDAYPYKSPSIGFINKIYHPNVDEMSGSVCLDVINQTWSPMFDLVNVFEVFLPQLLLYPNPSDPLNGEAAALMMRDRPAYEQKVKEYCEKYAKPEDAGITPEDKSSDEELSEEEDDSADEVILGNPDP

SEQ ID NO: 10566 - DNA, 1372 bp, Panicum virgatum
  misc_feature: Ceres CLONE 1724797
  misc_feature: Encodes the peptide sequence at SEQ ID NO. 10567
acacacctgccgagtgccgaggtgccatccccagcagctccaatccttccgtccatctcgatccccagcccaagaagctagctctcggccatggccaccaccgcgtcgaccctcctcaaatcctccttcgccggcgcccggctcccggccgccccgcgcgccccgtcctccgtcgccgtggcgaccccccgcgccgccgggcccatctgcgcctccgcctccgcctcctcctccaccccgccctacgacctcacctccttccggttcagccccatcaaggagtccatcgtcgcccgcgagatgacccgccggtacatgaccgacatgatcacccacgccgacaccgacgtcgtcatcgtgggcgccggctccgcggggctctcttgcgcgtacgagctctccaaggacccctccgtcagcatcgccatcgtggagcagtccgtgtcccccggcggcggcgcctggctcggcgggcagctcttctcggccatggtggtgcgcaagcccgcccaccgcttcctcgacgagctcggcgtcgcgtacgacgaggccgaggactacgtggtcatcaagcacgccgcgctcttcacctccaccatcatgagccgcctcctggcgcgccccaacgtgaagctcttcaacgccgtcgccgtcgaggacctcatcgtcaagcagggccgcgtcggcggcgtggtcacgaactgggccctcgtctccatgaaccacaacacccagtcgtgcatggaccccaacgtgatggaggccaaggtcgtggtcagctcctgcggccacgacgggccgttcggggccaccggcgtcaagcggctgcaggacatcggcatgatcagcgccgtgcccgggatgaaggccctcgacatgaacaccgccgaggatgagatcgtccgcctcacgcgtgaggtcgtgcccggcatgatcgtcaccggcatggaggtcgccgagatcgacggcgccccgagaatgggcccgacgttcggcgccatgatgatctccggccagaaggcggcgcacctggcgctccaggcgctgggcaggcccaacgccatcgacgggacggcccagaaggcgtcgccggcgtggcgcgaggagttcgtgatagcgtccaaggacgacgaggtcgtggacgcgtgagcaggggacgcgcgccgggtgggggagcgatttccgtggggattttctccgtttcttctggactctgctgctttgttcagttcagctgtgtctctcgctagtgtcgtgttcataccactgccacgccagtatgccaccgtgtgctctgtctcgtgggggcaccactctgtggggccctcctggcagctggaataaagagaagatgaaataaaatgcatcttgg

SEQ ID NO: 10567 - protein, 352 aa, Panicum virgatum
  misc_feature: Ceres CLONE 1724797
  misc_feature (59)..(301): Pfam Name: Thi4 Pfam Description: Thi4 family
  misc_feature: SWISSPROT Homolog: EC 1.3.99.1 Succinate dehydrogenase
MATTASTLLKSSFAGARLPAAPRAPSSVAVATPRAAGPICASASASSSTPPYDLTSFRFSPIKESIVAREMTRRYMTDMITHADTDVVIVGAGSAGLSCAYELSKDPSVSIAIVEQSVSPGGGAWLGGQLFSAMVVRKPAHRFLDELGVAYDEAEDYVVIKHAALFTSTIMSRLLARPNVKLFNAVAVEDLIVKQGRVGGVVTNWALVSMNHNTQSCMDPNVMEAKVVVSSCGHDGPFGATGVKRLQDIGMISAVPGMKALDMNTAEDEIVRLTREVVPGMIVTGMEVAEIDGAPRMGPTFGAMMISGQKAAHLALQALGRPNAIDGTAQKASPAWREEFVIASKDDEVVDA

SEQ ID NO: 10568 - DNA, 1020 bp, Panicum virgatum
  misc_feature: Ceres CLONE 1724804
  misc_feature: Encodes the peptide sequence at SEQ ID NO. 10569
aagccagaagctgctgcagcatccatccatcctgctctcgagctccaagcctcaaacccgtccgcgcctgctcaggctcagctagccggggacgaattaaccgagcagcatccatggcggccgtgttggtggcgaggcaggggcgcgagctgcagcgctacagccagcgcaccggcgggcgcatcgtggtggggtgcatcccgtaccgcgtgcggtgcgacggcgagctggaggtgctggtgatcacgtcgcagaaggggcacggcatgatgttccccaagggcgggtgggaggaggacgagtccatggacgaggccgcccggcgcgaggccctcgaggaggccggcgtcctcggcgacaccgagccggtgctcggcttctggcactacaagagccgccgctacgtcgaccagacctacgagggcttcatgttcccgctccgcgtcgccgacgagctccaccagtggcccgagatggcctcccgcaagcgcacctgggcaacggtgaaccaggtgatggacgggtgcccgcacttgtggatgcgggaggcgctcgagaagctcgtcgcccggcacgccatggccatgctgcagtccgctctctgatctggagagaggacctcgcggccggcgtactccctcgagaaaggatcggcagcacgaacccaagctagcacgcgtcgtcacggctcccacggtgcagcggcaggccggccggcgttccggcgctcggatttggtcgccctcaccggagagacggcggcgcggagcgcggggtggatgctggcggcgctttcttgactcctcccgagacgcggagtcgtcgttgcgcggttgcggcagatttaaaaaaataatctcagcgagcaaatcattggaccaaatgtaaacaaaaccaaacaggacacatcatactagcgaacgggcgaacagcagcgcggaacaatccacgattatttggagtcagtaacagaaaaagaaagtgtaaattagtgctaataacttcgtttcttggtgccag

SEQ ID NO: 10569 - protein, 163 aa, Panicum virgatum; identical to SEQ ID NO: 10399
  misc_feature: Ceres CLONE 1724804
  misc_feature (22)..(153): Pfam Name: NUDIX Pfam Description: NUDIX domain
  misc_feature: SWISSPROT Homolog: EC 3.6.1.52 Diphosphoinositol-polyphosphate diphosphatase

SEQ ID NO: 10570 - DNA, 906 bp, Panicum virgatum
  misc_feature: Ceres CLONE 1724809
  misc_feature: Encodes the peptide sequence at SEQ ID NO. 10571
cccgccggccgctgcgacaacccgccagaccgccaccgtcggcagtgctcctcccaaatcccagctctccgcagcaacctcgttcgacaggtgacttccaaccgccggtttttacctcccggggccataagcccggaccaccgatttgtagcatcttcactatatcagctctgtggtcatcacttatcggtagataaaacagtatgcagacatctagagctaggcttttcaaggagtataaggatgtacagcgagagaagtcagctgaccctgatatccaattaatttgtgatgattcaaacatattcaagtggactgctcttgtcaagggcccttctgaaacaccttatgaaggtggtgtttttcaacttgcgtttgcaattccagagcagtatcctttgctgcctccacaagttcgatttctgaccaaaattttccacccaaatgtgcattttaagactggtgaaatttgcctggacattttgaagaatgcatggagccctgcatggacccttcagtctgtttgcagagcaataattgctctgatggcccatcctgaaccagacagcccacttaactgtgattcaggcaatctcctaaggtcgggtgatatccgaggctatcaatcaatgggccgcatgtatacaaggctggcggccatgccaaagaaaaattagctgcacaagtgctaaggaaacacgccccaggtccgcccccatgctgtctgtgttttaacttgtgcttgtttccttaacactcagatgtgtgagtaagagtgagaagggagaaaacccgtgttttcaatgcatagtgtgtgatatattaggtcctggaatttggcagttgccaccgtaacctactgcactacagttactgtttcaatcagtttgtgctgtacgctctctg

SEQ ID NO: 10571 - protein, 157 aa, Panicum virgatum
  misc_feature: Ceres CLONE 1724809
  misc_feature (7)..(148): Pfam Name: UQ_con Pfam Description: Ubiquitin-conjugating enzyme
  misc_feature: SWISSPROT Homolog: EC 6.3.2.19 Ubiquitin--protein ligase
MQTSRARLFKEYKDVQREKSADPDIQLICDDSNIFKWTALVKGPSETPYEGGVFQLAFAIPEQYPLLPPQVRFLTKIFHPNVHFKTGEICLDILKNAWSPAWTLQSVCRAIIALMAHPEPDSPLNCDSGNLLRSGDIRGYQSMGRMYTRLAAMPKKN

SEQ ID NO: 10572 - DNA, 1092 bp, Panicum virgatum
  misc_feature: Ceres CLONE 1724834
  misc_feature: Encodes the peptide sequence at SEQ ID NO. 10573
gatggccgatgcgtcctcctcctgcgtcttcttcaggatcgaaccgcatctcgctcgaaaaccagccggccaggcagccatccacacgcctcgcgcggcatgctgcctcacgccgaggtgccggccagtaaggccgcggccgcgggcatcaagctgttcggcaaggtcatcaccacgcagcagcagcagcacgctggagccgccggcgccgccgcggggagcgcgccgccgccgaggctgctgcagcaggcggcggcgtcggggcgcgggggcgccgacctgctggaggaggccgcgcgggcgcgcgccgcggcggccgaggcgcggctgccgtgcccgcggtgccggagccgggacaccaagttctgctacttcaacaactacaacgtcaaccagccgcgccacttctgccgggcctgccaccgctactggacggccggcggcgccatccgcaacgtgcccgtcggctccggccgccgcaagaaccgcccggtgctgccgccgccaccgccgccgcccccccccccgcccccggcgccgcacgcaggcgacgccacgcccaccagcgccgaccacgcggtctcggaatccgggtctcctcctgtgttcacgaccgcctctggcgtcccctaccgcggctcacccttccacctcgcgccttcgccggcctgcaccgccgccggcctcccggagacggcggggcagtactggtggctcgtggcgcgtgccgcggcgcgtgcggttgcgccggaccgcgccttctgatccgaggaaaacggcgcgtcctttttttttggcgacggctcgctcctttcacggatcgggaaggaacgagcctggccggttgcgcgggtgaatagggtaggggtttgacccggtgaggacgctcgccgagtgctggaggaggcaggagaggctttttaggtgtaaccgtgtggtctttgcacaggaatcgaggtgtctgttctgattcttttcttttgactttgcatcgagcttgtggtgaaagctgttctgacccttacgccctgtgtttagatttttacccgtaaacccgtaaataaaaaaacccgtcacatcgaatgtttcgac

SEQ ID NO: 10573 - protein, 221 aa, Panicum virgatum
  misc_feature: Ceres CLONE 1724834
  misc_feature (72)..(134): Pfam Name: zf-Dof Pfam Description: Dof domain, zinc finger
  misc_feature: The sequence is a functional homolog of SEQ ID NO 1920 in the 10/412,699 US patent application
  misc_feature: The sequence is a functional homolog of SEQ ID NO 2182 in the 10/374,780 US patent application
  misc_feature: The sequence is a functional homolog of SEQ ID NO 408 in the 10/666,642 US patent application
  misc_feature: Functional homolog of the protein sequence given in SEQ ID NO 50213
  misc_feature: Useful for making plants with modulated biomass
  misc_feature: Functional homolog of the protein sequence given in SEQ ID NO 50214
  misc_feature: Useful for biocontainment applications
  misc_feature: Useful for making plants with modulated flowering time
  misc_feature: Useful for making plants with modulated light quality response
MLPHAEVPASKAAAAGIKLFGKVITTQQQQHAGAAGAAAGSAPPPRLLQQAAASGRGGADLLEEAARARAAAAEARLPCPRCRSRDTKFCYFNNYNVNQPRHFCRACHRYWTAGGAIRNVPVGSGRRKNRPVLPPPPPPPPPPPPAPHAGDATPTSADHAVSESGSPPVFTTASGVPYRGSPFHLAPSPACTAAGLPETAGQYWWLVARAAARAVAPDRAF

SEQ ID NO: 10574 - DNA, 854 bp, Panicum virgatum
  misc_feature: Ceres CLONE 1724844
  misc_feature: Encodes the peptide sequence at SEQ ID NO. 10575
acaccggcgagcacagcgaaacgcgggagcagagagagagagagagacccgccccctcctccctccgtccggtccccgatggcggctcgcttcgcggccctcgccgcgctcctcgccctcgccgccgccactgcgcgggcgtccaacgacgagggcgacgcgctctacgcgctgcggcagcggttcagggaccccaacggcgtgctgcagagctgggaccccacgctcgtcaacccctgcacctggttccacgtcacctgcaaccaggccagccgcgtcgaacgcctggacttggggaactccaatatctccggctccctcggccctgagctcaggcgccttgtgaacctcaaatacctggagctgtacaggaacaatttcgatggcgagatcccaaaggaattgggtaagctgaagaatctgatcagcttggatttgtacgccaacaagctcaccggagaaatccccaagtcactttccaagctcaactcactcagattcatgcgcttgaacaacaacaagcttaccggatcaattccaagggagcttgccaagctttccaacctcaaagtcattgacctgtctaacaatgatctctgtggaaccattcctgttgatggacctttctcaaccttccctcttagaagctttgagaacaacagcaggctcaacggtccagagctgcaagggttggttccctatgactccggatgttagatgctcctgttcaggctgatgctgctgcaacaaaacaatcaacaatgtatcccatccctagttgaaagaaggaaaaacaagatagtacaaagaaacctagcttggagaatgtggtgataatatatgtgtgttcagac

SEQ ID NO: 10575 - protein, 212 aa, Panicum virgatum
  misc_feature: Ceres CLONE 1724844
  misc_feature (22)..(62): Pfam Name: LRRNT_2 Pfam Description: Leucine rich repeat N-terminal domain
  misc_feature: SWISSPROT Homolog: EC 2.7.11.1 Non-specific serine/threonine protein kinase
MAARFAALAALLALAAATARASNDEGDALYALRQRFRDPNGVLQSWDPTLVNPCTWFHVTCNQASRVERLDLGNSNISGSLGPELRRLVNLKYLELYRNNFDGEIPKELGKLKNLISLDLYANKLTGEIPKSLSKLNSLRFMRLNNNKLTGSIPRELAKLSNLKVIDLSNNDLCGTIPVDGPFSTFPLRSFENNSRLNGPELQGLVPYDSGC

SEQ ID NO: 10576 - DNA, 858 bp, Panicum virgatum
  misc_feature: Ceres CLONE 1724854
  misc_feature: Encodes the peptide sequence at SEQ ID NO. 10577
gatcgtttgctccttctgcgacgtcctgcattggcctcctttgtcggttataatcatgcgaataggcttggctgagagatggcccttaccaagcaaaccgctcgcaagtccacgggtagggaaggctcccaggaagcagcttgcaactaaggctgcccgcaagtcagccccgaccactggaggagtgaagaagccccaccgctaccgccctgggactgttgccctccgtgagatccgcaagtaccagaagagcactgagctgttgatcaggaagctgcccttccagaggcttgttagggaaattgcacaggacttcaagactgatctgcgtttccagagccatgctgtgcttgccctccaggaggctgccgaggcgtaccttgttggtctgtttgaggacaccaacctgtgcgccatccatgctaagcgtgtgaccatcatgcccaaggacattcagctggccaggaggatccgaggcgagagggcttaatcatgatcatgacaatcaaaatctcgtgtcgtagtagtggtttaatgtggtgccatgttcggacatcagtagggcttgttttgtggatcataagtttctcttctgcagcactatgtgttgcgactaccgttgttggtgttattactagggtcgtcgaatacttaaattgtctcgtctagtgttgttaccgcgttgacagtttgacatttgtgtgctttgttgctgctgactagcagtgctgtttgtgcgctgctggattgtaagcttcatcgctgttgaggatccgttcgttaatgtcaagtttcgtgtaatagttggcgtacatcttcctcggatggttcatgttctatttagcaagaggtccatcc

SEQ ID NO: 10577 - protein, 162 aa, Panicum virgatum
  misc_feature: Ceres CLONE 1724854
  misc_feature (84)..(158): Pfam Name: Histone Pfam Description: Core histone H2A/H2B/H3/H4
IVCSFCDVLHWPPLSVIIMRIGLAERWPLPSKPLASPRVGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 10578 - DNA, 1117 bp, Panicum virgatum
  misc_feature: Ceres CLONE 1724860
  misc_feature: Encodes the peptide sequence at SEQ ID NO. 10579
gcagcgccgacttccgcgatgcagatcctccgccggaagcttctggaagcttcccgccgcctccctcttttctacgccgcggccgccgctccccgccgccgcgctcatgcggtcgccacgctcgccgccgccgcgcggtgggccccgcccgccggcgcgggctcgctggccgccgctccgtgggccgccacacagcgacgcggcgcgaagatgctcggctccgacgtgaaacttggaaatgtaatacaaagaagaggtcgtatttatcaggtaataaaagcacaacattcacatcaaggaagaggaggggccacaatacaggtggaactgagggatgttgacactggaaacaaaataacagaaaggtttcgtactgatgaggcccttgagagagtttttgttgaggagaagtcattcacatatctctatcaggaaggagacactgtgatgcttatggagcctgaaacatttgagcaaattgaagtttctaaggatctgtttggcaaagctgctgcgtacctgaaagatgaaatgaaggtgaacctacaatactttgatggccggccaatgtctgctacggttcctccaagagtgacttgcactgttgttgaagcacagccgaatacaaaagggcttactgctcaacctcagtacaaaagggtcgtgctggacaatggtcttacagtgcttgcaccgccttttattgaagcaggcgagaagattgtaatcagtacagcagatgattcatatatgacaagggcctaagggatatcttgtatagcgtattgttattccaaatgggaattgaatgcattttccctacttggataagttttcacttgtggagctaccgtggccaccagcaaccgagaatttagtttgtagccacacattttgtactcacaggtgttcttattttgtttcatttgaaacatttattcaacagcttcctttcatggagaaccatgggaatttttgtggtaacacacaacacatgtagagaagccaagttggtagatattttgaattatttaaattcccttgtatggcttactgttccgcagaacaatgggatttgattgtctgggtttcaatgcaaataaatacgaggtttgat

SEQ ID NO: 10579 - protein, 248 aa, Panicum virgatum
  misc_feature: Ceres CLONE 1724860
  misc_feature (192)..(247): Pfam Name: Elong-fact-P_C Pfam Description: Elongation factor P, C-terminal
  misc_feature (130)..(184): Pfam Name: EFP Pfam Description: Elongation factor P (EF-P) OB domain
  misc_feature (66)..(123): Pfam Name: EFP_N Pfam Description: Elongation factor P (EF-P) KOW-like domain
MQILRRKLLEASRRLPLFYAAAAAPRRRAHAVATLAAAARWAPPAGAGSLAAAPWAATQRRGAKMLGSDVKLGNVIQRRGRIYQVIKAQHSHQGRGGATIQVELRDVDTGNKITERFRTDEALERVFVEEKSFTYLYQEGDTVMLMEPETFEQIEVSKDLFGKAAAYLKDEMKVNLQYFDGRPMSATVPPRVTCTVVEAQPNTKGLTAQPQYKRVVLDNGLTVLAPPFIEAGEKIVISTADDSYMTRA

SEQ ID NO: 10580 - DNA, 1086 bp, Panicum virgatum
  misc_feature: Ceres CLONE 1724871
  misc_feature: Encodes the peptide sequence at SEQ ID NO. 10581
ggcaaaccacgccgcgcacaaaaccccacgagaaccctccaccacgacgcgacgcgacgccgccatggcgatccggatgagcaacaacgtgatcgtcgcgctgaacgtggtgacgctgctgctctcggtcccggtcctcgccgggggcgtctggctgcggtcccgcgccgacggcaccggctgcgaccatttcctctccaccccgacagtcgcgctgggcgcggcgctcgcggccgtcgccctcgcggggctcgccggcgcctgctgccgcgccacctggctcatttggctctacctcctcgccacgctcgcgctcgtcgccgcgctgctctgcttcaccgccttcgccttcgccgtcaccgccaggggggccggcgggggcgggggcaactccgcctggctgcgccgccacgtcgaggggaccaggagctggggccgggtccggagctgcctcgccaatgccggggtgtgcgagcgtctcgagaaggacggcggcaagagcaaggaggcggcggcggcccggctcgctggccgcggcctgtcgccggtcgagtccgggtgctgcaggccgccggcgagctgcaacttcacgtacgcggggggcggggagtggaccaggcccgccgggaggggccccgcggcgccggacgacccggactgcgccaggtgggacaacgacgacgacaagctctgctacgggtgccggtcgtgcaaggccggcgtggagggcgcgctcaggcgggactggaagcgcgccgccgtcgtcaacgccgtcttcctcgccttcatcgtcgtcgtctgcggcctcagctgctgcgcattccggaacagccgccgggacaacttcgcctaccacagcggccgcggcggatggcaacgcgccggagacgcataatcgaactgctaacctgtattcgtaggagaaacacgagttgctgctgcagggtctccctatgatcggtgttagtttagctgagcattatttgtagcttgtacacttgtacaatagcagttggctgtctgtatgatcagtgtctcagaggtaggatctggatttattaattgaatttccttctcttctctctc

SEQ ID NO: 10581 - protein, 276 aa, Panicum virgatum
  misc_feature: Ceres CLONE 1724871
  misc_feature (5)..(242): Pfam Name: Tetraspannin Pfam Description: Tetraspanin family
MAIRMSNNVIVALNVVTLLLSVPVLAGGVWLRSRADGTGCDHFLSTPTVALGAALAAVALAGLAGACCRATWLIWLYLLATLALVAALLCFTAFAFAVTARGAGGGGGNSAWLRRHVEGTRSWGRVRSCLANAGVCERLEKDGGKSKEAAAARLAGRGLSPVESGCCRPPASCNFTYAGGGEWTRPAGRGPAAPDDPDCARWDNDDDKLCYGCRSCKAGVEGALRRDWKRAAVVNAVFLAFIVVVCGLSCCAFRNSRRDNFAYHSGRGGWQRAGDA

SEQ ID NO: 10582 - DNA, 1017 bp, Panicum virgatum
  misc_feature: Ceres CLONE 1724875
  misc_feature: Encodes the peptide sequence at SEQ ID NO. 10583
gttgaacgtcgccgcactgtcggacctctgtcgcagcaagtccttctcctgcgggtgcgggggcgacgcactgccgccgtcgtctctgtgagcgggcggccagattccgttccgtctccgtgagcgggcgtccgccgggagcttgatgcgcaggggcggcggctctgccccgtcgtttgatgggcaacgcatgcggcagcacccttagatccaagcatctgcacagcttcaagtgcgccgcatcgcagcgccaggactccgagtacagcgccgcggcagccgccgactcgccgaagaagcccgcctcccgcgcgcccatgccgcccgccgccgccaccaccacggacgcccacgcgggccacgcgtcggtgccgcccgccgccgggatgaggcgcgacggggcgggcgcgccgccagacctcggctccgtgctcggccaccccacgcccaacctccgcgacctctacgcgctgggccgcaagctcgggcaggggcagttcggcaccacctacctctgcaccgagctcgccacggggtcgactactcgccgctgcctcgccggacctccggtcgattccggccgcctagaggtcaagatccgccgcgtaggggtgctgctccgaccgggcgggcgggtaggagctccgccgcgtgcgcgtgcggctccggccagcggcgcgggcaggagatcgccgcgagcgcgggggcgggagctccgctgcgggcgcgcgggaaagagctctaccgccggcacgggcacctccggcggggcggcgcgtggggggccggccggcgcagagatgggaggctcctattcatagagatttgggggtgctaatttgagctcccatcgaaaataggactatttaggaggcctgttggagtttattttctttctaaactcgtaaaatttagagtaagggtctaaatgagagtccgggctggagttgctcttatgaatgtattgaagaaaaaatcccctaaactcagaatgacgtcaatgtgatttcatagcgc

SEQ ID NO: 10583 - protein, 213 aa, Panicum virgatum
  misc_feature: Ceres CLONE 1724875
  misc_feature: SWISSPROT Homolog: EC 2.7.11.1 Non-specific serine/threonine protein kinase
MGNACGSTLRSKHLHSFKCAASQRQDSEYSAAAAADSPKKPASRAPMPPAAATTTDAHAGHASVPPAAGMRRDGAGAPPDLGSVLGHPTPNLRDLYALGRKLGQGQFGTTYLCTELATGSTTRRCLAGPPVDSGRLEVKIRRVGVLLRPGGRVGAPPRARAAPASGAGRRSPRARGRELRCGRAGKSSTAGTGTSGGAARGGPAGAEMGGSYS

SEQ ID NO: 10584 - DNA, 1325 bp, Panicum virgatum
  misc_feature: Ceres CLONE 1724881
  misc_feature: Encodes the peptide sequence at SEQ ID NO. 10585
ttacaacttcagtagacagatagcgaacttggatatgccggggctcatggcgatgatggcactggcaccatcgaccttgtcagtgaagcgatgcttcagctgcaaagagccaccgggcacgacgatgctgctgctcaagaagcgctcttcttcgtcagcacacctccttcgccgcagcttggcccggggggcagcgacgacggccaccgcggccgccattcgtgatgaggaggagctgatgcagcgcctggctgaggacgggtgggtggatcagcatgtgctgcctctgctcacccctgtggaggaggcctggcagccggccgacctgctgccctcctttgccgcctctgccgacgagcagcggagccaggtggcggagctccaggcccgcgcagccgccgtgcccgacgacctccttgtctgcctcgtgggcaacatgatcacggaggaggggctgcccacctacatgtgcatgggcaaccgcgtggccggcggcagcgacgccaccggctgcgacggccacgcctgggcgcgctggctgcgcggctggaccgccgaggagaaccgccacggcgacctgctcaaccgctacctctacctgtgcggccgcgtcgacatgcggcaggtggagaggacggtgcaccacctcctccgccgcggcatgcgcacgatgctgcggccctccagcgcctaccacagcctcatctacggcgccttccaggagcgcgccaccttcgtctcccacgcccacggcgacgcctgcctcgccaagatctgcggcgtcatcgccgccgacgagaggcgccacgaggccgcctacactaaaacctccgccagggccttcgagacaaacccggacggcatggtgcgggcgctcgccgccgtgatgcgcgccaaggtcaccatgcccggcgagctcatgactgacggccgcgacgagcacctcttcgatcacttctcggcggttgcgcagcgctcgggggtgtacacagcggcggactacggagacatggtggagcacttcgttcgcaggtggaaggtggcggagctcggcgctgacctgtccggcgaggggcggcgcgcgcaggactacgtgtgcgggctgccgcgcaagatacgcaggatggaagagctggccctcgaccgcgcggcccaaatggaggcccagtccgttagcttcagttgggtgttcgacaggcacgtccgtataggctgatcagttagccttaatttgggttggaggcccactacaactccttaactgaagaaggtccaatcactgctgcttctcttccctaataaaaaacttctgctgcttctgttgc

SEQ ID NO: 10585 - protein, 393 aa, Panicum virgatum
  misc_feature: Ceres CLONE 1724881
  misc_feature (62)..(390): Pfam Name: FA_desaturase_2 Pfam Description: Fatty acid desaturase
  misc_feature: SWISSPROT Homolog: EC 1.14.19.2 Acyl-[acyl-carrier-protein] desaturase
MPGLMAMMALAPSTLSVKRCFSCKEPPGTTMLLLKKRSSSSAHLLRRSLARGAATTATAAAIRDEEELMQRLAEDGWVDQHVLPLLTPVEEAWQPADLLPSFAASADEQRSQVAELQARAAAVPDDLLVCLVGNMITEEGLPTYMCMGNRVAGGSDATGCDGHAWARWLRGWTAEENRHGDLLNRYLYLCGRVDMRQVERTVHHLLRRGMRTMLRPSSAYHSLIYGAFQERATFVSHAHGDACLAKICGVIAADERRHEAAYTKTSARAFETNPDGMVRALAAVMRAKVTMPGELMTDGRDEHLFDHFSAVAQRSGVYTAADYGDMVEHFVRRWKVAELGADLSGEGRRAQDYVCGLPRKIRRMEELALDRAAQMEAQSVSFSWVFDRHVRIG

SEQ ID NO: 10586 - DNA, 1411 bp, Panicum virgatum
  misc_feature: Ceres CLONE 1724883
  misc_feature: Encodes the peptide sequence at SEQ ID NO. 10587
atccagcagctacagagcactattgaaaatatcgccttggagaagcaccatatcgcaaagaattcatgaaaggagaaccccgaaacgaaaaggatacatccagctaatcccaaacccagtccatcagaactgatcaagcaccagctagaaagattcctaaactagttcctaaaccccaccccaaagtcctaatccgtatcatattattcctccgttccccccagctgctcctccaccgaatccagatcatcattatcactgcactttgttcgagctatcgtgtactttgcttccagagccaggaaccagaccaaccacttctcgagccctccagctcactggtgttcttgccaagagagaggtggagaagatcgaagctttttgctgccactgttcttcgttctgcgccatgagcagcgcgctgcttcgggtctacccttccgagctcaagatcccctatgaggtgaagaagcagcgatcttgctgcatgcagctgacgaacaggaccgaacagtttgtggccttcaaggtgaaaacaacgaacccgaggaagtactcggtcaggcacagctgcggcatactgcttccacggggctcgtgcaatgtaacagttacaatgcaagcacctatggagatgctatcagaccaccactgcaaggacaagtttctcgtgcaaagcgttgtggtgcaggacagagcgacgatgaaagactttggtcctcaattgttcactaaagcaccaggtaggctaattgaggagttcaagctgcgagtggtgtatattgctgctaatcctccctcaccagttccagaggaagaagaggaagaggattcatcccctcgatcagaggtgatcagctcatctacatttgatgttgcacatagatgtataggtgcttctgcagcagaaccttcttgtgctgagggtacctctgtaatatcagggctggctggagagagagacttcgcagtagataaaaatcagaaggttcagcaagaaatggaactgcttggggagacaaggtcatctcaacagggattctcactgatgtttgtagtgtttgtcttcatgtcttctatgttcattggacacttgatgaacgaaatcaaggtctagccaaataacagttgtaaaagggaaagaaggatctgcatttctaccaacactgtcagagactcgatgtcacgttctccatacaaattttctcttagtttcacattgcagcatagcttcactccatgtaacatgactattctagaaacagaaagggttgatcaggaacctgtagttaatttgcgcattcaaatgtatgttctgattgtagttttgcatcaataggtttatagaggttttcctgacaaggctagtttgtatactagttttagaagctaataaaacagtttatatctg

SEQ ID NO: 10587 - protein, 235 aa, Panicum virgatum
  misc_feature: Ceres CLONE 1724883
  misc_feature (5)..(112): Pfam Name: Motile_Sperm Pfam Description: MSP (Major sperm protein) domain
MSSALLRVYPSELKIPYEVKKQRSCCMQLTNRTEQFVAFKVKTTNPRKYSVRHSCGILLPRGSCNVTVTMQAPMEMLSDHHCKDKFLVQSVVVQDRATMKDFGPQLFTKAPGRLIEEFKLRVVYIAANPPSPVPEEEEEEDSSPRSEVISSSTFDVAHRCIGASAAEPSCAEGTSVISGLAGERDFAVDKNQKVQQEMELLGETRSSQQGFSLMFVVFVFMSSMFIGHLMNEIKV

SEQ ID NO: 10588 - DNA, 1399 bp, Panicum virgatum
  misc_feature: Ceres CLONE 1724901
  misc_feature: Encodes the peptide sequence at SEQ ID NO. 10589
ggtcgctgtgcctcgcctacccggttcgcccccggacgctccctcctgccctgcgccgcgcccctgcctgccccctcccccctctgtccggtcatccggtggctgcggctgcgcgcatcatccgacctcgcgaaccggaaccaccaccaggacggctgctagactcgagcctcgcctccccctcctcccaccaaccgcagcagcgagacagagaatggctgcggcgccggggtccctcgcgtgctcctcccgcctctcccgcctcgcggacctccgccgcacgccggcggcccctgctgccccgcagcaggtccacctcggctgctcccgccgccgcgcgcagcgcaccgtcgccatggctggatccggcaagttctttgtggggggcaactggaagtgcaatggaacaaaggactccattagcaagcttgtatctgaattgaatgctgctacactcgaaactgatgtagatgttgtggtggcacctccattcccttatattgaccaggtcaagaattcactaactggtcgtattgaggtttctgctcagaatgtatggatcggaaaaggaggagcctacactggagagatcagtgcagaacaattggtggacataggctgtcaatgggtaattcttgggcactctgagcgtagaaatattattggtgaaactgatgagtttatcgggaagaaggctgcatatgcattgagccaaaatgttaaggttattgcctgcataggagagctgttggaagagagggaagcagggaaaactttcgatgtatgttttaagcagatgaaggcttatgcagatagtatttcaaactgggccgatgttgtaattgcatacgagcctgtttgggcaattggaactggaaaagttgctactcctgaacaagcccaggaagttcatgctgccatacgcgattggttgaagaccaatgtatcacctgatgttgcctctagcattcgaataatttatggaggttctgtaaatgctgccaattgtgcggagcttgcaaagaaagaagatattgatggttttcttgttggtggtgcctctttgaagggcccggacttcaccaccattatcaactcagtgacttccaagaaagttgcagcctgatgcattcggttagaaataagtgattgcaagagaggcagctcggtttttgctgtaccataggccttgtgggaggtgctctgtgtgatggtgtgcagtcacctcctccgtctggtttagctgatttgtagcacgaaaataaaaaaataatgcagatccaaccatcttttttgtcgttgacttgttgtagcccttgtgtacttgaagggagctgtacgtgagtggtcagtaaaacacgtgaaataataatgagaaaatttcttctttgacactccc

SEQ ID NO: 10589 - protein, 303 aa, Panicum virgatum
  misc_feature: Ceres CLONE 1724901
  misc_feature (54)..(293): Pfam Name: TIM Pfam Description: Triosephosphate isomerase
  misc_feature: SWISSPROT Homolog: EC 5.3.1.1 Triose-phosphate isomerase
  misc_feature: Functional homolog of the protein sequence given in SEQ ID NO 50215
  misc_feature: Useful for making plants with modulated biomass
MAAAPGSLACSSRLSRLADLRRTPAAPAAPQQVHLGCSRRRAQRTVAMAGSGKFFVGGNWKCNGTKDSISKLVSELNAATLETDVDVVVAPPFPYIDQVKNSLTGRIEVSAQNVWIGKGGAYTGEISAEQLVDIGCQWVILGHSERRNIIGETDEFIGKKAAYALSQNVKVIACIGELLEEREAGKTFDVCFKQMKAYADSISNWADVVIAYEPVWAIGTGKVATPEQAQEVHAAIRDWLKTNVSPDVASSIRIIYGGSVNAANCAELAKKEDIDGFLVGGASLKGPDFTTIINSVTSKKVAA

SEQ ID NO: 10590 - DNA, 241 bp, Panicum virgatum
  misc_feature: Ceres CLONE 1724903
  misc_feature: Encodes the peptide sequence at SEQ ID NO. 10591
tggggccacggaaagccgctcaagtgccccgacctgaacctggacctctgcatcagcccgccgtgccaggaggagcccctgaagccggtgaagcgggaggccgggctctgcttcagctgcagcctggggctccccaagagcgccgagtgcaagtgcagcagcttcctggggctccggaccgccatgctcgacttcagaagcctcgagatgaaatgaaatgaacctatctgttcctccctcc

SEQ ID NO: 10591 - protein, 71 aa, Panicum virgatum
  misc_feature: Ceres CLONE 1724903
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1004 in the 11/435,388 US patent application
  misc_feature: The sequence is a functional homolog of SEQ ID NO 1073 in the 10/374,780 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
WGHGKPLKCPDLNLDLCISPPCQEEPLKPVKREAGLCFSCSLGLPKSAECKCSSFLGLRTAMLDFRSLEMK

SEQ ID NO: 10592 - DNA, 1310 bp, Panicum virgatum
  misc_feature: Ceres CLONE 1724914
  misc_feature: Encodes the peptide sequence at SEQ ID NO. 10593
tcctctaactccgcatccaagtttctcaaaaaaaaaaaaaaaactccgcatccaccaaagcggccgcgctctgtcgctggcctcgagagctcagcaccctctcaccccgccgccgccgccgccgcgccgcgaacatgaaggccatcgggagcggcggggagtggtggtggaacctaccatctctccgccgcaagtcggactcccgccgccgcggccgccgcaacaccgacccccgcggccgacgccgcggtgccccgcgggagccgcgctcgtcgtcgtcctcggagtccatcggccggagcagcggctggcccgtagagttccccttcaggcaggcgctcactgccgcctctctcaccttcaccggggacaccatcgcgcaggtccgcggccgcatcgtcgaccgccgaagacgcggcaccgatcccgacagcaaggaactcataccagacatattgctgaatcatgattggcttcgtggatttcgtttggcttcttatggattccttctttatggcccaggatcctatgcatggtatcagtttcttgatcggtgtatgcccaagcagtcatttgtaaatttgtcagttaaggtcatactgaaccagattgtgcttggtccttgtgttattgctgtagtttttgcttggaacaacttatggttagggaaattatcagagctgccatctaaatatcagaatgatgcgcttcctacacttctatatgggtttaagttttggattcctgtatcaattgtcaactttgggatgattcctttgccagctcgtgttgcctttatgtcctcttgttccattttttggaacttttatctatcgactgctatgaacaaatgaatcttattgttcatcaggatatgtatgagccccgttcatcatgttatctacccccaataataaatttatgctccggttattggttatatccatccaacagagaagaatgtgaaggagatagttttgacaggcataacagtaatgtgaggtttcctccccttgaacagttccggtgcatcagcataaggtcgctgtaaaacttattcaagatgttgacgagcataacatcaatggaggacgtgaagttttgtctgatcatgtatgaagcacctggctccagtatgacttcaaaactcaaaaggcgttcaatttattattttggatatgtgctgcattagctcactccaatgacaatggcatattgacagtcatctctgaacagagatgcaggtgtattagttatgctatgagaatttgtgaattcagtgccggatgttgtatctgaaattccatctc

SEQ ID NO: 10593 - protein, 239 aa, Panicum virgatum
  misc_feature: Ceres CLONE 1724914
  misc_feature (174)..(239): Pfam Name: Mpv17_PMP22 Pfam Description: Mpv17 / PMP22 family
MKAIGSGGEWWWNLPSLRRKSDSRRRGRRNTDPRGRRRGAPREPRSSSSSESIGRSSGWPVEFPFRQALTAASLTFTGDTIAQVRGRIVDRRRRGTDPDSKELIPDILLNHDWLRGFRLASYGFLLYGPGSYAWYQFLDRCMPKQSFVNLSVKVILNQIVLGPCVIAVVFAWNNLWLGKLSELPSKYQNDALPTLLYGFKFWIPVSIVNFGMIPLPARVAFMSSCSIFWNFYLSTAMNK

SEQ ID NO: 10594 - DNA, 1328 bp, Panicum virgatum
  misc_feature: Ceres CLONE 1724921
  misc_feature: Encodes the peptide sequence at SEQ ID NO. 10595
gagtgtgagctgctttctgtcaaatcattctcgcttcatgttcctcacgatccccgaaacctcctcgcgagcatcgaccatgtctgcctactgcggaaaatacaaggatgagctcatcaagaatgctgcctacattggcacccctggaaagggtatccttgcagctgatgagtccactggcaccattggcaagcgtctttccagcatcaacgttgagaacatcgaggagaaccgccgtgccctccgtgagctcctgttctgctgccctggtgcccttcagtacataagtggtgtgatcctcttcgaggagaccctgtaccagaagaccaaggatggcaagcccttcgttgatgtcctcaaggagggaagcgttctccctggcatcaaggtcgacaagggcaccattgaggttgctggcactgacaaggagaccaccacccagggccatgatgaccttggcaagcgctgtgccaagtactacgaggccggtgcccgctttgccaagtggcgcgctgtcctcaagattggccccaacgagccatcgcagcttgccattgacctgaatgctcagggtcttgctcgctatgccatcatctgccaggagaatggtctggttccgattgtggagcctgagatcctcatcgatggccctcatgacattgagcgctgcgcttacgtcactgaggtggtccttgctgcctgctacaaggctctcaacgagcaccatgtcctcctcgagggtaccctcctgaagcccaacatggtgacccctggctccgactccaagaaggtgactcctgaggtcattgctgagtacaccgtccgcaccctccagaggactgttcctgctgccgtgcccgccgtcgtcttcctctctggtggacagagtgaggaggaggccaccctgaacctgaatgccatgaacaagctcaacaccaagaagccgtggtccctgtccttctccttcggccgtgccctccaggcaagcaccctcaaggcctgggctggcaaggaggataacgtggagaaggctagggcagccttcctcgccaggtgcaaggctaactctgaggctaccctcggcacatacaagggtgacgctgctgccggcgagggtgtctctgagagcctccacgtgaaggactacaagtactgatctgcctcttcttgcgtaccgtctttggacctgtctgcctacgagcatttaggttgctgagtgttcatttgctccttagagcatatatgcggacgtccctgaactttgagcttctcttatgtggaggagggtttgttcccctcacatttatatttttgtatattaaatactc

SEQ ID NO: 10595 - protein, 358 aa, Panicum virgatum
  misc_feature: Ceres CLONE 1724921
  misc_feature (11)..(358): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature: Functional homolog of the protein sequence given in SEQ ID NO 50216
  misc_feature: Useful for making plants with modulated phosphate use efficiency
  misc_feature: Functional homolog of the protein sequence given in SEQ ID NO 50217
  misc_feature: Useful for making plants with modulated biomass
MSAYCGKYKDELIKNAAYIGTPGKGILAADESTGTIGKRLSSINVENIEENRRALRELLFCCPGALQYISGVILFEETLYQKTKDGKPFVDVLKEGSVLPGIKVDKGTIEVAGTDKETTTQGHDDLGKRCAKYYEAGARFAKWRAVLKIGPNEPSQLAIDLNAQGLARYAIICQENGLVPIVEPEILIDGPHDIERCAYVTEVVLAACYKALNEHHVLLEGTLLKPNMVTPGSDSKKVTPEVIAEYTVRTLQRTVPAAVPAVVFLSGGQSEEEATLNLNAMNKLNTKKPWSLSFSFGRALQASTLKAWAGKEDNVEKARAAFLARCKANSEATLGTYKGDAAAGEGVSESLHVKDYKY

SEQ ID NO: 10596 - DNA, 1151 bp, Panicum virgatum
  misc_feature: Ceres CLONE 1724922
  misc_feature: Encodes the peptide sequence at SEQ ID NO. 10597
atctctcccacatccaggctgacgcccgcccggtacgagaaagaggatgaccatcccctccagccggcggcgccaaaaagcagctacccacccccgacccgcaacggtgggtaggggattgaagaaacatctgaagaggctcagtgccccgaagcattggatgttggacaaacttggtggagcttttgcccccaaaccatcttctggtcctcacaagtccagggagtgccttcccctcatcctcatcatcaggaacaggctcaagtatgctctgacttaccgtgaggttatttctatcctgatgcaacgccatgtcttggttgatggcaaggtcaggactgacaagacctacccagcagggttcatggatgtcatttctattcccaagaccaatgagaactacagacttctgtacgacactaagggtcgcttccgtcttcaccccatcagggatgaggatgccaagttcaagctctgcaaggttaggtctgttcagtttggccagaagggcattccctacctgaacacttatgatggtcgcaccatccgctaccctgacccactcatcaaggccaacgacaccatcaagatcgaccttgagaccaacaagattgttgacttcatcaagtttgatgttggcaacgttgtcatggtgactggtggaaggaacactgggcgtgttggtgtgatcaaaaacagggagaagcataagggcagcttcgagaccatccatgttgaggatgccctaggccaccagtttgccacccgtctgggcaatgtgttcaccatcggcaagggcaacaagccgtgggtgagcctgcccaagggcaagggtatcaagctcagcatcatcgaggagcagcggaagcgggatgccgctgcccaggctgctgccaacgcataaaatcctcagaatgtgctttgagttttgctatagcgagtttatctgcaaggatatagaactacccagactatcctgttttaagttttgccctatggttgttgattcgcgaactgatgtttgcagttagctgtaatgggagtatttacttattgaagtgcgttttcgagaacactgtctttcgtgttgtgtgaaccaaggccaattgtgaatggccgtgcgatcgaacctgctccacatttgaacaccg

SEQ ID NO: 10597 - protein, 247 aa, Panicum virgatum
  misc_feature: Ceres CLONE 1724922
  misc_feature (76)..(152): Pfam Name: Ribosomal_S4e Pfam Description: Ribosomal family S4e
  misc_feature (159)..(193): Pfam Name: KOW Pfam Description: KOW motif
  misc_feature (24)..(72): Pfam Name: S4 Pfam Description: S4 domain
MLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDAKFKLCKVRSVQFGQKGIPYLNTYDGRTIRYPDPLIKANDTIKIDLETNKIVDFIKFDVGNVVMVTGGRNTGRVGVIKNREKHKGSFETIHVEDALGHQFATRLGNVFTIGKGNKPWVSLPKGKGIKLSIIEEQRKRDAAAQAAANA

SEQ ID NO: 10598 - DNA, 690 bp, Panicum virgatum
  misc_feature: Ceres CLONE 1724923
  misc_feature: Encodes the peptide sequence at SEQ ID NO. 10599
gcgcaaatcctcttcctcgagttctcgtcaaccaaattcaaagtggcagatggagaaactctcggcgatgtctggccccggcaagggcgggaagggtgtgggcgaggggggtgccgatacccgccgcgaggaggctgcagcggtgcgggctgctcccgtgcctccgcggagacagcggcgaggcgggccggctggacccccgcgtcgcggacgagccgggcgccggcgcgtcgtccgccgcgccggccagcaagggcggcggcggggatgccaggcggttcgcgtgggccgagatcgagtccgtcacggcgggcttctcgtcccgcgtcatcggccagggcggcttcagcaccgtgtacctcgcctgcctctcctcctcccgcctcggcgccgtcaaggtgcagcgcagcagcgagcgcctccaccgcgccttccgccaggagctcggcgtgctcctctcgctccgccacccgcacgtcgtgcgcctgctcggctactgcgacgaacgagaggaaggcgtcttggtgttcgagtacgccccgaacggcgacctccacgggaggctccacggccgcggcaagccggcgctcccgtgggcgcgccgcatggcgatcgcgttccaggtcgccatggcgctggagcacctccacgaggcccgcgacccgcccgtgatccacggcgacatcaagg

SEQ ID NO: 10599 - protein, 229 aa, Panicum virgatum
  misc_feature: Ceres CLONE 1724923
  misc_feature (101)..(228): Pfam Name: Pkinase_Tyr Pfam Description: Protein tyrosine kinase
  misc_feature: SWISSPROT Homolog: EC 2.7.11.1 Non-specific serine/threonine protein kinase
ANPLPRVLVNQIQSGRWRNSRRCLAPARAGRVWARGVPIPAARRLQRCGLLPCLRGDSGEAGRLDPRVADEPGAGASSAAPASKGGGGDARRFAWAEIESVTAGFSSRVIGQGGFSTVYLACLSSSRLGAVKVQRSSERLHRAFRQELGVLLSLRHPHVVRLLGYCDEREEGVLVFEYAPNGDLHGRLHGRGKPALPWARRMAIAFQVAMALEHLHEARDPPVIHGDIK

SEQ ID NO: 10600 - DNA, 540 bp, Panicum virgatum
  misc_feature: Ceres CLONE 1724923-R
  misc_feature: Encodes the peptide sequence at SEQ ID NO. 10601
cggcgtccagggcgtccgcgcgccccgtcatgggctccccgggctacgtcgacccgcacttcctccgctccggcgtcgccaccaagaagagcgacgtctacagctacggcgtcctgctgctcgagctcctgaccgggcgggaggtcatctgcgccgacacggggtgccggctcaccgccgccgtggggcccacgctcagcgaagggaaagtggccgacgtggtggaccggaggctaggagacgagtacgacgcccacgagaccgcgaccgcggcggcgctcgcgctgcggtgcgtcagcgacggccccgggctccggccgtccatggcggaggtggtgcgcgagctccaggagaagatgacggcgctgatctccgccgccgggagcaaaccggccggcaaggcggctttgtgagctgtacgaggcagagaatgtaaatcccagtagcgtggttgagggatggcatattgttagtttctagtcctttgagtcgtaatatctcgtaacctgtcatcaatggaatgtcctcgtttcaagcccc

SEQ ID NO: 10601 - protein, 136 aa, Panicum virgatum
  misc_feature: Ceres CLONE 1724923-R
  misc_feature: SWISSPROT Homolog: EC 2.7.11.1 Non-specific serine/threonine protein kinase
ASRASARPVMGSPGYVDPHFLRSGVATKKSDVYSYGVLLLELLTGREVICADTGCRLTAAVGPTLSEGKVADVVDRRLGDEYDAHETATAAALALRCVSDGPGLRPSMAEVVRELQEKMTALISAAGSKPAGKAAL

SEQ ID NO: 10602 - DNA, 1005 bp, Panicum virgatum
  misc_feature: Ceres CLONE 1724932
  misc_feature: Encodes the peptide sequence at SEQ ID NO. 10603
acccaccgccgccgccgccgccgccgacacatccggagcaccttgactgcttgagcgtagtttaggagagaggattcgaggagtgatgtcaacagaggaggctgccgctgcggcgaccgaggtccccgcgaccgaggtcgagtccgaggcgccggccgccgaggaggcggaggcgaagcccgccaaggccaagaaggcggcgcccaaggagaagaaggcccccaaggagaagaaggcggccaaggagaagaagcccaccgcggcgaggaagccggccgcccacccgccgtacgccgagatgatctcggaggcgattgcggcgctcaaggagaggaccgggtcgagctcggtggccatcggcaagtacgtggaggagaagcacggcgggcagctgccgcccaacttccgcaagctgctggccgggcagctcaagaagctcgccgccgcggggaagctgacccgcgtcaagaactcgttcaagctgccggccgccgccgacgccaagtccaaggcgcccaagcccgccgccgcggccaagccgaagccagccaaggccgccaagcccgccatcaagcccaaggcgtccccgaaggcgaagaccaagaccgccgccaagcccaaggcggccgccgcctcccccaagcgcaaggccaaggccgccgccgcccccgccgcggcgcccaagccccgcggccgcccgcccaaggccgccaagaccgacgccaaggcctcccccgccaaggccgccgccaagaaggcgaagcccgccgccgccaccgccaagaaggagaagaaggccgcggcgacggccaagaaggccgccgcgaagcccaagaaggccgccgcatccccggccaggaagggcgcggcgaggaaggccaagaagtagacccccccctccctcccggccgtgctcgccgccggcgaccccgccatcccgcctatagatgttccccctccatctggattttgcaatccattcgtcgtagctttgtctgaaaatgg

SEQ ID NO: 10603 - protein, 267 aa, Panicum virgatum
  misc_feature: Ceres CLONE 1724932
  misc_feature (65)..(135): Pfam Name: Linker_histone Pfam Description: linker histone H1 and H5 family
MSTEEAAAAATEVPATEVESEAPAAEEAEAKPAKAKKAAPKEKKAPKEKKAAKEKKPTAARKPAAHPPYAEMISEAIAALKERTGSSSVAIGKYVEEKHGGQLPPNFRKLLAGQLKKLAAAGKLTRVKNSFKLPAAADAKSKAPKPAAAAKPKPAKAAKPAIKPKASPKAKTKTAAKPKAAAASPKRKAKAAAAPAAAPKPRGRPPKAAKTDAKASPAKAAAKKAKPAAATAKKEKKAAATAKKAAAKPKKAAASPARKGAARKAKK

SEQ ID NO: 10604 - DNA, 1144 bp, Panicum virgatum
  misc_feature: Ceres CLONE 1724935
  misc_feature: Encodes the peptide sequence at SEQ ID NO. 10605
aagcgacgacgactggggagtggcgccgcccttcgccggccgacgaggcaagagcctgcagtcgacacaacacagaagagggatttgggcgttgcttggtttcagcccatttggaagatgcctccccacaagatcgaaactgggcaccaggacgtggtgcacgatgtcgccatggattactacggtaagcgcattgcgacagcctcctcggacaacaccataaagatcgtcggcctcagtggcacctcgcaccagcagctggccaccctgactgggcaccaggggccggtctggcaagtcgcgtgggctcaccccaagtttggctcattgctggcctcctgtggctacgacggccgtgtgatcatatggaaggaaggggccaaacctgatgaatggattcaggcgcatactttcactgagcacaagtcctctgtcaactccattgcgtgggcacctcatgagcttgggctctgcttggcttgcggctcatcccacgggaacatttcagtattcacagctcgtgctgatggagtttgggacaccacacgcattgatcaggcgcatccagttggcgtaacttcagtttcttgggccccagcaatggctcctggtgctctgatcactgctggagcttctggccagtttgagtatgttcagaagcttgcatctggtggctgcgacaacacagtcaaagtctggaagctgcaaaatggaaattggaggatgaattgtttccctgccctgcagattcacaaggactgggtgagggacgtggcctgggctccaaaccttggcttaccgaagtctaccattgccagcgcgtctcaggatggaactgttgtgatctggactgaggcgaaggaaggtgagcaatgggtaggcaggattttgcatgacttcaaaacccctgtgtggaggctgtcgtggtcacttaccgggaatattttggctgcttctgatggcaataacaatgtgaccttgtggaaggaagctgttgatggtgaatggcagcaagtgacgactgttgagccataggtgtttggagctcggtgttgccagtaatatatttttttgttaactccagtaatgttgagattgttatctaatttttctgtatggtggtttccaagatttcggcatcact

SEQ ID NO: 10605 - protein, 305 aa, Panicum virgatum
  misc_feature: Ceres CLONE 1724935
  misc_feature (45)..(85): Pfam Name: WD40 Pfam Description: WD domain, G-beta repeat
  misc_feature (140)..(195): Pfam Name: WD40 Pfam Description: WD domain, G-beta repeat
  misc_feature (203)..(245): Pfam Name: WD40 Pfam Description: WD domain, G-beta repeat
  misc_feature (93)..(133): Pfam Name: WD40 Pfam Description: WD domain, G-beta repeat
  misc_feature (1)..(39): Pfam Name: WD40 Pfam Description: WD domain, G-beta repeat
  misc_feature: SWISSPROT Homolog: EC 2.3.1.48 Histone acetyltransferase
MPPHKIETGHQDVVHDVAMDYYGKRIATASSDNTIKIVGLSGTSHQQLATLTGHQGPVWQVAWAHPKFGSLLASCGYDGRVIIWKEGAKPDEWIQAHTFTEHKSSVNSIAWAPHELGLCLACGSSHGNISVFTARADGVWDTTRIDQAHPVGVTSVSWAPAMAPGALITAGASGQFEYVQKLASGGCDNTVKVWKLQNGNWRMNCFPALQIHKDWVRDVAWAPNLGLPKSTIASASQDGTVVIWTEAKEGEQWVGRILHDFKTPVWRLSWSLTGNILAASDGNNNVTLWKEAVDGEWQQVTTVEP

SEQ ID NO: 10606 - DNA, 1013 bp, Panicum virgatum
  misc_feature: Ceres CLONE 1724937
  misc_feature: Encodes the peptide sequence at SEQ ID NO. 10607
agccaagccaccacctgactcctctcgtcttcaccagcccggagccagccaccaccccaacgaaccaggcagggatccacccgcctagggtttcctccaatccgcgccaaggaagatgactacggcggcgcgcccgacctgggcgccggccaagggcggcaacgagcaggggggcacccgcatcttcggcccctcccagaagttctcctcccgcgacctcgccgcccacacctccctcaagcccaggaaagagggccagcagacccaagaggagttacagaagaggaacctcagggaggaacttgaggaacgtgaacgcaagcactactcttccaaggataagtcctatgccgaagagagagaccggcggaaaagccttctcttagaaggttcaaagagagatgctgaggataagatagttccacgagaaatcgatgcagatgactctgatgtggagcctaaaagtgacgacgaaagtgatgaggatgaagatgacgacgacgatgacacggaagcactaatggcagagctcgagaggattaagaaagaaagagctgaggagaagcttagaaaggagcgccaacaagcagaagaggaggccaagatgaaggaggctgaactgatgcggggaaaccctttgatcaatattaacaatccgggctccttcagcgttaagagaaggtgggatgatgatgtggtattcaagaaccagacacgtggagagaccaagactccaaaacggttcatcaatgacaccatcagaagtgatttccaccgcaaatttctgcagaggtacatgaagtgaggcttgtgctgtgtatggttgaacatgcccctggcgggtatgtgagggccttgtttcggggctcatcatcttgtgatagatgtttgtgtatgagcgagagaccattgtgctgtatgaaataacatgccctttaaagatgtgctttgcctccagactccagattgaaatgattagtgatacataaacccttttcctgacggggaaaggt

SEQ ID NO: 10607 - protein, 229 aa, Panicum virgatum
  misc_feature: Ceres CLONE 1724937
  misc_feature (1)..(229): Pfam Name: Cwf_Cwc_15 Pfam Description: Cwf15/Cwc15 cell cycle control protein
MTTAARPTWAPAKGGNEQGGTRIFGPSQKFSSRDLAAHTSLKPRKEGQQTQEELQKRNLREELEERERKHYSSKDKSYAEERDRRKSLLLEGSKRDAEDKIVPREIDADDSDVEPKSDDESDEDEDDDDDDTEALMAELERIKKERAEEKLRKERQQAEEEAKMKEAELMRGNPLININNPGSFSVKRRWDDDVVFKNQTRGETKTPKRFINDTIRSDFHRKFLQRYMK

SEQ ID NO: 10608 - DNA, 1049 bp, Panicum virgatum
  misc_feature: Ceres CLONE 1724938
  misc_feature: Encodes the peptide sequence at SEQ ID NO. 10609
ctccgcgtcttccctctccccagcttgtcagcagccgccgcgcgctgctccctcttctccccttcggcgccgtcatcgcctccgcggccgccagatcgcttgtgaaactatcttgtggggagatggcggtttctttcgctaacgtcaactctgaggcagggcttaaaaagcttgacgagtaccttctcactcgcagctacatcactggttaccaagcttccaaggatgacttggctgtctactcctcattttctgctgctccctcatccaagtatatcaatgtcacaaggtggttcagtcacattgatgcactcttgaggctgagtggagttactgcagagggccaaggtgtcaaggttgagtcatctgctggtccatcagcatcaacgcctgatgttgccgacacagcggctgcacctgctgctgacgacgacgatgatgatgttgacctttttggtgaggagaccgaagaggagaagaaggctgctgaagagcgtgctgcagctgtcaaggcatcgggcaagaagaaagaatctgggaagtcgtcagttttgcttgatgtgaaaccatgggatgatgagactgacatggccaagcttgaggaagcagtaaggaatgtcaagatggaaggactgctctggggagcatccaagcttgtcccagttgggtatggcatcaagaagcttcagatcatgttgactattgttgatgaccttgtttctgttgacactctgatcgaggaccatctgtgcgctgagccagtgaacgagcacgtccagagctgtgacattgttgccttcaacaagatctaaatctgctgggcgcaggctgtggtcagtggacactgcaccgatccaaaatatcctgagttttgcatgtggactagttatgtctgttccgtgtgtcgactagttattgcctgtgaggtttttggaacctagtcaaaagtgtaccagttctgttaccagggttaatttgcattatttgaaagaccgactggctggattttctgtttcttctattcgtaatatactctctctttcctggtt

SEQ ID NO: 10609 - protein, 229 aa, Panicum virgatum
  misc_feature: Ceres CLONE 1724938
  misc_feature (140)..(229): Pfam Name: EF1_GNE Pfam Description: EF-1 guanine nucleotide exchange domain
  misc_feature: SWISSPROT Homolog: EC 6.1.1.16 Cysteine--tRNA ligase
MAVSFANVNSEAGLKKLDEYLLTRSYITGYQASKDDLAVYSSFSAAPSSKYINVTRWFSHIDALLRLSGVTAEGQGVKVESSAGPSASTPDVADTAAAPAADDDDDDVDLFGEETEEEKKAAEERAAAVKASGKKKESGKSSVLLDVKPWDDETDMAKLEEAVRNVKMEGLLWGASKLVPVGYGIKKLQIMLTIVDDLVSVDTLIEDHLCAEPVNEHVQSCDIVAFNKI

SEQ ID NO: 10610 - DNA, 1230 bp, Panicum virgatum
  misc_feature: Ceres CLONE 1724940
  misc_feature: Encodes the peptide sequence at SEQ ID NO. 10611
attcgttccatcggccggcggcttaaaccctaggctcctccatcgccgcatcttctccgccgccgccttcgccttcgacgccgatggagttctggggtcttgaagtcaagcctggaaccactgttaagtgtgatcctagcgatggctacatccttcatctttcccaggctgctcttggggaatcaaagaaaagcgacacagcattgatgtatgtcaaagttgatgatcagaagctggccattggtaccctctcacatgacaagtaccctcacatcccgtttgatttggtctttgacaaagagtttgagctgtcacacacatcaaaagctgccagtgtgttcttctccggttacaaggtcgagcaacctggtgtggaagatgaaatggattttgattctgaagaagatgaagatgtaggggaagagcagaacattcctttaatcaaggaaaatggcaaagctcaagggaaggaggagcagaaaagcaaggcagggcctgcggcttcaaattcaagtgctgctgtaaaggatgttgacaagaaaatcaaggctgatgatgacagtgatgaggatgaaactgatgatgattctgatgacgatgatctatctcctgaagaggaaggcaacgatgatgattcaagtgatgagggtgattccagtgaggaggatgagaacagtgaggatgatgaggaagaagaaactccaactcccaagaagccagaggtaggcaagaagagagcagcggaaaatgctctgaagacacctgtttctgataagaaagcgaaagttgccacgccatctggccagaagacaggtggtaacaagggcactgcccacgtgccaactccgcacccagcaaagaaggtgagcaagacccctgcgaacaatgacaagtcaaaggagaagtccccaaaatctggtgggtcggtcgtgtgcaagtcgtgcagcaagacgttcaacagcgacatggctctacaggctcactcgaaggccaagcatggtgcaaagtgagggactctctgctggttgggattggtgcctttttagagttggggaagaaatggcggtagtaggccttattttgtcacgatacgtgccttagtggttgttatgtgattggtgcgtttcgtggagactcaaaatgcagcagaacaagctgccgtgaactagtattttgggttgttcggatggtagttttgggaatcgttgaatctaccttgatgctgtgctc

SEQ ID NO: 10611 - protein, 308 aa, Panicum virgatum
  misc_feature: Ceres CLONE 1724940
  misc_feature: Functional homolog of the protein sequence given in SEQ ID NO 50218
  misc_feature: Useful for making plants with altered lignin content
  misc_feature: Useful for making plants with modulated drought sensitivity
MEFWGLEVKPGTTVKCDPSDGYILHLSQAALGESKKSDTALMYVKVDDQKLAIGTLSHDKYPHIPFDLVFDKEFELSHTSKAASVFFSGYKVEQPGVEDEMDFDSEEDEDVGEEQNIPLIKENGKAQGKEEQKSKAGPAASNSSAAVKDVDKKIKADDDSDEDETDDDSDDDDLSPEEEGNDDDSSDEGDSSEEDENSEDDEEEETPTPKKPEVGKKRAAENALKTPVSDKKAKVATPSGQKTGGNKGTAHVPTPHPAKKVSKTPANNDKSKEKSPKSGGSVVCKSCSKTFNSDMALQAHSKAKHGAK

SEQ ID NO: 10612 - DNA, 1264 bp, Panicum virgatum
  misc_feature: Ceres CLONE 1724945
  misc_feature: Encodes the peptide sequence at SEQ ID NO. 10613
aggcggcaagctccccagcaactgtccgatgcaggagagcgtacgcgtaacgacggtaatggcagcgtcactccaagccgcggccaccctgatgcagccggccaagatcagcggccgcgcctccgcctcgctgccgtcccgtcagccgtcccacgtcgccagggcgttcggcgtcgacaccggcgcggccaggatcacgtgctccctgcagtccgacatcagggaggtcgcgagcaagtgcgtcgacgccgccaagctcgccggcttcgcgctcgccacctcggcgctcctcgtctccggcgcgagcgcggagggcacgcccaggaggctgacctacgacgagatccagagtaagacgtacatggaggtgaaggggaccggcacggcgaaccagtgcccgaccatcgacggcggtgtcgagtccttcccgttcaagcccggcaagtaccagatgaagaagttctgcctggaaccgacgtccttcaccgtcaaggccgacggcatcgccaagaacgcgccgcccgagttccagaagaccaagctcatgacccgcctcacctacacgctcgacgagatcgagggcccgctcgaggtcggctccgacggcgccctcaagttcgaggagaaggacggcatcgactacgccgccgtcaccgtgcagctcccgggaggcgagcgcgtgcccttcctcttcaccgtcaagcagctcgtcgccaccggcaagcccgagagcttcggcgggcccttcctcgtgccgagctaccgtggctcttccttcctcgaccccaagggccgtggtggctccaccgggtacgacaacgccgtggcgctccccgccggaggcagaggagacgaggaggagctcgtgaaggagaacatcaagaacgccgcatcgtcgacgggcaacatcacattgagcgtgaccaagagcaatccggagaccggcgaggtcatcggcgtcttcgagagcgtgcagccgtcggacaccgacctcggggccaaggcgcccaaggatgtgaagatccaggggatctggtacgcgcagctcgaatcttagacgacgcgaccgtgatccatgggcaagtgtacgatggggaacttttgagagcaaaggaggcggcattgtgtacctactaatgcaaatatatattggctgtcgatttttatttttagcatgcgtttcttctttttagtgttcacatgaactcccatgcaatgcaagctatacaattattcaagaatcgagagatccccgggtcgtagc

SEQ ID NO: 10613 - protein, 332 aa, Panicum virgatum
  misc_feature: Ceres CLONE 1724945
  misc_feature (95)..(331): Pfam Name: MSP Pfam Description: Manganese-stabilising protein / photosystem II polypeptide
MAASLQAAATLMQPAKISGRASASLPSRQPSHVARAFGVDTGAARITCSLQSDIREVASKCVDAAKLAGFALATSALLVSGASAEGTPRRLTYDEIQSKTYMEVKGTGTANQCPTIDGGVESFPFKPGKYQMKKFCLEPTSFTVKADGIAKNAPPEFQKTKLMTRLTYTLDEIEGPLEVGSDGALKFEEKDGIDYAAVTVQLPGGERVPFLFTVKQLVATGKPESFGGPFLVPSYRGSSFLDPKGRGGSTGYDNAVALPAGGRGDEEELVKENIKNAASSTGNITLSVTKSNPETGEVIGVFESVQPSDTDLGAKAPKDVKIQGIWYAQLES

SEQ ID NO: 10614 - DNA, 867 bp, Panicum virgatum
  misc_feature: Ceres CLONE 1724946
  misc_feature: Encodes the peptide sequence at SEQ ID NO. 10615
acacagcaaaaaagtgagaaaagtgaagcaaaacaacaaacaagcgagatcacccgtgacactgcagcgagcctctccgtccatctccggttctccacctcacctgggcacgcaagcttcgatggcagccacggtgatggcctccatgagctccctcgccttcaccaccgccggcgcgcgtgccggcgccctccccgtccgcgtcccggcggccgctgcgctcgcgccgcggcggcgcgccatggtcgtcagggcccaggccgaggacgccgagccagcagctgaggagacaaccgcggcgccctccactcccctgacggcgaagcccaaggcggcggcggcgaggcccgggctgtgggacgcactggcgttcagcgggccggcccccgagcgcatcaacgggcggctcgccatggtgggcttcgtgtccgcgctcgccgtcgaggcgtcccgcggcgggggcctcctctcgcaggccgggagcgggtcagggctcgcctggttcgcggccacggccgccgtgctctccgtggcgtcgctggtgccgctcctcaagggggagagcgccgagggccggagcggcggcgtcatgagcgccgacgccgaactctggaacggacgcttcgccatgctcgggctcgtcgcgctcgccgtcaccgagtacatcaccggcgcgcccttcgtcaacgtgtaaatacgggcgcacgcaattgtacggggctacgggcacgtgtagcagtgtagtagagagggtagtgtaaacctttggctaggacactctgcgcaggactcctttgtaaaacacttccgtttaaacggtcatgtaaaattgttgatctgaaatgagtaaatgactttatttgcgac

SEQ ID NO: 10615 - protein, 190 aa, Panicum virgatum
  misc_feature: Ceres CLONE 1724946
  misc_feature (64)..(181): Pfam Name: Chloroa_b-bind Pfam Description: Chlorophyll A-B binding protein
  misc_feature: SWISSPROT Homolog: EC 4.99.1.1 Ferrochelatase
MAATVMASMSSLAFTTAGARAGALPVRVPAAAALAPRRRAMVVRAQAEDAEPAAEETTAAPSTPLTAKPKAAAARPGLWDALAFSGPAPERINGRLAMVGFVSALAVEASRGGGLLSQAGSGSGLAWFAATAAVLSVASLVPLLKGESAEGRSGGVMSADAELWNGRFAMLGLVALAVTEYITGAPFVNV

SEQ ID NO: 10616 - DNA, 1278 bp, Panicum virgatum
  misc_feature: Ceres CLONE 1724975
  misc_feature: Encodes the peptide sequence at SEQ ID NO. 10617
agaggggacacgcaagcgagggtggtgccgccggcgcgagatcgagggatcccaatatcccatcccccgccgacgcgacgctgttcgagggccgagcggaattcgtcgccgccggagccggagccgagggagcccgagatggtgaactcgttcttcgtgttctgcgggtgcgtggaccaggccagcgtggcggtggtggagaagtgggggcgcttcgtccgcctcgccgagccgggcctccacttcttcaaccccttcgccggggagtgcgtcgcggggtccctcaccacccgcgtccagtccctcgacgtccgcgtcgagaccaagaccaaggataatgtcttcgtccagctgatttgcaccattcaatatcgtgttgtcaaggaaaatgctgatgatgcattctatgagttgcagaatccccaacagcaaattcaggcttacgtctttgatgttgttcgggccatagttccaagaatgaatctggatgatcttttcgagcaaaagaatgatgtggcgaaatctgtactggaggagcttgaaaaggtgatggcagattatggttacagcattgagcacattctcatgattgatatcattcctgacgctgctgtgcgcaaagcaatgaatgagataaatgcagcccaaaggcttcagctggcaagcgtctacaaaggagaagcagagaaggttctcttggtgaagaaggcggaagcagaagcagaggcaaaatatctctccggtgtcggcattgccaagcagcggcaagctataaccgacggcctcagggagaacatcctgaacttctcgcactcggtgtcgggcaccagcgccaaagaagtcatggacctgatcatggtcacacagtactttgacaccatcaaggagctcggggacggctcgaagaacaccacggtgttcatcccccacggcccgggccacgtgaaagacatcagcgagcagatccgggacggcatgatgcaggcctcgagcagcaacgtgtagaccactcgttgacgtgggcacacacggctggggacgcctcagctcgggctgagcctcaggctaatctgtttatagtattagatcgttagtggtaaataacgagtgctaggactttcggcttgtcacctggagttgtatgcggtcctgaaactagtgtggatgaattttcgtatgagataatgtccaggccgtacgtgtttttgcatgttctttctagctatgacaagttatatactgatctggccttttagacaatgtatagcgcttcagttg

SEQ ID NO: 10617 - protein, 288 aa, Panicum virgatum
  misc_feature: Ceres CLONE 1724975
  misc_feature (10)..(184): Pfam Name: Band_7 Pfam Description: SPFH domain / Band 7 family
MVNSFFVFCGCVDQASVAVVEKWGRFVRLAEPGLHFFNPFAGECVAGSLTTRVQSLDVRVETKTKDNVFVQLICTIQYRVVKENADDAFYELQNPQQQIQAYVFDVVRAIVPRMNLDDLFEQKNDVAKSVLEELEKVMADYGYSIEHILMIDIIPDAAVRKAMNEINAAQRLQLASVYKGEAEKVLLVKKAEAEAEAKYLSGVGIAKQRQAITDGLRENILNFSHSVSGTSAKEVMDLIMVTQYFDTIKELGDGSKNTTVFIPHGPGHVKDISEQIRDGMMQASSSNV

SEQ ID NO: 10618 - DNA, 891 bp, Panicum virgatum
  misc_feature: Ceres CLONE 1724986
  misc_feature: Encodes the peptide sequence at SEQ ID NO. 10619
gctcgaccggagaagcacacacaagccagccaaggcctccccgagcggagatggcacaagccatggcgtccatgaccggcctctcgcagggcgtgctgcccaccaggcgcgccgccagcagggccaggacggccgtcgtcagggcgtccgccgagggcgaggccgcggcacaggctggccgccgcgccgtgctcgggctggtggccaccggcatcgtcggcagcgtcttcacccaggcggtgcgcgccgatgaggccgtcaagaccatcaagatcggccccccgccgccgccctctgggggacttcccgggaccttgaactcggaccaggccagggacttcaacctcgccttgaaggagcggttctacctgcagccgctgccaccagcgcaggcggcggcgagggccaagtcgtcagcgcaggacatcctcaacctcaagccgctcatcgacaagaaggcttggccgtacgtcatgaacgacctccgcctccgggcttcctacctgcgctacgacctcaacaccgtcatcgcctcaaagcccaaggaggagaagaagagcctcaaggagctcaccggcaagctcttcagcaccatcgacgatcttaaccatgcggcaaagatcaagagcaccccagaggctgagaaatactatgcggcgactaaatctgccctcgatgacgttttggccaagctaggctagatggaatataatgggctaatggccatgtaatttcagacttttgtgtttgttcatatggagccggcaatgtaccatctcctgttgatattatatcaacaaacacttaactatgatgctatcgtgaggtcttgacaagaacaatcccaagcagatgtgataatcagaaatcaataccaacaacaattatatg

SEQ ID NO: 10619 - protein, 216 aa, Panicum virgatum
  misc_feature: Ceres CLONE 1724986
  misc_feature (12)..(216): Pfam Name: PsbQ Pfam Description: Oxygen evolving enhancer protein 3 (PsbQ)
MAQAMASMTGLSQGVLPTRRAASRARTAVVRASAEGEAAAQAGRRAVLGLVATGIVGSVFTQAVRADEAVKTIKIGPPPPPSGGLPGTLNSDQARDFNLALKERFYLQPLPPAQAAARAKSSAQDILNLKPLIDKKAWPYVMNDLRLRASYLRYDLNTVIASKPKEEKKSLKELTGKLFSTIDDLNHAAKIKSTPEAEKYYAATKSALDDVLAKLG

SEQ ID NO: 10620 - DNA, 869 bp, Panicum virgatum
  misc_feature: Ceres CLONE 1724994
  misc_feature: Encodes the peptide sequence at SEQ ID NO. 10621
ctcctttcatcctctgctgggataaacgctagctcaggtgacccgggaggaatgtcgtcggcccagatcgcgccgccgccggagcatgtgtgctacgtgcactgcaatttctgcaacacaattctcgcggtcagtgtcccgagcaatagcatgctgaacatcgtgacagtccgttgtgggcattgcactagcctgctgtcagtgaacttgataggactgatccaatcacttcctgtccagaatcactcacaggagaatttcaaggttcacaatattcacaatatcagctttactgaaaactactctgagtatgctccttcgtcttcaaaattccggatgccaatgatgttctcagcaaaaggagatcaggatcatatgctgcacgtgcgtgctctagagaagcggcaacgtgttccatcagcatacaatagatttattaaggaagagatacggaggattaaagcaagcaaccctgccataagtcatagagaagcattcagcactgcagcaaagaattgggcacattttccaaacatacattttggcctagggacccatgaaagcagcaagaagcttgatgaggccattggtgcggcaggtggtccccagaaagtccaagatctctactagagacctgcaacacccatcttgattccgtgttgtaagtaattttagaaaagaaaactatcttaattccaaatccatttgcaagtggtgtacatatataggtaagtgatatcatggataaataaagaataagacatatatatgtaagagaacataatgctactggctatttcaccaggacaacataggcacctgatcatgtggctatatcttagaggatctcaataaatgatcaatgtctc

SEQ ID NO: 10621 - protein, 192 aa, Panicum virgatum
  misc_feature: Ceres CLONE 1724994
  misc_feature (4)..(166): Pfam Name: YABBY Pfam Description: YABBY protein
  misc_feature: The sequence is a functional homolog of SEQ ID NO 414 in the 10/666,642 US patent application
  misc_feature: The sequence is a functional homolog of SEQ ID NO 888 in the 11/435,388 US patent application
  misc_feature: The sequence is a functional homolog of SEQ ID NO 1506 in the 10/666,642 US patent application
  misc_feature: The sequence is a functional homolog of SEQ ID NO 420 in the 10/666,642 US patent application
MSSAQIAPPPEHVCYVHCNFCNTILAVSVPSNSMLNIVTVRCGHCTSLLSVNLIGLIQSLPVQNHSQENFKVHNIHNISFTENYSEYAPSSSKFRMPMMFSAKGDQDHMLHVRALEKRQRVPSAYNRFIKEEIRRIKASNPAISHREAFSTAAKNWAHFPNIHFGLGTHESSKKLDEAIGAAGGPQKVQDLY

SEQ ID NO: 10622 - DNA, 1030 bp, Panicum virgatum
  misc_feature: Ceres CLONE 1724996
  misc_feature: Encodes the peptide sequence at SEQ ID NO. 10623
atcgcagcccgcctcgggccagccgctcggaccgcacgcagggccgcagccagccccaggctcccgtcgcattcgctcgctcgctcgctcgcgtcgtcgctctcgcctccgccgatccgcgcacgcagatcgccgaagcccggcggcgcaggggcgaaggggagcgagggagctcgcgcggcggcggaggaggaaggcgttcgccaccgtctcgaggaagagatggggctctcgttcgggaagctgttcagccgcctcttcgccaagaaggagatgaggatcctcatggtcggccttgatgccgccggtaagaccaccatcctctacaagctcaagctcggcgagatcgtcaccaccatccccaccatcggattcaatgttgaaactgtagagtacaagaacattagcttcactgtttgggatgttggtggccaggacaagatcaggcccctgtggaggcactacttccagaacacgcagggtctcatttttgttgtggacagcaatgacagggagcgtgttgttgaggctagggatgagctccacaggatgctgaatgaggatgagctgcgtgatgctgtgctgcttgtgtttgcaaacaaacaagatcttcctaatgctatgaatgctgctgaaattactgacaagcttggcctgcattccctgcgccagcggcactggtacatccagagcacttgtgctacatctggtgaagggttgtacgaggggcttgattggctttccaacaacatcgccaacaaggcttgaagcttttcggcagggctcccaggaagaggaagatgtctgaacaacttattgctgccttattacatattataagattatacaatctacaatagatagtgtgggtgtttgtgaagaaaaagaaactagttctcttttgaggtgctagtgccagatttggttatgtttttgcttttggctcggtattatcgcctgtccagtttcacaaaactgactctgtcaatcatgtgtacttatgctcggagatgtgtggtaaattaaattt

SEQ ID NO: 10623 - protein, 181 aa, Panicum virgatum
  misc_feature: Ceres CLONE 1724996
  misc_feature (1)..(177): Pfam Name: Arf Pfam Description: ADP-ribosylation factor family
  misc_feature: Functional homolog of the protein sequence given in SEQ ID NO 50150
  misc_feature: Useful for making plants with altered alkaloid content
  misc_feature: Useful for making plants with altered lignin content
  misc_feature: Functional homolog of the protein sequence given in SEQ ID NO 50219
  misc_feature: Useful for making plants with modulated nitrogen use efficiency
  misc_feature: Functional homolog of the protein sequence given in SEQ ID NO 50220
  misc_feature: Useful for making plants with altered terpenoid content
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKA

SEQ ID NO: 10624 - DNA, 1254 bp, Panicum virgatum
  misc_feature: Ceres CLONE 1724998
  misc_feature: Encodes the peptide sequence at SEQ ID NO. 10625
agatcaaccccatttctcctccactttggcatcacgcacgctcctccggctttcccgtgtcccccggagcagcgcgagggtttcgaacatggcggagcagccgcacgcggaaggcggcgcgagccccaagcacgagaccctgatggagaagctcgccgacaagctccacgtcggcggcaaggactcctcctcctcgtcctcggactccgacaacgacgagcggccgcgcccctcggcgccgcccgcgcccgccgccgaggtcaagccctccttctccgactccgcagccacggcggccgccgaggccaaggccaaggtgttccgcctcttcggccgcgagcagccgatccacaaggccctcggtggaggcaaacctgctgatgtgttcctgtggaggaacaggaacatctctgctggagtgcttggtggtgccactgcaatctggatcctctttgaattgcttggctaccatcttctgaccttcgtttgccatggtctcatattctctttgggtgttctgtttctctggtctaacgcctcctcgtacatcaacaaatcgcccccacgggtcccagaggtgatcattcctgaagatctggttgtcaacattgcactatctactcgttatgagatcaacagggccttcgccaatcttcgccagattgctcttggccgggacataaagaagttccttatggtgattgctgggctttggttgctttctgttcttgggagctgctgcaacttcttgaccttggtttacattgtatttgtggtgctgcacacagtccctgtcctctacgagaagtatgaggatcagattgactcgtatggcgagaaggggtgggtcgaaatcaagaagcagtacgccgtgtttgatgagaaggttctgagcaaagtaccaaggggccccgcgaaagacaagaagcactagaaacacaagtgatttggtgttgctctcggtagggaatgctagcaagtggttcgagtttgtcaggaggcatcaagactccctttttgtggtacgagcaccaatatgccacctatgccttgtgttattacggctgcctgtttggtcttttgatgggggtagctggatagctttgccctacaacagtgatgcagatgcagcatacgattttcttgtactgcagtttgattttgatctgtgttgtaagatgtagtgtgcgtaccgtacccgtgacgctgtttttttctatctatatggatgcagtttggaggctggttatattt

SEQ ID NO: 10625 - protein, 281 aa, Panicum virgatum
  misc_feature: Ceres CLONE 1724998
  misc_feature (96)..(279): Pfam Name: Reticulon Pfam Description: Reticulon
MAEQPHAEGGASPKHETLMEKLADKLHVGGKDSSSSSSDSDNDERPRPSAPPAPAAEVKPSFSDSAATAAAEAKAKVFRLFGREQPIHKALGGGKPADVFLWRNRNISAGVLGGATAIWILFELLGYHLLTFVCHGLIFSLGVLFLWSNASSYINKSPPRVPEVIIPEDLVVNIALSTRYEINRAFANLRQIALGRDIKKFLMVIAGLWLLSVLGSCCNFLTLVYIVFVVLHTVPVLYEKYEDQIDSYGEKGWVEIKKQYAVFDEKVLSKVPRGPAKDKKH

SEQ ID NO: 10626 - DNA, 1194 bp, Panicum virgatum
  misc_feature: Ceres CLONE 1725017
  misc_feature: Encodes the peptide sequence at SEQ ID NO. 10627
aacatcgacctcaaggtaccttcccctgcatctctgccgccgctcctcctgtacccaaccctgctgccatggagctacccgcccgcgtcctccagatcttaaccccccgaatactttgctcctaagtcctgactcgtgcctatggcgcttgtgatgtttcgtgcgccgtctggtttctgagcgtgtggtgcttttcccctgcatctcggccgctctgtttgctgtgtggtagttctaggatgcttggcagttcccctggcgcagtttcgtcggtggcagatttgaggcatcgaagacgagattttggattttgggaactgataaatgacaaatggaggaatctaagtttcagtgcaagtggaatgggttcaagggacaaaacaaggggtccaaggacaactggaccctcatgttccccattgtctacctcacaggcttcctcacaggcttcggttgccccagtggcaaataaagttgctgaagctccaccaggagctgagaaaaagcaacaggaagtgaaacctcatccaaagtatggtgccatgatcctggaagctctttcggagttgaatgagccaaatggtacagaacttactgaaatctgcagcttcatagagcaaagacatctagtgccaacaacctttagaagagtgattggtacaaagttacggcggcttgtagattcaaaaaaaattgaaaaggttgatactaagtcctataggctcgccgattcctttgcgacgagaactccagctccaataaaagcttcagctccaaaacagaaggatccatccaagccatcgaaggtgtcaaagaacctaggattgtttgccacctccagccctgcactagaggcagccatggccgcagcagccaaagtagctgatgcagaggtgaaagcacatgatgcacatgatcagatgatggaggcagaaaggatcctcaagatggctgagaagacggagtctctcctcacgattgcagcagagatctatgatcgatgttcaaggggagagataaccacattaaatccgccgcaaagggaggtctgaaacctaccggaggcctctgttttcatgtacatggataggttgtcctggattatctgcccatattgctcctatgttgtataatttaagtgtttgtgctgtacttgggatatagggttaaactaaataacaccagtgcaccgcc

SEQ ID NO: 10627 - protein, 270 aa, Panicum virgatum
  misc_feature: Ceres CLONE 1725017
  misc_feature (95)..(164): Pfam Name: Linker_histone Pfam Description: linker histone H1 and H5 family
  misc_feature: Functional homolog of the protein sequence given in SEQ ID NO 50221
  misc_feature: Useful for biocontainment applications
MLGSSPGAVSSVADLRHRRRDFGFWELINDKWRNLSFSASGMGSRDKTRGPRTTGPSCSPLSTSQASSQASVAPVANKVAEAPPGAEKKQQEVKPHPKYGAMILEALSELNEPNGTELTEICSFIEQRHLVPTTFRRVIGTKLRRLVDSKKIEKVDTKSYRLADSFATRTPAPIKASAPKQKDPSKPSKVSKNLGLFATSSPALEAAMAAAAKVADAEVKAHDAHDQMMEAERILKMAEKTESLLTIAAEIYDRCSRGEITTLNPPQREV

SEQ ID NO: 10628 - DNA, 1193 bp, Panicum virgatum
  misc_feature: Ceres CLONE 1725023
  misc_feature: Encodes the peptide sequence at SEQ ID NO. 10629
cactcttgtcatccaggcggcggcggcgcggtaggagaaggaggaggagcagcagcagcagcaggcggcgccgaagagcagctacccacccccaacccgcaaccatggctaggggattgaagaagcatctgaagaggctcaatgcgccgaagcattggatgttggacaaacttggtggagcttttgcccccaaaccatcttctggtcctcacaagtccagggagtgccttcccctcatcctcatcatcaggaacaggctcaagtatgctctgacttaccgtgaggttatttctatcctgatgcaacgccatgtcttggttgatggcaaggtcaggactgacaagacctacccagcagggttcatggatgtcatttctattcccaagaccaatgagaactacaggcttctgtacgacactaagggtcgcttccgtcttcaccccatcagggatgaggatgccaagttcaagctctgcaaggttaggtctgttcagtttggccagaagggcattccctacctgaacacttatgatggtcgcaccatccgctaccctgacccactcatcaaggccaacgacaccatcaagatcgaccttgagaccaacaagattgttgacttcatcaagtttgatgttggcaacgttgtcatggtgactggtggaaggaacactgggcgtgttggtgtgatcaaaaacagggagaagcataagggcagcttcgagaccatccatgttgaggatgccctaggccaccagtttgccacccgtctgggcaatgtgttcaccatcggcaagggcaacaagccgtgggtgagcctgcccaagggcaagggtatcaagctcagcatcatcgaggagcagcggaagcgggatgccgctgcccaggctgctgccaacgcataaaatcctcagaatgtgctttgagttttgctatagcgagtttatctgcaaggatatagaactacccagactatcctgttttaagttttgccctatggttgttgattcgcgaactgatgtttgcagttagctgtaatgcgactatttacttattgaagtgcgttttcgagaacatgtctttctgttttgtttacccgggttgctcttgaatgtacctgcatgtgtatcattgtggtctatggttgatcatactcggattcagtaatatcctcctaatatcatgtcctataggcc

SEQ ID NO: 10629 - protein, 265 aa, Panicum virgatum
  misc_feature: Ceres CLONE 1725023
  misc_feature (94)..(170): Pfam Name: Ribosomal_S4e Pfam Description: Ribosomal family S4e
  misc_feature (3)..(40): Pfam Name: RS4NT Pfam Description: RS4NT (NUC023) domain
  misc_feature (177)..(211): Pfam Name: KOW Pfam Description: KOW motif
  misc_feature (42)..(90): Pfam Name: S4 Pfam Description: S4 domain
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDAKFKLCKVRSVQFGQKGIPYLNTYDGRTIRYPDPLIKANDTIKIDLETNKIVDFIKFDVGNVVMVTGGRNTGRVGVIKNREKHKGSFETIHVEDALGHQFATRLGNVFTIGKGNKPWVSLPKGKGIKLSIIEEQRKRDAAAQAAANA

SEQ ID NO: 10630 - DNA, 973 bp, Panicum virgatum
  misc_feature: Ceres CLONE 1725027
  misc_feature: Encodes the peptide sequence at SEQ ID NO. 10631
aaaatccccattcgttcccctcctcctcctcgccgccgcgaaacctccccgattccccgcctcgatctactgccgatcatccccgaaccctcgccgaatcccagatccagcccagcccagccctccagactcccgcccgccggccgccatggggaaccccgagaagctgatgaaccagatcttcgacctcaagttcacctccaagtcgctgcagcggcaggcgcgcaagtgcgagaaggaggagaaggagcagaagctcaaggtgaagaaggcgatcgagaagggcaacgtggacggcgcccgcatctacgccgagaacgccatccgcaagcgcaccgagcacatgaactacctccgcctcgcctcccgcctcgacgccgtcgtggcgcgccttgacacgcaggccaagatgcaggtcattggcaagtccatgcagtccatcgtcaagtcgctcgactccgcgctcgccaccgggaacctccagaagatgtccgagaccatggacaacttcgagcgccagttcgtcaacatggaggtccaggccgagttcatggagggcgccatggccggctccacctcgctctccacgcccgagaccgaggtcaacagcctcatgcagcaggtcgccgacgactatggcctcgaggtctccgtcggcctcccgcaggccgcggcgcacgccatccctgctgccaaggataaggagaaggtcgacgaggacgacctctctcgccgccttgccgagctcaaggcccgcggctgagcacctttcaggctttcagccatttcagatgccattcatgctatgctgttgagcggcaattacccagtgtcaccttgactgctactcatatttggtagattcgtaaatactgttatgcttaagtgtgttggcatcgccatatggggtctgtggacttgaaaactttgctgtgttatcttgtactataaaatccataatttgcgggcttgc

SEQ ID NO: 10631 - protein, 204 aa, Panicum virgatum
  misc_feature: Ceres CLONE 1725027
  misc_feature (9)..(179): Pfam Name: Snf7 Pfam Description: Snf7
MGNPEKLMNQIFDLKFTSKSLQRQARKCEKEEKEQKLKVKKAIEKGNVDGARIYAENAIRKRTEHMNYLRLASRLDAVVARLDTQAKMQVIGKSMQSIVKSLDSALATGNLQKMSETMDNFERQFVNMEVQAEFMEGAMAGSTSLSTPETEVNSLMQQVADDYGLEVSVGLPQAAAHAIPAAKDKEKVDEDDLSRRLAELKARG

SEQ ID NO: 10632 - DNA, 1234 bp, Panicum virgatum
  misc_feature: Ceres CLONE 1725031
  misc_feature: Encodes the peptide sequence at SEQ ID NO. 10633
gcgcaagggagggggagcgcaacactcgcgagggagagagagacaagggggcggacacccacacgccgaccgcgcgagcgagcgagagagatccccctctcccccgccggatccgatctgacctgacctcgccgccgccgcctgccgtgggagggagaagaggaggaggaggcggagatggctcctgtgtcggcgctcgccaagtacaagctcgtattccttggggaccagtccgtcggcaagaccagcatcatcacccgcttcatgtacgacaaattcgacaacacctaccaggctacaattggtattgatttcctgtccaagacaatgtatcttgaagatagaaccgtgagactccaactctgggatactgctggacaggaaagattcaggagtttaattccaagctatatcagagactcttcagttgctgtcattgtattcgatgttgcaagcaggcagtctttcttaaatacatcaaaatggatagaggaagttcgcactgagaggggcagtgatgttatcattgttcttgttggcaacaaaactgaccttgttgacaagaggcaagtctcaatagaggaaggggaaggcaaggcaaaagaccttggtgtgatgtttatcgaaaccagtgctaaagctggctttaacattaaggctttgttccgtaagattgcggctgcgcttcctgggatggagaccctctcatcagcgaagcaggaagacatggttgatgtgaacttgaggtccggcaatgcaaactcatcccagtctcaggctcaggctgggggatgcagttgttagttgcagtccctgacacttgctgcttatgatctcgagaccctgagtgttggaacgtgttatctctgctgtttctctcaggaaggagagttgattgtctctcatcagtgaatctcaccatagtctttacccggtgaatggaccatttgcgttggaatgataccttttatgagttttctagtgtttttttttttctcagtggcctaagctagcaacagtgtatatttcggttggcactgcgaactcttaccattcgagttgggtattagagctagcgattggttcttgttgaacttatatatttttcatctgtcttgttgcagttagcttgagtcatgtttcctatgtgtaccaaacatgtattggaatttttgtaagctataataagtcctgcacggcgataaccaagtgatatcccagatatttcatcgtt

SEQ ID NO: 10633 - protein, 208 aa, Panicum virgatum
  misc_feature: Ceres CLONE 1725031
  misc_feature (11)..(172): Pfam Name: Ras Pfam Description: Ras family
  misc_feature (11)..(125): Pfam Name: Miro Pfam Description: Miro-like protein
  misc_feature: SWISSPROT Homolog: EC 2.7.11.1 Non-specific serine/threonine protein kinase
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIEEVRTERGSDVIIVLVGNKTDLVDKRQVSIEEGEGKAKDLGVMFIETSAKAGFNIKALFRKIAAALPGMETLSSAKQEDMVDVNLRSGNANSSQSQAQAGGCSC

SEQ ID NO: 10634 - DNA, 752 bp, Panicum virgatum
  misc_feature: Ceres CLONE 1725036
  misc_feature: Encodes the peptide sequence at SEQ ID NO. 10635
gtctcattccgcaccacctcctctccctcttccccttcctcctccttcccagcctctgctcgtgccgccgccggccatggcctgcctcaccgacctcgtcaacctcaacctctccgacaccacggagaagatcatcgccgagtacatatggatcggtggatctggcatggatctcaggagcaaggccaggaccctctccggcccggtgacggatcccagcaagctgcccaagtggaactacgacggctccagcaccggccaggcccccggcgaggacagcgaggtcatcctgtacccgcaggctatcttcaaggacccattcaggaagggcaacaacattctcgtcatgtgcgattgctacaccccagctggcgagccaattcccaccaacaagaggcacagcgccgccaagatcttcagcaaccctgaggttgccgctgaggagccctggtatggtattgagcaggagtacaccctccttcagaaggacaccaactggccccttgggtggcctgttggtggcttccctggccctcagggtccttattactgcggtatcggcgctgacaagtctttcgggcgcgacatagttgactcccactacaaggcttgcctgtatgctggcatcaacatcagtggcatcaacggggaggtcatgccaggacagtgggagttccaagtcggcccgtccgtcggcatttctgccggtgaccaggtgtggggtgctcgctacattcttgaaaggatcaccg

SEQ ID NO: 10635 - protein, 225 aa, Panicum virgatum
  misc_feature: Ceres CLONE 1725036
  misc_feature (17)..(97): Pfam Name: Gln-synt_N Pfam Description: Glutamine synthetase, beta-Grasp domain
  misc_feature (103)..(224): Pfam Name: Gln-synt_C Pfam Description: Glutamine synthetase, catalytic domain
  misc_feature: SWISSPROT Homolog: EC 6.3.1.2 Glutamate--ammonia ligase
  misc_feature: Functional homolog of the protein sequence given in SEQ ID NO 50222
  misc_feature: Useful for making plants with modulated water use efficiency
MACLTDLVNLNLSDTTEKIIAEYIWIGGSGMDLRSKARTLSGPVTDPSKLPKWNYDGSSTGQAPGEDSEVILYPQAIFKDPFRKGNNILVMCDCYTPAGEPIPTNKRHSAAKIFSNPEVAAEEPWYGIEQEYTLLQKDTNWPLGWPVGGFPGPQGPYYCGIGADKSFGRDIVDSHYKACLYAGINISGINGEVMPGQWEFQVGPSVGISAGDQVWGARYILERIT

SEQ ID NO: 10636 - DNA, 732 bp, Panicum virgatum
  misc_feature: Ceres CLONE 1725036-R
  misc_feature: Encodes the peptide sequence at SEQ ID NO. 10637
ggatcaccgagatcgctggtgtggtggtgacattcgacccgaagcccatcccgggtgactggaacggtgccggtgcccacacgaactacagcaccaagtccatgaggaacgagggtgggtacgaggtgatcaaggccgcgatcgagaagctgaagctgcggcacaaggagcacatcgccgcctacggcgagggcaacgagcgccggctgaccggcaagcacgagaccgccgacatcaacaccttcagctggggagtcgccaaccgtggcgcatcggtgcgcgtgggccgggagacggagcagaacggcaagggctacttcgaggatcgccggccggcgtccaacatggatccctacgtggtgacctccatgatcgccgagaccaccatcatctggaagccctgaagcgtccccgcccaaactccccccagctccccgtctcgtctcggtcggtccggcggccgccatggctgcctccggcgaccgcattgagctgggcgcggcaattgtccaattaatccgttccgttccattccattctgtccgattatacgctgctgctgccgctgccgctaccactactgcatttagttagatctgtgaaagggctgtgcgaaaacaaaacaaaaacattgtttgctttgatgctttgcacttccatgggtatcacttgtgtaatcctctcctccaataatggccgtaccgcagcggtggtaccatccgtacttgcatc

SEQ ID NO: 10637 - protein, 133 aa, Panicum virgatum
  misc_feature: Ceres CLONE 1725036-R
  misc_feature (1)..(132): Pfam Name: Gln-synt_C Pfam Description: Glutamine synthetase, catalytic domain
  misc_feature: SWISSPROT Homolog: EC 6.3.1.2 Glutamate--ammonia ligase
  misc_feature: Functional homolog of the protein sequence given in SEQ ID NO 50222
  misc_feature: Useful for making plants with modulated water use efficiency
ITEIAGVVVTFDPKPIPGDWNGAGAHTNYSTKSMRNEGGYEVIKAAIEKLKLRHKEHIAAYGEGNERRLTGKHETADINTFSWGVANRGASVRVGRETEQNGKGYFEDRRPASNMDPYVVTSMIAETTIIWKP

SEQ ID NO: 10638 - DNA, 962 bp, Panicum virgatum
  misc_feature: Ceres CLONE 1725043
  misc_feature: Encodes the peptide sequence at SEQ ID NO. 10639
aggacagcgcgatcgtcatccgccacccaggctcaactgctcgcggcgaggcagcacccgtcccctctctcccgtcctcctgcgcgctctccctcctcgctgacgcgcgcacacgtccaagcctccaaggggaccaaccaatcgcgcgcggctctggttgggaaatgggtctcctggaccagctctgggacgagacggtggccggcccgcgcccggagtccggcctcggcaggctccgcaagtacgcctccttctccccctcgtcgtcgtcctcgctggcccccgccgcggcgcccgcggtgacgcgcagcttcaccgtcgggggccgcccggcgtcgctgtccgtcgaccagtcgccgcacggggagtcgtacagctcctccgtcccgtcctccccggccagcgggccggactccccgttcgccgcagctacgcccaaggccgatggctatgggaggcttggccggaaatccaaggcctccgacgggccggagccggccatcgggccgaggagccccaccgtgtacgactgggtggtgatcaacttggaatgataagcaatcgagcggaggacgtacagagagcgaggaagctagctagcgtgtgtgtgtttgcctgcaagtttgaggctgcgtcgtgtttccgttccgtatatgttccgtgttctaccgaaaccgtgcctgactgtctggggtggcatgtgtagtagtatgtctagctagagacctggtaggatgatgatgatgatgatcagttcgtgggggttggaagcaggcggcgatccgatccagtctagttctgccttccggcaagatgggttttgttcagttcttcgatctgggggaagaactctgaaatgactaatgaggatgtggtgtacgcccgcctgctttgtttttctacgctcccctgtaattacctaatactgtgttcaatgcaaagcatggcactgctttcatctc

SEQ ID NO: 10639 - protein, 129 aa, Panicum virgatum
  misc_feature: Ceres CLONE 1725043
  misc_feature (7)..(126): Pfam Name: Auxin_repressed Pfam Description: Dormancy/auxin associated protein
MGLLDQLWDETVAGPRPESGLGRLRKYASFSPSSSSSLAPAAAPAVTRSFTVGGRPASLSVDQSPHGESYSSSVPSSPASGPDSPFAAATPKADGYGRLGRKSKASDGPEPAIGPRSPTVYDWVVINLE

SEQ ID NO: 10640 - DNA, 1047 bp, Panicum virgatum
  misc_feature: Ceres CLONE 1725045
  misc_feature: Encodes the peptide sequence at SEQ ID NO. 10641
actcagtacccgcacactgccagccagtgctcttccgctgctagagcgagcaccgagcagcagcgcacagcagcgtcgaggggagaggaagtgagctccactccagcccgctcgctctctccggccggtgcctcgtttccttgccgctgcgcgcctcggcaagctgcagctagtggccatgggtggtggcgcggctaggagggcggccgcggcggcgctggcggtggcggtgctggccggcgtggcgtcggcggccgtgtacgaggtgggcgacaaggccgggtggaccgtcatgggcaaccccaactacgccgcctgggccagctccaagaagttccatgtcaacgacgtcgtcgtgttcacgtacaacaagcagttccacaacgtggtggcggtgagcaaggcggactacaagaactgcgacgccagcaagccgatcgccacctggtccacgggcaacgactccgtcgtcctcaagaccgcgggccaccactacttcctctgcggcttcccgggccactgcgccgccggccagaaggtggacatccgcatcgccgcctcctctgatgccccttccgcggcgcccacccccgagcccgcagccggcggcggctccaagccctccagtggcgccacggccgcgccggcgccgcaccccaacgccgcgccccaggccctccccgcaggcagctccgtcgccgccaccgtcgccgcgtcgctgctctccctggccgcggccgtgctggcctgagcgtgaccaggggctccgtagtgtcggttagggggttggcgccattgtgaattgaattgagagctctgctgtgtctgttgccgtttgagcaggagcgcctggacctgcgttcgttttgctgttttgcccttgtggttctgtggatcctggcctgccttggggatttcttcctgttgtcaattaatttcctcatgctttcatgctttgagctcttcgttcatctcagtgcagtggtatcgtttgagaactatctgttctgctgcagtggccttttctgtcagcgtgacaccattttc

SEQ ID NO: 10641 - protein, 190 aa, Panicum virgatum
  misc_feature: Ceres CLONE 1725045
  misc_feature (36)..(119): Pfam Name: Cu_bind_like Pfam Description: Plastocyanin-like domain
MGGGAARRAAAAALAVAVLAGVASAAVYEVGDKAGWTVMGNPNYAAWASSKKFHVNDVVVFTYNKQFHNVVAVSKADYKNCDASKPIATWSTGNDSVVLKTAGHHYFLCGFPGHCAAGQKVDIRIAASSDAPSAAPTPEPAAGGGSKPSSGATAAPAPHPNAAPQALPAGSSVAATVAASLLSLAAAVLA

SEQ ID NO: 10642 - DNA, 1011 bp, Panicum virgatum
  misc_feature: Ceres CLONE 1725048
  misc_feature: Encodes the peptide sequence at SEQ ID NO. 10643
aagaagccccgcccggcgggctttctcagcttcagcgagagagatggagcagcagcagcgcgacggcgatggcagcgcggcggaggcggacatcgagcggctccccgccgacctcctcgcgcacgtcctctccctcctccccaccttccgcgacctctccatggcggggggagtgagccggaggtggcgccgggcggtggaacggtcgctggcgtcgcggcggcggctgagcttcgcggggcagcgcaccggcgacgacaccgccgcgcgcctcgtccgcgccgccgtcaacctccgcgacctcgacatttcacgaagctgctggggctgccaaatcaccgacgaaggcttgatcaagatttcgtccgcggattgcgtcgggaacctcacgtccatatcgctgtgggggttggctggaattacggataaaggcgttgtccagctggtgagaacgggaaagttcttttagattccgtcttgtcaatattcagattcaggtttcaagggcttattctctgcagcacctgaatattggtgggacattcatcacagacgaatccctgaatgcagtcgcaaatagctgcacaaatctgaagagcatcatcctgtggagctgccgccacgtgacggaggccgggctggtggcgctggtgaacaagtgccggcggctggagtgcatcaacgtgggcggcatgcgggtgccgccggagagcttcgtgggcctgctctccatcagccccgccctgcggatcaggtccatcccccagatcctcaacgccggggtgcaggtctcctgatgtgtgtctgtccatgatcacaaggattatcaccaggccagccatgagcccatcactggttcatggcaagaactgtcagaagggatccatgaaaggatcgaatgtttgttcacttgtttgtgttgtgttgattgttattctccaaaaaaaattgattgtatcttaaaattataccatcatggcagcacagaatagtttggaccatcagaaccac

SEQ ID NO: 10643 - protein, 141 aa, Panicum virgatum
  misc_feature: Ceres CLONE 1725048
  misc_feature (15)..(63): Pfam Name: F-box Pfam Description: F-box domain
MEQQQRDGDGSAAEADIERLPADLLAHVLSLLPTFRDLSMAGGVSRRWRRAVERSLASRRRLSFAGQRTGDDTAARLVRAAVNLRDLDISRSCWGCQITDEGLIKISSADCVGNLTSISLWGLAGITDKGVVQLVRTGKFF

SEQ ID NO: 10644 - DNA, 1136 bp, Panicum virgatum
  misc_feature: Ceres CLONE 1725049
  misc_feature: Encodes the peptide sequence at SEQ ID NO. 10645
gagatgaggtctcaggaccctcctcatctggctcgtccccttttccaagaacccgaggctctaagggaaacctcagtcttgcttaaagacaacttctgtcgaagtgaacttatatatatatctgagggttgaaacttcttagtttagtcttaagttagaaatgccttcgactactatgggtgggatccagaagctttatgaggtctgtaaaggatcattatctgaaaagggacctatatcttctgaagccatcgataaagtccgtgttgtattagacaagatcacaccttgtgatgttggactagagagtgaagctcaagctgcacgtgtttggcggagtccacaaacccggtgcaggaaaagagtttttccctccacccctgcgatcagataccgtcacatttatgagtgcaaaagcttctcaattgggatattttgcataccagcatcgtccatcattccactccacaaccatcctggaatgactgtacttagcaaagttttatatggcacagtgcatgtcaaagcatatgactggattgatagagctgaacctcttagcttactaaaagtgagacctgcgaaggttgtaagagatggtgaaatgtcggcgccttgcggagccatggttcttcatccagaagaaggcgggaacatacatggtttcaaagccatcacaccatgtgctatcctaaacattttaacacctccttactcttcagaaggtggaaggcactgctcctacttccggagctgcccaaagtcagacccatccggcattttattgaaccgtacaaaggaatctgaatttgtttggcttgaagaataccagccccgtgacagctttgtcattagaagggacctgtacacaggacctgctttaaagttatgagaacatcatgctcagcataataattgctttctttagtttcttaagttataaagtacatagccatgcaaagcattccatttctactttttgctttgcacttttatttagaggctcgtaattattccatttgatccgatttatgtattttaaggtaattttattgtacatttcatatgtaactcgctgacaaaatatttatataattatataaaagtggaaggtattttctagccttcctttggat

SEQ ID NO: 10645 - protein, 238 aa, Panicum virgatum
  misc_feature: Ceres CLONE 1725049
  misc_feature: SWISSPROT Homolog: EC 1.13.11.19 Cysteamine dioxygenase
MGGIQKLYEVCKGSLSEKGPISSEAIDKVRVVLDKITPCDVGLESEAQAARVWRSPQTRCRKRVFPSTPAIRYRHIYECKSFSIGIFCIPASSIIPLHNHPGMTVLSKVLYGTVHVKAYDWIDRAEPLSLLKVRPAKVVRDGEMSAPCGAMVLHPEEGGNIHGFKAITPCAILNILTPPYSSEGGRHCSYFRSCPKSDPSGILLNRTKESEFVWLEEYQPRDSFVIRRDLYTGPALKL

SEQ ID NO: 10646 - DNA, 1080 bp, Panicum virgatum
  misc_feature: Ceres CLONE 1725059
  misc_feature: Encodes the peptide sequence at SEQ ID NO. 10647
aaatccccacgcgaggcgaaaaaaccgagcgggcgaatcgaatcccgtcccgttcggcgagcgagcgagcgagcggcagcacctcgtcgccggctgggcctggggttgggttcggcctcgctcgatcgatcggatggcgcaccgggtggacaacgagtacgactacctcttcaagatcgtgctcatcggcgactccggcgtcggcaagtccaacatcctctcccgcttcacccgcaacgagttctgcctcgagtccaagtccaccatcggcgtcgagttcgccacccgcaccctgcagattgatgggaagactgtcaaggcacagatatgggacacggctggacaggagagataccgtgcaatcactagcgcttattacagaggcgctgttggagcgctcctagtctacgacataacaaagaagcaaacttttgacaacgttcagaggtggctccgggagctccgggatcatgcagatgccaacattgttgtcatgatggtcggtaacaagtcggacttgaaccacttgagatcggtccctgaggaagacggccaagcattttcagagaaggaaggcctatccttcctcgagacatctgcgctggaggcgatcaacgtcgagaaggcgtttcacaccatattgagcgagattcatcagacagtaagcaagaagacgcttgcagcgcaggagtctgcatccgccaacgggcgctccatgcagggaaccaccattaacgttgctgattcatccgcccccgcaaaaggttcatgctgttctagctgaagaactgattgcaacctaagaggggaagtctgaggcagcgttcgtttgtgcagagctgcacactgctgcgcctaggttgtagaccgcttcgcattatctgcctccaaaagccacattgactggtgattcttttgtcaaaggaacttttcctagcatcatacattgtaacctgtcaaatcacagcatattccttttgcatttgttctttaacctatccctgtatacttggaaggatcgaagagcattctgtactctgtaacacattcttctcctgatggtataataatctccagtac

SEQ ID NO: 10647 - protein, 216 aa, Panicum virgatum
  misc_feature: Ceres CLONE 1725059
  misc_feature (14)..(175): Pfam Name: Ras Pfam Description: Ras family
  misc_feature (14)..(128): Pfam Name: Miro Pfam Description: Miro-like protein
  misc_feature: SWISSPROT Homolog: EC 2.7.11.1 Non-specific serine/threonine protein kinase
  misc_feature: Functional homolog of the protein sequence given in SEQ ID NO 50223
  misc_feature: Useful for making plants with altered lignin content
  misc_feature: Functional homolog of the protein sequence given in SEQ ID NO 50163
  misc_feature: Useful for making plants with altered alkaloid content
  misc_feature: Functional homolog of the protein sequence given in SEQ ID NO 50164
  misc_feature: Useful for making plants with altered terpenoid content
MAHRVDNEYDYLFKIVLIGDSGVGKSNILSRFTRNEFCLESKSTIGVEFATRTLQIDGKTVKAQIWDTAGQERYRAITSAYYRGAVGALLVYDITKKQTFDNVQRWLRELRDHADANIVVMMVGNKSDLNHLRSVPEEDGQAFSEKEGLSFLETSALEAINVEKAFHTILSEIHQTVSKKTLAAQESASANGRSMQGTTINVADSSAPAKGSCCSS

SEQ ID NO: 10648 - DNA, 1044 bp, Panicum virgatum
  misc_feature: Ceres CLONE 1725060
  misc_feature: Encodes the peptide sequence at SEQ ID NO. 10649
gatgccgcctacaacctgaagggccgcgagctccgcctcggcctgccggggtccgagtcgccggagcgccgggtcgcggctgccaccgcgaccactctggacctgctcccagccaagggcgcgaagagcgggttcttcgacgaggtgccgccgccgtcgcccgccgccgctgcgggcaagggcaagaaggtggcggacgaggaggacgacgacaagaaggtggcagcgaccccgcagccggccgccaaggctcaggtggtgggatggccaccaatccgcagttaccgcaagaacacgatggctactacccagcagaagggcagcaaggaggatgctgaggccaagcagggccaagggttcctctacgtgaaggtcagcatggatggcgccccgtacctcaggaagattgacctcaagacatacaagaactacaaggatctctccactgcacttgagaagatgttcagtggctttagtaatggcaaggacggcttatctgagtaccacaaggatggtgaatatgttctgacttatgaagacaaggatggagattggatgctcgtcggcgacgtgccatgggagatgtttgctgactcttgccgtaggctcaggatcatgaaaggttcagatgcaattggacttgctccaagggcagctgataagtccaagaaccgcaactagaatggttgctactacagtccagagcaagagggagatccaatgactgtagggccctttatgaaaatcgaaaagtcagttttaagacgaattctgccttatggtctgtactacatggtttgctgttacgcgagtaaagaactccatgtctgttatgttagtttcgcaaaatcgtctatggaccaaacctctatccgattgtggttagggctttgtatgggtgttattcgtatcagtgtaaatggtttggttcattgtgtgctgctactttgattgagcagtcctacctagtttgcaaaatggtgtccatgaactgtttgtcggtcctctatataatgttcaatgaagctcgtgaatgtattgtct

SEQ ID NO: 10649 - protein, 226 aa, Panicum virgatum
  misc_feature: Ceres CLONE 1725060
  misc_feature (4)..(218): Pfam Name: AUX_IAA Pfam Description: AUX/IAA family
  misc_feature: The sequence is a functional homolog of SEQ ID NO 739 in the 10/374,780 US patent application
  misc_feature: Functional homolog of the protein sequence given in SEQ ID NO 50148
  misc_feature: Useful for making plants with altered alkaloid content
  misc_feature: Functional homolog of the protein sequence given in SEQ ID NO 50146
  misc_feature: Useful for making plants with altered terpenoid content
  misc_feature: The sequence is a functional homolog of SEQ ID NO 890 in the 10/412,699 US patent application
  misc_feature: The sequence is a functional homolog of SEQ ID NO 636 in the 11/479,226 US patent application
  misc_feature: The sequence is a functional homolog of SEQ ID NO 648 in the 11/479,226 US patent application
  misc_feature: The sequence is a functional homolog of SEQ ID NO 290 in the 10/412,699 US patent application
  misc_feature: The sequence is a functional homolog of SEQ ID NO 674 in the 11/479,226 US patent application
  misc_feature: The sequence is a functional homolog of SEQ ID NO 652 in the 11/479,226 US patent application
  misc_feature: The sequence is a functional homolog of SEQ ID NO 656 in the 11/479,226 US patent application
  misc_feature: The sequence is a functional homolog of SEQ ID NO 598 in the 10/666,642 US patent application
  misc_feature: The sequence is a functional homolog of SEQ ID NO 904 in the 11/435,388 US patent application
  misc_feature: The sequence is a functional homolog of SEQ ID NO 667 in the 11/479,226 US patent application
DAAYNLKGRELRLGLPGSESPERRVAAATATTLDLLPAKGAKSGFFDEVPPPSPAAAAGKGKKVADEEDDDKKVAATPQPAAKAQVVGWPPIRSYRKNTMATTQQKGSKEDAEAKQGQGFLYVKVSMDGAPYLRKIDLKTYKNYKDLSTALEKMFSGFSNGKDGLSEYHKDGEYVLTYEDKDGDWMLVGDVPWEMFADSCRRLRIMKGSDAIGLAPRAADKSKNRN

SEQ ID NO: 10650 - DNA, 1281 bp, Panicum virgatum
  misc_feature: Ceres CLONE 1725064
  misc_feature: Encodes the peptide sequence at SEQ ID NO. 10651
acgccgatcagcaggctataagcaatagctccatcttgtcagtgatcagcaatcggtgatggcgtcggagaagagcaagatcctggtggtcggcgccacggggtacctgggccggcacgtcgtcgcggcgagcgcgcggctgggccacccgaccttggcgctcgtcagggacacggcgccgtccgacccggccaaggcggcgctgctcaagagcttccaggacgccggcgtgacactcctcaagggcgacctctacgaccaggccagcctggtgagcgccgtcaaggccgccgacgtggtcatctccacgctcgggtcgctgcagctcgccgaccagaccaggctcatcgacgccatcaaggaggccggcaacgtcaagaggttcttcccgtcggagttcgggctggacgtggaccacacgggcatcgtggagccgggcaagtccgtcctgtccgccaaggtggccatccggcgcgccgtcgaggccgccggcatcccgtccacgtacgtggtggccggcttcttcgcgggctacgcgctgcccggcatcgggcaggccctcgcccagggcccccccgccgacaaggccgtsgtgctcggcgacggcaacgccaaggccgtgtacgtggaggagggcgacatcgggacgtacacggtgctcgccgccgacgacccgcgcgccgagaacaagacgctgtacgtgcggccgccggccaacacgctgtcgcacaacgagctgctggcgctatgggagaagaagtctggcagggggttcgagcgggagtacgtcccggaggagaccgtcctgaagcagatccaagagtcgccggtgccggcgaacatcatcctgtcgatctggcacgcggcgcaggtgaggggggagcagacgggattcgaggtcgacccggcgaagggggtggaggccgccgatctgtacccggacgtcaagtacaccaccgtcgacgagtaccttgacaggttcctctgaggaagacggcgcgcgcgacgtgtgctcgcggcggctgccgcggctcctgtcgtcgcctctgctctgctgctgccgccgtgcgggtcacctgctggtagctggtgacgctgcggctgcgccgctgccacctacatgcgtgatcatagatgtgtctccgatcgtcgaggtcctgatgccaatttccatggcaataagatcagttccctttggtggatcgcgatccagtttttgttgcatttgtgtactgtatgtgctgctactcttgtaatggacggcccggccatttcttaagc

SEQ ID NO: 10651 - protein, 309 aa, Panicum virgatum
  misc_feature: Ceres CLONE 1725064
  misc_feature (8)..(300): Pfam Name: NmrA Pfam Description: NmrA-like family
  misc_feature: SWISSPROT Homolog: EC 1.3.1.45 2'-hydroxyisoflavone reductase
MASEKSKILVVGATGYLGRHVVAASARLGHPTLALVRDTAPSDPAKAALLKSFQDAGVTLLKGDLYDQASLVSAVKAADVVISTLGSLQLADQTRLIDAIKEAGNVKRFFPSEFGLDVDHTGIVEPGKSVLSAKVAIRRAVEAAGIPSTYVVAGFFAGYALPGIGQALAQGPPADKAVVLGDGNAKAVYVEEGDIGTYTVLAADDPRAENKTLYVRPPANTLSHNELLALWEKKSGRGFEREYVPEETVLKQIQESPVPANIILSIWHAAQVRGEQTGFEVDPAKGVEAADLYPDVKYTTVDEYLDRFL

SEQ ID NO: 10652 - DNA, 732 bp, Panicum virgatum
  misc_feature: Ceres CLONE 1725069
  misc_feature: Encodes the peptide sequence at SEQ ID NO. 10653
cttcccttcgcgcaccgctccaccccacgccgccgcttcgccgccgcagccgccaccgtcgccatggcccggatcaaggtgcacgagctccgggggaagaacaaggcggagttgcaggcgcagctcaaggagttcaagtccgagctctccctcctccgcgtggccaaggtcaccggcggagcccccaacaagctctccaaaatcaaggtggtgcgcacctcgatcgcgcgcgtgctgacggtgatctcgcagaagcagaaggcggcgctgcgggaggcgtacaagaagaagaagctgctccccctcgacctccgccccaagaagacccgtgccatccgccgccgcctcaccaagcaccagctttctctgaagacggagagggaaaagaagcgtgagaagtacttccccatgaggaagtatgctatcaaggcctaggtcagaactgtgagatgtttctagcatattgtgggctgtttctttgcctaggaagtgttttaagttttgggttttatggacctttgctatgggttgaaactacggtacaatccctctgttacctcaaatacctagatgggtttaaggggcaattcgtattggcaatgaaaccttgcatgcttgttgtgatatggtcctttctacagttgtatcgctagacgatgatttttgtgtaggcctgctggatgtattgtgacagacttagacaagttatagatttcttttagtttcaacttt

SEQ ID NO: 10653 - protein, 123 aa, Panicum virgatum
  misc_feature: Ceres CLONE 1725069
  misc_feature (6)..(64): Pfam Name: Ribosomal_L29 Pfam Description: Ribosomal L29 protein
MARIKVHELRGKNKAELQAQLKEFKSELSLLRVAKVTGGAPNKLSKIKVVRTSIARVLTVISQKQKAALREAYKKKKLLPLDLRPKKTRAIRRRLTKHQLSLKTEREKKREKYFPMRKYAIKA

SEQ ID NO: 10654 - DNA, 612 bp, Panicum virgatum
  misc_feature: Ceres CLONE 1725071
  misc_feature: Encodes the peptide sequence at SEQ ID NO. 10655
aaaaccctcgctgctagcacccgccgccgcccgcgccgccgcctgcaccagccgcgacaaagatgagtcggcaccctgaagtgaagtgggctcagaggatcgacaaggtttacatcaccgtacagttatctgatgcaaaggatgctaaggtccatttggagccagatggtgtcttcacattctctggcagtgctggtacaaacttatatgaattgaaactagatctgaatgacaaagtcaatgcggaggctagcaagataagtgtgggtgtcaggtccatattctgtatcgtagaaaaagctgaggccaaatggtggaagaagcttgttcgggatgatcaaagggcacctcactttgtgaaagttgattgggacaaatgggtggatgaagatgatgacggtggtgatgtcaacttggatgggatggacttctcgaattttggtggcatgggcggtatgggcggcatgggtgatatggctggtctgggcggcatgggtgatatggctggtctgggcggcatgggtggcatgggtggtctgggcggcatgggtggtctgggcggcatgggtggcatgggtggtctgggcggcatgggtggtatgggaatggatg

SEQ ID NO: 10655 - protein, 183 aa, Panicum virgatum
  misc_feature: Ceres CLONE 1725071
  misc_feature (5)..(79): Pfam Name: CS Pfam Description: CS domain
  misc_feature: SWISSPROT Homolog: EC 5.3.99.3 Prostaglandin-E synthase
MSRHPEVKWAQRIDKVYITVQLSDAKDAKVHLEPDGVFTFSGSAGTNLYELKLDLNDKVNAEASKISVGVRSIFCIVEKAEAKWWKKLVRDDQRAPHFVKVDWDKWVDEDDDGGDVNLDGMDFSNFGGMGGMGGMGDMAGLGGMGDMAGLGGMGGMGGLGGMGGLGGMGGMGGLGGMGGMGMD

SEQ ID NO: 10656 - DNA, 1165 bp, Panicum virgatum
  misc_feature: Ceres CLONE 1725082
  misc_feature: Encodes the peptide sequence at SEQ ID NO. 10657
ataccagtcagtacaccactcggacggcgcacgcaccgcagctccagcggcagcgccgccgcacgccgtgcccgcaggtctctccttctcaggccttctcctgacctcctctcgagtctcgccgctcgactcggccgcgcgccgatggccctgctgcgggagcacctcgacctcatccgcgcgcacctcctcgacgaccgccacgaccacgacaacgacgccgccgccagctccgaggaccactcggcgtcgtcgccctcgccctcgccgcccgccgggcggaggccactgccggcgctctccgtcgcgctgcccccgcggccagcgctcgccctgcagcagcagcagcagctgtgggcggcgccgccgccgcagatcattcaccagcaggagcagagctactactactgcccggaagccgaggaggatgacttccggcggtaccgcggcgtgcggcagcggccgtggggcaagtacgcggcggagatccgggacccggcgcggaagggcgcgcgcgtgtggctgggcacctacgacaccgccgtggaggccgcgcgcgcctacgaccgcgccgcgttccgcctgcgcggctccaaggccatcctcaacttccccaacgaggtcgccttcggcaccgccgcgcggtgggggccgccgcctcctcctgctgccgccccccgctatcccgccgccgccggtaataacaagagggcgaggtcgccggagcgggggccgcaagaacagggcgccgggtgcatggtcatcagggaggtgaagcgggagcgggtgcaggagcccgccgggagttgcggttgggacggcgtggccacggcgccgacggcggcgagcggaggcgcggacttctgggaggaggaggagctgctcaagggggcgatctgcagcctgccgccgctctcgccgctgtcaccgcccccgcagctggccttcccgcagctctccgtcagctgacgtgtcgaagcatgcggctgatccatccatctgtggataggcatggagaagggcgcgtggactcctaattaactgatgagttattagtgttaatccactttgaggagttctaccatgagtacaactccaccaaatattctttcgttcgttgtctattcaagtatcttagtccaaacgacaagtaaatgttcttcgc

SEQ ID NO: 10657 - protein, 274 aa, Panicum virgatum
  misc_feature: Ceres CLONE 1725082
  misc_feature (98)..(150): Pfam Name: AP2 Pfam Description: AP2 domain
  misc_feature: The sequence is a functional homolog of SEQ ID NO 1011 in the 10/412,699 US patent application
  misc_feature: The sequence is a functional homolog of SEQ ID NO 700 in the 10/666,642 US patent application
  misc_feature: The sequence is a functional homolog of SEQ ID NO 160 in the 10/714,887 US patent application
  misc_feature: The sequence is a functional homolog of SEQ ID NO 160 in the 11/435,388 US patent application
  misc_feature: The sequence is a functional homolog of SEQ ID NO 28 in the 10/903,236 US patent application
  misc_feature: The sequence is a functional homolog of SEQ ID NO 2217 in the 10/666,642 US patent application
  misc_feature: The sequence is a functional homolog of SEQ ID NO 24 in the 10/903,236 US patent application
  misc_feature: The sequence is a functional homolog of SEQ ID NO 84 in the 10/714,887 US patent application
  misc_feature: The sequence is a functional homolog of SEQ ID NO 84 in the 11/435,388 US patent application
  misc_feature: The sequence is a functional homolog of SEQ ID NO 22 in the 10/903,236 US patent application
  misc_feature: The sequence is a functional homolog of SEQ ID NO 2215 in the 10/666,642 US patent application
  misc_feature: The sequence is a functional homolog of SEQ ID NO 82 in the 10/714,887 US patent application
  misc_feature: The sequence is a functional homolog of SEQ ID NO 82 in the 11/435,388 US patent application
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
  misc_feature: Functional homolog of the protein sequence given in SEQ ID NO 50224
  misc_feature: Useful for making plants with altered lignin content
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: The sequence is a functional homolog of SEQ ID NO 16 in the 10/903,236 US patent application
  misc_feature: The sequence is a functional homolog of SEQ ID NO 2209 in the 10/666,642 US patent application
  misc_feature: The sequence is a functional homolog of SEQ ID NO 76 in the 10/714,887 US patent application
  misc_feature: The sequence is a functional homolog of SEQ ID NO 76 in the 11/435,388 US patent application
  misc_feature: Functional homolog of the protein sequence given in SEQ ID NO 50225
  misc_feature: Useful for making plants with altered lutein content
  misc_feature: Useful for making plants with modulated biomass
  misc_feature: Useful for making plants with modulated flowering time
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: The sequence is a functional homolog of SEQ ID NO 166 in the 10/714,887 US patent application
  misc_feature: The sequence is a functional homolog of SEQ ID NO 166 in the 11/435,388 US patent application
  misc_feature: The sequence is a functional homolog of SEQ ID NO 34 in the 10/903,236 US patent application
  misc_feature: The sequence is a functional homolog of SEQ ID NO 1354 in the 10/666,642 US patent application
  misc_feature: The sequence is a functional homolog of SEQ ID NO 171 in the 11/479,226 US patent application
  misc_feature: The sequence is a functional homolog of SEQ ID NO 18 in the 10/714,887 US patent application
  misc_feature: The sequence is a functional homolog of SEQ ID NO 18 in the 11/435,388 US patent application
  misc_feature: The sequence is a functional homolog of SEQ ID NO 1954 in the 10/374,780 US patent application
  misc_feature: The sequence is a functional homolog of SEQ ID NO 8 in the 10/666,642 US patent application
  misc_feature: The sequence is a functional homolog of SEQ ID NO 8 in the 10/903,236 US patent application
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: Functional homolog of the protein sequence given in SEQ ID NO 50226
  misc_feature: Useful for making plants with altered alkaloid content
  misc_feature: Functional homolog of the protein sequence given in SEQ ID NO 50227
  misc_feature: Useful for biocontainment applications
MALLREHLDLIRAHLLDDRHDHDNDAAASSEDHSASSPSPSPPAGRRPLPALSVALPPRPALALQQQQQLWAAPPPQIIHQQEQSYYYCPEAEEDDFRRYRGVRQRPWGKYAAEIRDPARKGARVWLGTYDTAVEAARAYDRAAFRLRGSKAILNFPNEVAFGTAARWGPPPPPAAAPRYPAAAGNNKRARSPERGPQEQGAGCMVIREVKRERVQEPAGSCGWDGVATAPTAASGGADFWEEEELLKGAICSLPPLSPLSPPPQLAFPQLSVS

SEQ ID NO: 10658 - DNA, 1156 bp, Panicum virgatum
  misc_feature: Ceres CLONE 1725095
  misc_feature: Encodes the peptide sequence at SEQ ID NO. 10659
gcacactccgcgctgctcctcacctcgcctggctagtcttccgtttcaactttcaaggatccgaagcgctcctcttccttttctcggccctggttcgctcgctgcgctgggtgcgtgatcgccggagcgagaagctgccgtgggtggctggaggatatgtaggggcgacatggcggttcatctggtgctggcttgagattcttgggtgcgaggtttgatttgggttttggtggtaggcgggagttgctggtacagtaggaaaagtggaggaaacgatgagctttagtgccgtggacatggaggaggagagcggcactgcggccgccgtcgccgcgcaggtcgtgtggacccccgtggacgtcatcagccagcggctgatggtccagacctccgccacctgccgctaccgcggcggcgcggacgcgttccggaagatcctcgtcgccgacggcgtccgcggcctgtaccgcgggttcggcctctccatcctgacctacgcgccgtccaacgccgtgtggtggtcgtcctacgccatggcgcagcggttcctctggcgcgtcgtcggcgccgagcgctccgagagctacccgtccctgatggccgtgcagggcgcgagcgccgcgctggccgggggcgcgtccgcgctggtgaccatgccgctggacaccgtgaagacgcggctccaggtgatggaggcggacgcggcgcgcccgacgctggcgagcaccatgcgcgggctgctcaaggagggcgggtgggcggcgtgctaccgcgggctcgggccgaggtgggggtccatgtcgctgtcggcggcgaccatggtgaccacctacgagttcctgaagcggctgtcggcgaaggagggctccatgggctagatcttcctccgtccctaaccgtagcagtgatgatcgtcaagtgatgacgcgaccttgtacatattctcaagctatttgccgttctcgtttcttgatctggcgctataggagggggtgggcaggaggaagaactagaactagaactagaaaatgggggttttagaatgcagaatttttgcttgcttttgctctggcgctgcagtttcatgcctgtagctgctgcctctgatgatgatgatgaaagcttttatggagagaagaatttccggtcaaaactc

SEQ ID NO: 10659 - protein, 200 aa, Panicum virgatum
  misc_feature: Ceres CLONE 1725095
  misc_feature (11)..(96): Pfam Name: Mito_carr Pfam Description: Mitochondrial carrier protein
  misc_feature (107)..(197): Pfam Name: Mito_carr Pfam Description: Mitochondrial carrier protein
MSFSAVDMEEESGTAAAVAAQVVWTPVDVISQRLMVQTSATCRYRGGADAFRKILVADGVRGLYRGFGLSILTYAPSNAVWWSSYAMAQRFLWRVVGAERSESYPSLMAVQGASAALAGGASALVTMPLDTVKTRLQVMEADAARPTLASTMRGLLKEGGWAACYRGLGPRWGSMSLSAATMVTTYEFLKRLSAKEGSMG

SEQ ID NO: 10660 - DNA, 1090 bp, Panicum virgatum
  misc_feature: Ceres CLONE 1725104
  misc_feature: Encodes the peptide sequence at SEQ ID NO. 10661
aacactgccacagcagccgtgtccacctcacgtatgatctgtagccactgatagacaccagctgctagcctgtgctactgccgctgctgctacctgtcgtgtccttttcctctgcctgattgcctctctgctctgagccgccatggatatctggaagtccaaggtgctgcccaagatcaagctcgtcttcgccaagtccggcggcaagaaggccgccgccgccgccgagctcgtcaagtccttcgacgagtccaaggaggggatcaatggcgagttcgaggagaagaaggcggatctccagcctaaggtcgtcgagatctacgagtctgttcctgccccgctcaaggttctgatcaaggagaggagcaaggtgtccgggatcaagaagaactcggccgccatcaccaagttcttcgaggaactggccaagatcgagtttcctggcgccaagcaagtgagcgagggcatctccaaggtcggcccggccctgctgtccggccccatcttcgccacgttcgagaaggtctcctccctgctccctgtcgccgccgaggaggcgcccaaggaggctccggtcgtggccgccgccaccgctgaggaggcagccgagaagaaggacgccgccgctgctgaagcgccggccggcgagaagaaggaagaggctccggcagccgtcgaggagaagaaagaagaggcggctcctgcagccgccgaggagaccgccgccgcagcggagactgcgccccctgctgccgatgcacctgccgcagagcccgctgcggaggcggcgccggccgaggcagcggccccagccgagccggcggcgaaggccgaggaggagacgcccaaggcctagcctagctagggttcagattcatcttgcagcccgcagctaggtagagagatccttccccgcgtgcaaccatgctctaccatcacccgttcgttgttcttgcatatatgcaacctgtacgtttctgcgcagaccggttagacatgtatgtatatgtaagcctataatttttgtatgtacctattattcatttgaagtgtgaggacatgtatattattctcagttttggttcaattc

SEQ ID NO: 10661 - protein, 237 aa, Panicum virgatum
  misc_feature: Ceres CLONE 1725104
  misc_feature (1)..(237): Pfam Name: DREPP Pfam Description: DREPP plasma membrane polypeptide
MDIWKSKVLPKIKLVFAKSGGKKAAAAAELVKSFDESKEGINGEFEEKKADLQPKVVEIYESVPAPLKVLIKERSKVSGIKKNSAAITKFFEELAKIEFPGAKQVSEGISKVGPALLSGPIFATFEKVSSLLPVAAEEAPKEAPVVAAATAEEAAEKKDAAAAEAPAGEKKEEAPAAVEEKKEEAAPAAAEETAAAAETAPPAADAPAAEPAAEAAPAEAAAPAEPAAKAEEETPKA

SEQ ID NO: 10662 - DNA, 771 bp, Panicum virgatum
  misc_feature: Ceres CLONE 1725115
  misc_feature: Encodes the peptide sequence at SEQ ID NO. 10663
atcgcggtctctctcgcattcacgagctgccgtttactcctctgtcgagctcgcgcaaccacttcccctcgtgcggcttgcctttgcctgccaacgtgccacagcgaatggaagcctacgcggcagcggcgtcgccacggacggcggccatgggcgtggacaagctcagctaccagctcttctccctgctcgagagcaagttcctcttcggcgccggcgccgggtgcctgtcctccggccccgggacgccggcgcgggcgttcctcgacggcgggcgcgtgcgtgtgctggccatcgacggctgcggcgcgggcgccgaggacgcgctcctggccgccgcggcgctcgcgcggctcgaggccgggctgcgggagcaagccggggaccccgacgcgcgcgtcgccgacttcttcgacgtggccgcgggcgccggcgcgggaggcgtgctagccacgatgctgttcctcaggggccccgacgggcggccgcggtactcggcgcaggaggcgctcgcgttcgtggccggcagcgtcgggaagaaggacggctggggcggccggcgcgggcggtgggcgaagatgttccgcggctaccggagcggcgaacgcgtgttccagcgcctgttcggcgaggcgacgctcagggacaccgtggcgccgctgctcgtgccgtgctacgacctcgccaccgccgcgcccttcgtgttctcgcgcgccgacgccgtcgagagcgacaccttcgacttccgcctccgcgacgtctgcgccgcca

SEQ ID NO: 10663 - protein, 221 aa, Panicum virgatum
  misc_feature: Ceres CLONE 1725115
  misc_feature (61)..(221): Pfam Name: Patatin Pfam Description: Patatin-like phospholipase
MEAYAAAASPRTAAMGVDKLSYQLFSLLESKFLFGAGAGCLSSGPGTPARAFLDGGRVRVLAIDGCGAGAEDALLAAAALARLEAGLREQAGDPDARVADFFDVAAGAGAGGVLATMLFLRGPDGRPRYSAQEALAFVAGSVGKKDGWGGRRGRWAKMFRGYRSGERVFQRLFGEATLRDTVAPLLVPCYDLATAAPFVFSRADAVESDTFDFRLRDVCAA

SEQ ID NO: 10664 - DNA, 698 bp, Panicum virgatum
  misc_feature: Ceres CLONE 1725118
  misc_feature: Encodes the peptide sequence at SEQ ID NO. 10665
atcgtcgtccgtcgtactcgcccacaaggtacttaacacgggtcggcggccggcggttggaggagccgaggaggttggaggccggcttggagcagcagcagcagcagcagccggcaatggagaagccccggcaggtggtgcgcaagttcctggcgcggccgcagcacgagggcgtcggcgccgtcgtccgccgcagcatcggcaggtttgagctgaggtacttcgacccgttcctagtcctcgacgagttctccgtttctgctccggcggggttccccgaccacccgcacagaggattcgagaccgtcacctacatgctcgagggcgccgtgacgcacgaggacttcgagggccaccgcggcacgatcaaggccggcgacgtgcagtggatgacggccggccgcggcatcgtgcactccgagatgcccgccggccccggcacgtccaggggcctgcagctctgggtcaacctctcctccgccaacaaaatggtcgagcccgggtaccaggagatccagagcaaggacatcgcgtgcacgaccgccgacggcgtcacggtgcgcgtgatcgcggggcacgccatgggggcgcggtcgccggtgcgcacgcggacgccgaccatgtacctcgacttcaccgtgcgcccgcgcgccgcggcgcggcagcccgtgcccgcgtcgtggaacgccttcgcgtac

SEQ ID NO: 10665 - protein, 193 aa, Panicum virgatum
  misc_feature: Ceres CLONE 1725118
  misc_feature (21)..(117): Pfam Name: Pirin Pfam Description: Pirin
MEKPRQVVRKFLARPQHEGVGAVVRRSIGRFELRYFDPFLVLDEFSVSAPAGFPDHPHRGFETVTYMLEGAVTHEDFEGHRGTIKAGDVQWMTAGRGIVHSEMPAGPGTSRGLQLWVNLSSANKMVEPGYQEIQSKDIACTTADGVTVRVIAGHAMGARSPVRTRTPTMYLDFTVRPRAAARQPVPASWNAFA

SEQ ID NO: 10666 - DNA, 453 bp, Panicum virgatum
  misc_feature: Ceres CLONE 1725118-R
  misc_feature: Encodes the peptide sequence at SEQ ID NO. 10667
cgcaccacctgctcctcctcgggccgggcgacggcgtcgaggtgtggaacaagtcggacggcaggccgctccggttcctgctcatcgccggcgtgcccatcggggagcccgtggcgcagctgggcccgttcgtcatgaacaccgaggaggagatcgacatgaccgtcgacgacttcgagcgctacgccaacgggttcgagaaggctaggcactggaaatcgcaggccatggtagcgcttggggtagagtagggcggaacaaaaagagcagagtacacagccaagagaagaagaaaaaaatcagcacattattttcgttttttccctatttcgtactatagttgctcagatttattttttcagatttcctccatgtaaggtgactgatatcctgtgtttacgtaagtcgacgttctggtgcgttagattagatatggacgtacggtgcggattc

SEQ ID NO: 10667 - protein, 82 aa, Panicum virgatum
  misc_feature: Ceres CLONE 1725118-R
  misc_feature (1)..(64): Pfam Name: Pirin_C Pfam Description: Pirin C-terminal cupin domain
HHLLLLGPGDGVEVWNKSDGRPLRFLLIAGVPIGEPVAQLGPFVMNTEEEIDMTVDDFERYANGFEKARHWKSQAMVALGVE

SEQ ID NO: 10668 - DNA, 672 bp, Panicum virgatum
  misc_feature: Ceres CLONE 1725124
  misc_feature: Encodes the peptide sequence at SEQ ID NO. 10669
atcttcactgcgcgctgccactctcggagggcatggagcttggcctagcgctccgactcgtcgcgccgccgtcgccgacctgtatctcccgtcgatgtcttgctcttcagcctgattttatttccccgtgtgtgctacgaggaagacgcctccgcgtctcgggaatggagcatggagttggggttgtgtccagtgcgagtatgacctactcaggagtggaagacgaggagatggtggaaagtgaggtggtggtggaggaggaggaggaggagtctgaaccgatggcgagcacgaggccgcgcctggagctcattgagaagccggactggagcctggcgctgctagacgagtacgagtcggaggagttgggcacctctcaatgcgccaatcaccgcagcggctatgtagctgtattggggaaaccaaatgttggcaagagcacccttattaaccaaatggttggtcagaaactttcaattgtaacagataaaccacagacaacacgacatcgcattcttggtatatgttctgaaccagaataccagattatactttatgatactcctggtgtcattaaaaaagagatgcataagctggacagtatgatgatgaagaatgttaggagtgctatcgacagtgcagactgtgtgcttggttgttggtgatgcttgg

SEQ ID NO: 10669 - protein, 210 aa, Panicum virgatum
  misc_feature: Ceres CLONE 1725124
  misc_feature (123)..(209): Pfam Name: MMR_HSR1 Pfam Description: GTPase of unknown function
MELGLALRLVAPPSPTCISRRCLALQPDFISPCVLRGRRLRVSGMEHGVGVVSSASMTYSGVEDEEMVESEVVVEEEEEESEPMASTRPRLELIEKPDWSLALLDEYESEELGTSQCANHRSGYVAVLGKPNVGKSTLINQMVGQKLSIVTDKPQTTRHRILGICSEPEYQIILYDTPGVIKKEMHKLDSMMMKNVRSAIDSADCVLGCW

SEQ ID NO: 10670 - DNA, 1363 bp, Panicum virgatum
  misc_feature: Ceres CLONE 1725137
  misc_feature: Encodes the peptide sequence at SEQ ID NO. 10671
atgatctagctatcgcaaaaaattgaacttagaaaggatgctcgctgtagtgcagtgtgtatagttgtagctgctgctactgctcgccatggcctcctccctgtcagtcctggtgatcctgtgcctagcggcgtcggcctcggcgcaactgtcgccgacattctactctaggtcgtgcccccgagccctggccaccatcaaggccgccgtgacggcagcagtggcacaggagcctcgcatgggggcttccctgctcaggctccacttccatgactgctttgtccaaggctgtgacgcgtcagtgttgctgaacgacacggccaccttcaccggcgagcagactgcgttcccgaatgtgggatccatcagaggcttcaccgtggtcgacaacatcaaggcgcaggtggaggccgtgtgcaatcagaccgtctcctgcgccgacatcctcgccgtcgccgcccgcgactccgtcgtagcgttgggaggcccttcatagagggttcttctcgggaggagggactcgacgacggcgagcttatctctggccaacagcgacctgccggctccgaccttggatctcgccaatctcaccgccgcattcgccaggaagggccttagcagaaccgacctggtagctctctcaggagcgcacacgattgggctggcgcagtgcctgaatttccggggtcacatctacaacgacaccaacgtgaacccggccttcgcgacgctgcggcgggccaactgccccgcggcggccggcaacggcgacggcaacctggcgccgctggacaccacgacggccaccgtgtttgacaacgcctactacaccaacctggtggcgcagagcgggctgctgcactcggaccagcagctgttcaacggcggcgccacggacggcctggtgcgcacctacgcgtccaccccgacacggttcaacagggacttcgccgcggccatgatcaggatggggaacctcagcccgctcaccgggtcgcagggccagatcaggcgagcctgctcaagggtaaactagctagtagcaggacacacgcatatgcaggatcagctcccataaaaagtgtacgtaataattaaggccggtcgttcggccactgtcacttgtgtggtgcttgtgcttgtgcttgtactgatggttcatgcacaggaacgtacagcccttttttaatttggtcatcaacatcaagtgtgtgaaatgacgacagaaagtggcttgtagcctacccatatcatgcaaatgcttgaggggcccatatatagttctattgcccaatcatgttgtagtgttacagttgcaaaatgtcattatgacagttccattcaatcactggaagtgatgttc

SEQ ID NO: 10671 - protein, 135 aa, Panicum virgatum
  misc_feature: Ceres CLONE 1725137
  misc_feature (37)..(135): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 50228
  misc_feature: Useful for making plants with altered carbohydrate content
  misc_feature: Functional homolog of the protein sequence given in SEQ ID NO 50229
  misc_feature: Useful for making plants with altered cell wall content and/or composition
  misc_feature: Functional homolog of the protein sequence given in SEQ ID NO 50230
  misc_feature: Useful for making plants with modulated nitrogen use efficiency
MASSLSVLVILCLAASASAQLSPTFYSRSCPRALATIKAAVTAAVAQEPRMGASLLRLHFHDCFVQGCDASVLLNDTATFTGEQTAFPNVGSIRGFTVVDNIKAQVEAVCNQTVSCADILAVAARDSVVALGGPS

SEQ ID NO: 10672 - DNA, 907 bp, Panicum virgatum
  misc_feature: Ceres CLONE 1725141
  misc_feature: Encodes the peptide sequence at SEQ ID NO. 10673
acccagcgacactcaacgaccatcacaattattcaatcctcgcatttgcagcgcccacaaacccgcgaagaaaggaaggaagagaagctgctcccgatggagaacgccgatgcccctcccgccgccgtgaagccgtcgctgtccaagaagccctcgccatcgttccgcctccggaacggcagcctcaacgcgctgcggctgcgccgcgtgttcgacctcttcgaccgcaacggggacggcgagatcaccctcgacgagatggcctcggcgctcgacgcgctcggcctcggcgccgaccgcgccggcctggaggccgccgtcggggcgtacatcccggccggcgccgcggggctccgcttcggcgacttcgagtccctccaccacgcgctcggggacgcgctgttcggccccatcccggaggcggtgcccgaggaggacgaggagggggacatgaaggaggcgttccgcgtgttcgacgaggacggcgacggctacatctcggccgccgagctccaggccgtgctcaagaagctcggcctgcccgaggcgcggaacctcgccacggtgcaggagatgatatgcaacgtcgacagcgaccgcgacggccgcgtcgacttcggcgagttcaagaacatgatgcaggggatcaccgtgtggggcgcctagctgcagcgcccctgcgttgccagccctctactgcgtgttgacatgtatgtatctagctaggcagcgccttttcttctacccagcgcttcttcttcttcttgatcgcgcagtgttttcttcttgctcttggctttgctctggttgggatcgtagtcttcagaaatttggggcaacagcgaaggcccacaggccacgggcattgtttcctgttcttgatttatttactagcattattacatgg

SEQ ID NO: 10673 - protein, 189 aa, Panicum virgatum
  misc_feature: Ceres CLONE 1725141
  misc_feature (118)..(146): Pfam Name: efhand Pfam Description: EF hand
  misc_feature (34)..(62): Pfam Name: efhand Pfam Description: EF hand
  misc_feature (156)..(184): Pfam Name: efhand Pfam Description: EF hand
  misc_feature: SWISSPROT Homolog: EC 2.7.11.1 Non-specific serine/threonine protein kinase
MENADAPPAAVKPSLSKKPSPSFRLRNGSLNALRLRRVFDLFDRNGDGEITLDEMASALDALGLGADRAGLEAAVGAYIPAGAAGLRFGDFESLHHALGDALFGPIPEAVPEEDEEGDMKEAFRVFDEDGDGYISAAELQAVLKKLGLPEARNLATVQEMICNVDSDRDGRVDFGEFKNMMQGITVWGA

SEQ ID NO: 10674 - DNA, 971 bp, Panicum virgatum
  misc_feature: Ceres CLONE 1725142
  misc_feature: Encodes the peptide sequence at SEQ ID NO. 10675
gacctcagcagtacccggccgtatactatgtaattgacgcacaagcaagcaggcaggcgtcgatcatatatatcgacgatcgatcggctcccactgcaagaaccatcgctcggtcatatcatccgatccatagctaattattattagctagctaggtagctaccagcagcgacgaacagatcgatcgaccattgacgattcagacacatccatggccgagaacctcaagcccgtggccctgctgctgctgctgctcaacctgtgcttgtacaccatcctggccatcatcggcgggtgggcgctcaacgtctccatcgaacgcagcttcatcatcggccccgagctgcggctgccggcgcatttccaccccattttcttccccgtcggcaacttcgccaccggcttcttcgtgctcttctccctgatcgccggcgtcgtggggatcgcctccgccatggtgggcttcgcccacctccgcttctggaactaccacagcctgcagcccgcggcggcgttgggcctccttgcctgggcgctcacagtcctagccatgggactagcatgccaggagatctcattcgaccgacgaaacgccaagctgggcaccatggaggccttcacgatcgtcctgacagtgacgcagttcttctacgttctcgccatccgcggggggagtcacggccctgtcccggtcgaacgccacggcaacttgccatgaccggccggccgttaatcatacgacgatccatgacggaagcaacttgcggaggaacttaattattaacatatcatccgatccggccatgtggtcctttaatttgcttgttccttttggcttgatctatcgctgattgatttactataagtgagatcattcgattccttgagtgcaatcattaattggagacaactatatatatgtatatatattagaactgtactgttgatatattatataatatttaaagcat

SEQ ID NO: 10675 - protein, 168 aa, Panicum virgatum
  misc_feature: Ceres CLONE 1725142
  misc_feature (14)..(155): Pfam Name: AWPM-19 Pfam Description: AWPM-19-like family
MAENLKPVALLLLLLNLCLYTILAIIGGWALNVSIERSFIIGPELRLPAHFHPIFFPVGNFATGFFVLFSLIAGVVGIASAMVGFAHLRFWNYHSLQPAAALGLLAWALTVLAMGLACQEISFDRRNAKLGTMEAFTIVLTVTQFFYVLAIRGGSHGPVPVERHGNLP

SEQ ID NO: 10676 - DNA, 1068 bp, Panicum virgatum
  misc_feature: Ceres CLONE 1725143
  misc_feature: Encodes the peptide sequence at SEQ ID NO. 10677
ctctttcctcccttccccaaaacaaaacccgagcttcctagggttccgccgccatgccgcagggagaccacatagagctgcaccagaagcgccatgggcggcgcctggactacgaggagcgcaagcgcaagcgcgaggcgcgcgaggtgcacaagcgctcgaaggatgcacggaagttgcttggtgctaaggggaagaggttcgccaagaagcgatatgctgagaaagcgcagatgaagaagaccctgaaaatgcatgatgaatcaacttcgcggcagaaggctgatgatgatgtccaagagggtgctcttcctccgtatctgcttgatcgtgatcagacacagcgtgccaaggttcttagcaacacgatcaagcaaaaaaggaaggaaaaggcaggaaaatgggatgttcccttgccaaaggtcagaccagtagctgaagaagagatgtttaaggttctgcgaactggcaagcgaaaaaccaagcagtggaagagaatggttactaaagccacctttgttggacctggatttacaaggaagcccccaaagtatgaaaggttcatccggccaactggtttgcgtttcaccaaagctcatgtgactcacccagaactgaaatgtactttcaacctggatataatttctgtcaagaaaaacccaaatggcccaatgtacacttctcttggtgttatgacaaggggaacaatcattgaggtgaatgtcagtgaacttggtctggttactcctgctggaaaagttgtttggggtaaatatgctcaggttacaaacaacccggagaatgatgggtgtatcaatgctgtcttgctagtttagggtcacaaactggaggccttgctttcgcatactgaagttctgttatggtggtttatcttccggtttgtaccactctgatgatgtttttttgaccaatgctgtggcattctagtaccctgttgtgcaccatgggcataacatgtatcctgtattgttgctgcacgacaaatgatggtgctattatagcctggtgtaaaatttgaggaatacagattagcaacgtttttctgtc

SEQ ID NO: 10677 - protein, 260 aa, Panicum virgatum
  misc_feature: Ceres CLONE 1725143
  misc_feature (1)..(237): Pfam Name: Ribosomal_S8e Pfam Description: Ribosomal protein S8e
MPQGDHIELHQKRHGRRLDYEERKRKREAREVHKRSKDARKLLGAKGKRFAKKRYAEKAQMKKTLKMHDESTSRQKADDDVQEGALPPYLLDRDQTQRAKVLSNTIKQKRKEKAGKWDVPLPKVRPVAEEEMFKVLRTGKRKTKQWKRMVTKATFVGPGFTRKPPKYERFIRPTGLRFTKAHVTHPELKCTFNLDIISVKKNPNGPMYTSLGVMTRGTIIEVNVSELGLVTPAGKVVWGKYAQVTNNPENDGCINAVLLV

SEQ ID NO: 10678 - DNA, 748 bp, Panicum virgatum
  misc_feature: Ceres CLONE 1725156
  misc_feature: Encodes the peptide sequence at SEQ ID NO. 10679
atcctcgtcagctttgatcatctctgctccgtggtggccgccatggcgtcgcccatgctctccgccgccaccgtcccgctccagggcgccgccggcctctgcgagttctccgggctcaggagctccgcgtcgctgccgctgcgccggagcaatgccgcctccgacgacttcatgtccgccgtctccttccggacccacgcggtcggcacgagcagcggcgggccgcggcgggcgccggcggaggcgaagctcaaggtggcgatcaacgggttcggccgcatcgggcgcaacttcctgcggtgctggcacgggcgcgacgactcgccgctggacgtcatcgccatcaacgacacggggggcgtcaagcaggcgtcgcacctgctcaagtacgactcgacgctcggcatcttcgacgccgacgtgaggcccgagggcgacagcgccatctccgtcgacggcaaggtcatcaaggtcgtgtccgaccgcaaccccagcaacctgccgtggggggagctcggcatcgacctcgtcatcgaggggacgggggtcttcgtcgaccgcgagggcgccgggaagcacatccaggccggggccaagaaggtgctcatcaccgcgccgggcaagggcgacatccccacctacgtcgtcggcgtcaatgccgaccagtacaaccccgatgagcccatcatcagcaacgcctcctgcaccaccaactgcctcgcgcccttcgtcaaggtcctcgaccaga

SEQ ID NO: 10679 - protein, 235 aa, Panicum virgatum
  misc_feature: Ceres CLONE 1725156
  misc_feature (70)..(221): Pfam Name: Gp_dh_N Pfam Description: Glyceraldehyde 3-phosphate dehydrogenase, NAD binding domain
  misc_feature: SWISSPROT Homolog: EC 1.2.1.13 Glyceraldehyde-3-phosphate dehydrogenase (NADP(+)) (phosphorylating)
MASPMLSAATVPLQGAAGLCEFSGLRSSASLPLRRSNAASDDFMSAVSFRTHAVGTSSGGPRRAPAEAKLKVAINGFGRIGRNFLRCWHGRDDSPLDVIAINDTGGVKQASHLLKYDSTLGIFDADVRPEGDSAISVDGKVIKVVSDRNPSNLPWGELGIDLVIEGTGVFVDREGAGKHIQAGAKKVLITAPGKGDIPTYVVGVNADQYNPDEPIISNASCTTNCLAPFVKVLDQ

SEQ ID NO: 10680 - DNA, 140 bp, Panicum virgatum
  misc_feature: Ceres CLONE 1725156-R
tttccacttccttttttccacccctctcccttctctctgatttttcattgtcgagggacgacggattataatcgacttccggcaaaggaagtcgcaacgctgtataatgtggatttgtaatatatactaccattttgatc

SEQ ID NO: 10681 - DNA, 1515 bp, Panicum virgatum
  misc_feature: Ceres CLONE 1725163
  misc_feature: Encodes the peptide sequence at SEQ ID NO. 10682
gtcaaacccacgcgaccgcgagagctctccgagagggagtccgagagcaccaccacgagagagacgaatcttccgaatctctcggcggcgatggcgctctccgaccgctcccgcgagtcgctcctcccgagcttcctctacgactcctcctcggcgcgctccttcgccgccaccccctcgcgcctctcagtccccgtccccgccccggccccggccccggccgcggctggagcgggtggcggcgcgcccttcacgatccaggcgcccaaggagaagatcgagctctactcgccggcgttctacgccgcctgcacggccggagggatcgccagctgcgggctcacccacatggccgtcaccccgctcgacctcgtcaagtgcaacatgcagatcgatccagcgaaatacaagagcatctcatctggatttggtgtcctgttaaaggagcaaggggctaggggcttcttcaggggatgggtgcctaccttgcttggttacagtgctcagggggcttgcaagtttggcttctatgagttcttcaagaagtactactcagatattgcagggcctgagtatgcccagaagtacaagactctaatctacctggcaggttctgcttctgctgaggtaattgccgatgtggctctctgcccctttgaagctgtgaaggtacgtgtgcagacacagcctggatttgctcgtgggttgagcgatgggctccccaaatttgtccgatctgagggtgctctcgggctctacaagggacttgttcctctctggggtcgtcagattccttataccatgatgaagtttgcttcctttgagaccattgttgagcttatctacaagcatgctgtgcctgttcccaagtctgagtgcagcaagttgacccagttgggtatcagctttgctggtggctatattgctggtgtcttctgtgctattgtttctcacccggctgacaaccttgtttctttcctgaacaatgccaagggtgctacagtgggtgatgctgttaagaagtttggtctctggggtcttttcaccagaggacttcctattcgtattgtcatgattggtacccttactggtgctcagtggggaatttatgatgctttcaaagtcatggttggactcccaacaactggtggtgttacacctgccccagcagaggctgaattgaaggccagcgcttgatttttctgtatcccctgtgatggtatttggtggatggaattgtatcaatcactcaagagcttagttcccaatcttttgtttttttcttaacggatgatttgtccgtcacccttctgatgagaggaactcattaaacatttaaacaggaaataggtcttttcttacccccaggaaaagtttatgcgcaatgcataataatttgtaggacagcaagactgttagagcgaagattttgtttacctcctatagaggaatactcacaagtcaaatcatggagtttccggaagcacgcacagctcttaattttgccttgttcgg

SEQ ID NO: 10682 - protein, 368 aa, Panicum virgatum
  misc_feature: Ceres CLONE 1725163
  misc_feature (70)..(158): Pfam Name: Mito_carr Pfam Description: Mitochondrial carrier protein
  misc_feature (167)..(255): Pfam Name: Mito_carr Pfam Description: Mitochondrial carrier protein
MALSDRSRESLLPSFLYDSSSARSFAATPSRLSVPVPAPAPAPAAAGAGGGAPFTIQAPKEKIELYSPAFYAACTAGGIASCGLTHMAVTPLDLVKCNMQIDPAKYKSISSGFGVLLKEQGARGFFRGWVPTLLGYSAQGACKFGFYEFFKKYYSDIAGPEYAQKYKTLIYLAGSASAEVIADVALCPFEAVKVRVQTQPGFARGLSDGLPKFVRSEGALGLYKGLVPLWGRQIPYTMMKFASFETIVELIYKHAVPVPKSECSKLTQLGISFAGGYIAGVFCAIVSHPADNLVSFLNNAKGATVGDAVKKFGLWGLFTRGLPIRIVMIGTLTGAQWGIYDAFKVMVGLPTTGGVTPAPAEAELKASA

SEQ ID NO: 10683 - DNA, 1369 bp, Panicum virgatum
  misc_feature: Ceres CLONE 1725168
  misc_feature: Encodes the peptide sequence at SEQ ID NO. 10684
attcagctgacgccagacgccgagaggggagacccgcccagagccccagaaccagaagcgcgtccgctcgtctagtggtccggcgatgtcgaaccccgacgtggaggcgagcggcccggcgcgggcggcgccggcgacgacggggatcatgccgccgccggggcggtacagcgtggtcggcaacggcaacggcagcgcgccgccgtacgtggcgccgtcgccgttctactacgacaacgcggcggcacacgagcggcaccactggtcgtggctggtgccgctggtggtgatcgccaacgtggccatgttcgtcgtggtcatgttcgccaacaactgcccgcgcggcggcggggactgcgtcggccggggcttcctccgccgcttctcctttcagccgctcaaggagaaccccctcctcggcccctccgccgccacgctgcagaagtacgacgccctcgactggtacaaggtcgtgcacgggagccaggcttggcggctggagtcgtgcacctggctgcacgccggcctcatccacctgctcgccaacatgatcagcctcatcctcatcggcgtccgcctcgagcagcagttcggattctggaaggtcgggctggtgtacctcgtctcgggcttcggcgggagcgtgctctcggtgctcttcatcaggaagggcgtctccgtcggcgcctccggcgcgctcttcggcctcctcggagcgatgctgtcggagctcatcaccaactggaccatctacaccaacagatttgcagccttggtgaacctgatcatcatcgccgccatcaacctggcggtgggcatactccccctcgtcgacaacttcgcgcacatcggcgggttcgccaccggcttcctcctcgggttcgtgctgctgatccagccccagttcgggtggctggagcagcccttcggtgccaagtcaaagtccaagtacaaggcgtatcagatcatcctcctgcttcttgcactcgtcttgctggctgcagggtttgctgttggattggtcatggtgttcaggggagagaacggcaacgatcactgcagctggtgtcactacctcacctgcgtgccgacgtcaagctggaagtgtgacaattgacctgaacagagattagcgacgcgttagcactctcgcatctttacaggagaagtgagagcatgcgtccccaccattggagacaatgtcaagatagatacatgccccctcaccttgcacgacattgtcaatatattgctttcaagtttggtttttaaattctgccttgtatagaatttcaaacttgtccctttcgcattctttgcacatgaggagttcatcagtaatatttcttgtatatcttaagaactctgt

SEQ ID NO: 10684 - protein, 343 aa, Panicum virgatum
  misc_feature: Ceres CLONE 1725168
  misc_feature (129)..(273): Pfam Name: Rhomboid Pfam Description: Rhomboid family
  misc_feature: SWISSPROT Homolog: EC 3.4.21.105 Rhomboid protease
  misc_feature: Functional homolog of the protein sequence given in SEQ ID NO 50231
  misc_feature: Useful for making plants with altered cell wall content and/or composition
MSNPDVEASGPARAAPATTGIMPPPGRYSVVGNGNGSAPPYVAPSPFYYDNAAAHERHHWSWLVPLVVIANVAMFVVVMFANNCPRGGGDCVGRGFLRRFSFQPLKENPLLGPSAATLQKYDALDWYKVVHGSQAWRLESCTWLHAGLIHLLANMISLILIGVRLEQQFGFWKVGLVYLVSGFGGSVLSVLFIRKGVSVGASGALFGLLGAMLSELITNWTIYTNRFAALVNLIIIAAINLAVGILPLVDNFAHIGGFATGFLLGFVLLIQPQFGWLEQPFGAKSKSKYKAYQIILLLLALVLLAAGFAVGLVMVFRGENGNDHCSWCHYLTCVPTSSWKCDN

SEQ ID NO: 10685 - DNA, 1034 bp, Panicum virgatum
  misc_feature: Ceres CLONE 1725178
  misc_feature: Encodes the peptide sequence at SEQ ID NO. 10686
gcgcacccgctccaatggccgctacggctgtgaccgtgccctcctcgggcgtccccttccccgtctccaacaccgccgcacggcgctgcctgcttctcccttccccgattccccgccgagctctccgcgtcgtcgcctccgcggccgccgaggcgccgcccaagccgacgcagccgccgacctcgccctccggcatcgtgctcgtagaccccgccgaggcccagagggtgcaccgtctcaaggccgtctacgaccagaaggtcgtcccgctcatcaccgaggagttcggctacaccaatgtccaccaggtgcccaaggttgagaagattgtggtgaactgcggcctgggcgccgaggcggggaactccaaggggctggaggccgccatgaaggacctcgccaatatcaccggccagtggcccgtcaagaccaaggccaagaagtcagtggccagcttcaagatccgtgagggaaacaccatcggtatcgcagttaccctccgcggcaagataatgtacaacttcctggataggctcctcaaccttgggcttcctaggaccatggactttctcggcgtcaaccccaacagcttcgacgggcacggcaactacagtcttggcctccgtgatcagggcgtgttccctgagatcccctacgaggtgggtgggaagaagaacggcatggacgtgtgcattatcaccaccgccaagacggacaacgaggccttcaggctgctcgccctccttggcatgccgttctcggagaacatcaagcctgacgtggtgatccggaagaagaggttgaagcgccaccacttcttgagcaagggcaagggcaagggaggaagaaagtgaggagaggaacccatggtatggaacagtgagctagctgctcagcttgttgattgtgatcttttttttttttgcagggtttggtttagaaatatgatgatgttgttgttgttgtccctcaattctgtaactgttgtacttaaaaaaggtcagaatttggaatgcaaatgctttgctttggtc

SEQ ID NO: 10686 - protein, 279 aa, Panicum virgatum
  misc_feature: Ceres CLONE 1725178
  misc_feature (155)..(249): Pfam Name: Ribosomal_L5_C Pfam Description: ribosomal L5P family C-terminus
  misc_feature (95)..(151): Pfam Name: Ribosomal_L5 Pfam Description: Ribosomal protein L5
MAATAVTVPSSGVPFPVSNTAARRCLLLPSPIPRRALRVVASAAAEAPPKPTQPPTSPSGIVLVDPAEAQRVHRLKAVYDQKVVPLITEEFGYTNVHQVPKVEKIVVNCGLGAEAGNSKGLEAAMKDLANITGQWPVKTKAKKSVASFKIREGNTIGIAVTLRGKIMYNFLDRLLNLGLPRTMDFLGVNPNSFDGHGNYSLGLRDQGVFPEIPYEVGGKKNGMDVCIITTAKTDNEAFRLLALLGMPFSENIKPDVVIRKKRLKRHHFLSKGKGKGGRK

SEQ ID NO: 10687 - DNA, 1196 bp, Panicum virgatum
  misc_feature: Ceres CLONE 1725188
  misc_feature: Encodes the peptide sequence at SEQ ID NO. 10688
acacagctcacgcgcagcatcaccaccggagcatcagggagcacgggagagagcagagcgccacaggccgtccgatcctccgcgcgaagcagatcagatggctctcgctctctactgctctgccgcgctccgcgccgcgctggcctcgctggccccgcgggccgccgccaggggctacgcggcgtcggcggcgtccggggccatgcggcgcgcggcggccgcggcggagagcgccgccgcgggggaagccaaggaggccgggcgcggcgccgccgccgccgagatctcctgggtccccgaccccgtcaccggccactaccgccccgccaactgggccgccgccgccgaccccgccgacctccgcgccgcgcacctcgccagggcctgagccccgcccgcccccgcccacccgtctgacataacataccaattaccaacaaaggggaaggtggggtggaggtggaggttcgtttggcgtcgttgtcggccgcgcgcgcacgcgctgtcacggcggcggcccggcatggccgggaagtcgtctcggtcggacgcttgacgccgctacatcatctcggcctcgaccaatcgggagatacggtacatggaggggcggcctctggtcgccgtggcgtgcgtgcgtgcgtggtgggggctggacgacgccctgttcttccttctcgctggggctctcctaccagattcggatgtactactactacgctgcagagagcgggcagggtttcgctgctgttctacgttttgtttgtcgctatcagttaccaccggaaataaaaagttgcggtttgttctaattcctgccattgttgcgtctcaattatccaatgggaattgggaactgcacgcgtgagtcgtgtccttccttgcttgttcaatcacgaacagaaaaagaacaacgcgttcgactgggagcagcgcaactgaaacccatggcaatagtcgttgggtcggtaccgccgcgggcgcccgtcgtagcgatggcaacagctacaaattacctgcgtgcccgcgggtaaaaatccattagagtgaggattcatatatgtgtttgtgcccacgggtacgggtgcaagattatatttaaattcggcgggtaaaaatttacaaatttgaaaatattgtacttgtgattggtttacttgtaaacctgcaacaactaacatgtggatctcgtactc

SEQ ID NO: 10688 - protein, 96 aa, Panicum virgatum
  misc_feature: Ceres CLONE 1725188
  misc_feature (1)..(94): Pfam Name: LEA_3 Pfam Description: Late embryogenesis abundant protein
MALALYCSAALRAALASLAPRAAARGYAASAASGAMRRAAAAAESAAAGEAKEAGRGAAAAEISWVPDPVTGHYRPANWAAAADPADLRAAHLARA

SEQ ID NO: 10689 - DNA, 979 bp, Panicum virgatum
  misc_feature: Ceres CLONE 1725193
  misc_feature: Encodes the peptide sequence at SEQ ID NO. 10690
actgttgctcggtgctcccgtctccctgctcttcttcgccactaggaggaggaatccctcctccgatggccggcgtcgtctgcctccgtcgccgccggggcttcccctcctcggccacctgcgacctgcccctccttggccccctgcctcaccgtacgctccaggccatggccgccaagcacggccccgtgatgctcctgcgcctcggccgcgtgcccaccgcggtggcctcctcggcggccgcggcgcaggaggtgatgaagacccacgacctggccttcgcgagccgcacgagggcgcgcatgacggagcgcctcgtctacggccgcgacatggccttcgccccctacggtcgggagcagaaggccgccgcgatggtcggccgcgtccgccgcgcctcgccgggcgccgtcaacgtcaccgccctcatcatctcctacaccaacggcgtcatctcccgcgctgcgttcggcgaccaagggagattcggggtggacgacggcgagaagctcacccagctgttcgccgacttcgaggagctcctcgggacggtcaccatcggggacttcgtgccgtggctggcgtgggtcgacgcgctcatggggctggacgccaaggcagcgcgcacgtccgcgcagatggacgccttgctcgagcgggtcatcgcggaccaccgccggaggcgacgtgacggccggcgagaggatgacggccaccgggacttcgtcgacgtgatgctggacgtgaacgaggaggcggaggagaccgccgccgccggtggattattcgctcgaaatttgtgctgttgacactagaaagaaacggcttcgcagttttgacactcgaaacgttggcttcgatagaatgatgctacaaacgtgatgtcgctcgactcccgtgacatttgtagctttgtaatacatttgtcgttctttttcatcaatttagcatgcgaaatgacacttgtgcccttatcctc

SEQ ID NO: 10690 - protein, 247 aa, Panicum virgatum
  misc_feature: Ceres CLONE 1725193
  misc_feature: SWISSPROT Homolog: EC 1.14.13.68 4-hydroxyphenylacetaldehyde oxime monooxygenase
MAGVVCLRRRRGFPSSATCDLPLLGPLPHRTLQAMAAKHGPVMLLRLGRVPTAVASSAAAAQEVMKTHDLAFASRTRARMTERLVYGRDMAFAPYGREQKAAAMVGRVRRASPGAVNVTALIISYTNGVISRAAFGDQGRFGVDDGEKLTQLFADFEELLGTVTIGDFVPWLAWVDALMGLDAKAARTSAQMDALLERVIADHRRRRRDGRREDDGHRDFVDVMLDVNEEAEETAAAGGLFARNLCC

SEQ ID NO: 10691 - DNA, 1137 bp, Panicum virgatum
  misc_feature: Ceres CLONE 1725194
  misc_feature: Encodes the peptide sequence at SEQ ID NO. 10692
accaacagctcgcgccgcgcaacgccaccgcgccaccgagcacgcacgcgacagaggcggcggcgggagccattccactccgcggcgagggcgacgggagaggaggaggaggccagggcggcttgtgacgacgacgccggagcggcggcagggcggcatggggaggtccccgtgctgcgagcaggcgcacacgaacaagggcgcgtggaccaaggaggaggaccagcgcctcatcgcctacatcaaggcccacggcgagggctgctggaggtcgctccccaaggccgcagggctgctgcggtgcgggaagagctgccggctgcggtgaatcaactacctgcgcccggacctcaagcgcggcaacttcaccgaggaggaggacgagctcatcatcaagttccacgagctcttcggcaacaagtggtcgctcatcgccgggaggctgccgggccggacggacaacgagatcaagaactactggaacacgcacatcaagcgcaagctcctcgcccgcggcatcgacccgcagacgcaccgcccgctcgccgccgccgcgccgggccagcagcagccgccgcagcagcagcattaccagctggagccgcagaagcggcacgccgccgccgctccgggccatcacgaccaccacccacaggatcgtctcgaggtcctctccgactcgcccgaggcctgcagccgcagcagcgacgatgagccgcggtccgccacgccacctcctccggtgccggcgcagcggcggcgcctcgacatcgacctcaacctgtccatcagcctggcgccctaccagccgctggagtactccaccagcacgccaccggcgcaggaagccgtggcggcggcgatacccacggcagcaggccgcaacaacgcgacggcggcggtgtgcctgtgcctcaacagcctggactaccggccgggcgtcgagtgcgtctgcggcggcggcgccgcctccaggcagcagcaggagcaatgggctcggatttttttgccggcagcaccctgctaccgaggccaatagtgtgacagtgatcggtggcgacatgaggggaggtttgttgagggatgggggcagattatagttattaattaacaacttgagtgatccctgtaacatgc

SEQ ID NO: 10692 - protein, 56 aa, Panicum virgatum
  misc_feature: Ceres CLONE 1725194
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: Functional homolog of the protein sequence given in SEQ ID NO 50232
  misc_feature: Useful for making plants with altered alkaloid content
  misc_feature: Useful for making plants with altered lignin content
  misc_feature: Useful for making plants with modulated nitrogen use efficiency
  misc_feature: The sequence is a functional homolog of SEQ ID NO 1004 in the 11/435,388 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 1073 in the 10/374,780 US patent application
  misc_feature: The sequence is a functional homolog of SEQ ID NO 1002 in the 11/435,388 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1010 in the 11/435,388 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 296 in the 11/479,226 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 824 in the 10/412,699 US patent application
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: The sequence is a functional homolog of SEQ ID NO 569 in the 10/374,780 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: Functional homolog of the protein sequence given in SEQ ID NO 50233
  misc_feature: Useful for making plants with altered carbohydrate content
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: Functional homolog of the protein sequence given in SEQ ID NO 50234
  misc_feature: Useful for making plants with altered cell wall content and/or composition
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: The sequence is a functional homolog of SEQ ID NO 442 in the 10/412,699 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 1863 in the 10/374,780 US patent application
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 822 in the 10/412,699 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 271 in the 11/479,226 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 592 in the 10/374,780 US patent application
  misc_feature: The sequence is a functional homolog of SEQ ID NO 786 in the 11/435,388 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 796 in the 11/435,388 US patent application
  misc_feature: The sequence is a functional homolog of SEQ ID NO 1681 in the 10/374,780 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 58 in the 10/666,642 US patent application
  misc_feature: The sequence is a functional homolog of SEQ ID NO 836 in the 10/412,699 US patent application
  misc_feature: The sequence is a functional homolog of SEQ ID NO 1680 in the 11/479,226 US patent application
  misc_feature: The sequence is a functional homolog of SEQ ID NO 202 in the 10/666,642 US patent application
  misc_feature: The sequence is a functional homolog of SEQ ID NO 852 in the 10/412,699 US patent application
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: Functional homolog of the protein sequence given in SEQ ID NO 50235
  misc_feature: Useful for biocontainment applications
  misc_feature: The sequence is a functional homolog of SEQ ID NO 1071 in the 10/412,699 US patent application
  misc_feature: The sequence is a functional homolog of SEQ ID NO 587 in the 10/374,780 US patent application
  misc_feature: The sequence is a functional homolog of SEQ ID NO 728 in the 11/435,388 US patent application
  misc_feature: The sequence is a functional homolog of SEQ ID NO 1917 in the 10/374,780 US patent application
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: The sequence is a functional homolog of SEQ ID NO 726 in the 11/435,388 US patent application
  misc_feature: The sequence is a functional homolog of SEQ ID NO 794 in the 11/435,388 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: Functional homolog of the protein sequence given in SEQ ID NO 50236
  misc_feature: Useful for making plants with modulated biomass
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: The sequence is a functional homolog of SEQ ID NO 743 in the 10/666,642 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: Functional homolog of the protein sequence given in SEQ ID NO 50237
  misc_feature: Useful for making plants with modulated low light sensitivity
  misc_feature: The sequence is a functional homolog of SEQ ID NO 792 in the 11/435,388 US patent application
  misc_feature: The sequence is a functional homolog of SEQ ID NO 788 in the 11/435,388 US patent application
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 1100 in the 10/225,066 US patent application
  misc_feature: The sequence is a functional homolog of SEQ ID NO 158 in the 10/412,699 US patent application
  misc_feature: The sequence is a functional homolog of SEQ ID NO 2268 in the 10/374,780 US patent application
  misc_feature: The sequence is a functional homolog of SEQ ID NO 357 in the 11/479,226 US patent application
  misc_feature: The sequence is a functional homolog of SEQ ID NO 480 in the 11/435,388 US patent application
  misc_feature: The sequence is a functional homolog of SEQ ID NO 112 in the 11/375,241 US patent application
  misc_feature: The sequence is a functional homolog of SEQ ID NO 2398 in the 10/374,780 US patent application
  misc_feature: The sequence is a functional homolog of SEQ ID NO 466 in the 10/412,699 US patent application
  misc_feature: The sequence is a functional homolog of SEQ ID NO 580 in the 10/225,066 US patent application
  misc_feature: Functional homolog of the protein sequence given in SEQ ID NO 50238
  misc_feature: Useful for making plants with altered terpenoid content
  misc_feature: The sequence is a functional homolog of SEQ ID NO 790 in the 11/435,388 US patent application
  misc_feature: The sequence is a functional homolog of SEQ ID NO 178 in the 10/412,699 US patent application
  misc_feature: The sequence is a functional homolog of SEQ ID NO 389 in the 11/479,226 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 1656 in the 11/479,226 US patent application
  misc_feature: The sequence is a functional homolog of SEQ ID NO 834 in the 10/412,699 US patent application
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 1746 in the 10/412,699 US patent application
  misc_feature: The sequence is a functional homolog of SEQ ID NO 1970 in the 10/374,780 US patent application
  misc_feature: The sequence is a functional homolog of SEQ ID NO 452 in the 10/225,066 US patent application
  misc_feature: The sequence is a functional homolog of SEQ ID NO 584 in the 11/435,388 US patent application
  misc_feature: The sequence is a functional homolog of SEQ ID NO 446 in the 10/412,699 US patent application
  misc_feature: The sequence is a functional homolog of SEQ ID NO 196 in the 10/225,066 US patent application
  misc_feature: The sequence is a functional homolog of SEQ ID NO 2900 in the 10/374,780 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 1540 in the 10/374,780 US patent application
  misc_feature: The sequence is a functional homolog of SEQ ID NO 1634 in the 10/412,699 US patent application
  misc_feature: The sequence is a functional homolog of SEQ ID NO 36 in US patent 7193132
  misc_feature: The sequence is a functional homolog of SEQ ID NO 504 in the 10/666,642 US patent application
  misc_feature: The sequence is a functional homolog of SEQ ID NO 896 in the 11/435,388 US patent application
  misc_feature: The sequence is a functional homolog of SEQ ID NO 232 in the 10/225,066 US patent application
  misc_feature: The sequence is a functional homolog of SEQ ID NO 264 in the 10/374,780 US patent application
  misc_feature: The sequence is a functional homolog of SEQ ID NO 534 in the 11/435,388 US patent application
  misc_feature: The sequence is a functional homolog of SEQ ID NO 1625 in the 10/412,699 US patent application
  misc_feature: The sequence is a functional homolog of SEQ ID NO 978 in the 10/666,642 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 2574 in the 10/374,780 US patent application
  misc_feature: The sequence is a functional homolog of SEQ ID NO 278 in the 10/225,066 US patent application
  misc_feature: The sequence is a functional homolog of SEQ ID NO 170 in the 10/412,699 US patent application
  misc_feature: The sequence is a functional homolog of SEQ ID NO 1756 in the 10/412,699 US patent application
  misc_feature: The sequence is a functional homolog of SEQ ID NO 1980 in the 10/374,780 US patent application
  misc_feature: The sequence is a functional homolog of SEQ ID NO 750 in the 10/225,066 US patent application
  misc_feature: The sequence is a functional homolog of SEQ ID NO 1564 in the 10/374,780 US patent application
  misc_feature: The sequence is a functional homolog of SEQ ID NO 1572 in the 10/374,780 US patent application
  misc_feature: The sequence is a functional homolog of SEQ ID NO 1566 in the 10/374,780 US patent application
  misc_feature: The sequence is a functional homolog of SEQ ID NO 1408 in the 11/479,226 US patent application
  misc_feature: The sequence is a functional homolog of SEQ ID NO 664 in the 10/412,699 US patent application
  misc_feature: The sequence is a functional homolog of SEQ ID NO 126 in the 10/412,699 US patent application
  misc_feature: The sequence is a functional homolog of SEQ ID NO 1563 in the 10/374,780 US patent application
  misc_feature: The sequence is a functional homolog of SEQ ID NO 1626 in the 10/412,699 US patent application
  misc_feature: The sequence is a functional homolog of SEQ ID NO 979 in the 10/666,642 US patent application
  misc_feature: The sequence is a functional homolog of SEQ ID NO 156 in the 10/225,068 US patent application
  misc_feature: The sequence is a functional homolog of SEQ ID NO 262 in the 10/374,780 US patent application
  misc_feature: The sequence is a functional homolog of SEQ ID NO 282 in the 10/225,066 US patent application
  misc_feature: The sequence is a functional homolog of SEQ ID NO 186 in the 10/412,699 US patent application
  misc_feature: The sequence is a functional homolog of SEQ ID NO 1565 in the 10/374,780 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 1541 in the 10/374,780 US patent application
  misc_feature: The sequence is a functional homolog of SEQ ID NO 1635 in the 10/412,699 US patent application
  misc_feature: The sequence is a functional homolog of SEQ ID NO 2178 in the 10/374,780 US patent application
  misc_feature: The sequence is a functional homolog of SEQ ID NO 124 in the 10/412,699 US patent application
  misc_feature: The sequence is a functional homolog of SEQ ID NO 1742 in the 10/412,699 US patent application
  misc_feature: The sequence is a functional homolog of SEQ ID NO 1966 in the 10/374,780 US patent application
  misc_feature: The sequence is a functional homolog of SEQ ID NO 299 in the 11/479,226 US patent application
  misc_feature: The sequence is a functional homolog of SEQ ID NO 168 in the 10/225,066 US patent application
  misc_feature: The sequence is a functional homolog of SEQ ID NO 2718 in the 10/374,780 US patent application
  misc_feature: Functional homolog of the protein sequence given in SEQ ID NO 50239
  misc_feature: Useful for making plants with modulated flowering time
  misc_feature: The sequence is a functional homolog of SEQ ID NO 1434 in the 10/666,642 US patent application
  misc_feature: The sequence is a functional homolog of SEQ ID NO 1850 in the 10/412,699 US patent application
  misc_feature: The sequence is a functional homolog of SEQ ID NO 848 in the 10/412,699 US patent application
  misc_feature: Functional homolog of the protein sequence given in SEQ ID NO 50240
  misc_feature: Useful for making plants with modulated drought sensitivity
  misc_feature: The sequence is a functional homolog of SEQ ID NO 2556 in the 10/374,780 US patent application
  misc_feature: The sequence is a functional homolog of SEQ ID NO 272 in the 10/225,066 US patent application
  misc_feature: The sequence is a functional homolog of SEQ ID NO 528 in the 11/435,388 US patent application
  misc_feature: The sequence is a functional homolog of SEQ ID NO 1688 in the 11/479,226 US patent application
  misc_feature: The sequence is a functional homolog of SEQ ID NO 1852 in the 10/412,699 US patent application
  misc_feature: The sequence is a functional homolog of SEQ ID NO 2094 in the 10/374,780 US patent application
  misc_feature: The sequence is a functional homolog of SEQ ID NO 116 in the 11/375,241 US patent application
  misc_feature: The sequence is a functional homolog of SEQ ID NO 1648 in the 11/479,226 US patent application
  misc_feature: The sequence is a functional homolog of SEQ ID NO 2566 in the 10/374,780 US patent application
  misc_feature: The sequence is a functional homolog of SEQ ID NO 632 in the 10/225,066 US patent application
  misc_feature: The sequence is a functional homolog of SEQ ID NO 650 in the 11/435,388 US patent application
  misc_feature: The sequence is a functional homolog of SEQ ID NO 826 in the 10/412,699 US patent application
  misc_feature: The sequence is a functional homolog of SEQ ID NO 1914 in the 10/412,699 US patent application
  misc_feature: The sequence is a functional homolog of SEQ ID NO 2174 in the 10/374,780 US patent application
  misc_feature: The sequence is a functional homolog of SEQ ID NO 956 in the 10/225,066 US patent application
  misc_feature: Functional homolog of the protein sequence given in SEQ ID NO 50241
  misc_feature: Useful for making plants with enhanced nutritional value
  misc_feature: Useful for making plants with modulated heat sensitivity
  misc_feature: The sequence is a functional homolog of SEQ ID NO 200 in the 10/666,642 US patent application
  misc_feature: The sequence is a functional homolog of SEQ ID NO 830 in the 10/412,699 US patent application
  misc_feature: The sequence is a functional homolog of SEQ ID NO 160 in the 10/412,699 US patent application
  misc_feature: The sequence is a functional homolog of SEQ ID NO 214 in the 10/225,068 US patent application
  misc_feature: The sequence is a functional homolog of SEQ ID NO 2270 in the 10/374,780 US patent application
  misc_feature: The sequence is a functional homolog of SEQ ID NO 361 in the 11/479,226 US patent application
  misc_feature: The sequence is a functional homolog of SEQ ID NO 462 in the 10/225,066 US patent application
  misc_feature: The sequence is a functional homolog of SEQ ID NO 482 in the 11/435,388 US patent application
  misc_feature: The sequence is a functional homolog of SEQ ID NO 1015 in the 11/479,226 US patent application
  misc_feature: The sequence is a functional homolog of SEQ ID NO 138 in the 10/374,780 US patent application
  misc_feature: The sequence is a functional homolog of SEQ ID NO 436 in the 10/412,699 US patent application
  misc_feature: The sequence is a functional homolog of SEQ ID NO 60 in the 11/375,241 US patent application
  misc_feature: The sequence is a functional homolog of SEQ ID NO 1692 in the 11/479,226 US patent application
  misc_feature: The sequence is a functional homolog of SEQ ID NO 1672 in the 11/479,226 US patent application
  misc_feature: The sequence is a functional homolog of SEQ ID NO 846 in the 10/412,699 US patent application
  misc_feature: The sequence is a functional homolog of SEQ ID NO 1916 in the 10/412,699 US patent application
  misc_feature: The sequence is a functional homolog of SEQ ID NO 2176 in the 10/374,780 US patent application
  misc_feature: The sequence is a functional homolog of SEQ ID NO 1652 in the 11/479,226 US patent application
  misc_feature: The sequence is a functional homolog of SEQ ID NO 2568 in the 10/374,780 US patent application
  misc_feature: The sequence is a functional homolog of SEQ ID NO 60 in the 10/225,066 US patent application
  misc_feature: The sequence is a functional homolog of SEQ ID NO 828 in the 10/412,699 US patent application
  misc_feature: The sequence is a functional homolog of SEQ ID NO 2898 in the 10/374,780 US patent application
  misc_feature: The sequence is a functional homolog of SEQ ID NO 494 in the 10/225,066 US patent application
MGRSPCCEQAHTNKGAWTKEEDQRLIAYIKAHGEGCWRSLPKAAGLLRCGKSCRLR

SEQ ID NO: 10693 - DNA, 1261 bp, Panicum virgatum
  misc_feature: Ceres CLONE 1725201
  misc_feature: Encodes the peptide sequence at SEQ ID NO. 10694
cgaccacggccagctcacgccggtgcgccgcccgcccaagcgctcgcgccgcaccgcgcgctcactcaccaaccgctgctataagtctattaaacacaggcccagatccgcgcctccaccctgcccggctgcccgccaccgcccgcaaacaccaaccggcaccgcaccagcagcaccgtcgaccaccatggccgcctcgccgcgcctcgccatcctgctggcgctcctggcggcgtcgtcggcgcttgccgcggcgcagaaggccaaggtgaagccggcgcccgggccggccggggcggcggacgcggccccgccgacggacgtgaacaaggcgctcaaggacgaccagttcagcgagttcaagcagctgctccacgacacgcgcgtggacacccagatcaacgcgcagctgacggacagctacaacgggctgaccatcttcgcgcccaccaacgccgccttcgacaagctcaaggccggcgtgctcaacgggctgtcgccgcaggaccagatccagctggtcctctactgcgtgctccccagattctacagcctctccatgctcggcaccctcaacggcaaggtcaacacgcaggggtccggacacgacggcccctacaagtacgacatcaagcgcgcgggcaacaacgtcaacgtctccaccggcgtcaactccatgctcctggggagccccgtgagcaaggacttcccgctcgccgtctaccccgtcgacaaggtgccgctcccgtacgagctcttcggccccaagccgcccaccccggcgcccgcgccggccccggccccggccaagtccaagaccaagaagaagcacaagaaggccaccggcatcgccgagccgcccgtggccgacgactccaccgcctcggacggggacaagaagtcggcggccgcgcccgccgccggggtggccaggtgggtcgccgcgctcggggtgctcggcgccgctgtcctcggcggcctcttctgaggaaggatagaatcattcgaacatccggagatcagagggtgctggactggtggtggtggtgtgatccatggatgagatctcgtgcgtcgtgcattgccacgcacgatcgagctggcgtccccgtacactcatcgatcgatcgattattgatccctttaccgtgcatttgtgcgtccatcggctttattctttctctccctctttctttcttttttttggcttcttggtgatttgtatttgtaacttaatgtggtatacactagtacttcttgc

SEQ ID NO: 10694 - protein, 266 aa, Panicum virgatum
  misc_feature: Ceres CLONE 1725201
  misc_feature (54)..(187): Pfam Name: Fasciclin Pfam Description: Fasciclin domain
  misc_feature: Functional homolog of the protein sequence given in SEQ ID NO 50242
  misc_feature: Useful for making plants with altered carbohydrate content
MAASPRLAILLALLAASSALAAAQKAKVKPAPGPAGAADAAPPTDVNKALKDDQFSEFKQLLHDTRVDTQINAQLTDSYNGLTIFAPTNAAFDKLKAGVLNGLSPQDQIQLVLYCVLPRFYSLSMLGTLNGKVNTQGSGHDGPYKYDIKRAGNNVNVSTGVNSMLLGSPVSKDFPLAVYPVDKVPLPYELFGPKPPTPAPAPAPAPAKSKTKKKHKKATGIAEPPVADDSTASDGDKKSAAAPAAGVARWVAALGVLGAAVLGGLF

SEQ ID NO: 10695 - DNA, 1054 bp, Panicum virgatum
  misc_feature: Ceres CLONE 1725219
  misc_feature: Encodes the peptide sequence at SEQ ID NO. 10696
gcaagccagaagctgctgcagcatccacccatccttcccatcctgctctcgagctccaagcctccgacccgacggcgcgcctgctcagctagccggggacgaacgcaaccgagcagcatccatggccgtgttggtggcgaggcaggggcgcgagctgcagcgctacagccagcgcaccggcgggcgcatcgtggtggggtgcatcccgtaccgcgtgcggtgcgacggcgagctggaggtgctggtgatcacgtcgcagaaggggcacggcatgatgttccccaagggcgggtgggaggaggacgagtccatggacgaggccgcccggcgcgaggccctggaggaggccggcgtcctcggcgacaccgagccggtgctcggcttctggcactacaagagccgccgctacgtcgaccagacctacgagggcttcatgttcccgctccgcgtcgccgacgagctccaccagtggcccgagatggcctcccgcaagcgcacctgggcgacggtgaaccaggtgatggacgggtgcccgcacctgtggatgcgggaggcgctcgagaaactcgtcgcccggcacgccatggccgtgctgcagtccgctctctgatcaggactggagagaagaccacgcgggcggccggcgtgctcccgcaagaaaggaccggcagcacgaacccatgctagcgcgcgcgcacgtcgtcaaggctctcccggtgcagcggcaggccggccggcgctccggcgcccggatttggtcgccctcaccggagagacacggcggcgcgccgcgcgggtggatgctggcggcgctttcttgactcctccggggacgcggagccgtcgtcgcggcagatttttttaaaaaataatcgtagcgagcgaatcattggacacgaaatgtaaacaacaccgaacacgacgcatcatagccgaacaggcgtacagcagcgcggaacgatccacgattatttggagccggtaacagaacaaaatgtaaattagtgctagtaacttcgtatcttggtgccagaattgaatgaaacagctgttc

SEQ ID NO: 10696 - protein, 162 aa, Panicum virgatum
  misc_feature: Ceres CLONE 1725219
  misc_feature (21)..(152): Pfam Name: NUDIX Pfam Description: NUDIX domain
  misc_feature: SWISSPROT Homolog: EC 3.6.1.52 Diphosphoinositol-polyphosphate diphosphatase
MAVLVARQGRELQRYSQRTGGRIVVGCIPYRVRCDGELEVLVITSQKGHGMMFPKGGWEEDESMDEAARREALEEAGVLGDTEPVLGFWHYKSRRYVDQTYEGFMFPLRVADELHQWPEMASRKRTWATVNQVMDGCPHLWMREALEKLVARHAMAVLQSAL

SEQ ID NO: 10697 - DNA, 554 bp, Panicum virgatum
  misc_feature: Ceres CLONE 1725220
  misc_feature: Encodes the peptide sequence at SEQ ID NO. 10698
gaggtgatcaccaatccatcgtcatcattcatccggtgctcgacacagccgttgcgcgcggaggtcttgggcggcgacgaagagaccggagagaggaagcagcaggaagagacggacaaagatcagggaatgggcggcgccggcacggcggggaagcgcggcgcgcggtgcgagctctgcgggggggcggcggcggtgcactgcgccgcggactcggcgttcctctgcatgcgctgcgacgccaaggtgcacggcgccaacttcctggcgtccaggcacctgaggcgccgcctgcgcccgggcgcgcccgccggctcggcgtcctcggcgtcgtccgcgtcgagcggctcctgcgtgtccaccacggccgactccgcggggtcggcggccgccgcgtccgcgccggcgcggaagcgcgcggaggcggtgctggaagggtgggccgggcggatgggcttcgcggcggggcccgcgcgccggcgcgcggccggggccgcgggcgcgctccgggcgcygggccgcggcgtagccgccgcccgcgtcccgctccgcgt

SEQ ID NO: 10698 - protein, 141 aa, Panicum virgatum
  misc_feature: Ceres CLONE 1725220
  misc_feature (9)..(55): Pfam Name: zf-B_box Pfam Description: B-box zinc finger
  misc_feature (129)..(129): Xaa is any aa, unknown, or other
MGGAGTAGKRGARCELCGGAAAVHCAADSAFLCMRCDAKVHGANFLASRHLRRRLRPGAPAGSASSASSASSGSCVSTTADSAGSAAAASAPARKRAEAVLEGWAGRMGFAAGPARRRAAGAAGALRAXGRGVAAARVPLR

SEQ ID NO: 10699 - DNA, 1504 bp, Panicum virgatum
  misc_feature: Ceres CLONE 1725230
  misc_feature: Encodes the peptide sequence at SEQ ID NO. 10700
agacagcgactgggcaccgccgcccactctagaatccggccatggagctccgcgagctgggcggcacgggcctccgcgtcagcgccgtcggcttcggcgcctccccgctcggccacgtcttcggggacgtgccccgcgacaccgcccgcgccgccgtccgccgcgcgctcgacctcggcatcaacttcttcgacacctccccgtactacggcggcacggtctcggagtccgtcctcggcgactgcctccgccacgcggccgtcccgcgggaccaggtcgtcgtcgccaccaagtgcggccgctacaaggacgagggcttcgacttctccgccgcccgcgtcgcccgcagcgtcgacgagagcctcgcccgcctggggctcgactacgtcgacatcctccacgcccacgacatcgagttcaccagcctcgaccaggtcgcccgccacctgctcggcggattgccgcgcccacccctgcagctcgcgtaacgcaggatgcggtcgctctgctgacgctcactggtattgtagattgtgagcgagaccgttcccgcgctccggaagatcaaggagagcgggaaggcgcggttcatcgggattaccgggctgcccctcagcatctacccctacgtgctcgaccgggtgccaccgggctcggtggatgtcatcctgtcctactgccactatgggatcaatgacacctccctggtcgatctgctcccctacctgaagagcaagggcgttggggttatcacagcttcgccccttgcgatgggtcttctcacggataatgggcccccagactggcaccccgcaccggaggaacttaagtcggcatgcagggcagctgcagagcactgtagcaaaaaggggaaaagcatcacgaagctagctatgcaatacagcctgatgaacaacgaaatttctacagttcttgttggaatgaactcttcaaaacaggtggaggagaatgtggctgctgcattggagctgtcaacatcaggcattgacaaagaacttctgcatgaagttgaagcaattcttgagcctgtgaagaacatgacttggcctagcggcatccagcaagcctaatgtatggtagcagcttggtcagttgaaacctccagtgtgctggtcgattcagtcaattgtgtgcatccgcatcattgactgctcaatttgcaatcctggatagttgttgatgaaagcgaatgaaggggattgtcgggattttatgggcatgaaaaaaacatggacaataaaagatcgaagctgatcactgaataagcctttcgcatacacgtgggatggattaaaacatactattttggctgccaaacaagcacattgcatcctacttttacagcgaaacaaggcgttgttggattatacaccacacgtggattccaattttcttctttcattcatctgttatcctgggggtccaatgtaaatttatctcgcttcactgtcgatacagtatttttcaatataaaagtatgcag

SEQ ID NO: 10700 - protein, 148 aa, Panicum virgatum
  misc_feature: Ceres CLONE 1725230
  misc_feature: SWISSPROT Homolog: EC 1.1.1.107 Pyridoxal 4-dehydrogenase
MELRELGGTGLRVSAVGFGASPLGHVFGDVPRDTARAAVRRALDLGINFFDTSPYYGGTVSESVLGDCLRHAAVPRDQVVVATKCGRYKDEGFDFSAARVARSVDESLARLGLDYVDILHAHDIEFTSLDQVARHLLGGLPRPPLQLA

SEQ ID NO: 10701 - DNA, 1295 bp, Panicum virgatum
  misc_feature: Ceres CLONE 1725231
  misc_feature: Encodes the peptide sequence at SEQ ID NO. 10702
accccgattgggaatccgcatccggccctgcggcggcactcaattcccctggcttgccccccgccagcacgccccccggcgcgcgcccggcgccctgatcccgcggaaccggcgaggaagcccggcgccctcccgggaccgccggtgcgtccgtccccccgtcccctcgctcggtcagtgttcacatgatgtatcatgctaagaatttttctgtgccctttgctccgcagagggctcagaataatgagcatgcaagtaatattggagctattggtggaaccaacataagcaaccctgctaatcctgtaggaagtgggaaacaacgtctaagatggacttcagatctccataatcgctttgtggatgccatcgcccagcttggtggaccagatagagctacacctaaaggggtgctcactgtgatgggtgtgccagggatcacaatttatcatgtaaagagccatttgcagaagtatcgccttgcaaagtatataccagaatctcctgctgaaggttccaaggacgaaaaaaaggattcaagtgattccctctctaacatggattctgcaccaggattacaaatcaatgaagcattaaagatgcaaatggaggttcagaagcggctacatgagcagctcgaggttcaaaggcaattgcagctgagaattgaagctcaaggcaggtacttgcaaatgatcatagaggagcaacaaaagcttggtggatcattcaaagcttcagaggatcagaagctttcacattcacctccaagcttagatgagtaccctgagagcacgcagccttctcccaagaaaccaaggatagatgcgttgtcaccggattcagagcgcgatacgactcaagcagaattcgaatcccatctgattggtccatgggatcaagaaatctgcgggaaaaatctatgcggcgttgcattcccagtagaggagttcaaagcagaccctggtatgagcaaatcataaagcaaagccttccttgacgggcattcatcatagttgacctctccactagatgatctcattcgcatgtgaatatatatcatcttaacaacagaatgttgttcggatcttctggatccgcacctgatccttgcagccatggccagttgttgtcacggtagtattcatcatacaactcttgtaattatgaggatggtgttacaaagtttctagccagcatttccttagccctgagttgaaccatgtagcaagaaagaggacatgtttacacgcaatacatttgctgtgaagagggcgtgcccctggagctacctg

SEQ ID NO: 10702 - protein, 265 aa, Panicum virgatum
  misc_feature: Ceres CLONE 1725231
  misc_feature (47)..(98): Pfam Name: Myb_DNA-binding Pfam Description: Myb-like DNA-binding domain
  misc_feature: Functional homolog of the protein sequence given in SEQ ID NO 50243
  misc_feature: Useful for making plants with altered lignin content
  misc_feature: Useful for making plants with altered terpenoid content
  misc_feature: The sequence is a functional homolog of SEQ ID NO 1857 in the 10/374,780 US patent application
  misc_feature: The sequence is a functional homolog of SEQ ID NO 2862 in the 10/374,780 US patent application
  misc_feature: The sequence is a functional homolog of SEQ ID NO 990 in the 10/225,066 US patent application
  misc_feature: The sequence is a functional homolog of SEQ ID NO 1062 in the 10/225,066 US patent application
  misc_feature: The sequence is a functional homolog of SEQ ID NO 2788 in the 10/374,780 US patent application
  misc_feature: The sequence is a functional homolog of SEQ ID NO 1589 in the 11/479,226 US patent application
  misc_feature: The sequence is a functional homolog of SEQ ID NO 762 in the 10/412,699 US patent application
  misc_feature: The sequence is a functional homolog of SEQ ID NO 1097 in the 11/479,226 US patent application
  misc_feature: The sequence is a functional homolog of SEQ ID NO 2402 in the 10/374,780 US patent application
  misc_feature: The sequence is a functional homolog of SEQ ID NO 548 in the 10/225,066 US patent application
  misc_feature: The sequence is a functional homolog of SEQ ID NO 190 in the 10/225,066 US patent application
  misc_feature: The sequence is a functional homolog of SEQ ID NO 2866 in the 10/374,780 US patent application
  misc_feature: Functional homolog of the protein sequence given in SEQ ID NO 50244
  misc_feature: Useful for making plants with altered alkaloid content
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 2000 in the 11/479,226 US patent application
MMYHAKNFSVPFAPQRAQNNEHASNIGAIGGTNISNPANPVGSGKQRLRWTSDLHNRFVDAIAQLGGPDRATPKGVLTVMGVPGITIYHVKSHLQKYRLAKYIPESPAEGSKDEKKDSSDSLSNMDSAPGLQINEALKMQMEVQKRLHEQLEVQRQLQLRIEAQGRYLQMIIEEQQKLGGSFKASEDQKLSHSPPSLDEYPESTQPSPKKPRIDALSPDSERDTTQAEFESHLIGPWDQEICGKNLCGVAFPVEEFKADPGMSKS

SEQ ID NO: 10703 - DNA, 1178 bp, Panicum virgatum
  misc_feature: Ceres CLONE 1725236
  misc_feature: Encodes the peptide sequence at SEQ ID NO. 10704
tgcaccccaacccaaaagatcctgcttctcctcacggttaccaccataccgcaactccacccaaagccataaaaaccagtgcagcaacaatgagagctaaagtttccaggctctgaattttcagcatgttggcgcccgcatcagcccaggtgcctcacaccatacgacctgttgcaaactgctttgggcttcatcgacgatctgaccgatatcacagatggcgagggactggaaagaagatgattctttccactcgtggtgtgctcgaatccagcaatggtgcaccatccggtggccttgtgaaaaaaagaaagattgtggagcacattattctgcttcgagccaagccaaacatctcagatgctgaagagaaagatatgctggattatctatatacatcacaataccagatgagagggatactcacaatctcgttgggccgcatagaggagccaaatagcgagaactttacgcacgctgtcttcatgcgttttcagcagaaagaagacattgtgaagttctacagtagtgcctactattccaaaattcttgatgaccacgtaaaacctgtttcctatggctcagtttctgtagatttcgagtctgaggtggaagatgacattattcccctctttcgtaggggagagaaaagctggtccttgtgtcaggattttaactacggtgttgagtttatgttgctcatgtctttcgtggaaactgcatctcgagaggcaatggaggatgcatcatcttctctgcagaggttgatcatccaatgcagttcatttattgttcaggcaacctgtggccactgtttgaatccggaaaacggatataatcacgctgcagtgatccggtttccatcatttgatgacttcaagttgttccgggagagcatggagtacaaggatatgtgggcatcaaagttccatcctattgtggagaaatccctccagctacatttcaccgtcgaccccgtggggaaccagctgatgtagaccagccatgcctctgcactcttcagatgaacacagaccttgctgggagtcgaacaacatctctgctcatatgggaatgttttactgtcgtgtgcactctgtcccaaagtgtgcctgcaaattgtgctccacaacaacttcttgtagtatactcaatataaagaagagaatgaacactgg

SEQ ID NO: 10704 - protein, 290 aa, Panicum virgatum
  misc_feature: Ceres CLONE 1725236
  misc_feature (65)..(160): Pfam Name: Dabb Pfam Description: Stress responsive A/B Barrel Domain
  misc_feature (187)..(282): Pfam Name: Dabb Pfam Description: Stress responsive A/B Barrel Domain
MLAPASAQVPHTIRPVANCFGLHRRSDRYHRWRGTGKKMILSTRGVLESSNGAPSGGLVKKRKIVEHIILLRAKPNISDAEEKDMLDYLYTSQYQMRGILTISLGRIEEPNSENFTHAVFMRFQQKEDIVKFYSSAYYSKILDDHVKPVSYGSVSVDFESEVEDDIIPLFRRGEKSWSLCQDFNYGVEFMLLMSFVETASREAMEDASSSLQRLIIQCSSFIVQATCGHCLNPENGYNHAAVIRFPSFDDFKLFRESMEYKDMWASKFHPIVEKSLQLHFTVDPVGNQLM

SEQ ID NO: 10705 - DNA, 750 bp, Panicum virgatum
  misc_feature: Ceres CLONE 1725242
  misc_feature: Encodes the peptide sequence at SEQ ID NO. 10706
acagaaacatctgaattgttattcccccagctgcagaggaacaggcagagcttggccagaataattcaggatggccgcaggcgtgctgtgcttcagggcgtttgccctctccatggcctgccttctccttgccgtgcccctactagtggctcaggacccttccaagctgagcctggagtactactccaagacatgcccgaatgtggagcacgttgtccgcacggagatggagtgcgcggtgcgtgccgacacccgcaatgccgccctaatgcttcgcctgcatttccatgactgcttcgttcagggatgtgatggatcagtgctgcttgatgacaccgcgaccatgattggggagaagcaggcggaccagaacgtcaactcgctaaaagagttcgagctggtcgacaagatcaaggagaagctggaagccgagtgccctggaacagtttcttgcgcagacttgctcgccattgcagctagggacgcagttgtgctggtaggtgggccttactgggatgtcccggtaggaagattggactccaagaaagcaagcctggacctagcaaacagtgacatccctacagctcagcagggccttctcacactcattgccaaattctggcagaaaggccttgatgccactgacatggtggccctcgttggctcccacacgattggatttgccaggtgcgagaatttccgcgacaggatctacggcgactttgaaatgacatcaaagttcaatccgtc

SEQ ID NO: 10706 - protein, 226 aa, Panicum virgatum
  misc_feature: Ceres CLONE 1725242
  misc_feature (49)..(225): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 50245
  misc_feature: Useful for making plants with altered carbohydrate content
  misc_feature: Functional homolog of the protein sequence given in SEQ ID NO 50246
  misc_feature: Useful for making plants with altered cell wall content and/or composition
MAAGVLCFRAFALSMACLLLAVPLLVAQDPSKLSLEYYSKTCPNVEHVVRTEMECAVRADTRNAALMLRLHFHDCFVQGCDGSVLLDDTATMIGEKQADQNVNSLKEFELVDKIKEKLEAECPGTVSCADLLAIAARDAVVLVGGPYWDVPVGRLDSKKASLDLANSDIPTAQQGLLTLIAKFWQKGLDATDMVALVGSHTIGFARCENFRDRIYGDFEMTSKFNP

SEQ ID NO: 10707 - DNA, 1075 bp, Panicum virgatum
  misc_feature: Ceres CLONE 1725243
  misc_feature: Encodes the peptide sequence at SEQ ID NO. 10708
atccaccaccgctcgatcagccgaacaatctccccggacacgcgcgcagaaccgaagatggccgcgtcggcgctgcaccagaccaccagcttcctcgggcaggccctggtaccccgccccgccggcgccggcgccgacgccggcggccgcatcaccatgcgccgcaccgtgaagagcgctccccagagcatctggtacgggcccgaccgccccaagtacctgagccccttctccgagcagacgccgtcgtacctgaccggcgagttccccggcgactacgggtgggacaccgcggggctctccgccgacccggagaccttcgcgcgcaaccgcgagctggaggtgatccactcgcggtgggcgatgctgggcgcgctggggtgcgtgttcccggagatcctggccaagaacggcgtcaagttcggcgaggcggtgtggttcaaggccggcgcgcagatcttctccgagggcgggctggactacctgggcaaccccaacctggtgcacgcgcagagcatcctggccatctgggcgtgccaggtggtgctcatgggcttcgtcgagggctaccgcgtcggcggcgggccgctcggcgaggggctcgacaaggtgtacccgggcggcgccttcgacccgctggggcttgccgacgacccggacaccgccgcggagctcaaggtgaaggagctcaagaacggccgcctcgccatgttctccatgttcggattcttcgtgcaggccatcgtcaccggcaagggccccatcgagaacctcttcgaccacgtcgccgaccccgtcgccaacaacgcctgggcctacgccaccaacttcgtcccgggcaactgatcaatctgctctgcttgtaggcgtgtagtagttgcacgcgccggcgtatgctccgtgtgctctcgtcagattcagattcagatcatcagcagctgcgtctgcctgcacgtgatgtaaacttgtaaactacgcacggagatgcatgtgtaagatcaatggtgtacgtgtaccataccattcatgagtggatcttcttgtcactcatccatcgatgctgattctttctctc

SEQ ID NO: 10708 - protein, 262 aa, Panicum virgatum
  misc_feature: Ceres CLONE 1725243
  misc_feature (61)..(229): Pfam Name: Chloroa_b-bind Pfam Description: Chlorophyll A-B binding protein
MAASALHQTTSFLGQALVPRPAGAGADAGGRITMRRTVKSAPQSIWYGPDRPKYLSPFSEQTPSYLTGEFPGDYGWDTAGLSADPETFARNRELEVIHSRWAMLGALGCVFPEILAKNGVKFGEAVWFKAGAQIFSEGGLDYLGNPNLVHAQSILAIWACQVVLMGFVEGYRVGGGPLGEGLDKVYPGGAFDPLGLADDPDTAAELKVKELKNGRLAMFSMFGFFVQAIVTGKGPIENLFDHVADPVANNAWAYATNFVPGN

SEQ ID NO: 10709 - DNA, 1430 bp, Panicum virgatum
  misc_feature: Ceres CLONE 1725245
  misc_feature: Encodes the peptide sequence at SEQ ID NO. 10710
atgctcgcaggccaagcagtgccgcactggtagcggtaggcggtagctcacctacaacaaatctgctgcagcagccggcgccgttgcgctgtgcaaaatttactctgccgcctgcaacggtgcagcagtctccccttcctcctcctcatcttcttccgttccttctccgtccgatccctggcgatggcgatgcgggcggaggtgctgctgctggctgtgctcgtggcggccgcggccctcctgtcgtcgctcgactcgcgcagcgacgtgcggctgctggaggtaggggacagcgacctcgagctggtcccgctcgacggcgccgcggggccggagagcgtcgtcttcgacaggggcggcgaggggccgtacgcgggcgtgtcggacgggagggtcctcaggtggcggccggaggagcggcggtgggaggagcactcctgctcggcgccggagctgttggacggctgcagaggctcgcaggacccgggccgggaggacgagtgcgggcgtccactgggcctcaagttccacgacgagacgggggagctttacgtcgcggacgcctaccacgggctcagagtggttgggccggaggagaacgtgtccaggccgctgctgccgccggagtggcaaggcagccgccccttcagcttcgccaacggcatcgagatcgactacgaaaccggagccgtctacttcaccgagaccagcacaaggtttcggagaagggagtttctgaacattgttatatccggtgacaacaccggtaggttgttgaaatatgaccccaagagcaatgaagtggaagtcttggttgatggtctagctttcgccaatggcttggctatgagcacggatggcagttaccttctccttgcagaaaccacaaccggcagaattctaaggtactggatcaagacgccaaaagcttcaaccctagaagaagttgcccggctgccttggtttccggataacatcaagatgagccctagaggagggttctgggttggtctccatgccaagagagggaagatcgccgagtggtcgatctcgtacccttggctaaggagattgatattgaagctgccgatgcggcatgtccaacgtgcctcctggctcttgaatcggcttggccgtcaggttatagcgttgaggttgaatgaggatgggaaaacaatggaggcaattagtgttcacggtgctattcaaaaggttttcaagtcggtcagcgaggtggaagaaaggggtgggagcctgtagataggctctgttatggcgccatttcttggagtttacaggttgtagaagtatttaaatggtatgattgaatatacatttgcatatatatggtagttgtttaatagaggaaaataatattatacgcgtgtatatggtaccatttgccctacaatatagtgaagattattcac

SEQ ID NO: 10710 - protein, 358 aa, Panicum virgatum
  misc_feature: Ceres CLONE 1725245
  misc_feature (159)..(247): Pfam Name: Str_synth Pfam Description: Strictosidine synthase
  misc_feature: SWISSPROT Homolog: EC 4.3.3.2 Strictosidine synthase
MAMRAEVLLLAVLVAAAALLSSLDSRSDVRLLEVGDSDLELVPLDGAAGPESVVFDRGGEGPYAGVSDGRVLRWRPEERRWEEHSCSAPELLDGCRGSQDPGREDECGRPLGLKFHDETGELYVADAYHGLRVVGPEENVSRPLLPPEWQGSRPFSFANGIEIDYETGAVYFTETSTRFRRREFLNIVISGDNTGRLLKYDPKSNEVEVLVDGLAFANGLAMSTDGSYLLLAETTTGRILRYWIKTPKASTLEEVARLPWFPDNIKMSPRGGFWVGLHAKRGKIAEWSISYPWLRRLILKLPMRHVQRASWLLNRLGRQVIALRLNEDGKTMEAISVHGAIQKVFKSVSEVEERGGSL

SEQ ID NO: 10711 - DNA, 1120 bp, Panicum virgatum
  misc_feature: Ceres CLONE 1725254
  misc_feature: Encodes the peptide sequence at SEQ ID NO. 10712
atcacacccaaccagcaaccaggcagagcacagagcagagcagcaagaggagtgatccgatcgagatggccgccgccaccatggccctcacctcccgcgcgctcgccggcaagccggcggccagcagcaggtacatgttcggcgggggccgcatcacgatgcgcaagaccgcggcgaagccgaagccggcggcggccggcagcccctggtacgggcccgaccgcgtcctgtacctgggcccgctctccggcgagcccccgagctacctgaccggcgagttccccggcgactacgggtgggacaccgcggggctgtcggccgacccggagaccttcgccaagaaccgcgagctggaggtgatccactgccgctgggccatgctgggcgcgctggggtgtgtgttcccggagctcctcgcccgcaacggcgtcaagttcggcgaggcggtgtggttcaaggcgggggcccagatcttcagcgagggcgggctggactacctgggcaacccgagcctggtgcacgcgcagagcatcctggccatctgggcgtgccaggtggtgctcatgggcgccgtcgaggggtaccgcgtcgccggcggcccgctcggggaggtggtggacccgctgtacccggggggcagcttcgacccgctggggctcgccgacgacccggaggccttcgcggagctcaaggtgaaggagatcaagaacggccgcctcgccatgttctccatgttcggcttcttcgtgcaggccatcgtcaccggcaaagggccgctggagaacctcgccgaccacctcgccgaccccgtcaacaacaacgcctgggcctacgccaccaacttcgtccccggcaagtgagcgagctcgatcgctatgtgaagctagcgacccgggggatcgcgcgtgtaccgtagacgtacgtattcgtatgtactgctacatactgcagggtgtacgagtatctgtgaaggggacctgggatcgcacagtttggtgtacaagtagtagtgtatttgtacgcatgcatgcgctggaccggatcaatgaaatacgcgcaccgcgttgtaaatttgtagcaaaataatttataataaagtgtaatctctaaatctgtatct

SEQ ID NO: 10712 - protein, 264 aa, Panicum virgatum
  misc_feature: Ceres CLONE 1725254
  misc_feature (63)..(231): Pfam Name: Chloroa_b-bind Pfam Description: Chlorophyll A-B binding protein
MAAATMALTSRALAGKPAASSRYMFGGGRITMRKTAAKPKPAAAGSPWYGPDRVLYLGPLSGEPPSYLTGEFPGDYGWDTAGLSADPETFAKNRELEVIHCRWAMLGALGCVFPELLARNGVKFGEAVWFKAGAQIFSEGGLDYLGNPSLVHAQSILAIWACQVVLMGAVEGYRVAGGPLGEVVDPLYPGGSFDPLGLADDPEAFAELKVKEIKNGRLAMFSMFGFFVQAIVTGKGPLENLADHLADPVNNNAWAYATNFVPGK

SEQ ID NO: 10713 - DNA, 1323 bp, Panicum virgatum
  misc_feature: Ceres CLONE 1725258
  misc_feature: Encodes the peptide sequence at SEQ ID NO. 10714
ctctcctcctcccgaaccgcacgcagacaccacagaccgcagggcaccccgtgtcggcagcggagcagaagcagcgagcgatccatggcgacccaggctctcctctccgggcggcagctgctcgaccgccccgtgcagtcggccgtctcccggtcctcgtcggccaggaaggcgcccttcgtcgtcagggccagctccagcccaccggccaagcaaggcgccgaccggcagctgtggttcgcgtccaagcagtccctctcctacctcgatggcacgctgcccggcgactacggcttcgacccgctggggctgtcggacccggagggcaccggggggttcatcgagcccaagtggctggcctacggcgaggtgatcaacggccggttcgccatgctgggcgcggcgggcgccatcgccccggagatcttcggcaagctgggcatcatcccggcggagacggcgctgccgtggttcaagacgggggtcatcccgcccgcgggcacctacaactactgggccgactcgtacacgctcttcgtcttcaacatggcgctcatgggcttcgccgagcaccgccgcctccaggactggtacaacccgggctccatgggcaagcagtacttcctcgggctcgagaagttcctcggcggctccggcgacccctcctacccggggggcccactcttcaacccgctcgggttcggcaagacggagaaggagatgaaggagctcaagctcaaggagatcaagaacggcaggctcgccatgctcgccatcctcggatacttcatccaggggctcgtcaccggcgtcggcccctaccagaacctgctcgaccacctcgccgaccccgtcaacaacaacgtgctcaccagcctcaagttccactagaagccgccgccgccgccgccgcctgttgtcgttgtagtggaagcgagaggtgatcgtcgatgtgctgttcatatgctggcgggctggctggctgatggaagaggtttgcatcgtgtatgatctatccatggccggcctgcttgctgcttgtaacaaattagtaaatccatcctgttaattgagaccagagattgtattgcacatggtaaatcaatgtacaattccgatcgattggggtgatgtcattgtatatggtcatatggtgggcgacgagccgacgacgtccatttcatcttaccatcagttcatggttgtctaccctctatagaacaaaaacaaaaagattatgagcgcagtgattcaagaagagcacgatcttttcttgtgaagatgttcgaacgactttagtttatacaatatagaaaataacgc

SEQ ID NO: 10714 - protein, 268 aa, Panicum virgatum
  misc_feature: Ceres CLONE 1725258
  misc_feature (56)..(239): Pfam Name: Chloroa_b-bind Pfam Description: Chlorophyll A-B binding protein
MATQALLSGRQLLDRPVQSAVSRSSSARKAPFVVRASSSPPAKQGADRQLWFASKQSLSYLDGTLPGDYGFDPLGLSDPEGTGGFIEPKWLAYGEVINGRFAMLGAAGAIAPEIFGKLGIIPAETALPWFKTGVIPPAGTYNYWADSYTLFVFNMALMGFAEHRRLQDWYNPGSMGKQYFLGLEKFLGGSGDPSYPGGPLFNPLGFGKTEKEMKELKLKEIKNGRLAMLAILGYFIQGLVTGVGPYQNLLDHLADPVNNNVLTSLKFH

SEQ ID NO: 10715 - DNA, 1181 bp, Panicum virgatum
  misc_feature: Ceres CLONE 1725261
  misc_feature: Encodes the peptide sequence at SEQ ID NO. 10716
aaaccctaaccccctccagaaccttaaacccttctccccggcggcggctacaagctcctcgtcgactcggaaccatgaggccaccagctggaggacgcggcgggaggggagggagattcgatggcggcggtcgtggcggcggtggccggggctttggtggcggtagaggaaggggggacaggggtggcagaagtggcggcggtggcaggactccgaggggtggcagccgcggtggaaggggcggtcgtggtggtggcatgaagggcgggagcaaggccgtcgtggttccgcacaagcacgccggcatcttcatctccaagtccaaggaggacgccctctgcactaagaacatggtcccgggcgagtccgtctattcagagaagcgcgtctccgtccagaatgaggatgggacaaaggttgaatacagggtgtggaaccccttccgttccaagctggctgctgctgtgctaggtggtgttgacaacatctggattgctcctggtactcgagtgctgtatcttggtgctgcttctggcacaactgtgtctcatgtgtctgatattgttggaccagagggattggtctatgctgttgagttctctcacaggagtggtagggatcttgtcaatatggcaaataagagaaccaatgtgatccccattattgaggatgctaggcaccctgcaaggtaccgcatgttggttggcatggttgatgttatcttctctgatgttgcacagcctgaccaggctaggattttagcccttaatgcttcatacttcttgaagaacggtggccattttgtgatttcaatcaaggctaactgtatcgactccaccatgcctgctgaagctgtgtttgctgctgaggtggagaagctgaagcttgagcagttcaagccatcggagcaggtgaccctggagccctttgagcgcgaccacgcctgcgtggtcggtggctacaggatgccgaagaagcaaaaggctacgtcttaaagagaaggaatggtgtttgatgcgtggccgtcttctttctgagatatattatgttgtatcctggagaaagaacttttgtgcaagtgttagggttttgtagcagctatgttgaactagtgctggtttaacagctactatttggttggatcaagatatggtagtatttccgttcattttccttgcatg

SEQ ID NO: 10716 - protein, 306 aa, Panicum virgatum
  misc_feature: Ceres CLONE 1725261
  misc_feature (67)..(298): Pfam Name: Fibrillarin Pfam Description: Fibrillarin
  misc_feature: Functional homolog of the protein sequence given in SEQ ID NO 50143
  misc_feature: Useful for making plants with altered alkaloid content
  misc_feature: Useful for making plants with altered lignin content
  misc_feature: Functional homolog of the protein sequence given in SEQ ID NO 50144
  misc_feature: Useful for making plants with altered terpenoid content
MRPPAGGRGGRGGRFDGGGRGGGGRGFGGGRGRGDRGGRSGGGGRTPRGGSRGGRGGRGGGMKGGSKAVVVPHKHAGIFISKSKEDALCTKNMVPGESVYSEKRVSVQNEDGTKVEYRVWNPFRSKLAAAVLGGVDNIWIAPGTRVLYLGAASGTTVSHVSDIVGPEGLVYAVEFSHRSGRDLVNMANKRTNVIPIIEDARHPARYRMLVGMVDVIFSDVAQPDQARILALNASYFLKNGGHFVISIKANCIDSTMPAEAVFAAEVEKLKLEQFKPSEQVTLEPFERDHACVVGGYRMPKKQKATS

SEQ ID NO: 10717 - DNA, 1326 bp, Panicum virgatum
  misc_feature: Ceres CLONE 1725262
  misc_feature: Encodes the peptide sequence at SEQ ID NO. 10718
cccgattcccaattccccctctcggccggccgcgaccggattcgttccgccgtccctcgcagccttcgatccgagccgcgggaggtgcgcccgccgatcgagcggtagggcagggcggagggaggaggaggaggatgagcttccaggacctggaggcgggcaacgtccgcggggcgccgctgggcggcgcgcggcggaacggccgggggggccccgcggcgggcggcgccggcgcgtcgcaggccgtcgcgtcgggcgtcttccagatcaacaccgccgtcgccacgttccagcgcctcgtcaacacgctcggcacgcccaaggacacccccgacctgcgcgacaggatacataaaacacggcaacacataacacaactagttaaggatacatcggacaagcttaaacaagctagtgaggcggatcatcgtgtcgaagtcagcgctaccaagaagattgctgatgcaaagctagctaaggatttccaagcagtccttaaagaattccagaaagctcaacggttagcagttgagagagaagctgcatatgcaccttttatttctcaagcaggtctgccacagagctacaattcaagcgaggtgaataatggtgctgataagttggctgagcagcggacacagcttctggaatctagaaggcaagagcttgtcttcttcgataatgaaattgtgttcaacgaggccatcatcgaggagagggatcaggggatacaagagattcagcaccaaattactgaagtaaacgaaatcttcaaagatcttgctgtgctagtccacgaccaaggagcaatgattgatgacattgactcccatatagagaatgcagttgttgcaacttcacaggcaaaaggccagctttcaaaagctgctaaaactcagaagtcgaactcttcactgatatgcttgttgctggtcattttcggagttgtcctgctcatagtgataatagtccttgcagcctaaaaagcttgaagggctcctgaggctccgaaatctgatcaagcttagcatgaagaattccttcataagttatttttgctatgcagtcaggaatgtatcctggtttccgcctggaggtggtggttggcgttctggttgtggtatggtggtgtatgtggtgatggtgtgcgcctggaatgcatcagttcatataagcataatcgtttcctgtcagcctagtgcttcttgtctcacagcctgctctgtttatatctgtaatgtatcgtcgatgattgcgtgctgtagaacaaggaggcttacattatctgtggtatgacatttcttgattccgtaagaaatcatttgc

SEQ ID NO: 10718 - protein, 282 aa, Panicum virgatum
  misc_feature: Ceres CLONE 1725262
  misc_feature (194)..(256): Pfam Name: SNARE Pfam Description: SNARE domain
  misc_feature (26)..(125): Pfam Name: Syntaxin Pfam Description: Syntaxin
MSFQDLEAGNVRGAPLGGARRNGRGGPAAGGAGASQAVASGVFQINTAVATFQRLVNTLGTPKDTPDLRDRIHKTRQHITQLVKDTSDKLKQASEADHRVEVSATKKIADAKLAKDFQAVLKEFQKAQRLAVEREAAYAPFISQAGLPQSYNSSEVNNGADKLAEQRTQLLESRRQELVFFDNEIVFNEAIIEERDQGIQEIQHQITEVNEIFKDLAVLVHDQGAMIDDIDSHIENAVVATSQAKGQLSKAAKTQKSNSSLICLLLVIFGVVLLIVIIVLAA

SEQ ID NO: 10719 - DNA, 971 bp, Panicum virgatum
  misc_feature: Ceres CLONE 1725272
  misc_feature: Encodes the peptide sequence at SEQ ID NO. 10720
acaccacaccacaccacaccgcgtccacatcctcccgcgcttctccgctcagcccgcgcgtttccgctgaggagggatagccgcgcggcgcgtcgaggggcttgtctttgatcgggtagctgaggctgagcgggcggggcaggatgatgtgcgacacggcggccgtggccgtggcggcgccgcggtacaggggcgtgcggaagcgggcgtggggccggttcgcggcggagatccgcgacccggcgaagcgcgcgcgcgtctggctcggcaccttcgactccgccgaggccgcagcgcgcgcctacgacgtcgccgcgcggaccctgcgcggcccgctcgccaggaccaacttcccctgcgcctcctcccgcctcccgctgccctcccgccaccaaggcggctgtggcggcggcctcgtcgcgccgccgcccgccgcgccgacgtgcagctccagctccaccgtcgagtcctccagcggaccccgaggggcgcccagggctgcggcggcggcggcgcctcgaattcggaggcgttcggtgaaaaagccgcggccggcagcgcccgacaccgactgccacagcgactgcgcctcgtcggcctccgtcgtggacgacggcgacgacgcctccacggtccggtcgcgcgcgccgttcgacctcaacgtcccggcgccggtggacggtgaccacgccctcgacctctgcacggagctgcggctctgagcaatatgatcctcgaacaacaacaacagcaaaacatcgaaggcgattttgccccggtcttcttttcctgactaaattctgatatgattgactcgtgctcgagagttctcgttttctttaacgcctcttgtatttggatctgctaccatcttctctgcccattctatttgtacaccagataacatgtaagatgttcacgaattaacacatatcttttcttaaaaaatgaattaacacggatgttgctat

SEQ ID NO: 10720 - protein, 192 aa, Panicum virgatum
  misc_feature: Ceres CLONE 1725272
  misc_feature (13)..(64): Pfam Name: AP2 Pfam Description: AP2 domain
  misc_feature: Functional homolog of the protein sequence given in SEQ ID NO 50247
  misc_feature: Useful for making plants with altered carbohydrate content
  misc_feature: Functional homolog of the protein sequence given in SEQ ID NO 50248
  misc_feature: Useful for making plants with modulated cold sensitivity
  misc_feature: The sequence is a functional homolog of SEQ ID NO 1419 in the 11/479,226 US patent application
  misc_feature: The sequence is a functional homolog of SEQ ID NO 668 in the 10/412,699 US patent application
  misc_feature: Functional homolog of the protein sequence given in SEQ ID NO 50249
  misc_feature: Useful for making plants with altered lignin content
  misc_feature: Functional homolog of the protein sequence given in SEQ ID NO 50250
  misc_feature: Useful for making plants with altered alkaloid content
  misc_feature: The sequence is a functional homolog of SEQ ID NO 1754 in the 10/374,780 US patent application
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: The sequence is a functional homolog of SEQ ID NO 1288 in the 10/374,780 US patent application
  misc_feature: The sequence is a functional homolog of SEQ ID NO 1434 in the 10/412,699 US patent application
  misc_feature: The sequence is a functional homolog of SEQ ID NO 160 in the 10/714,887 US patent application
  misc_feature: The sequence is a functional homolog of SEQ ID NO 160 in the 11/435,388 US patent application
  misc_feature: The sequence is a functional homolog of SEQ ID NO 28 in the 10/903,236 US patent application
  misc_feature: The sequence is a functional homolog of SEQ ID NO 16 in the 10/903,236 US patent application
  misc_feature: The sequence is a functional homolog of SEQ ID NO 2209 in the 10/666,642 US patent application
  misc_feature: The sequence is a functional homolog of SEQ ID NO 76 in the 10/714,887 US patent application
  misc_feature: The sequence is a functional homolog of SEQ ID NO 76 in the 11/435,388 US patent application
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
  misc_feature: Functional homolog of the protein sequence given in SEQ ID NO 50251
  misc_feature: Useful for making plants with altered oil content
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: The sequence is a functional homolog of SEQ ID NO 1464 in the 10/666,642 US patent application
  misc_feature: The sequence is a functional homolog of SEQ ID NO 170 in the 10/225,066 US patent application
  misc_feature: The sequence is a functional homolog of SEQ ID NO 2 in the 10/903,236 US patent application
  misc_feature: The sequence is a functional homolog of SEQ ID NO 278 in the 10/666,642 US patent application
  misc_feature: The sequence is a functional homolog of SEQ ID NO 332 in the 10/374,780 US patent application
  misc_feature: The sequence is a functional homolog of SEQ ID NO 46 in the 10/225,068 US patent application
  misc_feature: The sequence is a functional homolog of SEQ ID NO 8 in the 10/714,887 US patent application
  misc_feature: The sequence is a functional homolog of SEQ ID NO 8 in the 11/435,388 US patent application
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: The sequence is a functional homolog of SEQ ID NO 200 in the 10/714,887 US patent application
  misc_feature: The sequence is a functional homolog of SEQ ID NO 200 in the 11/435,388 US patent application
  misc_feature: The sequence is a functional homolog of SEQ ID NO 36 in the 10/903,236 US patent application
  misc_feature: The sequence is a functional homolog of SEQ ID NO 162 in the 10/714,887 US patent application
  misc_feature: The sequence is a functional homolog of SEQ ID NO 162 in the 11/435,388 US patent application
  misc_feature: The sequence is a functional homolog of SEQ ID NO 30 in the 10/903,236 US patent application
MMCDTAAVAVAAPRYRGVRKRAWGRFAAEIRDPAKRARVWLGTFDSAEAAARAYDVAARTLRGPLARTNFPCASSRLPLPSRHQGGCGGGLVAPPPAAPTCSSSSTVESSSGPRGAPRAAAAAAPRIRRRSVKKPRPAAPDTDCHSDCASSASVVDDGDDASTVRSRAPFDLNVPAPVDGDHALDLCTELRL

SEQ ID NO: 10721 - DNA, 1101 bp, Panicum virgatum
  misc_feature: Ceres CLONE 1725274
  misc_feature: Encodes the peptide sequence at SEQ ID NO. 10722
ttccctggaaggcctcggttgacacttgacaccagcaactcaaccattctccctgtgtcatcaccagcaacaggaagatggggtcgttagatgccacacgagctgagctcggcctcgttgttctgtacctgaacaaagccgaggctagggacaagatctgcagggcgattcagtatggctcaaagttcataagcaacgggcagcccggcaccgcgcaggatgtcgatagatccaccaccttagctcgaaaagttttccgtctcctcaagtgggtcaatgatcttcatgctcttatcagcccacctgctaaaggggctcctctcacactggtcctgcttggcaagtctaaaaatgcactgctttcgacgttcttattcctggatcaaattgtgtggttaggacgaacaggaattatcaagaacaaggaggcgacggaccgggttgccaggatatccctgtactgttggatggcttcttctgcctgtgctagtctagtcgagcttggagagcttaagaggctatcgaaatcaatgaggaagcttgcaagagagctgaggcacactgataaatacgagaacgaacagtaccagaacaaaatgaagcagtcggatgagcggctgctggccctggtgaaggcggccacggacgtggtcgtggccatcgggcttcttcagctggcacccaagaaggtgactcccagagtgacgggagctctcggattcgtcacctcgctcatctcctgctatcagcaactcccttcccgcgcccccgtggccaaagtcaaggcatgagatgggtcgctcgaaattgagctgtacttcagcatggaccgcacgataatttcggctagtctgatttcagctgatttaataatggtctgtgcgaaagaataagctggaaatagacaaacagagcagaagagagggaataatgtacagtagtatatgtgtgccggtgcagaatgcatgggttggcacctatgctttcatgcggtactctttttttgattgcctagtaatggacgtggttacgtcttgtatgttcacacgtggctcctacctgtgccaccgtggataatattcttcttttagtgtgttgtac

SEQ ID NO: 10722 - protein, 237 aa, Panicum virgatum
  misc_feature: Ceres CLONE 1725274
  misc_feature (11)..(226): Pfam Name: PEX11 Pfam Description: Peroxisomal biogenesis factor 11 (PEX11)
MGSLDATRAELGLVVLYLNKAEARDKICRAIQYGSKFISNGQPGTAQDVDRSTTLARKVFRLLKWVNDLHALISPPAKGAPLTLVLLGKSKNALLSTFLFLDQIVWLGRTGIIKNKEATDRVARISLYCWMASSACASLVELGELKRLSKSMRKLARELRHTDKYENEQYQNKMKQSDERLLALVKAATDVVVAIGLLQLAPKKVTPRVTGALGFVTSLISCYQQLPSRAPVAKVKA

SEQ ID NO: 10723 - DNA, 1068 bp, Panicum virgatum
  misc_feature: Ceres CLONE 1725276
  misc_feature: Encodes the peptide sequence at SEQ ID NO. 10724
actcttgtcatcccggcggcggcggcgcgaaaggagaaggaggaggagcagcagcaggcggcgccgaagagcaagctacccacccccagcccgcaaccatggctaggggattgaagaagcatctcaagaggctcaatgcgcctaagcattggatgctggacaaacttggtggagcttttgcccccaaaccatcttctggtcctcacaagtccagggagtgccttcccctcatccttatcatcaggaacaggctcaagtatgctctgacataccgtgaggttatttctatcctgatgcaacgccatgtcttggttgatggcaaggtcaggactgacaagacctaccctgctgggttcatggatgtcatttccattcccaagaccaatgagaactacaggcttctctatgacaccaagggtcgcttccgtcttcaccccatcagggatgaggacgccaagttgaagctctgcaaggttaggtctgttcagtttggccagaagggcatcccctaccttaacacctatgatggtcgcaccatccgctaccctgacccgctcatcaaggccaacgataccatcaagatcgaccttgagaccaacaagattgttgacttcatcaagtttgatgttggcaatgttgtcatggtgactggtggaaggaacactgggcgtgttggtgtgatcaagaacagggagaagcataagggcagctttgagaccatccacgttgaggatgcccagggccaccagttcgccacccgtctgggcaatgtgttcaccattggcaagggcaacaagccgtgggtgagcctgcccaagggcaagggtatcaagctcagcatcatcgaggagcagaggaagcgggatgccgctgcccaggctgccgccaacgcataaattcctcagaatgtgcttttgagtttttctatagcgagtttatctgcaaggatatagaactatctacccagactatcctgttttaagttttgccctatggttgttgattcgcgaactgatgtttgcagttagctgtaatgcgactatttacttattgaagtgcattttcgag

SEQ ID NO: 10724 - protein, 265 aa, Panicum virgatum
  misc_feature: Ceres CLONE 1725276
  misc_feature (94)..(170): Pfam Name: Ribosomal_S4e Pfam Description: Ribosomal family S4e
  misc_feature (3)..(40): Pfam Name: RS4NT Pfam Description: RS4NT (NUC023) domain
  misc_feature (177)..(211): Pfam Name: KOW Pfam Description: KOW motif
  misc_feature (42)..(90): Pfam Name: S4 Pfam Description: S4 domain
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDAKLKLCKVRSVQFGQKGIPYLNTYDGRTIRYPDPLIKANDTIKIDLETNKIVDFIKFDVGNVVMVTGGRNTGRVGVIKNREKHKGSFETIHVEDAQGHQFATRLGNVFTIGKGNKPWVSLPKGKGIKLSIIEEQRKRDAAAQAAANA

SEQ ID NO: 10725 - DNA, 1191 bp, Panicum virgatum
  misc_feature: Ceres CLONE 1725281
  misc_feature: Encodes the peptide sequence at SEQ ID NO. 10726
atcgacgacctatcgatcccctggtaggtgtctccgtctagcgctttccactcccaccgagctctatccacaccgctttccactctccttctgctcctctcgtcatcgtccatggagggcaaggacgcctccgacgcgccaccggccggcgcgccgcagcccgcggctcctgctcctcccgcggcggggcagccgcagccgcagccgcccgaggcggcgcggtggggcacgcggcagatgggctcgccggcggcgcctggggcgcacccggagaaccaggaggcggcgcgggggacggcggcgcgcggggaccaggagctgccgccctacgtcatcgtgggggagcccgtggcggcgccgaggcagaaaggggacagccccatggagcacatcctcgacttcttcaacgtctggagccgcaaggccgaggagctcgcgtccaacatctggttcaacctgaagacggcgccgtcgatgtcggacgcggcgatgggcaagctgagcctgggcgccaaggcgctgtcggagggcgggttcgagaagctgtacaggcagaccttctccgcgggccccgacgagcagctgcggaagaccttcgcgtgctacctgtcgacggccaccggccccgtcgccggcacgctctacctgaccaccgcgaccgtcgccttctgcagcgaccggccgctctccttcgccgcgccgtcggggcagaccgcctggagctactacaaggtggcgatcccgctggacaaggtcgcggcggtggagccggtgacgaccaaggagagcccgccggagaagtacgtgcacgtcgtcaccgtcgacgcccacgacttctggttcatgggcttcgtcagctacgacaaggccgtgcaccacctcaccgaggccgtcgtctcccaccgctcgtcgtcccagtaccagaagcagggcgtcgccggcgccggcgccgccgccggccagtgaggagagctccgttcgccggagacgcgtgtgtagctagccctgtgcagtgtagcgactagtgagtgctttgtgtcatgcttgttgcttgtgagatggacggtctaccgactcctgtgtgcgtgtggtacatttccgtggtatttgtgaattgtttgatgtgtatacacttgttaatactacctccatttcaaattatagttcgcgatttcaaattgtttgactttc

SEQ ID NO: 10726 - protein, 284 aa, Panicum virgatum
  misc_feature: Ceres CLONE 1725281
  misc_feature (144)..(222): Pfam Name: GRAM Pfam Description: GRAM domain
MEGKDASDAPPAGAPQPAAPAPPAAGQPQPQPPEAARWGTRQMGSPAAPGAHPENQEAARGTAARGDQELPPYVIVGEPVAAPRQKGDSPMEHILDFFNVWSRKAEELASNIWFNLKTAPSMSDAAMGKLSLGAKALSEGGFEKLYRQTFSAGPDEQLRKTFACYLSTATGPVAGTLYLTTATVAFCSDRPLSFAAPSGQTAWSYYKVAIPLDKVAAVEPVTTKESPPEKYVHVVTVDAHDFWFMGFVSYDKAVHHLTEAVVSHRSSSQYQKQGVAGAGAAAGQ

SEQ ID NO: 10727 - DNA, 1364 bp, Panicum virgatum
  misc_feature: Ceres CLONE 1725283
  misc_feature: Encodes the peptide sequence at SEQ ID NO. 10728
gccacacgccgagcaaaacaatccaaaacccctcgcggtccgtctccagatcccaccaagcctctccccttcctcggctggcgacaggcagccgctgccgcctcctgcgggttgcggcctgaccggcccggcctctgccgccgccccttatattcagaaccgtgcggagcagagcagagcagtactgcaaagcaagtagaattggcgtatcttccctcctccgtcgaacgggcgaaggaagggaggaggctggagatactggtgggcggctgggagcgccatggattggggtgttccggcattgatgaactccgtagccgacccgtcctaccgggacctctgctgctacggggccggaatcgcagggaacgtcttcgccttcgtcctcttcatctccccactgccgacattcaggcggatcgttcggaatggatccacggagcagttctcgggtatgccctacatctactcgcttctcaactgcctcatctgcatgtggtacggcctacccttcgtctcgtacggcgtcatcctcgtcaccaccgtcaactccatcggcgccgtcttccagctcgcctacaccgccgtattcatcgcctttgctgacgccaaggagaggttgaaggtctctggtctcctggcagctgtctttctggtgttcggcctgattgtatatgttagtttggccttgcttgatcacaatacacgacagacattcgttggatatctcagcgtcgcatccctcatattcatgttcgcgtctcccttgtccatcattaatctggtcatcaggacaaagagtgtggagtacatgcccttctatttatcattttctatgttcctgatgagtgtatcgttcttcatatatggggtgctgctacatgatttcttcgtatatattccaaacgggattggaaccatattgggtatcatacagttgttgctgtatgcctacttcagaaaagaatcaagaggggaagacagactgccactgctagtcacaaatacatgagcatgccaaagaacaaggtacattgtcgaagctgtgtaaattcttgaggcgtgtacagtcgttgctttattctgcttttgtatgcttggaattcagaggataaacttgacctgtcagtgctgaatgggcggcctatcacattgatttgagtcaaggccgatgttatctgaggacagaagactccaattgccgtagttgtccaaatcgtttcgtttctgtcaaaagcacgctgtttattagttatgtgtacacgcaacacaagtcagagtttctctgtatattccacggtagatgcttcaaattgttggaatcatttgtttaaatatataaatatatatatatatatatacgt

SEQ ID NO: 10728 - protein, 243 aa, Panicum virgatum
  misc_feature: Ceres CLONE 1725283
  misc_feature (145)..(231): Pfam Name: MtN3_slv Pfam Description: MtN3/saliva family
  misc_feature (26)..(112): Pfam Name: MtN3_slv Pfam Description: MtN3/saliva family
MDWGVPALMNSVADPSYRDLCCYGAGIAGNVFAFVLFISPLPTFRRIVRNGSTEQFSGMPYIYSLLNCLICMWYGLPFVSYGVILVTTVNSIGAVFQLAYTAVFIAFADAKERLKVSGLLAAVFLVFGLIVYVSLALLDHNTRQTFVGYLSVASLIFMFASPLSIINLVIRTKSVEYMPFYLSFSMFLMSVSFFIYGVLLHDFFVYIPNGIGTILGIIQLLLYAYFRKESRGEDRLPLLVTNT

SEQ ID NO: 10729 - DNA, 1256 bp, Panicum virgatum
  misc_feature: Ceres CLONE 1725285
  misc_feature: Encodes the peptide sequence at SEQ ID NO. 10730
attttgtcgcgccccagctcctcgtggcgaaacttggcggcgccctctgacctctcctttttccacacctttcgatcggcggccgcctccctcctccccctccactcccatccccttccccgagcagccgccgccgccgccgccatggccatgaagggacccggcctcttctccgacatcggcaagaaggccaaggatctgctcacgaaggactacacctacgaccagaagttcaccatctccactgtcagcgcctccggagtgagcctcacttccacagctgtgaagaaaggagggctttatactcttgatgtcagctcagtttacaagtacaagaatactcttgttgacattaaagtggacactgaatcaaacatatctaccaccttgactgtgttggatgccctgccatccacaaaacttgtgacatctgtgaagctgcctgactacaattctggaaaggtggaattgcaatacttccatgagaatgcaagttttgctactgttgttggcacgaagccatcacctgtggttgaacttaatgggacagttggtgctcaaggagtttcgtttggggcagaagctgggtatgatactgctacaggaaaacttaccaagtacactgctgcaattggtgtaaccaagccagactaccatgctgcattcattctggccgacaaaggtgacaccattaaagtgtcaggtgtttatcaccttgatgagaagcggaaagcctcagctgtggctgaactaacacggaggctctcaacaaatgagaacacactcactgttggtggcctatacaagattgatcctcagacagccgtgaaggcaaggctcaacaacactggaatgcttgccacgcttcttcagcatgagcttaaacccaagtcactcttgacaatctctggtgaattcgataccaaggcactggacaggccccccaagtttggcttggcacttgcattgaagccctgatcagatcatccccggtcgattgctggtgaatttcgaattctttggttgtgtttgcaaagctgtagccaataatttgttccacggatatgttctgttaacctggcaaaggttcgacgctgtgtgggaaggatccggatgggtcgtctacaacattttttacccatcagtttttgttgtcgaaagcatctgtagacgtatgccggttggttctttagcttaggctctccgacacaatgccactgagtactgaggagccgccacggtaatgttttgcatgc

SEQ ID NO: 10730 - protein, 277 aa, Panicum virgatum
  misc_feature: Ceres CLONE 1725285
  misc_feature (5)..(270): Pfam Name: Porin_3 Pfam Description: Eukaryotic porin
MAMKGPGLFSDIGKKAKDLLTKDYTYDQKFTISTVSASGVSLTSTAVKKGGLYTLDVSSVYKYKNTLVDIKVDTESNISTTLTVLDALPSTKLVTSVKLPDYNSGKVELQYFHENASFATVVGTKPSPVVELNGTVGAQGVSFGAEAGYDTATGKLTKYTAAIGVTKPDYHAAFILADKGDTIKVSGVYHLDEKRKASAVAELTRRLSTNENTLTVGGLYKIDPQTAVKARLNNTGMLATLLQHELKPKSLLTISGEFDTKALDRPPKFGLALALKP

SEQ ID NO: 10731 - DNA, 1180 bp, Panicum virgatum
  misc_feature: Ceres CLONE 1725289
  misc_feature: Encodes the peptide sequence at SEQ ID NO. 10732
acaagatgggggttcatgcatactggagctcgtgagatgaggtctcaggaccctcctcatctggctcgtccccttttccaagaacccgaggctctaaaagaaacctcagtctttcaacttctgtcgaagtgaacttgtatatatctgagggttgaaacttcttagtttagttctaagttattataaattccttcgactactatgggcgggatccagcagctttatgaggtctgtaaaggatcattatctgaaaagggacctatatcttctgaagccatcgataaagtccgtgttgtattagacaagatcacaccttgtgatgttggactagagtgtgaagctcaagctgcacgtgtttggcggagtccacaaacccggagtaggaaaagagtttttccttccagccctgcgatcagataccgccacatttatgagtgcaaaagcttctcaattgggatattctgcataccagcatcgtccatcattccactccacaaccatcctggaatgactgtacttagcaaagttttatatggcacagtgcatgtcaaagcatatgactggattgataacgctgaacctcttagcttattaaaagtgaaacctgcgaaggttgtaagagatggtgaaatgtcggcgccttgtgcggccatggttcttcatccagaagaagaggggaacatacatgctttcaaagccatcacaccatgtgctatcctagacattttaacacctccttactcttcagaaggtgggaggcactgctcctacttccggagctgcccaaagtcagacccatcgggcgttttattgaaccgtacaaagggatctgaatttgtttggcttgaagaataccagccccgtgacagctttgtcattagaagggacctgtacacaggacctgctttaaagttatgagaagatcatgcgcagcataataattgctttctttagtttcttaagttataaagaagtacatagccatgcaaatcattccatttccccatttgctttgcacttttatttagaggcacgtaattattccattcgattcgatcagatttatgtattttaaggtaattttattgtacatttaatgtgtaactcgctaacaaaatatttatataattatataaaagtgaaggtatttttgagccttcctttggatacaggcctccag

SEQ ID NO: 10732 - protein, 238 aa, Panicum virgatum
  misc_feature: Ceres CLONE 1725289
  misc_feature: SWISSPROT Homolog: EC 1.13.11.19 Cysteamine dioxygenase
MGGIQQLYEVCKGSLSEKGPISSEAIDKVRVVLDKITPCDVGLECEAQAARVWRSPQTRSRKRVFPSSPAIRYRHIYECKSFSIGIFCIPASSIIPLHNHPGMTVLSKVLYGTVHVKAYDWIDNAEPLSLLKVKPAKVVRDGEMSAPCAAMVLHPEEEGNIHAFKAITPCAILDILTPPYSSEGGRHCSYFRSCPKSDPSGVLLNRTKGSEFVWLEEYQPRDSFVIRRDLYTGPALKL

SEQ ID NO: 10733 - DNA, 1340 bp, Panicum virgatum
  misc_feature: Ceres CLONE 1725295
  misc_feature: Encodes the peptide sequence at SEQ ID NO. 10734
aagaaccgcgtgtacatgcacgagccgtatggctgcgtccgcgatcccgcgactgggtccttggttttaccgctttccttgctccgtttattccctctcccgttctactcgcttgcatcaacgtggatatattatcttcgcgtgctcccattgttatattgcctccgccctccgcccctccggcaccgcgaactccttcctcttcctggtgcgctccagttcttggccgatccccaccagcggatcccgcgatcttgctgacttcgtccagggacggcagtttccgcgaaaattgactgccttcccgtcagtcagcatgagcgggaagcgatccttcttcgcatccaagaagaaggccaccaatcctttcgattccgactccgacgacggcgataagaagcagcagcggccggcgcaggcctcctccgtgccgcccccggccgaacagcgtgtctccctcttcggcgccggcgccggcggccaagaaaggggcgggctcttatcctccttgaaggcgccgaggaacagccactaccgaaacgacttccgcgacgctggcggcctggagagccagtcagttcaggagctggaggggtacgcgacgtacaaggccgaggagaccacgcgccgggctcagggatgcgtcacaatagccgaggagatgagggataccgcgtccaagaccctcgtcaccgtccaccagcaggggcagcagatccaccgcacgcacatgatggccgtcgacatcgaccaggacctttccaggagtgagaagctattgggtgatcttgggggcctattttccaagaagtggaagccaaagaaaaatggcacaatcaagggtcctatgctaagtagagatgattccttcataagaaggggcagccatttggagcaaaggcagaaattagggctggtcggtcagcctcgatcggatgtgcgtgaatttcattctgaaccaacatcagcacttgagaaagttgagatggagaaagcaaagcaggatgaggctctgtctgatctaagcgacatactgaccgagctgaaagggatggccgttgacatgggctctgaaattgagaggcaaacaaaggcaatgggagatgcagaaaaggattatgacgagctgaacttccgggttaagggagcaaacactcgagctcgccatctacttggcagataaaaagctatgaattcttgtctctagatgttctatatgtcgatgactagtcttgagggtgctcttgactcctcttttgcactatatggggcatcaagacgtttttttgcattgaattttgatcagaatggttggctgtggacatttcagcttgtattgt

SEQ ID NO: 10734 - protein, 288 aa, Panicum virgatum
  misc_feature: Ceres CLONE 1725295
  misc_feature (228)..(287): Pfam Name: SNARE Pfam Description: SNARE domain
MSGKRSFFASKKKATNPFDSDSDDGDKKQQRPAQASSVPPPAEQRVSLFGAGAGGQERGGLLSSLKAPRNSHYRNDFRDAGGLESQSVQELEGYATYKAEETTRRAQGCVTIAEEMRDTASKTLVTVHQQGQQIHRTHMMAVDIDQDLSRSEKLLGDLGGLFSKKWKPKKNGTIKGPMLSRDDSFIRRGSHLEQRQKLGLVGQPRSDVREFHSEPTSALEKVEMEKAKQDEALSDLSDILTELKGMAVDMGSEIERQTKAMGDAEKDYDELNFRVKGANTRARHLLGR

SEQ ID NO: 10735 - DNA, 923 bp, Panicum virgatum
  misc_feature: Ceres CLONE 1725299
  misc_feature: Encodes the peptide sequence at SEQ ID NO. 10736
gcctcccctggccagcggctgagcccaccaccaccaccacgttccgcgccacgccacgccagcggcatggagccgaggaagggcggcgcacgcgtgccccgggcggtgtccgtcctggcggggctgctggagcgcgccgccgagcgcggcgacgccgggggagacgggggcgccgctcccgcgtcgccgtcggcggcggcgttccggggcaagaccctgccggcgatccccgtgcgacggtacgcggagcggatataccggtacgcggggtgcagccccgcgtgcttcgtcgtcgcctacgtctacctcgaccgcctggctgggcagcgcccgctggacggggatgcggcggcggcggaggcacccgccgtggtcggcgtcgactcctacagcgtgcaccgcctgctcatcaccgccgtcatggtcgccgccaagttcatggacgacatgcacaacaacaacgcctactttgcgcgggtagggggcgtggaggtggcggagatgaacgggctggagctggagctcctcttcgcgctgcgcttccgcctcaacgtcacgccggacaccttcgcgcgctactgcgccgcgctcgagggccagatgctcgtgccgatgccgtcggcggtgcctcccgcctccgaggcggaggaggccgagcgccgccgccgcggcgaccaccaggccgcgctgctgctgattaggaaggccaaggatggtgcagccaccgccgttcgtgatcaggccggggccgggagcagggccgccggcggcgcggtgcccgtcgtcccgagagtggccgtggagatgttcgcccgatgacgacacgattcttttcagttaatttaatttaatttgttggttcctgtcctaggagggcttcgtttccgattgattagttcttgttcttggtgagctgccacgac

SEQ ID NO: 10736 - protein, 250 aa, Panicum virgatum
  misc_feature: Ceres CLONE 1725299
  misc_feature (11)..(161): Pfam Name: Cyclin Pfam Description: Cyclin
MEPRKGGARVPRAVSVLAGLLERAAERGDAGGDGGAAPASPSAAAFRGKTLPAIPVRRYAERIYRYAGCSPACFVVAYVYLDRLAGQRPLDGDAAAAEAPAVVGVDSYSVHRLLITAVMVAAKFMDDMHNNNAYFARVGGVEVAEMNGLELELLFALRFRLNVTPDTFARYCAALEGQMLVPMPSAVPPASEAEEAERRRRGDHQAALLLIRKAKDGAATAVRDQAGAGSRAAGGAVPVVPRVAVEMFAR

SEQ ID NO: 10737 - DNA, 1297 bp, Panicum virgatum
  misc_feature: Ceres CLONE 1725315
  misc_feature: Encodes the peptide sequence at SEQ ID NO. 10738
cccatccacacacacaaacacacaccactgtcatttagctgttcttgttgggcagctgaacaccctgctgtgcactgcagatctcctgctctggagaacaattctcagtttgtcttgcctggttttgctgcagtagttcagacttcagaaggagaaggttttacaggtgcaggagccaagaggttgttgaagggtttgaagacatggaggatgttgtgaagttcatctttggaatttctgggaatgtcattgctctctttctcttcctatccccagtgcctaccttctggaggataatcaggaggaggtcaacagaggacttctcgggagtgccgtacaacatgacgctcctcaactgcctcctatcagcttggtacggcctgccgttcgtgtccccgaacaacatcctggtgtcgacgatcaacggcgcgggcgcggcgatcgaggtcgtgtacgtggtggtcttcctggtgttcgcgtccagccggcggacgcggctgcggatgctgggcctggcgtcggcggtggccgcggtgttcgccgccgtggcgctggtctccctgctggcgctccggggggagggccgcaaactcttctgcggcgtcgccgccaccgtcttctccatctgcatgtacggctcgccgctctccatcatgaggctggtggtgaagaccaagagcgtggagtacatgccgttcctgctgtcgctggcggtgttcctgtgcggcacgtcctggttcgtctacggcctgctcggccgcgaccccttcgtcgcgatccccaacgggtgcgggagcttcctgggcgccgtgcagctcatcttgtacgccatctaccggaacagtggcggcaacaaaaaagccgttgccgagcggggcggcaacaagcagcagcacgccgacggcgacgtggagatggcctccggcgccgacgccaagggcagcagcagtaaggtcgccgacgacgacgtcgacggcgccgcccgcaaggaggaccggctggtgtagctagctagccacttggcgcggtccacggaatctgcttcctgctgatactgctagtagaatagcaagcacgtgtgttagctgccgtctcgaatctcttttccggattctctttctcatgtgcgagtgtaagctttttttttcttcttcccatttctccccgcaaatcggctgttctgctctcccgtgatacgggagcgcgtgtaacaatatttatcatgtactgtcatgtaactgtatcgacttatcgttattattatctttattagtacatgaaagaaaaatcaatgatc

SEQ ID NO: 10738 - protein, 267 aa, Panicum virgatum
  misc_feature: Ceres CLONE 1725315
  misc_feature (130)..(216): Pfam Name: MtN3_slv Pfam Description: MtN3/saliva family
  misc_feature (7)..(96): Pfam Name: MtN3_slv Pfam Description: MtN3/saliva family
MEDVVKFIFGISGNVIALFLFLSPVPTFWRIIRRRSTEDFSGVPYNMTLLNCLLSAWYGLPFVSPNNILVSTINGAGAAIEVVYVVVFLVFASSRRTRLRMLGLASAVAAVFAAVALVSLLALRGEGRKLFCGVAATVFSICMYGSPLSIMRLVVKTKSVEYMPFLLSLAVFLCGTSWFVYGLLGRDPFVAIPNGCGSFLGAVQLILYAIYRNSGGNKKAVAERGGNKQQHADGDVEMASGADAKGSSSKVADDDVDGAARKEDRLV

SEQ ID NO: 10739 - DNA, 937 bp, Panicum virgatum
  misc_feature: Ceres CLONE 1725326
  misc_feature: Encodes the peptide sequence at SEQ ID NO. 10740
aggcaggactggccgctagcagaggggaagcgaagcgaggagagcaatggcgtcgccgtccacgctgtctttgacgtccgccttcccctccccctcctcctcgcgccgcctcacggcatctcgccgggcgacgtctctggtcatcgtcgcccagggaaaggtcaagaagtaccgccaggtcatactgacagacgacatagaagaactaggtcggaagggggatacattgaaggtgcgagctggattctaccgcaatttcctccttcccaagggcaaggccacgcttctaaccccagaagtcctcaaggaaatgcaactcgaacaggagagaatagaagctgagaagaagcgggtcaaagaagagacacaacaacttgctcgagtttttgaaaccatcggggctttcaagattccacgcaaaggcggaaaaggaaaacaaatctttggaagcgtcacagcacaggatgttgttgacataataaagtcacaacttaatagagatgtcgacaagaggcttgtgacagttccagaaatccgtgaaaccggggagtatgttgcagagattaagcttcacccggatgtgacagctcgagtaaggctgaatgtctatgcgaaatgagatgtgcagttactgaagcttgaatggacggtgggggtctgggggagcctgatttcgccagagattttgctgaaaatgccaggcgttgtggtagaaaaatggaggtctggactggttcatcctgcctgtaaagttaattttcagtttgttgatttcgtggagtgaaaactagaaaagtttgtaaaccacagttggtttgaccgcagtttgtaaaccacagttggtttgaccgcagtttgtaaaccacagttggtttgaccgctgaagcatcccttgcatgtttatcatggctgaagaaaaatggctgcagcctttagc

SEQ ID NO: 10740 - protein, 190 aa, Panicum virgatum
  misc_feature: Ceres CLONE 1725326
  misc_feature (104)..(190): Pfam Name: Ribosomal_L9_C Pfam Description: Ribosomal protein L9, C-terminal domain
  misc_feature (43)..(90): Pfam Name: Ribosomal_L9_N Pfam Description: Ribosomal protein L9, N-terminal domain
MASPSTLSLTSAFPSPSSSRRLTASRRATSLVIVAQGKVKKYRQVILTDDIEELGRKGDTLKVRAGFYRNFLLPKGKATLLTPEVLKEMQLEQERIEAEKKRVKEETQQLARVFETIGAFKIPRKGGKGKQIFGSVTAQDVVDIIKSQLNRDVDKRLVTVPEIRETGEYVAEIKLHPDVTARVRLNVYAK

SEQ ID NO: 10741 - DNA, 1373 bp, Panicum virgatum
  misc_feature: Ceres CLONE 1725332
  misc_feature: Encodes the peptide sequence at SEQ ID NO. 10742
aaggatcccccggccgcggctcgccatgtccttcccgcggctcctcgtcctcttcctcctggcggcggcggtggccgcgccgccgcgccgcgcggccgccgcctgcgcggcggacaagttctcgggcaaccgcgtgttcgcgacgtgcgtcgacctgccccgcctgggcgcgtccctgcactggacctacgacaccgcggcgtcgtccctgtccgtcgcgttcctcgccgccccgccctccggcggctgggtcgcctgggggctcaaccccagcgccgacggcatgatcggcacgcaggcgctcatcgccgtccccaagggcggcggcgcgtacgaggtgcagcggtaccccatctccgggtactcgctgggttcccccgggccgctctcctaccagacgtccaacctcgccgccgagctcggcaacgacggccgcctccggattttcgggaccctcaagctcccgaacgggaccggggaggtgaaccaggtctggcaggtgggcccattctccggcgggtccatcggtagccactcgacgactaatgccgacaacctgaactccaaggggaagctgaacctcctcaccggggccagcaccgccgccagcggagggagcagcattctcaggaagagaaatacccatggagtcctgaatgctgtgagctggggccttctgctgccaatgggagccatttttgcgagatacctcaagacattcaaatcggccgatcccgcttggttctacctccatgtcgcgtgccagctgattggatatggtgtcggagtgtctggctgggcgactgggattcatcttggaaacatgtccaagggaatcacttattcagttcacaggaacattgggatcgcagtatttgctcttggtaccctgcagatctttgcgctcttcttgaggccgaagaaggatcacaagtaccggttctactggaacatttaccatcactccatcggttacaccatcatcatactgggcgtcatcaacatcttcaagggaatgtccatcctgagtgtcgaccagaagtggaagacggcctacatcattgccatcggcatcctgggtgccatcgccctgatcctggaggtcgttacatggggcatcgtcttgaagcggaggaaagaggacagcaagacctacaatggcaacgggaacggccacttgccggtatctatgtaatgactctatagtcaggtccctttggcctctatttatcttcagtgttgtgttggtgtgcagatgtaggcgggtagctcctgtgatcatagtgtccaatctccctttttgtatgatagatgtgtgtacactgcacaattatactggagatgagtcacgagtgatgctagtggctttggtc

SEQ ID NO: 10742 - protein, 389 aa, Panicum virgatum
  misc_feature: Ceres CLONE 1725332
  misc_feature: Functional homolog of the protein sequence given in SEQ ID NO 50252
  misc_feature: Useful for making plants with modulated phosphate use efficiency
MSFPRLLVLFLLAAAVAAPPRRAAAACAADKFSGNRVFATCVDLPRLGASLHWTYDTAASSLSVAFLAAPPSGGWVAWGLNPSADGMIGTQALIAVPKGGGAYEVQRYPISGYSLGSPGPLSYQTSNLAAELGNDGRLRIFGTLKLPNGTGEVNQVWQVGPFSGGSIGSHSTTNADNLNSKGKLNLLTGASTAASGGSSILRKRNTHGVLNAVSWGLLLPMGAIFARYLKTFKSADPAWFYLHVACQLIGYGVGVSGWATGIHLGNMSKGITYSVHRNIGIAVFALGTLQIFALFLRPKKDHKYRFYWNIYHHSIGYTIIILGVINIFKGMSILSVDQKWKTAYIIAIGILGAIALILEVVTWGIVLKRRKEDSKTYNGNGNGHLPVSM

SEQ ID NO: 10743 - DNA, 873 bp, Panicum virgatum
  misc_feature: Ceres CLONE 1725357
  misc_feature: Encodes the peptide sequence at SEQ ID NO. 10744
accgcagactcttccgccgtcgtcgcgcctcctcgctcggtaggtaggagaggaagagggcgaaatggtgaagcacaacaacgttatccccaacgggcacttcaagaagcactggcagaactatgtcaagacatggttcaaccagcccgcccgcaagcagcggcgccgcatcgctcgtcaaaagaaggctgcgaagatattcccacgcccaactgctggacctcttcgccctattgtccaatgccaaactctcaagtacaacatgaagtcaagggctgggagaggcttcactcttgaggagctgaaggctgcgggcattccgaagaagcttgctccaaccattggcatttctgtggatcaccgccgcaagaacaaatcacttgagggactccaggctaatgtccagaggctgaagacgtacaaggccaagctggttatcttcccaaggcgtgctcgcaaggtcaaggctggtgactctactcctgaggagcttgccagcgccacccaggtccagggtgactacatgccttttactcgtggtgagaagcgctcggttgaggttgtgaaggtcagcgatgagatgaagtcgttcgcagcgtatggcaagatccgccttgagaggatgaacaagaagcaccttggtgcccgccagaagaaggccgctgaggctgagaaggaagagaagaagtaaagtgaccatcggatatagtatcttctagttgatgctacagccaagggcttgttctaagttttgttttgttcctgaaagtagagaccagtggattgttttggtgtccttgtactgtttgatacctggtacgcatttgcgtacactattatctagtggttcatcggattcttgtcctcttgcgc

SEQ ID NO: 10744 - protein, 208 aa, Panicum virgatum; identical to SEQ ID NO: 10192
  misc_feature: Ceres CLONE 1725357
  misc_feature (6)..(185): Pfam Name: Ribosomal_L13e Pfam Description: Ribosomal protein L13e
  misc_feature: Functional homolog of the protein sequence given in SEQ ID NO 50165
  misc_feature: Useful for making plants with modulated nitrogen use efficiency
  misc_feature: Functional homolog of the protein sequence given in SEQ ID NO 50166
  misc_feature: Useful for making plants with modulated phosphate use efficiency

SEQ ID NO: 10745 - DNA, 1201 bp, Panicum virgatum
  misc_feature: Ceres CLONE 1725364
  misc_feature: Encodes the peptide sequence at SEQ ID NO. 10746
ataccatatccatcttcaattctccatccatcaagtgaagttcagcgcaaatcaccccgatgccgagcatggcggcgccattgctctgcctggcgctgctcctggcgtccggcgccgccgccggcgcccaagctctcaaaaactacccacaggtaaagttcagcaccgcgtcggcgacgccggagaagtacaacacctttatcgccgctgtccgcgccgcgctggtgagcaaagctggggggaagagcaacgggatccccgtgcttctcgaccgggacgacccgctcgcgcttcaaacctacctgaacatcactctgacgaactcggcggggcattcgatcagcctgaagatggatgtcaccggagcttacttcaccgcctacgtggcgtggaagtactcgtgcctgctcaaacgatccggccgggcattctcgtcggcgatctgctattccgatgatccatggtcgagctcagctgccattgctgcggcgctgcagtactccgccgccgccggcgccggcgcccgcgtcgtggtggacgcgtgcccgccgcgcgtccctgcggcgcgcgccgtctgggaggcgcgcgccgacggcacggtggcgctgcgggcgagcgggctggtcctgtcggtgacctcgtcgtcggcgttcgccggcgtcacggtgcggcgcgacgaccgcggcacgggccagtcgtggacgcccaccaacgagaccgcgccgctgaccgcccccgtcgtcgggttcggcgaccgctgcctgcaggcggacggcgtgggggcggtctccctcgcggcctgcggcagcgggatggcgtggtcgctgtaccccgacgggtccgtgcggccgccggcgtggctgtttctccagtggaggtgcctggcggcggacgccggcgggcgggtggcggtgaggttctgcgacgggtccggctcggcctgcgagcgctgggtgttccgcagcgatggcaccgtgctcaacaccggcaccgggatggtcctggacgcgaggccgtcggccggcaagagcggccgctacgacgtcgtcgtgtcgccggccaccggcagcgccacccagcagtgggcactcatgctgtgagctctgatggctgatccgatccgtctgcaacagggctagacagtgtgtcgtgtacaataaagtcgtgtgttgcatggttgctgaataaagtctagctctac

SEQ ID NO: 10746 - protein, 343 aa, Panicum virgatum
  misc_feature: Ceres CLONE 1725364
  misc_feature (221)..(339): Pfam Name: Ricin_B_lectin Pfam Description: Ricin-type beta-trefoil lectin domain
  misc_feature: SWISSPROT Homolog: EC 3.2.2.22 rRNA N-glycosylase
MAAPLLCLALLLASGAAAGAQALKNYPQVKFSTASATPEKYNTFIAAVRAALVSKAGGKSNGIPVLLDRDDPLALQTYLNITLTNSAGHSISLKMDVTGAYFTAYVAWKYSCLLKRSGRAFSSAICYSDDPWSSSAAIAAALQYSAAAGAGARVVVDACPPRVPAARAVWEARADGTVALRASGLVLSVTSSSAFAGVTVRRDDRGTGQSWTPTNETAPLTAPVVGFGDRCLQADGVGAVSLAACGSGMAWSLYPDGSVRPPAWLFLQWRCLAADAGGRVAVRFCDGSGSACERWVFRSDGTVLNTGTGMVLDARPSAGKSGRYDVVVSPATGSATQQWALML

SEQ ID NO: 10747 - DNA, 1337 bp, Panicum virgatum
  misc_feature: Ceres CLONE 1725365
  misc_feature: Encodes the peptide sequence at SEQ ID NO. 10748
aagcacgaccgcgccgccatgggctaccaggacgcgccgagtcgcggcgggaagctatcgctggccagcgtgggcttcgccggccccggcgccggggcgggcgagggcgggtacaaggagctcctcgtcatgcctaaggacgacggcctcgacggcgccaaggtcgcggaggtcatcgccgtcaggcttccggacgtcgcaggggccgtgaagactatcttggggcgcagagaggttagagaatttgccagtggggcattagctggtgctatgtcaaaagctattcttgctccccttgagactatcaggacaaggatggttgtaggagtaggatctaggcatatttttggtacttttgtggagatcattgaacaaaatgggtggcaagggctttgggcgggaaatacaatcaatatgctccgcattattccaacacaagcagtagagctcgcaacattcgagtgtgtcaaaaggagcatggcagaagcacaagagaaatggaaagaggatggatacccaaagatacagcttggcaacctgaaaattgagctgccactccacttcttgtctccagttgctattggcggtgctgctgctggaatagctggcacattggcttgtcatcctcttgaagttatcaaggatcgcttgactgtcagtcgagaggtttatcctaccattagccttgccttcagcaagatctaccagactgaaggcataggtggtctatattctggcctctgtccaacactaattggcatgattccttacagcacatgctacttctttatgtatgatacaatcaagacctcttactgccgcttacataagaaatcatctttgagtcgtcctgagctagtacttattggggctctttcaggcctcactgcaagtacaatcagcttccccctggaagtagcaaggaagcggctcatggtcggagccctgaagggcaagtgcccgcccaacatgattgctgccttgtcggaggtgatcaaggaggacggcctcctgggactttaccggggatggggcgcaagctgcctgaaggtcatgccgaattccggcatcacctggatgttctacgaggcttggaaggacattcttctcgctgacaaggacaagcagtgttagctgctgaacaatgaaggcattgcgccattgccgctcatgaagtttgctcctttggctgagattcctggtaccttttcaagtttcagaatcccacccgtgccgaggaatgggtagataggatgcgttgctctttttggccgatgagtagaagcatttgttgatcctcaccgattctgaacatctgatcgccaatttttgttaac

SEQ ID NO: 10748 - protein, 371 aa, Panicum virgatum
  misc_feature: Ceres CLONE 1725365
  misc_feature (182)..(270): Pfam Name: Mito_carr Pfam Description: Mitochondrial carrier protein
  misc_feature (276)..(367): Pfam Name: Mito_carr Pfam Description: Mitochondrial carrier protein
  misc_feature (75)..(158): Pfam Name: Mito_carr Pfam Description: Mitochondrial carrier protein
MGYQDAPSRGGKLSLASVGFAGPGAGAGEGGYKELLVMPKDDGLDGAKVAEVIAVRLPDVAGAVKTILGRREVREFASGALAGAMSKAILAPLETIRTRMVVGVGSRHIFGTFVEIIEQNGWQGLWAGNTINMLRIIPTQAVELATFECVKRSMAEAQEKWKEDGYPKIQLGNLKIELPLHFLSPVAIGGAAAGIAGTLACHPLEVIKDRLTVSREVYPTISLAFSKIYQTEGIGGLYSGLCPTLIGMIPYSTCYFFMYDTIKTSYCRLHKKSSLSRPELVLIGALSGLTASTISFPLEVARKRLMVGALKGKCPPNMIAALSEVIKEDGLLGLYRGWGASCLKVMPNSGITWMFYEAWKDILLADKDKQC

SEQ ID NO: 10749 - DNA, 1191 bp, Panicum virgatum
  misc_feature: Ceres CLONE 1725367
  misc_feature: Encodes the peptide sequence at SEQ ID NO. 10750
cttccctctcctccgccctctccgattgagtggctcaccttcctcttcccccaaccagattcccaagagctgccgctgttgttggtggaagatctttggcggaagatccgaactcttgtgttggggtttctccgggttttcctgcgctggagggaggtttcgttctcgctgaccatggtttggctgggaagcagcatcttgatgcgcaatctctgagctttatgaagatcgccagccacctgcgccgctcctgcttcctccactccttctcggtcgtcttcctgtactggttttatgtgatctcataacttgccctcacccggatccgccattccccgtgctctccccgtcccctcttcctcctcccttccttcttgctttcctgaagaatcgccgaataatagcactagtactagcagcagcagcagcggtagagaattgtttggtggtgagctaaagatcctgccttgatgtcgtcgtcgtcgctgtcaccggcggggacggggaggatgtccgggtcggacggcgactcggcggccgacacgcaccggcgcgagaagcggcggctgtcgaaccgcgagtcggcgcggcggtcgcggctgcggaagcagcagcacctggacgagctcgtgcaggaggtggcgcggctgcaggccgagaacgcgcgcgtggcggctcgcgccgccgacatcgcgtcgcagtacgcgcgcgtggagcaggagaacaccgtgctccgggcgcgcgccaccgagctcggcgaccggctgcgctcggtcaacgaggtgctccgcgtcgtcgaggagttcagcggcgtcgccatggacatccaggaggagatccccgccgacgacccgctgctccggccgtggcagctgccctaccccgccgccgccatgcccatcggcggcgcgcacatgctccagtactgatgactgatgaggatgcctctccccctgccatgaaggcagctggaggttggcaagaaagaattggctgcattgaggactacataggagggctgtatctgctgctgctgtgttataatctgtattctggttcttcaataattgttgctgttgtttgtctgtgtgtaagtgatgatgatgttcatcttatgtaaggtgtaatttcgtgtttggtttctgtactgtgtcttgtaatgttatgaataagtgttatgatttcctatcc

SEQ ID NO: 10750 - protein, 152 aa, Panicum virgatum
  misc_feature: Ceres CLONE 1725367
  misc_feature (23)..(86): Pfam Name: bZIP_1 Pfam Description: bZIP transcription factor
MSSSSLSPAGTGRMSGSDGDSAADTHRREKRRLSNRESARRSRLRKQQHLDELVQEVARLQAENARVAARAADIASQYARVEQENTVLRARATELGDRLRSVNEVLRVVEEFSGVAMDIQEEIPADDPLLRPWQLPYPAAAMPIGGAHMLQY

SEQ ID NO: 10751 - DNA, 1425 bp, Panicum virgatum
  misc_feature: Ceres CLONE 1725372
  misc_feature: Encodes the peptide sequence at SEQ ID NO. 10752
aaaaaaaaggtccaacccgatcagaggcatcaaaagaatttctcaaaagcatcttcgcctccagcggccgccggaggatccgaaggaacccaaaccgcggacgaggggcggcgcgacggctgtgggcaccatggagagctcgtcgccgtcggtgccgttcccgcagctgcaggcgccggtggagagcacctaccgcgcctgcaccatcccctaccggttcccctccgacaacccgcgcaaggccacgcccgtcgagatccagtggatcgacctcttcctcaaatccgtcccgtccttcaagcagcgcgcggagaacgaccccaccgtgcccgacgcgccggccaaggcggagaagttcgcgcagaggtacacagcaatgcttgaagagatgaagaagaatccagagagccatgggggaccaccagactgcatacttctctgtaggcttcgtgagctagtacttagagagctggggtttatggatatcttcaagaaggttaaggatgaggagaatgccaaggctatgtcactgtttgagggtgttgttcagcgaaatgatgaaattgaagatgatggaaaaagagttgagaacttgatccggggaatcttagctggaaatatttttgatctaggatctgcacagcttgcagaagtttttgctaaagatggcatgtcgttcttggcaagttgccaaaatcttgtatctcgaccttgggttattgatgaccttgatgcatttaagagcaaatgggccaagaaatcatgggaaaaggcagttatctttgtcgataactctggtgctgatgttatcttgggaatattaccatttgcgagggagttgctccgacgtggtgcaaaggtgatacttgctgctaatgacatgccttcgatcaatgacgtcacctatccagaactgattgagattataaacaagctcaaggatgcagatggaaagctagcaggtgtggatgcatccaacctgcttgttgccaactctggtaacgatctgcctgttattgatttgtctagtgtgtcaccagaacttgccttcatggcaaatgatgctgatctggttgtcctagaaggcatgggaagagcaatcgaaactaacctatatgcacaaatgaaatgtgactcgatcaagattggaatggttaagcatcctgaagtcgcccaattttttggaggaagactttatgattgtgtcttcaagttcaacgaggcctgaatgctgagatacctcagctaactcctgttgctgtcgcaattgcagtgctgtaattttcctcgacatccgaaatgcttgtttctgtcttcagtagagatagcaagtgaaataagtctggcttcatggaggtgtcattactcagttgtatgaattgttgcccaaaatgaaacttctgaacttcaagacgtatttgttcc

SEQ ID NO: 10752 - protein, 365 aa, Panicum virgatum
  misc_feature: Ceres CLONE 1725372
  misc_feature: SWISSPROT Homolog: EC 2.7.1.33 Pantothenate kinase
MESSSPSVPFPQLQAPVESTYRACTIPYRFPSDNPRKATPVEIQWIDLFLKSVPSFKQRAENDPTVPDAPAKAEKFAQRYTAMLEEMKKNPESHGGPPDCILLCRLRELVLRELGFMDIFKKVKDEENAKAMSLFEGVVQRNDEIEDDGKRVENLIRGILAGNIFDLGSAQLAEVFAKDGMSFLASCQNLVSRPWVIDDLDAFKSKWAKKSWEKAVIFVDNSGADVILGILPFARELLRRGAKVILAANDMPSINDVTYPELIEIINKLKDADGKLAGVDASNLLVANSGNDLPVIDLSSVSPELAFMANDADLVVLEGMGRAIETNLYAQMKCDSIKIGMVKHPEVAQFFGGRLYDCVFKFNEA

SEQ ID NO: 10753 - DNA, 1092 bp, Panicum virgatum
  misc_feature: Ceres CLONE 1725377
  misc_feature: Encodes the peptide sequence at SEQ ID NO. 10754
ttcgcgccgccgcagcacccaatccttcatccccctcactcaccggagcgccgcggccccccacccttcagcaagccatggcggagcgcggcggggagcgcggtggcgagcgcggcgggttcggcaggggcttcggccgcggcggccgcggcgaccgtggcgggcgccgtggtgggcggcgcgggcagcgccaggaggaggagaagtgggtccccgtcaccaagctcggccgcctcgtgaaggagcagaagatcaccaagatcgaggagatctacctgcactcgctccccgtcaaggagcaccagatcgtggagaccctcctccctggcctcaaggacgaggtcatgaagatcacgcccgtgcagaagcagacgcgcgccgggcagcgcacccgcttcaaggccttcgtcgtcgtcggggactgcgacggccacgtcgggctcggcgtcaagtgcgccaaggaggtggccaccgccatccgcggcgccatcatcctcgccaagctctccgtcgtgcccgtcaggaggggctactggggtaacaagatcggccagccgcacaccgtgccgtgcaaggtcaccggcaagtgcggctccgtcacagtgcgcatggtgcccgcccccaggggttccggcatcgtcgccgcgcgcgtgcccaagaaggtgctgcagttcgctggcattgaggatgtcttcacctcgtcccgcggctccaccaagactcttggcaacttcgtcaaggcaaccttcgactgcctgatgaagacctacggtttccttacacctgagttctggaaggagaccagtttctccaggaccccgttccagcagttcactgatatcctggcaaagcctaccaagggtcttatgcttgaggccccagttgagacagtagaggcttaggatgttggagtaaagagttctacttgcttcgagttctctaatgcacctactatatcatagttaagaacttagggagtcaactttcggtcttctttgcctggatgttgctattttctgtcaagttttggattatggtgcaatgctactcctattgctgaatgctacataaatgtctcatgaatcgtcttcc

SEQ ID NO: 10754 - protein, 274 aa, Panicum virgatum
  misc_feature: Ceres CLONE 1725377
  misc_feature (84)..(150): Pfam Name: Ribosomal_S5 Pfam Description: Ribosomal protein S5, N-terminal domain
  misc_feature (167)..(240): Pfam Name: Ribosomal_S5_C Pfam Description: Ribosomal protein S5, C-terminal domain
MAERGGERGGERGGFGRGFGRGGRGDRGGRRGGRRGQRQEEEKWVPVTKLGRLVKEQKITKIEEIYLHSLPVKEHQIVETLLPGLKDEVMKITPVQKQTRAGQRTRFKAFVVVGDCDGHVGLGVKCAKEVATAIRGAIILAKLSVVPVRRGYWGNKIGQPHTVPCKVTGKCGSVTVRMVPAPRGSGIVAARVPKKVLQFAGIEDVFTSSRGSTKTLGNFVKATFDCLMKTYGFLTPEFWKETSFSRTPFQQFTDILAKPTKGLMLEAPVETVEA

SEQ ID NO: 10755 - DNA, 1257 bp, Panicum virgatum
  misc_feature: Ceres CLONE 1725379
  misc_feature: Encodes the peptide sequence at SEQ ID NO. 10756
attccccgtttcgttctcggctagacccccgcccgaatcgatggagattagggctcctccgacgagcctgaggctcgcggcacccccggcctccgccagcttccgccggaccgccctcaggacctccttcctcaacggcagtgtttcacttagagttctgcgcatacggcaatcaaatgtcaacagatttaggtgcaatgccaacctctttgatagactatctagggttgtcaagtcctatgcaaatgctgttttaagtacattcgaagaccccgaaaagatcctagatcaggcggttcttgagatgaatgatgatttaacaaagatgcggcaagccaccgctcaggtcttggcatctcaaaagcggcttgagaacaaatacaaagctgctgaacaagcttctggtgattggtatcggagggctcagctcgctcttcaaaagggagatgaggatcttgcccgtgaagcccttaagcgccgtaaatcgtatgctgataatgcgagctccttaaaggctcaacttgatcagcagaagggtgttgttgaaaatttgatttcaaataccaagcttcttgagagcaagatagcagaggccaagcagaaaaaggataccctaaaagcccgtgctcaatcagccaagacggcaacaaaagtgagtgaaatgttgggtaatgtaaatacaagtagtgccctttcagcatttgagaaaatggaggaaaaagttatggtgatggagtcccaagcagaggcacttggtcagttagcaactgatgatctagaagggaagtttgcattgctggagacttcatctgttgatgatgatcttgcacaaatgaaaagagaactatctggaagttcattgaaaggggagcttcctccgggtagaacagccgtgaacaactcaggtgcagcacgacctttccccgacctggagattgagaatgaactaaatgagctgcggagaaaggccaaggattattaggttgcaccgttcttgtcgattcagcaggcctgacaaaatctcgtcccccggaaaatagtatagccgcagatttctccattgtgttgttgaaactccagtgcaccctgtttgttaaagagtattgaatcttgcaacattctcggcgttctcccctgcgagtgacatttgtacaggtagggtagctataaattgatgtaaatcacaactcgccctgagcccttttttgcatacaataacatgtataatatgtattactataaagaacaatttttttt

SEQ ID NO: 10756 - protein, 313 aa, Panicum virgatum
  misc_feature: Ceres CLONE 1725379
  misc_feature (55)..(271): Pfam Name: PspA_IM30 Pfam Description: PspA/IM30 family
MEIRAPPTSLRLAAPPASASFRRTALRTSFLNGSVSLRVLRIRQSNVNRFRCNANLFDRLSRVVKSYANAVLSTFEDPEKILDQAVLEMNDDLTKMRQATAQVLASQKRLENKYKAAEQASGDWYRRAQLALQKGDEDLAREALKRRKSYADNASSLKAQLDQQKGVVENLISNTKLLESKIAEAKQKKDTLKARAQSAKTATKVSEMLGNVNTSSALSAFEKMEEKVMVMESQAEALGQLATDDLEGKFALLETSSVDDDLAQMKRELSGSSLKGELPPGRTAVNNSGAARPFPDLEIENELNELRRKAKDY

SEQ ID NO: 10757 - DNA, 1074 bp, Panicum virgatum
  misc_feature: Ceres CLONE 1725385
  misc_feature: Encodes the peptide sequence at SEQ ID NO. 10758
gtcgcgaggatatggcggacgggacgcagggggcgagttcggccgtggcgttgaaggcctcgccatcggcggcggcgatggcgcagggactgcgcggaggtagcaaccctctggaggagtggagcgcgcgcgtgaaggctattgaggccaggttccgcgggtggatggcgaagcagcctatccacatcgaggccgcggctaccacggccgtgggggcgctgcagggcggggcgctgggcatgctcatgggctcgctcactgcagacggagggtcgccgttccccatgccgcagacgccccccaacgccaatccggaggccatggcgtcgttgaagcaggcccaggctttagctggtggacctttggtgcaagcccgaaattttgcagtcatgactggcgcaaatgcaggcatttcttgtgtgatgagaaggatacgagggcaagaggacatccagggcagcatggtagctgcttttggttcgggcgctcttttctccatagtgagcggaatgggaactcctaatccagttgcaaatgcaattacaactggagctgcttttgcagtatttcaaggtggctttttcatgattgggcagaaattctccaagccaccgagtgaagacacatactactctcggacaagaagcatgctgcaccaactgggccttgaaaagtatgagaagaatttcaagaagggactcctcaatgatcaaacattgcctctcctcactgacagtgctctaagagatgtgaagatcccccctggacccagattactcattctcaatcaaattaaaagggaccctgagctggtacgaacgaagtaaagttgcaattgtcaactactggttctgagttgcatagggtttgaaagtgatgccatctctgttttcataataaactttctaggcgtgcgtatttagtaagcaagaatttagctatgttttttgtagttatttgttttgtgttttgtcaatcagtttacgccaatcctattgaattttgaataacagatatttacatggcatcctattgaaatttaaactggtgttgcatacagtgatcaaaccttgg

SEQ ID NO: 10758 - protein, 271 aa, Panicum virgatum
  misc_feature: Ceres CLONE 1725385
  misc_feature (52)..(193): Pfam Name: Tim17 Pfam Description: Tim17/Tim22/Tim23 family
  misc_feature (203)..(264): Pfam Name: SAM_1 Pfam Description: SAM domain (Sterile alpha motif)
MADGTQGASSAVALKASPSAAAMAQGLRGGSNPLEEWSARVKAIEARFRGWMAKQPIHIEAAATTAVGALQGGALGMLMGSLTADGGSPFPMPQTPPNANPEAMASLKQAQALAGGPLVQARNFAVMTGANAGISCVMRRIRGQEDIQGSMVAAFGSGALFSIVSGMGTPNPVANAITTGAAFAVFQGGFFMIGQKFSKPPSEDTYYSRTRSMLHQLGLEKYEKNFKKGLLNDQTLPLLTDSALRDVKIPPGPRLLILNQIKRDPELVRTK

SEQ ID NO: 10759 - DNA, 1036 bp, Panicum virgatum
  misc_feature: Ceres CLONE 1725397
  misc_feature: Encodes the peptide sequence at SEQ ID NO. 10760
accacaaaacagcgcaacgcatcgcggcggctcccccagtctgtctggtcaggtctcacctcccctctgccctcccaatcacccgcccgcgagatcgccgccccaggggggccctagattccgatggcctcgcgccggcgcaccctgctcaaggtcatcatcctcggcgacagcggggttgggaagacgtcgttgatgaaccaatacgtgaacaagaagttcagcaaccagtacaaggctacgattggcgcggatttcctcaccaaggaggtgcagttcgaggacaggctcttcactttgcaaatatggaacacagctggtcaggaaaggtttcagagtcttggtgttgcattctaccggggagcagattgttgtgtcctagtctatgatgttaattctatgaagtcatttgataatctgaacaattggcgtgaagagtttctaattcaggctagcccatcagatccggacaacttcccttttgttcttttgggtaacaaagttgatgtagatggtggcaacagtcgtgtggtctccaagaaaaaggcaaaggcatggtgcgcctctaaagggaacatcccatactttgagacatctgcgaaggatggaacaaatgtcgaagatgctttccagtgtatcgtaaagaacgctctgaagaatgaaccagatgaagaactgtatgtgccggataccgtggatgtggtgggtggcaaccgggcccagagatcatctggttgctgttaaagcctgacacatcatgaggcgttgcgatcatcggctctgcagtaaccttcgcctgggtctccatggttctcaatttcatttgttacctttccagtctcctgctatgtatccaaggccggctgtcccccatgctgtcgattcgtggacgttgtgcagtttcatcagtagcgtcatatcttgtgaatacaatttggcgaaataagagaagtgtaaactaaagttcatccgttatggtctgtgtgcgacagaatatgaagtttgtctagctcggaatagccttatcctcgcgttc

SEQ ID NO: 10760 - protein, 206 aa, Panicum virgatum
  misc_feature: Ceres CLONE 1725397
  misc_feature (10)..(178): Pfam Name: Ras Pfam Description: Ras family
  misc_feature (10)..(128): Pfam Name: Miro Pfam Description: Miro-like protein
  misc_feature: SWISSPROT Homolog: EC 2.7.11.1 Non-specific serine/threonine protein kinase
  misc_feature: Functional homolog of the protein sequence given in SEQ ID NO 50193
  misc_feature: Useful for making plants with modulated water use efficiency
MASRRRTLLKVIILGDSGVGKTSLMNQYVNKKFSNQYKATIGADFLTKEVQFEDRLFTLQIWNTAGQERFQSLGVAFYRGADCCVLVYDVNSMKSFDNLNNWREEFLIQASPSDPDNFPFVLLGNKVDVDGGNSRVVSKKKAKAWCASKGNIPYFETSAKDGTNVEDAFQCIVKNALKNEPDEELYVPDTVDVVGGNRAQRSSGCC

SEQ ID NO: 10761 - DNA, 1220 bp, Panicum virgatum
  misc_feature: Ceres CLONE 1725407
  misc_feature: Encodes the peptide sequence at SEQ ID NO. 10762
acctccagctttccaagccccggaaccttatctccatccaaatcctcatcccaccccatcccgagcgagcgtcatggccgccgcgctcttctccacctccctttcaaccagcttcctcgccctatcctccccgaaacccgccgcaaccgcggcctccgccttcctccccttcaggctgccgctgctcgctgtgtcggcgccgggaaggcgggtgttcgagcccgtggccgtcgcggtctcgtcagagtacgagaccgagggcgcggagcaggaggatgagggagccgaggagttctccgaggacctgaagctgttcgtcggaaacctgccgttcagcgtcgacagcgcgcagctcgccgggctctttgagcaggccggctccgtcgagatggtcgaggttgtatatgatagaatgactggacgaagccgtggatttgggttcgtgacaatgtcctcagctcaagcagctggagccgctgttgagcaattcaatggttatacatttcaaggaagaccactgagggtgaactccgggccaccgccgcctagagatgactccgcaccaagagcaccaagaggcggtggtggcggtgaaagctttgcagattcagcaaacaaggtctatgtggggaatctcgcatggggtgtcgacaactcgacgcttgagaacctgttcagcgagcaagggcaggtgcttgatgctaaggtcatctacgatagggaaagcggcaggtcaaggggatttggttttgtcacctatcgtaccactgaggaggtcaacaatgccatatcaaacctcgatggcatcgacttggatggcagacagatccgagtcacggttgcggaatcaaagccgagacgccaattttgaaatttcatgatggtgatttagaggttaatagtgtgtttcgccaagtgttagttcctagcttctattattgccaccatattatgagtaaaatgaagattcggatgatgggggctggaagtgaaattgttgtataccgggagaatttcccagactgcaatgaacacaaacgctcttatgttcattgcgctttcaaaaagaagtagaaatattcttgtccccgcatgcgtacatagcatcggtcaagaacatatgtgttatgatctaacttttttttctgaatgttcgtgatggtatgtgtcatgtatgatccttctggaaaataaattcagttatttttttcagctgaacc

SEQ ID NO: 10762 - protein, 265 aa, Panicum virgatum
  misc_feature: Ceres CLONE 1725407
  misc_feature (183)..(254): Pfam Name: RRM_1 Pfam Description: RNA recognition motif. (a.k.a. RRM, RBD, or RNP domain)
  misc_feature (80)..(151): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: The sequence is a functional homolog of SEQ ID NO 22 in US patent 7244875
  misc_feature: Functional homolog of the protein sequence given in SEQ ID NO 50183
  misc_feature: Useful for making plants with altered alkaloid content
MAAALFSTSLSTSFLALSSPKPAATAASAFLPFRLPLLAVSAPGRRVFEPVAVAVSSEYETEGAEQEDEGAEEFSEDLKLFVGNLPFSVDSAQLAGLFEQAGSVEMVEVVYDRMTGRSRGFGFVTMSSAQAAGAAVEQFNGYTFQGRPLRVNSGPPPPRDDSAPRAPRGGGGGESFADSANKVYVGNLAWGVDNSTLENLFSEQGQVLDAKVIYDRESGRSRGFGFVTYRTTEEVNNAISNLDGIDLDGRQIRVTVAESKPRRQF

SEQ ID NO: 10763 - DNA, 1194 bp, Panicum virgatum
  misc_feature: Ceres CLONE 1725409
  misc_feature: Encodes the peptide sequence at SEQ ID NO. 10764
accaaacctcaccaaacacatcccgatttcctccccggcatcacctattcagatcaaatccgtcgcatgaaaaataagaaagagcagacgaccgcttcacctgcttcccagttggaattggaaccctgcagacctgtgcgtggtcgctcgcgtgctacaccctccaaaccgagctctagcgggcactcgagagattagctgattaggtaaccaatcttcaacaagaactgccgctttcgtatatatccgagcttttttggccacgcatggacaccttggatcccagccgctgcatcggaagcgtatctccgtgtgcacacccccgtcctccatggccggagctcgcgttgctctggcgctgtgcgccctgctgctgctcgtcgacggcgtggcctggagagccgaggcggcctcgtacaccgtcgggaacagcgccgggtgggatctcagcgcagacttgccgtcgtgggccaacggcaaaaccttctacgtcggcgacgttctaggtacgatcgagaaccttgccagcatcccctgtctcgctcgtccaagcacatgctgcagttcagagtctgtttcctccgcaaccgttcgatcagagaccaaaacgcaatcgacgtccctgatcgcgacacgatttgcttgctcacggtgtgctcctttccttgatccagtgttccagtactccaggtaccacaccctggacgaggtcgacgaggccgggttcaagaactgcagcgcggcgagcgcggtcatgtcccggagcgacggcaacacgacggtgccgctggcggcgcccggcgaccggtacttcatctgcggcaaccagctgcactgcctgggcgggatgaagctgcacgtgctcgtcaaccagccggcggcgggaggagcagcgggagccccggcggggcccccgcaggccccgccgcaggccgccctcccgcccagcaccgacgacgacgccggcgtccccaggctcttcctcggcgggtcccgccggaccacggcgggggcgccgccgctggcggcgtggctgctcgttgctgtggccctgcttgtatgaagaagaggtggccgcggttcaaagcacgggttcgcgatgtcaccgagtttgtactccgcttctttctccctcctgcttgtatgaaatttttgcgagccaacgaatcgaagcgtcaaaaatggcggtttctt

SEQ ID NO: 10764 - protein, 243 aa, Panicum virgatum
  misc_feature: Ceres CLONE 1725409
  misc_feature (109)..(173): Pfam Name: Cu_bind_like Pfam Description: Plastocyanin-like domain
MAGARVALALCALLLLVDGVAWRAEAASYTVGNSAGWDLSADLPSWANGKTFYVGDVLGTIENLASIPCLARPSTCCSSESVSSATVRSETKTQSTSLIATRFACSRCAPFLDPVFQYSRYHTLDEVDEAGFKNCSAASAVMSRSDGNTTVPLAAPGDRYFICGNQLHCLGGMKLHVLVNQPAAGGAAGAPAGPPQAPPQAALPPSTDDDAGVPRLFLGGSRRTTAGAPPLAAWLLVAVALLV

SEQ ID NO: 10765 - DNA, 974 bp, Panicum virgatum
  misc_feature: Ceres CLONE 1725412
  misc_feature: Encodes the peptide sequence at SEQ ID NO. 10766
caatcgaattcagctagggagcccaacacaagcacaagtggaatcaggaatggccatggcggccgtgggcattgccggcggcgcactggcgcccctcctccccacgcagcgcggcggccgccgctgcgcggtctcgttcaggcgcgcggcgtcggtggcggtgcgcgcgtcgtacgaggccggggtgggcgtgatggcgaccaaggttgggatgatgacctacttcgacccggccacggggaagccggtgccggtgacggtcgtcgggttccgggagggcgggaacgtggtgacgcaggtgaagacggcggccacggacgggtacgacgccgtgcaggtcgggtaccacggcgtgcgcgaggacaagctcacgcgcccggagctgggccacctgggcaaggccggcgcgccgccgctgaggcacctgcaggagttcaggctcaccgccgtcgacgcgttcgagcccggccaagagctcgacttcgccgagctcttcaaggagggcgacctcgtcgacgtcaccggtaactccatcggcaaggggttccaaggtggcatcaagaggcacaacttcaagcgtgggttgatgactcacggttccaagagccataggcaactgggttccattggtgctggaacaacaccagggcgggtgtacaaggggaagaagatgcctgggaggatgggagggaccaagaccaagatcaggaagctcaagattgtcaagatcgacaatgacctccgggtcctcatgatcaagggcgctgtaccgggaaagcctggtaatctcctccgcatcgcccctgccaagatcgtcggcaagaacatccccaagaactagaatttttcactaaactttgagtgttccccaccctgctggctgctgcaaactggatgtaatttcttcaccaattaccagtttttgtacacacaagatttcagattagtaatcaccagatatgagtgttatcgtc

SEQ ID NO: 10766 - protein, 261 aa, Panicum virgatum
  misc_feature: Ceres CLONE 1725412
  misc_feature (50)..(249): Pfam Name: Ribosomal_L3 Pfam Description: Ribosomal protein L3
MAAVGIAGGALAPLLPTQRGGRRCAVSFRRAASVAVRASYEAGVGVMATKVGMMTYFDPATGKPVPVTVVGFREGGNVVTQVKTAATDGYDAVQVGYHGVREDKLTRPELGHLGKAGAPPLRHLQEFRLTAVDAFEPGQELDFAELFKEGDLVDVTGNSIGKGFQGGIKRHNFKRGLMTHGSKSHRQLGSIGAGTTPGRVYKGKKMPGRMGGTKTKIRKLKIVKIDNDLRVLMIKGAVPGKPGNLLRIAPAKIVGKNIPKN

SEQ ID NO: 10767 - DNA, 1125 bp, Panicum virgatum
  misc_feature: Ceres CLONE 1725422
  misc_feature: Encodes the peptide sequence at SEQ ID NO. 10768
cccatcagccatcccctcctgctgcaatcttcctctgaattgtgggtctgcggcaatggcggcgctcgctccatcgaagatcctcggcacccagctcaactttgccggctcctcccggtacgccaccactacaccgaccactggggcgcagaagatcgtctccctcttcaaaaagaagcctgcccagaagcccaagcccgccgccgtatcatcctcatccccggacatcagcgatgagctcgccaagtggtatggccctgacaggaggatcttcctgccggatggtctcttggaccgctcggaggtgccggagtacctcacgggagaggtcgctggagactatggctacgatccttttggtctgggcaagaagccaggggacttcgccaagtaccaggcctacgagctgatccatgccaggtgggccatgctcggcgccgccggtgccatcatcccggaggcgtgcaacaagttcggcgccaactgcggccctgaggccgtctggttcaagaccggcgccctgctcctggacggcaacaccctcagctacttcggcaacagcatccccatcaacctggtggtggccgtcatcgccgaggtcgtcctcgtcggcggcgccgagtactaccggatcatcaacggcctggacctggaggacaagctgcaccccggcggcccgttcgaccccttgggcctggccagcgaccccgaccaggctgccatcctcaaggtgaaggagatcaagaacggccggctggccatgttctccatgctcgccttcttcatccaggcgtacgtcaccggcgaaggccccgtcgagaacctcgccaagcacctcagcgaccccttcggcaacaacctcctcaccgtcatctccggcgccgccgagaggacgcccagcctgtgagcaatgctggctgctgctgcgtttgattttaccgggaaacagagtgtgcgtgagggtctgaactctgaagaatgtgccattcgtgtaaattatcaagatggggaagaaaccatttcgttctgatctctgatgtgactgctgcttgaactttcttgtgcctgctgggatatgctgcttaagtaattgatcgctcttaaggttccaaattggaatcttgc

SEQ ID NO: 10768 - protein, 283 aa, Panicum virgatum
  misc_feature: Ceres CLONE 1725422
  misc_feature (83)..(247): Pfam Name: Chloroa_b-bind Pfam Description: Chlorophyll A-B binding protein
MAALAPSKILGTQLNFAGSSRYATTTPTTGAQKIVSLFKKKPAQKPKPAAVSSSSPDISDELAKWYGPDRRIFLPDGLLDRSEVPEYLTGEVAGDYGYDPFGLGKKPGDFAKYQAYELIHARWAMLGAAGAIIPEACNKFGANCGPEAVWFKTGALLLDGNTLSYFGNSIPINLVVAVIAEVVLVGGAEYYRIINGLDLEDKLHPGGPFDPLGLASDPDQAAILKVKEIKNGRLAMFSMLAFFIQAYVTGEGPVENLAKHLSDPFGNNLLTVISGAAERTPSL

SEQ ID NO: 10769 - DNA, 1370 bp, Panicum virgatum
  misc_feature: Ceres CLONE 1725426
  misc_feature: Encodes the peptide sequence at SEQ ID NO. 10770
aaagccccaggctccctcccccaactccctctccttgctcgcttgctcgctctccatggacgctccaggaagctgcacgcctcctgcacgctaagtgcgtgatcagagaagctgctgccaagctttaccagttgaccctgaaccaaacaggagctacctgctagctccgggtaccagcagcagctagcgagcgagcaggtgtactactagctagctagctaagtgagctagctcgttagctgcgcgtagcttgattggttggctagcggtgtagcggtggtagtagcgttaggtagctggtaacttttttgggcatggagagcacaccggtgctggtgaggcacgccggcggcgtggcggcgctgcggcagctgccgccggggttccggttccgccccacggacgaggagctggtggtgcagtacctccgccgcaaggccttgggcgtgccgctccccgccgccgtcatccccgtcgtccgcgacctctacagcctcgacccctgggacatccctgccgccgctgatgcgagcgagggggagaagtacttcttcgcggtccggccggcgggcgtcggcggcggatgcagcggcaagctgggcggcgctagggcggcgaccgcgagcgggcggtggaagccggcggggaaggagaagccggtggtcctgccccggccctgcggcggcgggagcctcctcgtcggcgtgaagcgggcgatgacgttcgcgccccggcggaagaagaaggcgtcgtcggctgccctggccgccggctgggtcatgcacgagtaccgcctcgccgcgccgctgcacaagaacttcacggccaggacggtcttctcgtggcagagccggggctgcagcctggcgcaggccgaaggggagtgggtggtgtgccgggtcttccagaggagcagcaacagcaacaggccgagacggcgagcgacgcctgccggcggccacgccgccgccgcgtcgccgtcgtcgtcgtcgaccgccagctgcgtcacggacggctcggaccaggaagaggtcagcagctagctacctcgcggccggccggccacaagaaccacaaggtctgcacagctgctgctagctgtacgtgcctctcaaagagaggcttggatcggagctgagttagcctatagccttaggcttaaaccaggaaacgaaaacgacctgccgcccttgcttaattttcttgattgctccaacaatttcttgtcactttagttccttctctgtatctctctctttccctccctttgtataatgtaatgcagtgtaatctagtgagaggaagcaggcagtgccggatcattaacaaacaagttaaacaggttcaggaagcttctagttgaggttttc

SEQ ID NO: 10770 - protein, 242 aa, Panicum virgatum
  misc_feature: Ceres CLONE 1725426
  misc_feature (20)..(162): Pfam Name: NAM Pfam Description: No apical meristem (NAM) protein
MESTPVLVRHAGGVAALRQLPPGFRFRPTDEELVVQYLRRKALGVPLPAAVIPVVRDLYSLDPWDIPAAADASEGEKYFFAVRPAGVGGGCSGKLGGARAATASGRWKPAGKEKPVVLPRPCGGGSLLVGVKRAMTFAPRRKKKASSAALAAGWVMHEYRLAAPLHKNFTARTVFSWQSRGCSLAQAEGEWVVCRVFQRSSNSNRPRRRATPAGGHAAAASPSSSSTASCVTDGSDQEEVSS

SEQ ID NO: 10771 - DNA, 1289 bp, Panicum virgatum
  misc_feature: Ceres CLONE 1725432
  misc_feature: Encodes the peptide sequence at SEQ ID NO. 10772
actcgtcgcttcgctcccgaccgcatcgcgatcagtcacctcctcctcctctccgcctcgccggagatcagacgaggcgccgccgggagatggacgcctcctaccgccgcgccggctccggaggcggctccgcgccgcgctccgtcgaggacatcttcaaggactaccgcgcccgccgctccgccatcctccgcgccctcacccacgacgtcgaggagttctacgcgcagtgcgatccagagaaggagaacctgtgcctgtacgggtacgcgaacgaggcgtgggaggtggcgctgccggcggaggaggtgcctacggagctgccggagccggcgctcgggatcaatttcgcgcgcgacgggatgaaccgccgcgactggcttgcgctcgtcgccgtccactccgactcgtggcttgtctccgtcgcattctactacgccgcgcggctcaaccgcaacgaacggaagcgtttatttagcatgatgaacgagctgccaactgtttttgaagttgtctctggtggcgggaaacagtctagggagagggacagatccgcttccgacaacagtggtagaaataaactgtcagtgaagcatacaagcgagccacgcatagaaaataacgccagtgagcccgacgagggctacgatgaagacgacggtgaccacagccaaacattgtgtgggacttgcggtgggatatacagcgcggacgagttctggatcgggtgcgacatttgcgagaagtggtaccacggcaagtgcgtgaagatcaccccagcaaaggcagagagcataaagcagtacaagtgcccgagctgctcaaagagacctaggccactgtagcaccgtccttcgcgctggaggacgggcttggcggtggcgccccccaccatagatggaaacctgcacaagcaggaggtccggagtttactccttgtgcaaaggtcaatgcaggaggtccggagtttactccttgtgcaaaggtcaatgcaggaggtccggagtttactacttgtgcaaggtcaataccgtcttgcgatgtttactgtatcttttcgatttagcttatatatgactgacgatggcgatgctgatgtgaggtacgatcacacatattgattatagcctttattgttgtttctccttgccctggagtgagttaacggtagtctgtatgttgccggaaaaggaaataggggcagtaaggaagcctttgtaatgttcctaaatgtgaaacgagcagcttatgcaacaataatccgagaggtttgtgttaatattttactc

SEQ ID NO: 10772 - protein, 251 aa, Panicum virgatum
  misc_feature: Ceres CLONE 1725432
  misc_feature (197)..(247): Pfam Name: PHD Pfam Description: PHD-finger
  misc_feature: SWISSPROT Homolog: EC 1.14.11.27 [Histone H3]-lysine-36 demethylase
  misc_feature: Functional homolog of the protein sequence given in SEQ ID NO 50175
  misc_feature: Useful for making plants with altered lignin content
  misc_feature: Useful for making plants with modulated flowering time
  misc_feature: The sequence is a functional homolog of SEQ ID NO 1645 in the 11/479,226 US patent application
  misc_feature: The sequence is a functional homolog of SEQ ID NO 782 in the 10/412,699 US patent application
  misc_feature: The sequence is a functional homolog of SEQ ID NO 816 in the 10/412,699 US patent application
  misc_feature: Functional homolog of the protein sequence given in SEQ ID NO 50174
  misc_feature: Useful for making plants with altered alkaloid content
  misc_feature: The sequence is a functional homolog of SEQ ID NO 1052 in the 10/225,066 US patent application
  misc_feature: The sequence is a functional homolog of SEQ ID NO 2552 in the 10/374,780 US patent application
  misc_feature: The sequence is a functional homolog of SEQ ID NO 1981 in the 11/479,226 US patent application
MDASYRRAGSGGGSAPRSVEDIFKDYRARRSAILRALTHDVEEFYAQCDPEKENLCLYGYANEAWEVALPAEEVPTELPEPALGINFARDGMNRRDWLALVAVHSDSWLVSVAFYYAARLNRNERKRLFSMMNELPTVFEVVSGGGKQSRERDRSASDNSGRNKLSVKHTSEPRIENNASEPDEGYDEDDGDHSQTLCGTCGGIYSADEFWIGCDICEKWYHGKCVKITPAKAESIKQYKCPSCSKRPRPL

SEQ ID NO: 10773 - DNA, 757 bp, Panicum virgatum
  misc_feature: Ceres CLONE 1725433
  misc_feature: Encodes the peptide sequence at SEQ ID NO. 10774
aggagtagtccttagtgtgagcccagccagccgcgcacagctccggcggccggccagatattccagggctccgttccgttccgttgcaggaacccagattgcgggcggtgacaggctctgttcttggccttcttctgttccggcggagtccgtccggggccgcctcgctcggctgctcccggccgcgccggcggcggataccctgattcgaagtgttctcgcagcgcggccgaggtgtccgggaatcgatctgaatcagcgccttctccgtgagggaggactgagttcggagaatggctgatatccagctaggttgccacactataaggtcccatggcaccaaagtggcaagattacatatgtatgattggatcatactcctctgcctggctgtccttgacggactgctaaacataattgagccttttcaccgctttgttggacgggatatgatgattgacttgcgctatcctctaaagggcaacacaattccattttgggctgttccactgattgcaattgtgctaccctggtttgtctttgctggaatttactttaaaatgaaaaatgtttatgatttacaccatggcatactagggattttatattcagtgcttataactgctgtgattaccgatgcaattaaggatggtgttggccgccctcgcccagacttcttttggcgctgtttccctgacggcatacctaattacgataatatcaccactgatgtcatttgccatggagaaaagagtgt

SEQ ID NO: 10774 - protein, 154 aa, Panicum virgatum
  misc_feature: Ceres CLONE 1725433
  misc_feature: SWISSPROT Homolog: EC 3.1.3.4 Phosphatidate phosphatase
MADIQLGCHTIRSHGTKVARLHMYDWIILLCLAVLDGLLNIIEPFHRFVGRDMMIDLRYPLKGNTIPFWAVPLIAIVLPWFVFAGIYFKMKNVYDLHHGILGILYSVLITAVITDAIKDGVGRPRPDFFWRCFPDGIPNYDNITTDVICHGEKS

SEQ ID NO: 10775 - DNA, 1206 bp, Panicum virgatum
  misc_feature: Ceres CLONE 1725438
  misc_feature: Encodes the peptide sequence at SEQ ID NO. 10776
cttatccccttccccttcccccctcctcccccactcgcgcggcgccaccatggcctcctccgtcgcggcggctctccgcgccctcgccgccagcacctccgcctccctcgcgaagcccagcgccaccccgtcccccttcctcgtcctcctcgccccgaccccgccccgccgcccgctcggcctccgctccgcccgccgcctgccgctcgccccgctcgccgcctccgactccttcgagtcctccgtcggcgtcgactacgcggagccggcccccgccgagtccgagcgggagggggaggaggaggaggaggaggggggcggggcgggggatgaggaggaggaggctgccgccgaggcgtccgcggacgaggaggaggtcggggagtacgtcgagccgcccgaggaggccaaggtctacgtcggcaacctgccctacgacgtcgacagcgagcgcctcgcgcagctcttcgagcaggctggtgtcgtcgaggtctcagaggtcatttacaacagagaaacagatcggagccgtggatttgggtttgtcactatgagtactgtcgaggaggctgagaaggctgtggagatgttccatcgctatgatgtcaatggaaggcttcttactgtaaataaagcagctcctagaggttctcgtgtggaaagacctcccagacaatttggcggtccttccttcaggatttatgtgggcaacctgccatggcaagtggatgactctagattggtgcagttgttcagcgagcatggtaaagtggttgatgccagagttgtctatgaccgagaatctgggcgttcgcggggatttggttttgtaactatggcaacacaggaggaattggatgatgctattgctgcccttgatggacagagtttggatggccgtgccctgcgggtgaatgttgcggaggagcgaccgcggcgaggtttctagtgaggatgtgtctgggtggacagcagacttgttccataggagcatcatagcgtggtctgatactggtttagaccctccattctcttttcttgtgttctgggctccctatcatcctgtcttattgtgaagaggaagtgttctctgctatttcattaactgttggttgtgttcatgagttcatgtattgtaggctactgttatggtgcacctagctcaatttgtcgttgcaattcaaaattttgtctgacatctgttcg

SEQ ID NO: 10776 - protein, 299 aa, Panicum virgatum
  misc_feature: Ceres CLONE 1725438
  misc_feature (217)..(288): Pfam Name: RRM_1 Pfam Description: RNA recognition motif. (a.k.a. RRM, RBD, or RNP domain)
  misc_feature (122)..(193): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MASSVAAALRALAASTSASLAKPSATPSPFLVLLAPTPPRRPLGLRSARRLPLAPLAASDSFESSVGVDYAEPAPAESEREGEEEEEEGGGAGDEEEEAAAEASADEEEVGEYVEPPEEAKVYVGNLPYDVDSERLAQLFEQAGVVEVSEVIYNRETDRSRGFGFVTMSTVEEAEKAVEMFHRYDVNGRLLTVNKAAPRGSRVERPPRQFGGPSFRIYVGNLPWQVDDSRLVQLFSEHGKVVDARVVYDRESGRSRGFGFVTMATQEELDDAIAALDGQSLDGRALRVNVAEERPRRGF

SEQ ID NO: 10777 - DNA, 1031 bp, Panicum virgatum
  misc_feature: Ceres CLONE 1725440
  misc_feature: Encodes the peptide sequence at SEQ ID NO. 10778
ctcgccgcctccccccccccctccccccgcgtcgccgtcgtctcccgttcggaacgctaagctccactccggcgaaatggccccgaagcgaggtggcaaggcgccggtgccggccaagaagaaaacagagaagataaccaacccgctcttcgagaagaggccgaagcagttcggtatcggcggtgcgcttccgcccaagaaggacctgcaccggttcgtcaagtggcccaaggtcgtgcgcatccagcgccagcgccgtatcctcaagcagcgcctcaaggtgccgccggcgctcaaccagtttacccgtaccctcgacaagaacctcgctaccaacctgtttaagatgcttctgaagtaccgccctgaggacaaggctgccaagaaggagagacttttgaagagggctcaggctgagaatgaagggaaaaccgttgaggctaagaaaccaattgtcgtgaagtatggccttaaccatgtgacctacctcattgagcagaacaaggcccagcttgttgtcatcgcccatgatgtggatccgattgagcttgttgtgtggcttccagccctgtgcaggaagatggaggtcccttactgcattgttaaaggaaaggctcgccttggatcgattgttcacaagaagaccgcatccgtgctgtgccttaccactgtcaagaacgaggacaagcttgagttcagcaagatcttggaggctattaaggcaaacttcaacgacaagtttgacgaggtcaggaagaagtggggaggtggcatcatgggctccaagtcgcaggccaagaccaaggccagggaaaagctgctcgccaaggaggccgcccagcggatgacctagattatcttattctgagtcccgtctgtagttcctgtgccgacccggaaaagctgatgagcattgtgcactcgtattgtggttttctgaatctagtttcacatgttttcattcgccagaccatgtctagaaactttgcaagacaagagtttacagtgtttatgagatgttttgagcctcg

SEQ ID NO: 10778 - protein, 258 aa, Panicum virgatum
  misc_feature: Ceres CLONE 1725440
  misc_feature (113)..(208): Pfam Name: Ribosomal_L7Ae Pfam Description: Ribosomal protein L7Ae/L30e/S12e/Gadd45 family
MAPKRGGKAPVPAKKKTEKITNPLFEKRPKQFGIGGALPPKKDLHRFVKWPKVVRIQRQRRILKQRLKVPPALNQFTRTLDKNLATNLFKMLLKYRPEDKAAKKERLLKRAQAENEGKTVEAKKPIVVKYGLNHVTYLIEQNKAQLVVIAHDVDPIELVVWLPALCRKMEVPYCIVKGKARLGSIVHKKTASVLCLTTVKNEDKLEFSKILEAIKANFNDKFDEVRKKWGGGIMGSKSQAKTKAREKLLAKEAAQRMT

SEQ ID NO: 10779 - DNA, 1236 bp, Panicum virgatum
  misc_feature: Ceres CLONE 1725444
  misc_feature: Encodes the peptide sequence at SEQ ID NO. 10780
acttcctccctgctctccccaccacctcttatcgcttccgcgctctaatggcctcacaccccgccgccacgcagtaaacgaagacgacgggccccactccctggcaccctccccccgcgccccttcccatgaggcagccgcacctctcgccgcagccctccccctccccctcccccgtcctctcctcccacttctcgccgccggcggcgctcggggcctcgccgtggcggcggcggcggctgcaccgggggcgggccttccagcctcctctctcctcgctgcgggatcccaacaaggccacgctacgcaaggcctcgcccaacgtccccttccgcctcggcggcggcgggagcggcaaccccaaggaccgccgccccgtcgccgataaggaggaggagtcggcggcggagggctctggcggcgctggggcgctcacagggacgctgctcgctggagcgctcttggttggggtcgtagggggctttggggcggccggctacgtgtacaaggaccagatcaacaccttcctcacgcagttctctgggttcattgatggttatggtcctgctggatatgctcttttcgtacttgtatatgcaggcttggaggttcttgcgattccagcaatacctctaaccatgtcagccggtctattatttggcagtgttactggtacaattattgtttcagtcagtggaacactagctgcagcagtcgccttccttattgctagatactttgccagagagcgaattctcaaactggttgaaggaaataagaagtttctagctattgataaggcaataggtgaaaatggatttaaagttgttactctgcttcgtttgagtcccctattgcctttctcccttgggaactacctatatggcttgacttcagtgaagttcttgccttatgtcttgggcagttggttgggaatgcttccaggatcatgggcttatgtcagtgctggtgcatttgggcgagctataattcaagatgaatcggagattggtttgcaaggaaatggccagctatagacactgggtgtagggttattatttacagccgttgctgctgcttatgtaacaaggcttgcaaaggatgctgtaaaggagatcgacgattagaatggtaggacactctaatagaaaggagggccctctggatagtatactagcacattgtacatcactggcacctttggtgcaatctaatctaatggaaaatcaattttct

SEQ ID NO: 10780 - protein, 302 aa, Panicum virgatum
  misc_feature: Ceres CLONE 1725444
  misc_feature (164)..(283): Pfam Name: SNARE_assoc Pfam Description: SNARE associated Golgi protein
MRQPHLSPQPSPSPSPVLSSHFSPPAALGASPWRRRRLHRGRAFQPPLSSLRDPNKATLRKASPNVPFRLGGGGSGNPKDRRPVADKEEESAAEGSGGAGALTGTLLAGALLVGVVGGFGAAGYVYKDQINTFLTQFSGFIDGYGPAGYALFVLVYAGLEVLAIPAIPLTMSAGLLFGSVTGTIIVSVSGTLAAAVAFLIARYFARERILKLVEGNKKFLAIDKAIGENGFKVVTLLRLSPLLPFSLGNYLYGLTSVKFLPYVLGSWLGMLPGSWAYVSAGAFGRAIIQDESEIGLQGNGQL
